United States Patent 11,931,406 (FLAVIVIRUS VACCINE) - sequence listing, part 60

SEQ ID NO: 21313 - RNA, 9879 nt, Artificial Sequence
  derived and/or modified CDS sequence (opt6) from DENV-1__FJ024483__SS-prME
aguguaaccauguuacuuauguugcuaccuacagcacuugcauuucauuuaaccacccgugguggggaaccacauaugauuguaaguaaacaagaaagagggaaaaguuuacuauuuaaaacuagcgcagggguaaauaugugcacgcuuauagcgauggaucucggugaacuuugugaagauacuaugacauauaaauguccacaaauaacagaagcagaaccagacgacguugauugcuggugcaacgcuacagauacauggguaacauauggcacguguucucaaacaggagaacacagaagagacaaaagaucagucgcauuagcgccucacguaggguuaggguuagagacaagaacggaaacauggaugucaucugagggcgccuggaaacaaauucaacgaguagaaacaugggcacuaagacauccuggauuuacugugauagcccuuuuucuagcacaugcgauuggcacaagcauaacacaaaaaggaauuauauucauuuuacugaugcuuguaacacccaguauggcuaugcgaugcguagggauaggcaauagagauuucguugaaggcuuaucgggugcuacuuggguagauguaguucuagaacacgggagcugugucacgacuauggccaaaaauaaaccaacucuugauauugaacuacugaagacagaaguuacaaaucccgcaauauuaagaaaguuaugcauagaagccaaaauuucaaacacaacaacggauucuagauguccaacccaaggggaggcaacgcuuguugaagaacaagacgcuaauuucguauguagaagaacuuuuguagauagaggaugggguaacggaugugggcuuuuugguaagggaucauuacuaaccugcgccaaauucaaaugcguaacaaaauuagaggggaagauaguccaguaugaaaaccugaaauauucuguuauaguaaccguacacacaggugaccagcaucaaguagguaacgagacaacagaacauggcacgauugcaacaauaacaccacaagcaccuacgagugaaauccaauuaaccgacuacggggcauuaacuuuagacugcucaccacgaaccgguuuagauuuuaacgaaaugguacuacuuacuaugaaagaaaaauccuggcugguucauaaacaaugguuuuuagaucucccacucccguggacaucaggcgccagcacaagucaagaaacguggaaucgacaagauuuguugguaacuuuuaaaacugcacacgcaaagaagcaagaggugguaguucuaggaucacaagaaggugcuaugcauacagcuuuaacaggcgcaaccgaaauccaaacaagcggcacuacaacuaucuuugcuggucacuugaaauguagacuuaagauggacaaauuaacauuaaaaggaacaucuuaugugauguguacaggaucauucaaacuagaaaaagaaguugcugaaacacagcauggaaccguucugguacagguuaaguaugaaggaacugaugcuccauguaaaauuccguucaguacacaagacgagaaagguguaacgcaaaacggaagacugauuacggcuaauccuauagucaccgauaaggaaaagccugugaacauagaaacugaaccgccuuucggcgagaguuacaucguuguuggggcgggagagaaagcguuaaaacucucgugguucaagaaaggaucuucaauugguaaaauguucgaagcgacagcuagaggugcacggagaauggcaauacuuggugauacagcaugggacuuuggaagcaucggaggcguauuuacaagcguuggaaaacucguccaucagguguuuggaacagcuuacggaguauuauucucuggcguuaguuggacaaugaagauagguauaggcauacucuuaacguggcucggacugaacucaagaucaacuagccugaguaugacgugcaucgcgguagggaugguaacauuguacuugggggucaugguacaagcugacagugguugcguaaucaauuggaaaggccgugaauuaaaaugugggagugggauauuugucacuaaugagguacacacuuggacugaacaguacaaauuccaagcugauaguccuaaaagauuaucagcagcaauaggcaaagcaugggaagaagggguauguggcauacgaagugcaacucgauuagaaaauauaauguggaaacaaauuagcaaugaauuaaaccauauucuauuagaaaaugacaugaaguuuacaguaguaguaggugacgcaaauggaauauuagcacaggguaagaaaaugauaagaccacaaccgauggaacacaaauacucuuggaagaguuggggaaaagcaaaaauaauuggagccgauauccaaaauacgacguuuauuauagacggcccagauacaccugaguguccagacaaccaacgggcauggaauauaugggagguugaggauuacggcuucggaauuuuuacgacuaacauauggcuaaaacuacgagacaguuauacacaaaugugcgaccaucgcuuaaugagugcggcaaucaaagauucaaaagcgguacaugcugacaugggauauuggauugaaagugagaaaaaugagaccuggaaacucgcccgugcauccuuuauugaagugaagacuuguacauggccuaagucucauacauuauggucuaacggaguccuagaaucagaaaugauaaucccaaagauauauggcggcccaauuucacaacauaauuacagaccaggcuauuauacacaaacagcuggaccauggcacuuagguaaacuagaacucgauuucgaucucugugaagguacuaccgucguugucgaugaacacugugguaaucgaggcccaagccucagaacgacgacgguuacagguaaaauaauccacgaaugguguuguagaucauguacacuaccaccuuuaagguuuagaggagaggacggaugcugguacggcauggaaauacguccagugaaagaaaaagaagaaaauuuaguaagaucaaugguuuccgcagguuccggggaaguggauucauuuucuuuagguaucuuaugcgcaucuauuaugauagaagaggucaugcgaucucgcuggagucgcaagaugcuaaugaccggaacucucgcaguauuucugcuuuugauaaugggccaauuaaccuggaaugaccuuauaagacucugcauaauggugggcgcaaaugccucugaucguaugggaaugggaacuaccuaccuagcacuuauggcaacauuuaaaaugcgcccaauguucgcuguaggacuuuuguuuagaaggcuaacuucacgagaaguguuacugcucacuauagguuuaaguuugguugcaucgguggagcuacccaauucgcuggaagaguuaggagauggguuggcaaugggaaucaugaugcucaagcuacuuacggaauuucaaccgcaccaauuauggacaacguuauuaucuuugacauuuauuaaaacuacucuaucacucgauuaugcuuggaaaacuaccgcaauggcguuaucaauuguuagccuauucccgcuaugcuuaucaacuacuagccaaaagacgacuuggcugcccguacuguuggggucauuuggguguaaaccauuaacgauguuuuugauaacugaaaauaagauuuggggcaggaaaaguuggccccuaaacgaaggaauaauggcaauaggaauugucucaauauuguuaucuagucuucucaaaaacgacguaccacuugccgguccauuaauagcaggaggaaugcuuaucgcgugcuacguaauuucgggaagcagugcagaucuuucguuagaaaaagccgcagaagugucaugggaacaggaagcagaacacagugguacaucacacaauauacucguagagguacaagacgacgguacaaugaagaucaaggacgaggaaagggacgauacguuaacuauauuacuaaaagcuacauuauuggcaguuucaggaguauacccgaugagcauaccggcaacucuauuuguaugguauuuuuggcaaaagaagaaacaacgaagcggaguccugugggacacgccaucaccaccugaaguggagagagcugucuuggacgacggaauuuaucggauucugcagagaggccuucugggaaggucgcaaguaggugugggaguuuuccaagauggaguguuucauacuauguggcacguuacacggggagcaguguuaauguaccaggguaaacgacucgaaccaagcugggccucugucaaaaaggaccuaaucagcuacgggggcggauggagauuucaagguaguuggaauacuggcgaagaaguucaaguuauugccguugaaccagguaaaaauccgaaaaauguccaaaccacgccagggacauucaaaacaccagaaggugaaguuggugcuauagcguuagauuucaagcccggaacaagcggcagcccaauuguaaauagagaggguaagauuguuggacuguaugggaaugguguaguaacaacuucaggaaccuauguaucagcuaucgcucaagcaaaggcuucccaggaaggacccuuaccugaaaucgaggaugaaguuuuuaaaaagaggaauuuaacaauuauggauuuacauccaggcucuggaaaaacccgaagguaccuaccagcuauagugcgagaggccaucaagcgaaaacugcguacgcuaauacucgccccuacacgugucguugcaagugaaauggcagaagcucuuaaaggaaugccuauaagguaucaaacaacugccgucaaaucagaacauacaggaagggaaauagucgauuugaugugccaugcgacuuucacaaugcgucuacuauccccuguccgaguucccaauuacaauaugauaauuauggaugaagcgcacuuuacagaucccgccuccauagccgcacgaggauauauaucuacgcgcguugguaugggcgaagcugcagcuauauuuaugaccgcaacaccuccggguucaguagaagcauuuccucaaucgaaugcaguaauacaggaugaagaacgagacauuccagaaagaagcuggaacucaggauaugauuggauaacagacuucccugguaaaacgguuugguucgugccaaguauaaaauccggcaaugauaucgcaaauugucugaggaaaaauggaaaaagaguaauucaacuaucucguaaaaccuuugacacagaauaccagaaaacuaagaauaaugacugggauuauguaguuacuacugauauaagugaaaugggagcaaacuuccgagcagaucgaguuauagacccucgccggugucugaaacccgucauccuuaaagauggucccgagaggguaauccucgcugguccgaugcccguaacuguugccucagcggcacaacgccgcgggcgcauaggucguaaucaaaacaaggaaggagaucaauacguguauaugggucaacccuuaaauaaugacgaggaucacgcacauuggacggaagcaaagaugcuguuagauaacauaaacacaccugaaggaauaauaccugcguuauucgaaccagaacgagaaaagucagccgcuauagauggggaauauagauuacgaggugaagcgcggaagacuuucguagaauugaugcguaggggagaccuaccaguuugguuaagcuacaaaguugcuucugaaggauuucaauauagcgaccgcagaugguguuucgacggcgaaaggaacaaccaggugcuugaagagaacauggauguagagauuuggacuaaagaaggagagaggaagaaacuaagaccacgauggcuagaugcaaggacuuacagcgauccgcuagcucuacgugaguuuaaggaauuugccgcaggccgaagaaguguuucaggugacuuaauucuggaaaucgguaagcuaccgcaacacuugacacugcgagcgcagaaugcacuagauaacuugguuauguuacacaacucggagcaaggggguaaagcguaucgucacgcaauggaagaacuucccgauacaauugaaacuuuaaugcuauuagccuuaauagcuguccuaacagggggagugacauuauuuuuccuaucuggaaaaggacucggcaagacuucaaucgguuuauuaugcguaacagcgucgucugcacuucuauggauggcaagcguggagccccauuggaucgcugcgagcauaauucuagaauuuuuccuuaugguauuacuuaucccugagccggaccgacaacguaccccucaagauaaucaauuggccuacgugguaaucggccuuuuauuuaugauucuuacugucgcagcaaacgaaaugggacuccuagaaacuaccaaaaaggaccuugguauugggcacguggcagcugaaaaucaucaacacgcgacaaugcuagauguugaucucagaccagcuucggcuuggacacuuuacgcuguggcgacaacaguaauaacaccuaugaugcgacauaccauagagaacacaaccgcaaacauaagucuuacagcaauagcaaaucaagcugcaauacuaaugggguuagauaaagguuggccaauaaguaaaauggacauagguguaccacuauuagcacuugguuguuacucacaaguaaacccauuaacauuaacggcggccguacugaugcuaguagcccauuaugcaaucauaggaccaggguugcaagcaaaagccacaagagaagcacagaaaagaacggcagcuggaauuaugaaaaacccuacaguagaugguauugucgcaauagaccuagauccagugguguacgaugcaaaauuugaaaagcaacuuggacagauuaugcuuuuaauauuauguacgagucaaauauuauuaaugaggacgacuugggcacucugcgaaucaaucacccuagcaaccggcccucuaaccacauuaugggagggaucgccaggcaaauuuuggaacaccacgauugcugucucgauggcgaacaucuucagagguucauauuuagcaggggcuggauuagccuuuaguuugaugaaaucucuaggaggcgguagaaggggcacuggugcccagggcgaaacacuaggagagaaauggaaaagacaacugaaucaacucucgaaaagcgaauuuaacacauauaaaagaucagguauaauggagguagauagaucagaagcuaaggaaggguuaaaacguggugaaacgacuaaacacgccgugucacguggaacggcgaaacuacgcugguuuguagagaggaaccuugucaaaccagaagguaaaguuauugaucuuggauguggucguggaggauggucauauuacugcgcgggucucaagaaggugacugaaguuaaagguuacacgaaaggagggccggggcacgaagaaccuauacccauggcuacuuauggauggaacuuaguaaaauugcacucaggcaaggacgucuucuuuaugccaccagaaaaaugugauacguugcucugugauauuggugagaguaguccaaauccaacaauagaagagggaaggacauuaagaguccuaaaaauggucgaaccaugguuacguggaaaucaguucugcaucaaaauacuuaauccuuacaugccuucaguaguagaaacuuuggaacaaaugcaaaggaaacacggagggaugcucguacggaacccgcugucucgcaauucaacccacgagauguauugggucaguugcgguacaggaaacauaguaucagcuguaaauaugacuagccguaugcuguuaaaccgcuuuaccauggcgcacagaaagccaacuuaugaacgcgacguagaucuaggagcgggcacacgacauguagcagucgaaccugaaguugcaaaccuggacauaauaggucaaaggauugaaaauaucaaaaaugaacauaaaagcacauggcacuacgaugaggauaauccauacaaaacuugggcauaccaugguucauaugagguuaaaccgagcggaagugcaucaagcauggucaacggcgucguucgccuauugacaaagccaugggacgugauaccaaugguaacucaaauugcaaugacugacaccacacccuucggacagcaaagaguauuuaaagagaagguagacacgagaaccccaagagccaagcgaggaaccacccaaauuauggaagugacagccaaaugguuauggggcuucuuaagucgaaacaaaaagccaaggaucuguacuagggaagaguuuacacgcaaaguaagaucgaaugcggccauaggagccgucuucguugaugaaaaucaguggaacuccgcgaaggaagcaguugaggaugagagauucugggacuuaguacaucgugaaagagaguuacauaaacaaggaaaaugugcgacaugugucuauaauaugauggggaaaagagagaagaaauuaggggaauuuggaaaagcuaaagguucaagagcaauaugguacauguggcuaggcgcuagauuucuugaauuugaagcguugggguuuaugaaugaagaucauugguuuuccagagaaaacaguuuuucaggaguagagggagagggacuucauaaauuggguuacauccuccgagacauaucuaagauuccgggaggcaauauguaugcugaugacacugcuggaugggacacaagaaucacugaggacgaucuccagaacgaagcgaaaauaacggacaucauggaaccugaacaugccuugcuugcuacuucuauauucaaacuaacauaccaaaacaaaguaguacgaguccaaaggcccgccaagaauggaacuguaauggacgugaucaguagaagagaucaacgagguuccggccaagucgguacauacggcuuaaauacguucacgaacauggagguccaauugauaagacagauggaaucagaaggaauuuuucucccgagugaacuugaaacuccaaauuuggcagaacgaguucucgacuggcuugagaagcacggagccgaaagauuaaaacggauggccauaucuggagaugacugcguagugaaaccaauugaugaucgauucgcgacugcuuuaacugcacuaaacgauauggggaagguacgaaaagacaucccacaaugggaaccaucaaaggguuggaaugacuggcaacaggucccauuuugcagccaccacuuccaccaauugaucaugaaggacggacgagaaaucguagugccguguagaaaucaagaugaacuuguaggacgcgcuagagugagucaaggcgccggcuggagcuugagggagacagcguguuuaggaaaaaguuaugcacagauguggcagcuaauguauuuccauagacgggauuugcggcuagccgcgaaugcgauaugcucagcaguuccaguagacugggugccuacgucuaggacuacuuggagcauucaugcgcaccaucaguggaugacaacagaagauauguuaagcguauggaauagaguguggauagaagaaaaucccuggauggaggauaaaacacauguuucaucgugggaagaagugccauaccucggcaaaagagaagaucaauggugcggcuccuuaaucggacuaacugcaagagcaaccugggccacuaauauucaggucgcaauaaaucaaguuagacguuugauagggaaugagaacuaccuugacuauaugacgucaaugaaacgcuuuaaaaacgaaucggauccagaaggagcccugugguaa

SEQ ID NO: 21314 - RNA, 9879 nt, Artificial Sequence
  derived and/or modified CDS sequence (opt6) from DENV-1__EU596504__SS-prME
aguguaacaauguuauuaauguuacuuccuaccgcacuagcauuucaucuaacaacaagagguggagaaccacacaugauagugucuaaacaagaacgggguaagagcuugcuuuucaaaacauccgcaggcgucaauaugugcacacucauagcaauggauuuaggagaacuuugugaagauaccaugacauacaaauguccucaaaucacagaagccgaaccagacgauguagacugcuggugcaacgcaacagauacauggguaacuuacggaacuuguagucaaaccggugagcauagacgggauaaaaggaguguggccuuagcaccacacgucggccuagggcuagaaacaaggacagaaacauggaugagcagugaaggagcuuggaaacagauucaaagaguagaaacgugggcacuacgccacccagguuuuacugucauugcauuguuuuuagcgcacgcuauagguacaucuauaacacaaaaaggaauaaucuuuauccuacucaugcuggugacuccaaguauggcaaugcgaugcguaggaauagggaaucgugauuuuguagaaggauuaagcggugcaacauggguagacguaguacuggaacacgggucaugcgucaccacaauggcuaaaaacaaaccaacucuggacauagaacuccuaaaaaccgaaguaacaaauccagcaauccuacgcaaacuauguauugaagccaaaauaucaaauacaacuacagauucaagguguccuacccaaggcgaagccacccuuguugaggaacaagacgcaaacuuuguaugccgaagaacauuugucgaucguggauggggaaacggauguggacuuuucgguaaaggaucgcuauuaacgugcgcaaaauuuaaaugcguaacaaaauuagaaggaaaaauaguacaauaugaaaacuuaaaauacucgguuauaguuacaguacauacaggggaucagcaucaaguuggcaacgaaacuacugagcaugguacaauagcaacaauuacaccgcaggcccccaccagcgaaauacaacugacggauuacggugcccugacccuagauugcagcccacguacugggcuagauuuuaacgaaaugguucuccuaacgaugaaagagaaaucaugguuagugcauaaacaaugguuuuuagauuuaccuuugccuuggacauccggagcuaguacaucgcaagagacauggaaucgacaagaccuucuuguaacauuuaaaaccgcacaugcuaagaaacaagaaguagucguacuugguagucaagaaggagccaugcauaccgcuuuaacuggugcaacugagauacagaccucagguacaacuacaaucuucgcaggucaucuaaaaugccgcuugaaaauggacaaauuaacacuuaaagguacgaguuacguaaugugcacagggucauucaaacuagaaaaggaaguugcagagacacagcaugguacgguccuggugcaagucaaauacgaaggcacggacgcuccuugcaaaauacccuuuucgacccaagaugaaaaaggaguaacccagaacggcagacucauuacggcaaauccaauugucacagauaaagagaagccaguaaauauagaaacagagccaccuuuuggagagucauauauaguaguuggagcaggggagaaagcguugaaauuguccugguucaagaaagguucauccauaggcaagauguuugaggcuacugcaagaggggcuagacgaauggcaauuuuaggagauacagcgugggauuucgggagcauaggaggggucuuuacaucaguaggcaaauugguacaccaaguuuuugggacugcauauggaguucuauuuaguggcgucuccuggacaaugaagauuggcauaggaauccuacuaacauggcucggauuaaacucacgaagcaccucccuauccaugacaugcuuugcuguugguauggucacauuguaucuaggaguuaugguacaagccgacucuggauguguaauaaauuggaaaggaagagaacuaaaaugugguaguggaauauucguaacuaaugagguacauacauggacugagcaauauaaauuccaagcagauucuccaaaacgccucucagcagcuauaggaaaggcuugggaagaaggcguauguggaaucagaagugcuacuagacuagaaaacauaauguggaagcagauaaguaaugagcuaaaucauauacugcucgagaacgauaugaaauuuacuguaguuguuggagaugcaaacgggauacuugcucaagguaagaaaaugauaagaccgcagcccauggaacauaaauauaguuggaaaucguggggcaaggcaaagauaauuggagcggauauucaaaacacgacguuuaucauagauggaccugacacaccggaguguccggacaaucaacgagccuggaauauaugggagguugaagacuacggauucggaauauucaccacaaauaucugguuaaaacuaagggacucauauacucaaaugugugaccacagauuaaugagcgcggcgaucaaagauucaaaagccgugcaugcagauaugggguauuggaucgaaucugagaagaaugaaaccuggaaacuugccagagcuucguuuaucgaaguaaaaacauguacauggccaaaaucccauacauuauggucuaaugguguauuagagucagaaaugauuaucccuaaaauauauggaggcccuauuagccaacauaauuauagacccggauauuuuacccaaacagcaggaccauggcaucuugguaaacuagagcuggacuucgaccugugugaaggaacuacagugguaguagacgaacauugcggaaauagaggaccgagucuuagaaccacaacggucacaggaaaaauaauacaugaaugguguugcagaucgugcacucuaccacccuugagauucagaggugaagaugguugcugguacggaauggaaauacguccggucaaggaaaaagaagagaaccuugugcggucaaugguguccgcaggaucuggggaaguugauaguuucagccuuggaauacugugugcuucgauaaugauugaagaagugaugagaucgagauggagcaggaaaaugcucaugacgggcacccuugcgguguuccuucuacuaauaaugggacaauuaacuuggaaugauuuaauucgacuauguauaaugguuggcgcuaaugcgagugaccgaaugggaauggguaccacuuacuuagcacuaauggccacauucaaaaugcguccuauguuugcuguuggacuauuauuucgaagacuaacaagccgagaaguccuucuguuaacaaucggccugucucucguagcaucaguggaacuacccaacucauuagaagaacuuggugacgguuuagcaaugggaaucaugauguuaaaauuauuaacugaguuccagccacaucaacuauggaccacucuacuaucauuaaccuuuauaaagacgacguuaaguuuagauuacgcguggaaaacuaccgcuauggcccuguccauuguaucacucuuuccucuaugucucucaaccacaucucagaagacuacuuggcugcccguacuuuuagguucauuuggcuguaaacccuugacaauguuccuaaucacagaaaacaaaauuugggguaggaaauccuggccccuaaaugaaggcauaauggcuauugguauaguaaguauacuucucagcagucuucugaagaaugauguaccgcuagcagggccacuaauagccggaggaauguugauagcauguuauguaaucucaggaaguagugccgaccuuucucuggaaaaagcagcagaaguaagcugggaacaagaggcggaacauucagguaccagucauaauauucugguagagguacaagaugacggaacuaugaaaauuaaagaugaggagcgagaugauacuuuaacaauacuuuugaaagccaccuuacuagcuguaagcggcguauauccaaugucgauuccggcaaccuuguuuguaugguauuucuggcagaagaagaaacagcggucagggguacuaugggacacgccgagcccaccagaagucgaaagagccguccuagacgaugguaucuaucgaauacuacaacguggucuccucgguaggagccaaguaggcgucggcguguuccaagacggaguauuucauacaauguggcauguaacuagaggcgcagucuuaauguaucaaggcaaaagauuagaaccaucgugggcaagugucaagaaagauuugauuuccuacggggguggguggcgcuuucaaggcucuuggaacaccggagaagaaguacagguuauagcgguugagccgggaaagaauccgaaaaacgugcagaccacaccuggaaccuuuaagacaccagaaggugaaguuggcgcuauugcuuuagauuuuaaacccggaacgucgggcucuccuauaguaaaucgagaagggaaaauaguaggguuauacggcaacggagucguuacaacaucugguacauacgucagcgccauagcgcaagcaaaagccagccaagagggaccauuaccagaaauagaagaugaaguuuucaagaaaagaaaccuaacgauaauggauuuacaucccgguuccggaaaaacacgccgauauuugccugcuauuguccgagaagccaucaaacgaaaacuucgaacacuaauucucgcaccgacgcgagucguugcaucagagauggcagaagcauugaaagguaugccgauaagauaucaaaccacugccguaaaaucggaacauacaggcagagagauugucgaccuaaugugccaugcuacguuuacaaugagacuccuaaguccaguccguguacccaauuauaauaugaucauaauggacgaggcacacuuuacggacccggcgaguauagcugcccgaggauacauuaguacgagagucggaaugggugaagcggccgcaauuuuuaugacggcaacaccacccggaaguguagaagcauuuccucaaucuaaugcuguaauucaagacgaagagagggacauaccugaacgaaguuggaacucuggcuacgacuggauuacagauuucccuggcaaaacuguaugguuuguccccucaauuaaaucugggaaugauauugcaaacuguuugcguaaaaauggcaaaagggugauucaauuaucgagaaaaacguuugauacagaguaccagaaaaccaaaaauaacgacugggacuauguugucacaacagauaucucagagaugggagcgaacuuuagagcagacagagugauagacccacgacggugucuuaagccagugauuuuaaaagacgggccugaaagaguuauuuuggcuggccccaugccggucacuguagcuucagcagcacagagaagggguaggaucggaaggaaucaaaauaaggaaggugaucaauaugucuacauggggcaaccuuuaaacaacgacgaagaccaugcucauuggacugaagcaaaaauguuauuagauaauauuaauacaccagaaggaaucauaccugcucuuuuugaacccgaaagagaaaaaucagccgcuaucgacggcgaguaccgauugagaggugaagcgcggaagacuuuuguagaacuaaugagacgcggugaccuaccuguguggcucucauauaaaguggcaucagagggauuccaauauagugaccgaagaugguguuucgauggugaaagaaauaaccaaguucuagaagagaacauggacguugaaauauggacaaaggaaggagaaaggaagaaauuaagaccacgaugguuagaugcgagaaccuacucggauccucuggcuuuaagggaauuuaaagaauuugcagccggcagaagaagcguaucuggagaucugauuuuagaaaucggcaaauuaccacagcaucuuacacuaagggcacaaaacgcgcuagauaacuuagucaugcuucauaacucggaacaaggaggcaaagcauauagacacgcuauggaagaguuaccugauaccauagagacgcucaugcucuuagcgcuaauugcuguauuaaccggagguguaacgcucuuuuuccucagcgggaagggucucggaaaaacuucaauaggguuacuaugcguaacugcuucaucagcuuuauuauggauggcgucaguagaaccacacuggauugccgcuucaaucaucuuggaguucuucuuaauggugcuccuuaucccagaacccgauaggcagcgaacgccccaagauaaccaacucgcuuauguaguaauuggcuuacuauuuaugauacugacuguugcagcaaaugaaaugggccuacuagaaacaacuaagaaagaucucgggauaggacauguggcagccgaaaaucaccaacacgccaccaugcuugauguagaccucagaccggcaucugcguggacacuauaugccguggccacgacuguuauaaccccaaugaugcgucacacaaucgaaaacacaacagcaaauauaucacuaacugcaauugcuaaccaagcagccauacuaauggguuuagauaaagguuggccgauuagcaaaauggauauaggcguaccucugcuugcacucgguuguuacucccaaguuaauccuuuaacauuaacagcugcaguguugauguuaguggcgcauuacgcgauaauagguccagggcuucaagcgaaagccacccgagaagcacaaaagcgcaccgcggcaggaauuaugaaaaacccuacuguagacgggauugucgccaucgacuuagauccuguuguauacgaugccaaguuugaaaaacaacuaggccaaauaauguugcugauacuaugcacuucacagauccuguugaugagaacuacuugggcguugugcgaaaguaucacuuuggcuacaggcccauuaacgacauugugggaaggaaguccaggcaaauuuuggaauacaacaauugcaguuucuauggcgaacauauuuagaggaucuuauuuagcaggcgcaggucuagccuucucauuaaugaaaucguugggagguggucgaagggggacgggagcgcaaggggaaacacuaggcgaaaaauggaaacgccagcuaaaccaacucuccaaaucugaguucaauacauauaaaagaagugguauaauggaggucgacagauccgaagcuaaagaagggcuuaaacgcggcgaaacaacuaaacaugcuguaucuaggggaacugcaaaguugaggugguuuguagagagaaacuuagucaaaccugaagguaaaguuaucgauuuggguugcgggcguggcggcuggucuuauuauugcgcuggacucaagaaggugacugagguaaaagguuauacaaaaggaggacccggacaugaggaaccuauuccuauggccaccuauggauggaaccuggugaagcuguauuccgguaaagauguauucuucaugccuccagaaaagugugauacacuauugugcgauauuggcgagagcagcccuaauccaacuauagaagaaggucggacucuaaggauuuuaaaaaugguagaaccaugguuacgugguaaucaauuuugcauuaaaauacuaaauccuuauaugccuucuguuguagagacacuggaacaaaugcaacguaagcacgggggcauguuaguaagaaacccccuuagccgcaauucuacucaugaaauguacuggguaucaugcggaacugggaacauagugucugccguuaauaugacguccagaauguugcuaaaucgauuuacgauggcacaccgaaaaccaacauaugagagagauguggaucuuggggcagggacaagacauguugcaguagagccagaaguugccaacuuagauauaauaggucagagaauugaaaauaucaaaaacgaacauaaaaguaccuggcauuacgacgaagauaauccguauaaaacaugggccuaccauggaaguuaugaaguaaaaccuucagguucagcgagcuccauggugaauggcguuguacgauuacuaaccaaaccuugggauguaauaccuauggugacacaaaucgcaaugacugauacuacacccuuuggacaacaaaggguuuuuaaagaaaaaguugacacacgcaccccaagagccaaaagagguacgacccagauuauggaggugacagcuaaaugguuauggggauuucuguccaggaacaagaagccacguauauguacuagagaagaauuuaccagaaaagugcgaaguaacgcagcuauaggugcaguuuuuguugacgagaaucaauggaauagugcaaaagaggcagucgaggacgaaagauucugggaccuaguacauagagaacgagaauuacauaagcaagggaaaugugcuacaugcguuuauaacaugaugggaaagagggagaagaaauuaggugaauuugguaaagcgaagggaucaagagcuauaugguacauguggcucggagcucgauuuuuagaguucgaggcuuuaggauuuaugaacgaggaccauugguuuagccgagaaaauaguuuaucaggaguagaaggagaaggauugcauaaauugggauauaucuugcgagacauuaguaaaaucccgggcgguaacauguacgcugacgauacggcuggaugggacacacguauaacagaagaugacuugcagaaugaagcaaaaauuaccgacauuauggaaccggaacaugcauuacucgccacaucgauauucaaguugacauaucagaacaaagugguucgcguacaaagaccagccaaaaaugguacgguaauggacguaauaagucguagagaucaaaggggcuccggacaagucggcacuuauggccuaaauacauuuacuaauauggaaguccagcuuauucgccaaauggaaucagaagguauauuccuaccaucagaacuugaaacgccaaauuuagccgaacgagucuuggacugguuagagaaacacggcgcugaacgacucaaaaggauggccaucucaggggacgacuguguaguuaagccaauagaugacagauucgcaaccgcacugacugcauuaaaugacauggguaaaguacgaaaggacauaccucaaugggaaccuaguaaagguuggaacgauuggcagcagguuccuuuuugcucacaccauuuccaucaacuaauaaugaaagacgggagggaaauuguuguuccuuguagaaaucaggaugaguugguagguagagcaaggguaagucaaggggcuggguggucucucagagagaccgcaugccucggaaaaucuuaugcacaaauguggcaauuaauguauuuccauagacgagacuugcgauuagcugccaaugcuauuugcucggcaguacccguggauuggguaccuaccucccguacaacuuggucaauacaugcacaucaucaguggaugaccaccgaggacauguuaucagucuggaaucguguauggauugaggagaauccauggauggaagacaaaacgcauguaagcucaugggaagaaguaccauaucuagggaagcgggaagaccaaugguguggaucgcuaauaggauuaacggcacgagcaacaugggcuacaaauauucaaguagcaauuaaccaagugcgacgcuugauagggaaugaaaauuacuuagauuauaugaccucaaugaagagguucaaaaaugaaucagauccagaaggugcauuaugguga

SEQ ID NO: 21315 - RNA, 9879 nt, Artificial Sequence
  derived and/or modified CDS sequence (opt6) from DENV-1__FJ024481__SS-prME
ucagucaccauguuauuaauguuacuuccaacggcacucgcauuucaucugacuacuagagguggugaaccacauaugauaguuagcaaacaagaacgggggaaaucacuacuauuuaaaacaucagcuggugugaauauguguacuuuaauagcaauggacuuaggggaauuaugugaagauacuaugacuuauaaauguccucaaauuacagaagcugaacccgaugacguggauuguugguguaacgcuacagauacauggguaacuuauggaacaugcucgcaaacuggugaacaucgaagagacaaacgaagugucgcauuagcuccgcacguagggcuaggccuugaaacacgaacugaaaccuggaugucgagugagggggcauggaaacaaauacaaagaguugaaaccugggcuuuaagacacccuggcuuuacaguaauugcucucuuuuuggcacacgcuauugggacaucuauaacgcaaaaaggaauaauauuuauccuacucauguuaguaacuccuucuauggcuaugcggugcgucggaauaggaaaucgcgauuuugucgaagguuuguccggggcuacguggguagauguaguuuuagaacauggaaguugcguaacuacuauggcuaaaaauaaaccaacgcuggacauugagcuacuaaaaacagaagucacuaacccugcaauucuuagaaaacucuguaucgaagcaaaaauuucuaauacaacuacugauucuagaugcccgacacagggcgaagcaacccugguagaggagcaagacgcaaauuuugucugucgacggacauuuguagaucgaggaugggguaaugggugugguuuguuugguaaagguucacuacuaacaugugcaaaauuuaaauguguaacuaaauuagaaggcaaaauugugcaauaugagaaucuuaaguauucgguuauaguaacaguccacaccggagaucaacaccaaguuggaaaugaaacaaccgaacauggaacaaucgcaacaauuacaccucaagcuccuaccuccgaaauacaguuaacggacuauggcgcauuaacacuagauuguuccccacgcacuggguuagacuuuaacgagaugguguuacucacaaugaaagaaaaaucuugguuagugcauaaacaaugguuucuggauuuacccuuaccauggaccucaggugcaucgacgagucaagagaccuggaaucggcaagaccuccuaguaacuuucaagacagcgcacgccaagaaacaagagguuguaguacuaggaucacaagaaggcgcaaugcauacagcacucacuggugcaacggagauucagacuucggggacaacgaccauauuugcuggucaucugaaaugcagauuaaaaauggauaaacuaacacuaaaagguacaaguuaugucaugugcacagguagcuuuaaacuugaaaaagagguagcagagacacaacacggcacgguuuuaguccaaguaaaauaugaagggacugaugcaccaugcaaaauaccauuuuccacacaggaugaaaaaggagucacgcaaaauggacgguuaauaacggccaacccgaucguuaccgauaaagaaaaaccaguaaacauagaaacagagccuccauuuggagaaucuuauaucgugguuggugcuggcgaaaaagcauuaaaguuaucaugguuuaagaaggggucauccauagguaaaauguucgaagcaacagcucgcggggcaaggcguauggcaauucugggggacacagcgugggauuuuggaaguauuggugggguauucaccaguguugggaaacugguacaccaggucuucggcacugcuuauggcguauuguuuucagguguuagcuggacuaugaaaauaggaauuggaauacuauuaacguggcucggacuuaauagucgaucaacuucuuuaagcaugacauguauagcuguggguauggucacacuauacuuggguguuaugguucaagcggacucaggcuguguuauaaacuggaaagggagagaacuuaaaugcggcagugguauauucguaacaaaugagguacauacauggaccgaacaauauaaguuccaagcagacucgcccaaaagauuaagugcagcgaucggcaaagccugggaggaaggagucugcggaauaaggucggcgacucgacuagaaaacaucauguggaagcaaauuuccaaugagcuuaaccauauucuacucgagaaugauaugaaguucacuguuguaguuggagacgccaauggaauacucgcgcaagguaaaaagaugauucgaccccaaccaauggaacacaaauauucguggaaaaguuggggaaaagcgaagaucauaggagcugacauucaaaacacgacauucauaaucgaugggcccgauacacccgaaugccccgauaaucagcgagcauggaacauaugggaaguagaagacuauggguuugguauuuucacaacaaacauauggcugaaacuuagggauucuuauacacaaaugugugaccaccguuuaaugucggccgcgauaaaagauagcaaagccguacaugcugauaugggguacuggauagaauccgagaaaaaugaaacuuggaaacuugcaagagcuucauuuaucgaaguaaagacuuguacguggccgaagucacauacgcuguggucaaaugggguguuggaaucugaaaugauuauacccaaaauuuaugguggaccaaucagccaacauaauuauagaccgggcuauuuuacacagaccgcaggaccauggcaucuaggaaaguuagaauuagauuuugaucucugcgaggggaccacaguaguaguugacgaacacugcgggaaucgcggcccaaguuuacggacaaccaccguaacagguaaaauuauacacgaauggugcuguagaagcugcacucuucccccuuugagguuuagaggcgaagacgggugcugguacgggauggagauucgcccaguuaaagagaaagaagaaaaucuaguacguagcaugguaucugcuggcuccggugaaguagacucuuucucguugggaaucuugugcgcgucaauaaugauagaggaagucaugagaagucgauggagcagaaaaauguuaaugacagguacacuugcaguauuucuccuucucauaauggggcaauuaacuuggaaugacuuaauuagauuaugcauuauggucggcgccaaugcaucggaucgaaugggaaugggaacaacauaucucgcacuuauggccacauuuaagaugcguccgauguuugcuguagguuugcuauuucguagauuaacaaguagagaaguauuauuauugacaauugggcuuucacugguugcaucgguagaacuaccuaauucauuagaagaauuaggggauggucucgcuauggguauaaugaugcuuaaguugcuaacggaauuucaaccccaucaguuauggacuacauuauuaagucuaacauuuauuaaaacaacacuuaguuuggauuaugcauggaagacgacagcaauggcucuuagcauagugucguuauuuccacucugccucaguacgacuucacaaaagacuacguggcuaccuguccuauuaggcucuuucgggugcaaaccccuaaccauguuccuaauaacggaaaauaaaauauggggaaggaaaaguuggccauuaaacgaagggaucauggcaaucggaauugugucgauccuacuaucaucccuuuugaaaaacgauguuccguuagcaggaccgcugaucgcuggcggaaugcuaauugcaugcuacguuauaagcggguccagcgcagacuuaucguuagaaaaggccgccgaaguaagcugggaacaagaagcugagcauagcggaacgucacacaauauauuaguagaaguacaagaugauggaacgaugaagaucaaagacgaagaacgagaugacacacuaacgauacuucucaaagcaacgcuacuggcagugucugggguuuauccaaugucaaucccugcuacucuuuuugugugguacuuuuggcagaagaagaaacaaaggaguggaguauuaugggacacgcccuccccaccugaaguugagcgagcuguccuagacgauggcauauauaggauccugcaaagaggcuuguuaggaagaucucaaguaggaguaggaguauuccaagauggcgucuuucauacaauguggcaugucacgagaggggcagucuuaauguaccagggaaaaagauuagaacccaguugggcuucgguuaagaaggauuuaauaaguuauggagggggauggagguuucaaggaucauggaauacaggugaagaaguucaagugauugcuguggaaccagguaaaaaccccaaaaauguucaaacuacaccugguacauucaaaacuccagagggggaagugggugcaauugcucuagauuuuaagccuggcacuuccggcuccccaaucguaaacagggaagguaaaauuguuggucuuuacggaaauggagucguaacuaccucuggaacguauguaagcgccauagcgcaggcaaaagcgucccaggaaggaccgcugcccgaaauugaagaugagguuuuuaaaaagaggaacuuaacuauaauggacuugcaucccgguagcggaaaaacacgcagguaucuuccugcaauaguuagagaagcuaucaaacggaaauuacggacucuaauauuggcucccacgagagugguagcgucugagauggccgaagccuuaaaaggaaugccaauuagauaccaaaccaccgcaguuaaauccgagcacacaggaagagaaauuguggaccuuaugugccacgcaacuuuuacaaugagacuuuuaucuccaguaaggguaccaaauuauaauaugauuauuauggacgaagcgcauuuuacagaucccgcgagcauagcggcgagaggcuauauauccacccggguggguaugggugaagcugcugcuauuuuuaugacagcuacaccaccggguucuguagaagccuucccccaaaguaacgcuguaauacaagaugaggaacgagauauaccagagagaucuuggaacucagguuacgauuggauaacggacuuuccaggaaaaacggucugguuuguaccaagcauuaagagcgggaacgacauugcuaauugucuuaggaaaaaugguaagagagugauucaguuaucuagaaaaacuuuugacacagaauaccagaaaacuaaaaacaacgacugggauuacguggugacaaccgauauaucugagaugggugcaaauuuucgagcugaccguguaauagacccaagaaggugucuuaaaccaguaauuuuaaaagacggacccgagagggugauccuagcaggacccaugccagugacaguugccagugcagcgcaacggcgaggaagaauagguagaaaucaaaauaaagaaggagaccaauacguuuauauggggcaaccucuuaauaacgaugaagaccaugcucauuggacagaagcuaaaaugcucuuagauaauauaaauacgccagaagguauuauuccagcucuguucgaaccagaacgcgaaaagucagcagcaaucgauggugaguaucgacuacgcggcgaggcuaggaagacauuuguagaacugaugagaaggggugaccuaccgguauggcucagcuacaagguagcauccgaaggauuucaguacucagauaggcguugguguuucgacggagagcgcaacaaucaaguucucgaagaaaauauggauguugagaucuggacaaaagagggagagaggaagaaacuuagaccccgguggcucgacgcucgaacauauucugauccccucgcuuuacgagaauuuaaagaauuugcagcaggaagaagaucuguuagcggagauuuaaucuuagaaauaggaaaauuaccacaacauuuaacuuuaagggcgcagaaugcauuggacaauuuggugaugcuacauaauagugaacagggcgguaaggcguacagacaugcaauggaagaacugccggauacaauagagacacugaugcuuuuagccuugauugccguucuaacaggaggaguaacucucuucuuuuuauccggaaaaggucuuggcaaaacgucuauaggauuauuaugcgugaccgcgucuagugcacuacuuuggauggcaagcguggagccccacuggaucgcugccagcauaauacuagaguucuuccuaaugguguuacuaaucccagaacccgacaggcaaagaacuccgcaagauaaccaacuggcauaugucguuaucggccuacucuucaugauauuaacagucgcugcaaacgaaaugggccuucuagaaacaacuaagaaagacuugggcauaggucacguagcggccgaaaaucaucaacaugcuacaauguuagacguagauuuacguccugcuucugcauggacucuuuaugccguugcuacaacaguuauaacccccaugaugcgccacacaauugaaaauaccacggcaaauaucaguuuaacagccauugcgaaccaagccgcaauacuaaugggacuagauaaaggcuggccaauuuccaaaauggauauaggugugccuuuacuagcuuuaggauguuauucgcaagucaacccucucacgcuuacagcugcuguauuaaugcugguugcccacuaugcuauaauuggcccuggauuacaagcgaaagcgacaagggaagcacagaaaagaaccgcggcagggauaaugaaaaauccgacaguggacgguaucgucgcuauagacuuagaucccguaguguacgacgcuaaauucgaaaaacaauuaggccagauuaugcuauuaauauuaugcacgucacaaauauuauugaugcguacaaccugggcgcuuugcgaaucuauuaccuuggcaacgggcccguuaaccacucugugggaggggucgccagguaaauuuuggaauacuacaauagcaguaucuauggcuaauauauuuagggguaguuauuuggcaggagcaggccuugcauuuucacuaaugaaaucauuaggagguggucgucgagguacaggagcucagggagagacacuaggagaaaaguggaaaagacaacuuaaucaauuauccaaaucagaauuuaauacauauaaacgaaguggaauaauggaagucgacagaagcgaagcaaaagaaggauuaaaacguggcgagacgaccaagcacgcgguaucgagagguacggcaaaacuacgaugguuuguggaacgaaauuuaguaaaaccagagggaaaaguaauagaccuugguugcgguagaggcggauggucguauuacugugcaggguuaaagaaagucacggaagucaaaggguauacgaaaggagggccaggacacgaggaaccaauuccuauggcaaccuacggcuggaauuuaguuaaauuauauagcgguaaagauguauuuuucaugccgccagagaaaugcgauacucuacuaugugauauaggugaguccagcccaaauccaaccauagaggaaggaagaacgcuccgaauacucaaaaugguugagccuuggcuccgcggaaaccaguucuguauuaaaauacuaaacccguacaugccgagcguaguagaaaccuuagaacaaaugcaaagaaaacaugggggaauguuaguaagaaauccuuuauccagaaauagcacccaugaaauguacuggguuucauguggaacugguaauauugugagcgcugucaauaugacgucacguaugcuucucaaccgcuucacaauggcucauagaaagccaacauaugaaagggacguugaccuaggggcagggacacgccauguagcgguagaaccugaaguggcaaaccucgauauaaucggccaaagaauugaaaauauaaagaaugaacauaaaucaaccuggcauuaugaugaagauaauccauauaagacaugggcguaccauggaucauacgagguuaaacccaguggaucagcaucaagcaugguuaaugguguuguuagguuauuaacaaagccgugggaugugauuccuaugguaacacagauugcaaugaccgauacaacuccguuugggcagcaaagggucuuuaaagaaaaagucgauacgcgaacuccgagagcaaaaagagguacuacccaaauuauggaaguaacugccaaauggcugugggguuuucucaguaggaauaaaaagccccgaauuugcacucgcgaggaguucacuaggaaaguaagaagcaaugcagcuauaggagcuguguucgucgaugaaaaucaauggaauagugcaaaggaagcugucgaggaugagagguuuugggaucugguucacagagaaagagaguugcauaaacaaggcaaaugugcuacauguguauacaauaugauggguaaacgagagaagaaauuaggcgaguucggaaaggcaaagggaucaagagcaauaugguauauguggcuaggggcaagauuuuuggaguucgaagcgcugggcuuuaugaaugaagaccauugguuuucaagagaaaauaguuuaucaggaguugaaggagaagguuuacacaaacugggauacauacugagagauauaaguaaaauuccgggcggcaauauguaugccgacgacacggcagguugggacacccgaauuacagaggaugaucuucaaaacgaagccaaaauaacggauauaauggaaccggagcacgcgcuuuuggcuacaaguaucuuuaaacuaacuuaucaaaacaagguggugagaguccagcggccugcuaaaaacgggacagucauggaugucaucucuagaagagaccaaagagguucugggcaagucgggacauacggucuaaacacauucacgaauauggagguacaguuaauuaggcagauggaaagcgagggaaucuuuuuaccuagcgaauuggaaacgcccaaucuggccgaacgaguucucgacuggcuagaaaagcacggugcagaaagacuaaaacggauggcuauaagcggggacgacuguguugucaaaccgauagacgauagauucgcgaccgcauugacagcacucaaugauaugggaaagguacguaaagauaucccccagugggaaccaagcaaaggauggaaugacuggcagcaaguuccauuuugcucacaucauuuucaccaauuaauaaugaaagauggaagagaaauugugguaccuuguagaaaccaagaugaacuuguuggucgagcucggguaucucaaggggcuggauggucacugagagagacagccugccuaggaaaaagcuaugcacaaauguggcaacucauguauuuucauaggcgugaucuucgacuagcugcuaacgcuaucuguagcgcgguuccaguugauuggguaccaacaagcagaacaacauggucuauacaugcacaucaccaauggaugaccacagaggauaugcuguccguguggaauaggguauggauugaagagaacccauggauggaagauaaaacacacgucucaucaugggaagagguccccuaucuaggcaagagagaagaccaauggugcgguucgcuuauuggacuaacugcgcgcgcuacaugggcaacuaacauacaaguagccauuaaccagguuagacgguuaauuggaaaugagaauuaucuagauuauaugacaaguaugaaaagauuuaaaaaugaaucggauccugaaggagcauuaugguaa

SEQ ID NO: 21316 - RNA, 9879 nt, Artificial Sequence
  derived and/or modified CDS sequence (opt6) from DENV-1__GQ199872__SS-prME
ucaguaacaauguuacugaugcuucugccaacagcauuagcuuuucaucuaacuacaagaggcggggaaccacauaugauuguuucuaaacaggaacguggaaaaucuuuauuauucaaaacaagugcgggaguaaauaugugcacguuaauugcaauggacuuaggugagcucugugaagauacaaugacuuacaaauguccgcaaaucacagaagcggaaccagacgacguugauugcuggugcaacgcaacagauacguggguuaccuacggaacguguucacaaaccggcgaacaccgcagggacaaaagaucuguggcgcucgcaccacacguagguuuaggauuagaaacuagaaccgagacauggaugucaucagaaggagcguggaaacaaauucaaaggguagaaacaugggcucuacgacacccagguuucacgguaaucgcuuuauucuuagcacacgcaauuggaacaucaaucacucaaaaagggauuauauucauauuauuaauguuagucacaccgaguauggcaaugcgauguguagguaucgggaaucgagauuuuguugaaggcuugucuggugcaaccuggguggacguuguucuugagcacggaucuugcgucacaacaauggccaaaaauaaacccacccuagacauugaguugcuaaaaacagaaguuacaaauccugcaauucuaaggaaacuauguauagaagcuaaaauaagcaauacaaccacagacucgcguugcccuacucaaggggaggcaacauuagucgaagaacaggaugcaaacuuuguuugcagaagaacuuucguagauagaggcuggggaaaugggugcgguuuauuugguaaagggagucuauugacuugugcaaaauucaaaugcguaacuaaauuagaaggaaaaauagugcaguacgaaaaucuaaaauauuccguaaucguuacaguacauacaggggaccaacaucaaguagggaacgaaacaacugaacacggaacaaucgcgacaauuacuccacaggcaccaacaagcgagauucaauuaacugacuauggagcauuaacauuagacuguucacccagaacgggguuagauuucaacgaaauggugcuucuaacuaugaaagaaaaaucauggcucguacacaaacaaugguuucucgaucucccucuuccuuggacuucaggagcaucgacaagucaagaaacuuggaauaggcaagauuuauuaguuaccuucaaaacagcacaugccaagaaacaagaaguagugguacuggggucgcaagagggugcgaugcacacagcacuaacuggcgcaacggaaauucagaccucgggaacaacuacuaucuuugcuggccauuuaaaaugucgacuaaaaauggacaaauuaacauuaaaaggaacuucauacgugaugugcacaggaucauuuaaauuagaaaaagagguagcugaaacacaacauggcacuguauuaguacaaguuaaauaugaggguacagacgcaccaugcaaaauucccuuuaguacacaagaugaaaaagguguaacucaaaaugggcggcuaauaaccgcaaaccccauagucacagauaaagagaagccugugaauauagaaaccgaacccccauucggagagucguauauaguuguaggugcaggcgagaaagcauugaaacuuaguugguuuaagaaaggcucaagcauagggaaaauguuugaagcaacugcuaggggagccaggcgaauggcaauucuaggcgauaccgccugggacuuuggaucuauaggaggaguauuuacuuccguagguaaacuuguacaucaagucuucggaaccgcauauggaguauuauuuucgggggugucauggaccaugaaaauuggaauaggaauauuacuaacguggcuuggacucaauucaagaucaacaagucuuaguaugacaugcauagcaguuggcauggucacacuguaucucgggguaaugguccaagcagacucgggguguguuaucaauuggaaggggcgcgagcuaaaauguggcucugguauauuugugacuaaugaaguacauacguggaccgaacaguauaaauuucaagcugauucuccaaagagguuaagugcggcaauagggaaggcaugggaggaaggaguauguggcauuaggucugccacccgauuagaaaauauaauguggaaacaaauuaguaaugaauugaaucauauacuacuagaaaacgacaugaaguucacaguggugguaggagacgcaaauggaauccuugcccaaggaaagaagaugauaagaccccaacccauggaacauaaauacucauggaaaaguuggggaaaggcuaaaaucauaggggcugacauucaaaacacuacauucauaaucgaugguccagauacaccagaguguccagacaaucaaagagcauggaauaucugggaagucgaagacuauggauuuggaauauucacuacaaauauaugguuaaagcuccgcgauucauauacacagaugugcgaccacagacucaugucagcugcaauuaaagacucaaaagcuguacacgcugauaugggauacuggaucgaaucagaaaagaacgaaacauggaaguuagcccgugcauccuuuauugaggucaaaacuuguacuuggccaaagagucauacucuuuggucaaacggggugcuggaaagcgaaaugauaauaccaaagaucuaugguggaccgauaucacagcauaacuacagaccaggauacuuuacccaaacagcaggaccauggcaccuugggaaacuagaauuggacuuugacuugugugaggggaccacagugguaguggaugagcacuguggaaauagagguccauccuuaaggacuacaaccguaacgggaaagauuauucacgagugguguugucgaucuugcacacuaccuccgcuacgcuucagaggcgaagacgggugcugguauggaauggaaauaagaccaguaaaggaaaaagaagaaaaccuaguccguagcaugguuucugcaggaucgggcgaaguagacagcuuuagccuugggauucuaugcgcuuccaucaugauagaggaagugaugagaucaagauggucucggaagauguuaaugacaggcacauuggcaguauuccucuuguuaauuaugggccaacuuaccuggaaugaucuuauccggcucugcauaaugguaggcgcuaaugcaucagaucgcauggguaugggaaccacguacuuggcuuugauggcaaccuuuaaaaugagacccauguucgcaguaggucuacuauuucggagauugacaucuagggaaguacuauugcugacaauaggacucaguuuaguugccucaguagaacuaccuaauagucucgaagaauuaggagauggacuagcaaugggaauaaugaugcuaaaguuacuaaccgaguuucagccccaucaacucuggacaacucuuuuaucauugaccuucaucaagacaacccuuucauuagacuacgcauggaaaacaacugcaauggccuugucgauaguauccuuauuuccucuaugcuuaucaaccacaucgcagaaaacuacuugguuacccguccuauugggaucauucggauguaaacccuugaccauguuucuaauuaccgaaaauaaaauuuggggucgcaaaucuuggccacuaaacgaaggaaucauggccauaggaaucguuaguauacucuugaguagcuuacucaagaacgauguacccuuagccgggccacugauagcaggagggauguugauagcguguuauguuauaucggggagcagcgcugauuuaucguuggagaaagcagcagagguaucgugggaacaagaagccgaacauuccgguacaucgcauaacauauuggucgaaguacaagaugaugguacaaugaaaauaaaggacgaagagagagacgauacucuuaccauauuacuaaaagccacucuucuugcuguaucuggaguguaccccaugucaauuccagcaacauuauucguaugguacuuuuggcagaagaagaaacagcgcucagguguacuuugggacacuccuucaccaccugaaguugagagggccguacuggacgacggaauauauagaauuuuacagagagggcuauugggacgaucacagguuggagucggaguuuuccaagacgggguauuccauacuauguggcacguuacacguggcgccgucuuaauguaccaagggaaacgacuugagccuagcugggcuucuguaaagaaagaucugauaucauacggaggaggauggagauuccaggggagcuggaacacaggagaggaggugcagguuaucgcaguagaaccugguaaaaaccccaaaaauguucaaacgacaccagggacauuuaaaacgccugagggggaaguaggagcaaucgcacuagauuuuaaaccugguacaaguggaagcccaauagugaauagagaagguaaaauagucgggcuguaugguaacggaguugucacaacuuccgggacauauguguccgccaucgcgcaggcuaaagcaagucaagaagguccauuaccugagauagaggaugagguuuucaagaaacguaauuuaacaaucauggaucuacacccuggaucugguaagacacgaagauauuuaccagccauaguucgugaagcaauaaaacgaaagcuacgcacuuuaauauuggcaccgacuaggguuguugcuucagagauggcggaggcacuuaaaggaaugccuauacgcuaucaaacuacugcaguaaaaagugagcauacagggcgagaaaucgucgacuuaaugugucacgcuacauuuacuaugcguuuauuaaguccaguacguguuccgaauuacaauaugauuauaauggaugaagcccauuucacagauccagcaagcauagcagcaagaggauauauaucgacccgaguuggaaugggagaagcugcugcaauuuuuaugacagcaaccccaccagggucaguugaagcauuuccacagagcaacgcugugauacaagacgaagaacgggauauuccagaaagaucauggaacaguggguaugauuggauaaccgacuuucccggaaaaacgguaugguuuguccccaguauaaaauccggaaaugacauagcgaacuguuuaagaaagaauggcaaaagagugauacaauuaucucgaaaaacauucgacaccgaauaccagaaaacuaaaaauaacgauugggauuauguaguuaccacggacaucucagagaugggagcuaacuuccgggcagacagaguuauugacccaaggagaugucuaaaaccaguaauacuaaaagaugguccggaaagagugauacuagcagggccgaugccagucacgguugcuagcgccgcucaacgacggggaagaauaggacggaaucaaaauaaggagggugaccaauauguauauaugggacagccacuaaacaacgaugaagaccaugcccacuggacagaggcaaaaaugcugcucgacaauaucaauacuccugaaggaauuauaccagcuuuauucgagccggagagggaaaaaucagcugccaucgacggggaguaccgacuacguggagaagccagaaaaacauuuguugaacucaugcgaaggggagaucuaccugucuggcuaagcuauaaaguagcaagugagggauuucaauauucagauaggaggugguguuuugauggagaaagaaacaaucaaguuuuagaagaaaacauggacguggaaaucuggacgaaagagggagaacgaaagaaacucagaccacgauggcuggaugcucgcacguacucagauccacucgcauuaagggaguucaaagaauuugcggccgguaggcgcagcgucagcggugauuuaauauuagaaaucggaaaacuaccucaacaucuuacucuacgugcacagaaugcgcuugacaaccuagugauguuacauaacuccgaacaagggggaaaggcauauagacaugcaauggaagaguuaccagauacuauagagacucuaaugcuacucgccuugauagccguacuaacaggcggggugacauuguucuuuuuaucgggaaagggacuagguaaaacaaguauagggcuucuguguguuacagcaucuagugcauuguuauggauggcaagugucgaaccacauuggaucgccgcaucuauuaucuuagaguucuuuuuaaugguacuacucaucccugagccagacagacaacguacaccgcaggacaaucaauuagcauauguuguaauuggauuguuauuuaugauucuaacgguagcugcaaacgaaauggggcuucuggagacaacuaagaaagaucuagguauuggccacguagcggcggaaaaucaccagcaugcuacuauguuagauguugaucucagaccugcuagcgcauggaccuuauacgcaguagccacaaccguaauaacccccaugaugagacauaccauagaaaauacaacagccaacauaucacuuacugcaauagcgaaccaagcagcaauccuuaugggacucgauaaaggauggccaauaucgaaaauggauauagguguuccuuuauuagcacugggguguuauucccaaguuaauccacucacuuuaacugccgccguauuaaugcuaguugcucacuacgcuaucauugguccaggacuccaagcaaaagccacaagagaagcgcagaaaagaacugcagcggguauaaugaaaaauccuacggucgauggaauagucgcuauugaucuagauccaguuguauacgaugcgaaguuugaaaaacaacuuggucaaauaauguuauuaauacucugcaccucacagauucuguugaugagaacuacaugggcgcuaugcgaaaguauuacguuagccacuggaccauugacaacacuaugggagggaucuccaggcaaauucuggaauacaacaauagcuguaucgauggcuaacauauuuagggggucauaucuugcuggugcaggucuugcauuuucacuuaugaagucucugggcgguggaagaagggggacuggggcacagggagaaacguuaggugaaaaauggaaaagacaauuaaaucaacuaucgaaauccgaauuuaauacguacaaaagauccgggauaauggagguugacagaucggaggccaaggaaggacuuaagcgaggagaaaccacgaagcaugcgguaagcagagggacggcuaaguugcgaugguuuguagagagaaaucucguuaaaccagaagggaaaguaauagaccuaggcugcgggcgaggaggguggucauauuauugugccgggcuaaagaaaguuacugagguuaaaggguacaccaaagggggaccaggacaugaagaaccaauaccaauggcaacuuauggauggaauuugguaaaauuacauucagguaaagauguauucuuuaugcccccugaaaagugcgauacauugcuaugcgauauuggagagucuaguccaaaccccacaauagaagaagguaggacuuuaaggguacuuaagaugguagaaccaugguuaagaggaaaccaauuuuguauaaagauauugaauccuuauaugccaucgguaguugagacacuugagcaaaugcagcggaaacaugguggaauguuaguaaggaacccacuuucaagaaacaguacgcaugaaauguauugggugagcugcggaacuggcaauauuguuuccgcaguaaauaugacguccaggaugcugcuaaaucgauucacuauggcacacaggaaaccaacauacgaaagagauguagauuuaggcgcagguacaaggcauguugcaguggagccggaagucgcaaacuuagacaucauuggucaacgaauagaaaauauaaagaacgagcauaaaaguacguggcauuaugaugaagauaauccauauaaaacgugggccuaccauggcucuuaugagguaaaaccgagcgguagugcuuccucaaugguuaaugggguaguuagacuccuaaccaaaccaugggacguuaucccaauggucacucaaauugcaaugacagacacaacaccguuuggccagcaacgaguuuuuaaagaaaaaguggacacccgaacuccuagagcgaaaaggggcaccacacagauaauggagguaacugcuaagugguuauggggauuucuaucgagaaauaagaaaccuagaauuuguacucgagaggaauuuaccaggaaagucagaucaaaugcugccauaggggcgguuuuuguagaugagaaucaguggaacucagccaaagaagcaguugaagaugaacgauucugggaucuaguacauagagaacgagaauuacacaaacaaggaaaaugcgcaacgugcguguauaacaugaugggcaaacgugagaagaaacuuggggaauuugguaaagccaaagggucucgagcaauaugguacauguggcuaggagccagauucuuagaauuugaagccuugggguuuaugaaugaagaucauugguucucucgugagaauaguuuaaguggugucgagggggaagggcuacauaaacuuggauacauccuaagagacauaagcaaaaucccaggagguaauauguaugcagaugauacggcuggcugggacacccgcauuacagaagaugacuuacaaaaugaagcuaaaaucacggauauaauggaaccugaacaugcauuauuagcaaccagcauuuuuaaauuaacguaccaaaauaaaguaguaagggugcagaggccagccaaaaauggaacuguaauggauguaauuucccguagagaucaaaggggaucaggucaaguagguacuuaugguuuaaauaccuucacaaauauggaaguucaguuaauaagacaaauggaguccgaaggaaucuuccuuccguccgaacuagaaacgccuaauuuggcggagagaguacuggacuggcucgaaaaacacggggcagaaagacuuaagagaauggcaauaucaggugaugauuguguuguaaaacccauagaugacagguuugcuacagcacucacagcacuuaaugauaugggcaaaguuagaaaggauaucccgcaaugggagccgucaaaaggauggaacgauuggcaacagguaccuuuuuguucgcaccauuuccaucaacuaaucaugaaagaugggagagaaaucgugguacccugcagaaaucaagaugaauuagucggcagggcccgggugucccaaggugcgggguggucacugcgugagacggcuugucuagguaaaagcuacgcacaaauguggcagcuaauguacuuucaucgacgugaucuucgguuagcagcaaacgcuauauguucugccgucccgguggacugggucccaacaucccgaaccacauggagcauucacgcucaucaucaauggaugacaacggaagauauguugucuguuuggaaucgagucuggaucgaagagaacccguggauggaagacaagacccauguuucguccugggaagaaguaccuuauuuaggaaagagggaggaccaaugguguggaucucuaauuggguuaacugccagagcaacuugggcaaccaauauccaaguggccauaaaccaaguaaggagacuaauaggaaaugaaaauuauuuggaucacaugacaucuaugaaaagauuuaaaaacgagucggauccugaaggagcauuaugguag

SEQ ID NO: 21317 - RNA, 9879 nt, Artificial Sequence
  derived and/or modified CDS sequence (opt6) from DENV-1__FJ410290__SS-prME
uccguaacuauguuacucaugcucuuaccuacagcuuuagcauuucaccuaacaacgaggggaggcgaaccgcauaugauuguaaguaaacaagaacgaggcaaaaguuugcuguuuaaaacuucagccgguguaaauauguguacacuuauagcaauggaucugggugaauuaugcgaagacaccaugacauauaaauguccacaaauuacggaagcagagcccgacgauguagauuguuggugcaaugcuacagacacgugggugacguacgguacgugcucucagaccggcgaacaucgucgagagaaacguaguguggcauuagcuccacacgugggacucggcuuggaaacaagaacugagacauggaugucgagcgaaggcgcauggaaacagauacaaagaguagaaacaugggcguuacgacauccuggguuuacagucaucgcacuauuccuagcacacgcaauuggaacauccauaacccaaaaaggaaucauauuuauacucuuaauguuaguaaccccuucuauggcaaugaggugcguagguauugguaauagagauuuugucgagggguuaucaggagcgacauggguagauguaguucuagagcacgguaguuguguaacgacaauggcuaaaaauaaaccaacauuagacauugaauuacugaaaacggaaguaacaagcccagcaauucuacgaaaacuuugcauagaagcaaaaauaucaaauaccaccacagacucuagauguccaacucaaggugaagcaacacuuguugaagaacaagaugcuaacuuuguuugcagaagaacauucguagaucgaggcuggggaaauggcuguggacuuuuuggaaaaggauccuuauuaacuugugcaaaauuuaaauguguuacuaaacuugaaggaaaaaucguacaauacgaaaaucuaaaauacaguguaauuguaacaguucauacuggagaucaacaccaaguuggcaaugagacaaccgaacacggaaccaucgcaaccauuacaccgcaggcuccuacauccgagauacagcuuaccgacuacggagcacuuacauuagacuguucacccagaacugggcuugauuuuaaugagaugguauuauuaacaaugaaagagaaaucuuggcuuguucacaaacaaugguuuuuagauuuaccucucccguggacaagcggcgcgaguacaagccaagaaacuuggaaucgccaagaucuuuuaguuacuuucaaaacugcgcacgccaagaaacaagagguagucguccuaggaucucaagaaggcgccaugcauacugcacuaacaggggcaacagagauucaaacgagugggacuacgacuauuuucgcaggucaucuaaaaugccguuuaaaaauggauaaguuaacacuaaagggaaccucguacgugaugugcacagguaguuucaaguuagaaaaggaaguagcugaaacgcaacacgguacuguucuuguacaagucaaauaugagggaaccgaugcaccuugcaaaauuccauuuuccacgcaagacgagaaaggaguuacacaaaaugguaggcugauaacggcuaauccuauaguuacagacaaagaaaaacccgucaacauugaaacugagccuccuuucggagaaaguuauauagucguaggggccggagaaaaggccuuaaagcuaagcugguucaagaaaggauccaguauaggaaaaauguucgaagccacggcaagaggagcccgaaggauggcuauacuuggugacacagcuugggauuucgguuccauugggggaguauuuacaucuguaggaaaguugguucaucagguuuuugguacagcuuauggaguccuguuuucgggaguaaguuggacaaugaaaaucgguauaggaauauuauuaacuugguugggacuaaacucaagaagcacauccuuaucaaugacgugcauugcaguugguaugguaacgcuuuaccucggcguaaugguacaagcagauucuggauguguaauaaacuggaaaggucgugaauuaaaauguggcucaggcaucuuugucacaaaugaaguacacacauggacugagcaauacaaauuucaagcagacagucccaaacgccuuagcgccgcaauaggaaaagcaugggaagaggggguuugugguauuagauccgcgacaagauuagaaaauauaauguggaaacaaauuuccaacgaacuaaaccacaucuuguuggaaaacgauaugaaauucacuguaguaguuggugaugcuaauggcauauuggcucaaggcaagaaaaugauaaggccacagccaauggaacacaaauauaguuggaagucguggggcaaggcaaaaauaaucggugcagacauucaaaauacuacauucauuauagaugggccagacaccccagaauguccagauaaucaacgagcauggaacaucugggaaguugaagauuaugguuuugguauauucacaaccaacauaugguuaaaauugagagauaguuauacgcaaaugugcgaucaccgacuaaugagugcagccauaaaagacucuaaagccguacaugcagauauggguuauuggauagaaucagaaaagaaugaaacguggaaauuggcuagagcuucuuucauugaaguaaagacauguaccuggcccaaaagucauacauuauggucuaaugggguauuagaaucagaaaugaucauuccgaaaauuuacgguggacccauaucccagcauaauuacaggccgggauauuucacccaaacagcuggaccauggcacuuggguaaguuagaacuagacuuugaccuuugcgaggguacaaccgugguagucgacgagcacugcggcaacagaggcccaagccuuagaaccacgacaguaaccggaaaaaucauacaugaguggugcugcagaaguugcacacuuccaccucugagguuucggggugaagacggauguugguacggaauggaaauuagacccgugaaggagaaagaagaaaaucucguuagaucuaugguaagcgccgguucaggcgagguagauaguuuuucucuuggaauuuuaugugugucgaucaugauagaagagguaaugaggucccgauggucacgaaaaaugcuaaugacagguacccuaguuguguuucuauugcuaauaaugggccaauuaaccuggaaagaucuaaucaggcucuguauaaugguaggggcgaaugcuucagacagaaugggaauggguacuacuuauuuagcacugauggcaacuuuuaaaaugagaccaauguucgcuguaggauuauuauuucgaagauugacaagcagagagguuuuacuccuuacaauaggacugucauuaguugccaguguagaacuaccuaacagucuagaggaauuaggggacgguuuagcuaugggaaucaugaugcucaaauugcuuacagaauuucagccucaccaguuauggacuaccuuauuaucgcuaacauuuauaaaaacaacgcucucauuagauuaugccuggaaaacaaccgcuauggcacuaucgauuguuagccuauuuccucuauguuuaagcacaacgagucagaaaacgacguggcuuccaguacuacugggcaguuuuggaugcaagccacuuacgauguuccuaauuacugaaaauaaaauuugggguaggaaaucguggccuuuaaacgaaggaauuauggcaauagguauaguaucaauauugcugucaucucuacucaaaaacgaugucccacucgccggaccauuaaucgcgggaggaauguugauagcaugcuaugucauauccgguaguagcgccgaccuaucgcuagaaaaagcagcugaggugucaugggaacaagaggcagaacauagcgggacuucgcauaacauuuugguggaaguccaagaugacggaacuaugaagaucaaggacgaggagcgagaugauacgcuaaccaucuuacucaaggccacccuacucgcugucucuggaguguaccccaugucaaucccugcaacucuuuuuguuugguacuucuggcagaagaaaaagcaaaggucgggaguauuaugggauacaccaucgccacccgaagucgaaagagcggugcuagaugauggaaucuauagaauauugcaacguggacuguugggaagaucucaaguugggguggguguauuucaagaugggguuuuccauacuauguggcauguuacaagaggagccgucuuaauguaucaagguaaacgauuggaaccuaguugggcuaguguuaagaaagaucuaaucaguuacggaggaggcuggcgguuucaaggcagcuggaauaccggggaagaaguucaagugauugcaguggaaccagguaaaaauccuaaaaauguacaaacgacaccaggaacuuucaaaaccccagagggggaagucggcgccauugcacuugauuucaagccagguaccuccggaucaccuauaguaaauagagaggggaaaauaguugguuuauaugggaacggagucguaacaaccucugguacguacguaucggcuaucgcccaagccaaagcaucgcaagaaggcccacuaccugaaauugaagacgaaguguuuaagaaaagaaaccuaacaaucauggauuugcauccaggaucuggcaaaacucguagauaccuucccgcgauagucagagaagcgauaaaaagaaaauuacgaacacuuaucuuggcaccaacaaggguaguggccucagaaauggccgaggcguuaaaggggaugccaauucgauaccagacaaccgcuguaaagucugaacacacaggacgagaaauaguggaucuaaugugucaugcgacuuuuacuaugcguuuauuaaguccagucagagucccaaacuauaacaugauaaucauggaugaggcgcauuuuaccgacccugcaucuauugcagcgagggguuauauuucaaccaggguggguaugggugaagcagccgcuauauucaugacagccacgccgccagguucuguggaagccuucccacaaucgaaugcagucauucaagaugaggaaagagauauuccugaacguucguggaacucagguuaugacuggauuacggauuuuccaggaaagacgguaugguucgugccuucgauuaaaucugggaaugauauagcaaauugccuaaggaaaaaugguaagaggguuauucaacuaagucggaagacuuuugauaccgaauaucagaaaacuaaaaauaacgacugggacuacguaguaacuacagacauauccgagaugggggcgaauuuucgugcagaccgaguuaucgacccucgaagaugucucaagccgguaauuuugaaagaugggccagaaagagucaucuuggcagguccaaugccggugacaguagcaagugcugcacaaaggagggguagaauaggucgaaaccaaaacaaagaaggcgaccaauacguauauaugggucaaccuuuaaauaacgaugaagaucacgcgcauuggacugaggcaaagauguuacuagacaauaucaauaccccagaagggauaauaccugcacuguuugaaccugaacgggagaaaagugcugcaauagauggagaauacagacuucgaggggaagcuagaaaaacguuuguagaauuaaugcgacguggugaucucccaguaugguugucauacaaaguugcaucggagggguuucaauacagcgauaggagauggugcuuugauggugagcgcaacaaucaaguucuagaagagaauauggauguggaaauauggacaaaggaaggagagagaaagaaauuacgaccccgauggcuagaugcuaggacauacucagacccccucgcacuucgagaauuuaaagaguucgcagcagguaggcgaucugucagcggcgaucuaauauuggaaauaggaaaacuuccgcaacaccuaacgcucagggcgcaaaaugcgcuggacaaccuugucaugcuacacaauuccgaacagggagguaaagcauaucgacacgcaauggaagaguuaccagauaccauagagacauugaugcucuuggcccuaauagcaguuuugacuggcggaguaacacuauuuuucuuaucugggaaagggcuuggaaaaacgucuauaggacuauuaugcgucacggcaucaagugccuuacuauggauggccuccguagaaccgcauuggauagcagcaaguauuauuuuggaguuuuuccuaaugguccugcuaaucccagaaccugaucgccagagaacgccucaagacaaucaguuggcauauguagugauaggccuacuauuuaugaucuuaacaguggcagcaaaugaaaugggguuauuggaaacaaccaagaaagauuuaggaauaggucaugucgcagcugaaaaucaccaacacgcaaccaugcuagacguagauuugaggccggccagcgcguggacgcuauaugcaguugcuacgacaguaauaacgccaaugaugagacacaccaucgaaaauacaacagcgaacauaaguuuaacugcgauugccaaccaagcggccauucugaugggucuggauaagggguggccuauuucgaagauggacauuggugugccccuacuagcacuaggguguuauagccaggugaauccauuaacucuaacagccgcagucuuaauguuaguggcgcauuacgcuauaauugggccgggucuccaagcaaaagcuaccagagaggcucagaaaaggacugcggcuggaauaaugaaaaauccuacggucgauggaauagucgcaauugaucuugacccagucguauaugaugcaaaauuugagaagcaacuuggucagauuauguuacugauucuaugcacuagccaaauauuauuaaugagaacaacaugggcacuaugugaauccauaacgcuggcuacaggaccauugaccacacuuugggaagggaguccgggcaaguucuggaacaccacuauagcaguuagcauggcaaacauauuuagaggaucguacuuagccggugcaggccuugccuucucacuuaugaagucccuaggggguggccgaagaggaacgggugcccaaggugaaacacuuggcgaaaaauggaaaagacaacucaaccaauuaucgaaaagugaauuuaauacguacaagcgaagcgguaucauggaaguagaccguuucgaagcaaaagaaggauuaaaacggggugaaaccacaaagcaugcagucucaaggggaaccgcaaaauuacgaugguuugucgaaagaaaccuaguaaaaccagaagggaaaguaauagaucuaggaugugggagagguggauggucuuauuauugugccgggcuuaagaaaguuacugaaguuaaaggguauacaaagggagggccuggccacgaggaaccuauaccuauggcuacauacggcuggaauuugguuaaacuccauucuggaaaagacguauucuuuaugccaccugaaaaaugugauacucuguuaugugauaucggcgagucaaguccaaauccuacaauagaagaaggacguacccuaagaguauugaaaaugguagaaccuugguugagaggaaaucaauucugcauuaaaauacuuaauccauacaugccaucaguugucgaaacacucgaacaaaugcagcgaaaacauggcgggaugcuaguucgcaauccguuaucgcguaacagcacucacgaaauguacuggguuagcuguggcaccggaaacauuguaagugcagucaauaugacgagccgaauguuacuaaauagguuuacuauggcgcacagaaagccuacauaugagcgggauguagacuuaggagcaggcacacgccacguagcugucgagccugagguugcgaauuuagacauaaucggucaaagaauagaaaauauaaagaacgaacauaaaucaacuuggcacuacgaugaagacaaucccuacaagaccugggcuuaccauggauccuacgaaguaaaaccaagcggcucugcgucuagcauggucaauggugugguaaaauuauuaacuaaacccugggaugucauaccaaugguaacgcaaauugccaugacagauaccacgccauucggacaacagcgcgucuucaaagaaaagguugauacgagaacaccacgagcaaaacgagguacuacccagaucauggaaguaacagcuaaauggcucugggguuucuuguccagaaacaagaaaccuagaaucugcacccgugaagaguucacaagaaaaguacguucaaacgcggcaaucggagcagucuuuguagaugaaaaucaauggaacagugcaaaagaagccguagaagaugaaagauuuugggaucuaguucaucgcgaaagggaguuacauaagcaggggaaaugugcgacuugcgucuauaauaugauggggaagagagagaagaaauuaggagaauuuggcaaagccaaaggaucacgggcuauaugguauaugugguuaggggccagauuucucgaguuugaggcuuuggguuuuaugaaugaagaccauugguucucaagagaaaauucauuaagugggguagaaggagaggggcuccacaaacugggauacauccuaagagauauuaguaagaucccuggaggaaacauguaugcagacgauacugccgguugggauacaagaauaacagaagaugauuugcaaaaugaagcuaagaucacugacaucauggaaccggaacaugccuuauuagcuacuucuauuuucaaacuaacauaucaaaauaaaguaguuagagugcaacggccagccaaaaauggaaccgugauggacguuauaagccgccgcgaccagcgugguucagggcaagugggaacauauggucuuaauacguuuacaaacauggaaguucagcugauacgacagauggaaucagaaggaaucuuuuuaccaucagaacuagaaacaccaaauuuggcugaacguguguuagauuggcuagggaaacauggggcagaacgauuaaaacgaauggcuaucagcggggaugauuguguuguuaaaccaauagaugacagguuugcaacugcauuaacugcuuugaaugacaugggaaagguuagaaaagauauaccacaaugggaaccaucuaaaggauggaaugauuggcaacaaguaccauucugcagccaucacuuccaccaauuaauaaugaaggauggaagggaaauaguaguaccuugucgaaaccaagacgaauuaguuggccgugcaagaguaagucaaggcgccggcuggucgcugagggaaacagcaugucuaggcaagagcuacgcucaaauguggcaacugauguauuuccaucgacgagaccuaagauuggcuacuaacgccaaguguucagcugucccaguagauuggguaccaacaagcaggacuacauggagcauacaugcacaucaucaauggaugacgacugaagauaugcuaaguguauggaauagaguguggauugaagaaaauccguggauggaggacaaaacgcacgucuccagcugggaagaaguaccauaucuugguaagcgugaagaccaaugguguggaagccucauuggccuuacagcuagagccacgugggcgacuaacauccaagucgcaauuaaucaaguuagacguuuaaucgguaacgaaaauuaccuagauuacaugacauccaugcgaagauucaagaacgaaagcgacccggaaggagcacucugguaa

SEQ ID NO: 21318 - RNA, 9879 nt, Artificial Sequence
  derived and/or modified CDS sequence (opt6) from DENV-1__FJ024423__SS-prME
ucugugacuaugcuccugaugcuauugccaacugcacuagcguuucacuugacuacucgaggaggagaaccacauaugauaguaagcaaacaagaaaggggaaaaucucuccuauuuaaaacuucugccggugugaauauguguacacuaauagcaauggaucuaggggaauuaugugaagacacaaugacguacaaaugcccacagauaacagaagcggaacccgaugauguugauuguuggugcaaugcaaccgacacauggguaacguacggaacgugcagucaaacaggagaacaccguagggauaaacgaagcguggcguuagccccucauguaggguuagggcuggaaacuagaaccgaaaccuggaugucaagugaaggugccuggaaacaaauccaaagaguggaaacuugggcuuuaaggcauccaggguucacuguuguagcuuucuuuuuagcucaugcaauagguacaaguauuacccaaaaaggaauuauauuuauauuguuaaugcugguaacacccucuauggcaaugcgaugcguaggaauuggaaacagagacuucguugagggccucaguggugcgacauggguugauguuguauuagagcacggguccugugugacgaccauggccaaaaacaaaccaacuuuagauaucgagcuauuaaaaacagaaguaacuaaucccgccauccuucguaaacucugcauagaagcgaaaauaucuaacacuacaacugauucaagauguccuacacagggugaggcaacucuuguagaagaacaagaugccaauuucguuugucgaagaacuuuuguagacagaggauggggcaauggaugcggccuuuuugggaaaggcucuuuacuaacuugugcgaaauuuaaaugugugacaaaacuagaagguaaaauaguacaauaugaaaaccuuaaauauucaguaauugugacgguacacaccggagaccaacaccaaguugguaaugagaccacagaacacggcacgauagcgauaauaacaccacaagcaccaacauccgagauacaacucacggacuauggagcuuugacccuugauuguucaccacgaacagggcuagauuucaaugagaugguacuacuuacaaugaaagagaaaagcuggcuagugcauaaacaaugguuccuagauuuaccauuacccuggacguccggagcaagcaccagucaagagacauggaauagacaggaucuucuaguaacauuuaaaaccgcucaugcuaagaaacaagaaguggucguacuaggcagucaggaaggagcaaugcacaccgcacugacuggagcaacggaaauacaaacaucuggaacgacaacuauuuuugcuggucaccuuaaaugcagacuaaaaauggacaaacuuacauuaaaaggaacaucauacguuauguguaccgguaguuucaagcuagaaaaagaaguagcagaaacacagcaugggacaguacuggugcaagugaaauacgaggggacggaugcaccauguaaaaucccuuuuaguacccaagaugagaagggagugacgcaaaacggaagguuaauaacggcuaacccaauaguaacugauaaagaaaaaccuguaaacauugagacagaaccuccauucggagaguccuacauuguuauuggcgcaggggaaaaagcucugaaauuaucuugguucaagaaagguaguucaauagguaaaauguuugaagcaaccgcuagaggcgccagaagaauggcuauucuuggugauacugcuugggauuuuggcaguauaggggguguauuuacaagcguagggaaauuaguccaccaagucuuugguacugcauauggcguucuuuucagcggcguaagcuggacaaugaagauagggauaggcauacuacuuacauggcuaggucugaacagcagaucaaccucucuuucaaugacauguauugcagucggaaugguuacccuauaccucgguguaauggugcaagcagauaguggcuguguaauuaauuggaagggcagagaacuaaaguguggaagugguauuuuuguuacaaaugagguacauacuuggacugaacaguacaaauuucaagcagauucaccuaaaagacuaucggcugcgauagguaaagcaugggaagaaggugucuguggcauucguucugcgacgagacuugaaaacauuauguggaaacaaauauccaaugaauuaaaucauauauuauuagaaaacgacaugaaguucaccguaguuguaggggacgcaaaugguauucuugcacagggcaagaaaaugauuagaccgcagccgauggaacacaaauauuccuggaagucauggggaaaagcaaaaauuauaggggcggacauacaaaauaccacuuucauaaucgacgggccagauacgccugaauguccugacgaucaaagggcauggaacauaugggagguggaagacuaugguuucggaauauucacaacaaauauauggcugaaacugagggauucuuauacgcagaugugcgaucaucggcuuaugagugcagcgaucaaagacaguaaggcugugcaugcagauaugggauauuggauagagagcgagaaaaaugagacauggaaacuagcucgggcaucauuuaucgaaguaaaaacauguaccuggccuaagagucacacacuauggucuaacggugugcuagaaagcgaaaugauuauaccaaaaauauauggaggacccaucucucaacauaacuaccgaccaggguauuuuacucagacagccgggcccuggcauuuaggaaaacuugaacucgauuuugaccuaugcgagggaaccaccguagugguagaugaacauuguggaaaccgaggacccagcuuaaggacuacaacugucacggguaaaaucauacacgaauggugcuguaggucaugcacucucccuccccucagauuucgaggugaagauggaugcugguauggaauggaaauacgcccagugaaagaaaaagaggagaaucuuguacguucaaugguuagcgcgggaucgggagagguagauaguuucagucuagggauacuaugcgcgagcauuaugauugaggagguaaugagauccagauggagcagaaaaaugcuuaugacagggacccuagcagucuuccucuuauugauaaugggacaguuaacuuggaaugaucuaauucgauuauguauuaugguuggagcuaacgcuucugauagaauggggaugggaacuacauaccuagcguuaauggcaacuuuuaagaugaggccaauguuugcggucggacuacuauucagaagauugaccucgagagagguucucuuguuaacuauugggcuuagucuaguggcuucaguugagcuuccuaauaguuuggaagaguuaggcgacggauuagcaaugggaauaaugaugcuaaaacuacuuacggaauuucaaccacaccaauuauggacuacuuuacuuagucugacauucauuaaaacuacgcuaagucuugauuaugcuuggaagacuacugcaauggcguugucgauaguaucauuauuuccuuugugucuguccacuaccagucaaaagacuacauggcuaccgguccuucuugguucauuugguugcaaacccuuaacaauguuccuaauaacggagaauaaaaucuggggaagaaaaaguuggccgcuaaacgaaggaauuauggcaauaggcauuguaucaauauuguuaucgaguuuacuaaagaaugauguaccauuagcugggccauuaauagcggguggaaugcugauagcauguuauguaauauccggauccucagcugacuuaucgcuugaaaaagcagcagaggucucaugggaacaagaagcugagcauucaggaacuagccacaauauucugguagagguucaagaugacgguaccaugaaaauuaaagaugaggaaaaagaugacacgcucacaauauuacuuaaagcaacuuuacuggcaguuucugguguguauccaaugagcaucccggcaacauuauuuguaugguacuucuggcagaaaaagaaacaacgaucaggaguccuaugggacacuccauccccuccagagguggaaagagcaguuuuagaugacgguauauaccggauccuucagaggggacuccuagguagaucccagguggguguaggaguauuucaggacggaguauuucauacaauguggcauguaacaagaggggcgguucuuauguaccaaggaaaacgauuagaaccgaguugggcuagcgugaagaaagaucucauuucauauggaggaggauggcgguuucagggaaguuggaacacaggggaagaaguccaaguaauugcgguggagccagguaaaaaucccaaaaauguacaaacgacaccagggacguuuaaaacgccagaaggugaaguaggagcuauagcguuagauuucaaaccgggaaccaguggaagcccuauugucaaucgcgagggcaaaauaguaggauuguaugggaauggaguaguaacaacaaguggaacauaugucucagcaauagcccaagcaaaggcuagucaagaaggcccacuuccugaaauugaagaugagguuuuuaagaaaagaaaccugacuauuauggaccuccauccugguucagguaaaaccagaagguaucuaccggcaauagugagagaagccauaaaacgaaaauuacgaacacuaaucuuagcaccgaccagaguaguagcaagugagauggcagaggcuuuaaaagguaugccuauuagguaucagacaacagcugucaaaucagaacauacgggacgugagauuguugauuugaugugccaugcaaccuuuaccaugcgacuguuaucucccguaagaguaccuaacuauaauaugaucauuauggacgaagcacacuucacggaucccgcuucgaucgccgcaagaggguacauuucgaccagaguaggcaugggugaagcagcugcuauuuuuaugacggcuaccccgccaggaucaguagaagccuuuccacaaucuaaugccguaauacaagaugaggaacgagacaucccggagcguucguggaauaguggguaugacuggauaaccgauuucccggggaagacugugugguucguaccaaguauuaaaucuggaaaugauauugcgaauuguuuacggaaaaacgguaaaagagucauucaauuaagucgaaaaacauuugacacagaauaccagaaaacgaaaaacaaugacugggauuacguaguaacaaccgauauuagugaaaugggugcuaauuuccgugcagaucgcguuauagauccacgacgaugcuuaaaaccaguuauuuuaaaggaugguccugaacggguaauauuagcagguccuaugccgguuacuguggcaagugcagcacaaaggcgugggagaauaggucguaaccagaacaaagagggggaucaauauguuuauauggggcaaccauuaaauaacgacgaagaucaugcacacuggaccgaggccaaaauguuacuugauaacauaaauacuccagagggcaucaucccagcccuauuugagccggaacgugagaaaagcgccgccauagauggugaguauagauuaagaggagaagcgcguaaaacuuuuguagagcuuaugagaagaggagaucuaccugucugguuaagcuacaaaguagcuuccgaaggauuucaauauagugaccgaaggugguguuuugauggggaaaggaacaaccaaguacucgaagaaaauauggauguggaaauuuggacuaaagaaggugaaagaaagaaacuuagaccgcggugguuggaugcaaggacguauucagauccucuugcuuugcgugaauuuaaagaguucgcggcagggcgcagauccgucaguggagauuugauucuggaaauagguaaauuaccccaacaucuaacccuucgcgcacaaaacgcccuagacaaccugguaauguugcacaauucugaacaaggaggaaaggccuaccgucaugccauggaagaguuaccggauacgauagaaacguugauguuauuagcgcucauagcgguacuaacgggaggagugacauuguucuucuuaucaggaaaaggacuagggaagacauccaucggacuauuaugcgucaccgcgaguucugcauugcuauggauggcaaguguagaaccccacuggauugcugccaguauuaucuuagaauuuuucuuaaugguccuauugauuccagaacccgaucggcaacgaacaccacaagauaaucaacucgccuacguugucauaggucugcuauucaugauacuuaccguagcugcaaaugaaaugggauuauuggaaacgacgaaaaaggauuuggggauuggccauguugccgcagaaaaccaccagcaugcuacuaugcuagaugucgacuuaagaccugcgucggcauggacccuguaugcaguggccaccacugucaucaccccaaugaugcgucauacaauugagaacacgacagcaaauaucucuuuaacggccauugcgaaucaagccgcaauauuaauggguuuggauaaaggguggccuauuagcaaaauggacauugguguaccacugcuugcguuagggugcuacagucaagugaacccccuuacacucacagccgcuguccuaaugcuaguggcgcauuacgcaaucauuggcccgggcuuacaagcuaaggcuacacgggaagcccaaaaacggaccgccgcuggaauuaugaaaaauccuacuguugaugguauaguugcgauugaucuagauccuguuguuuaugacgcaaaauucgaaaagcaacuugggcagauaaugcuucuaauucuuugcacaucacaaauacucuuaaugcgaaccacgugggcucuaugugaaaguauuacucuggcaacugguccauugacaacacucugggaagguagccccggaaaguuuuggaauacuacuauagcggugaguauggcaaacauuuuucggggaagcuaccuugcgggugcuggucucgcuuuuucgcuaaugaaauccuuaggcgggggaaggcgugguacaggcgcucagggugaaacuuuaggagaaaaauggaaacgacagcuaaaccaacugucaaagucagaauuuaacacuuauaaacgaucagggauaauggaaguagauagaucugaagcuaaggagggacuaaaaaggggagagacgacgaaacacgcagugucuaggggcacagcuaaacuccgaugguuuguagaacgaaaucuaguuaagccagaaggaaagguuauagacuuagguuguggacgaggcggauggagcuacuacugcgcuggguuaaagaaaguuacagaaguaaaagguuauacaaagggaggucccggucaugaggaaccaauuccaauggcuaccuauggauggaacuuaguuaaauugcauucaggaaaagaugucuucuucaugccaccagaaaaaugcgauacgcugcuuugcgauauaggugaaucgaguccuaacccaacaauagaagaaggacguacguuaagaguucuuaaaaugguagagccguggcuaagaggcaaucaauuuugcauaaaaauauugaauccguacaugccaucaguaguagagacuuuagagcaaaugcaaagaaaacacggaggaauguuaguuaggaacccucucagccgaaacucaacgcacgagauguauuggguaaguugcggaacaggcaauauagucucagcugugaauaugacaucacgaaugcugcuuaacagauucacaauggcacauaggaagccuaccuaugaaagagauguagaucucggggcugggacgaggcauguggcagucgaaccugaaguugcgaacuuagacaucauaggacagcgaaucgagaauaucaaaaacgaacacaaaucuaccuggcauuacgaugaagauaacccauauaaaacuugggcguaucauggaucguaugaagucaagccuagcggaagugccucuuccaugguaaaugguguaguuagauugcuaacaaaacccugggaugugauacccauggucacacaaauagcaaugaccgauacuaccccuuuuggucaacagcgaguuuucaaagaaaagguggacaccagaacaccacgagcaaaacguggcaccacccaaauuauggagguaaccgccaaguggcuaugggguuucuuaagccguaauaagaaaccuagaauuugcacacgagaagaguucacaaggaagguaaggucuaaugcggcuauuggugccguauucguggacgagaaucaauggaacagugcuaaggaggcaguagaggaugaaagauuuugggaucuuguacauagagaacgugaauuacacaaacaaggaaaaugugcaaccugcguguauaauaugauggguaagcgcgaaaagaaguuaggugaguucggcaaagcaaaagguagcagagcuauaugguauauguggcucggugcacguuuucuagaauuugaggcuuugggauucaugaacgaggaucauugguuuagcagggaaaauucucucuccgguguugagggcgagggcuuacauaaauugggauauauauuaagagauauaaguaaaauaccuggugggaacauguacgcggaugauacugcggguugggauacuagaauaacagaagaugaucuccaaaaugaagcaaaaauaacagauauaauggaaccugaacaugcguuacuagcaacaaguauuuuuaaacugacauaucaaaacaaaguuguaagagugcaacggcccgcuaaaaacggaaccgugauggaugugauaaguagaagagaucagcgcgguucuggacaaguuggaaccuauggucuaaacacauuuacuaauauggagguacagcuuauaagacaaauggagucagaggggauauuccuuccuucagaacuagaaacaccaaaccucgcaaaacggguauuagauuggcuagaaaaacauggugcugaaagguuaaaaagaauggcaauaucaggugaugauugugucguaaagcccauagaugauagauuugcgacugcgcuaacugcuuuaaaugauaugggcaaagugagaaaggauaucccgcaaugggaaccaaguaaaggguggaaugauuggcagcaaguuccuuucugcucacaucacuuucaucagcucauuaugaaagaugggagagagauaguuguaccguguaggaaucaagacgaacucguuggcagagcuagagugagccaaggagcuggauggagccuaagagaaacagcgugucugggaaaauccuaugcucaaauguggcaacuuauguauuuucaucgcagagaucucagacucgccgccaacgcaauaugcagugccguaccaguggacugggucccuacaucaagaacgacguggucaauacaugcacaucaucaguggaugacaacagaagacauguuaucaguguggaaccggguuuggauagaagaaaauccauggauggaggacaagacucaugugaguaguugggaagaaguuccauauuugggaaaaagagaagaccaauggugcgguagcuugaucggauuaacggccagagcuacuugggcaacaaacauucagguggcgauuaaccagguaaggagauugauugggaacgagaauuaucucgacuacaugacaaguaugaaacgauucaagaacgaaagcgauccagagggcgcacucugguag

SEQ ID NO: 21319 - RNA, 9879 nt, Artificial Sequence
  derived and/or modified CDS sequence (opt6) from DENV-1__FJ547089__SS-prME
ucugucacaaugcuacuaauguuacugccaacugcgcuugcauuucacuugacuacuagagguggugaaccucauaugauaguauccaaacaagaaagagguaaaucacuacuuuuuaaaacaucggcuggugugaauauguguacacuaauagcaauggaucuaggggaacuaugugaagauacuaugacuuacaaaugcccacaaaucacagaagcggaaccugacgacgucgauuguugguguaacgcaacugacacauggguaacauauggaacgugcagccaaacgggagagcaccgucgggacaaaagaucuguugcauuggcaccacacguaggauuaggauuagaaaccagaacugaaacauggaugagcuccgaaggggcauggaaacagauccagcggguagaaacuugggcucuuagacaucccggauucaccguaauagcacuauucuuagcucacgcuauaggcaccucgaucacacaaaaaggaauaauuuuuauacuacugauguuaguaacaccaucuauggcuaugcguuguguggguauaggaaaucgggauuucgucgaaggccugagcggugcaacauggguugacguagucuuggaacacggaucuugcgugacaacaauggccaaaaacaaaccaacuuuggauauagaauuacugaaaacagaggugacaaacccugcaauacuaaggaaauuauguaucgaagcuaaaauaucuaacacuacuaccgacuccaggugucccacucagggagaagcaacguuagucgaagaacaagaugcaaauuucguuuguaggagaacauuugucgacagaggcugggggaacggauguggacuuuuuggcaaagggaguuuauugacuugugcgaaauucaaauguguaacaaaauuagaaggcaaaauuguccaguaugaaaacuuaaaauauucgguaauugucacaguucauacaggugaucaacaucaaguggggaacgagacaacggaacacggaacgaucgcaacuauuaccccacaagcgccaacgucagaaauucaauuaacggauuacggggcccuaacucuugacugcucuccacgcaccggauuggauuucaaugaaaugguguuacugacgaugaaagaaaaauccugguuaguucacaaacaaugguuuuuagaucuaccccugcccuggacaaguggcgcgucaacaucacaagaaacauggaaccgucaagaccuccuaguaacauuuaaaacugcacacgcgaaaaagcaagaagugguuguccuugggagucaagaaggagcaaugcauacugcucuaacaggugccaccgaaauucaaacaaguggaacuacuacgaucuucgcaggucauuuaaaaugucgcuugaaaauggacaaacugacauugaaaggcacuucguauguaauguguacaggaaguuuuaaacuggaaaaagaaguagcagaaacacagcaugguaccguuuugguucaagugaaauaugaagguaccgaugccccuugcaaaauaccuuucuccacgcaagacgagaaaggggucacacaaaauggaaggcuuauuacagcaaaccccauugucaccgauaaagaaaaacccguaaauauugaaacagaaccacccuuuggagaaaguuacauagugguuggugccggugaaaaagcacugaaauuaagcugguuuaagaaagguucgagcauuggaaaaauguuugaagcaacagcccgcggugcacguagaauggcuauucuaggagauacagcaugggacuucggaaguauuggaggaguauuuaccaguguagguaaauuagugcaucaagucuucggcacagcauauggaguacuauuuucaggaguuuccuggacaaugaagauuggaaucgguauuuuauuaacauggcuaggacuaaauucccguucaacuagcuuguccaugacauguaucgcaguugggaugguuacccuuuaccuaggaguaaugguacaagcagauuccggaugcguaauaaauuggaaagggagagagcucaaauguggaucaggaauauuugucacaaacgagguacauacauggacggaacaauauaaauuccaagccgauucacccaaaagacucucggcagcuauugggaaggcaugggaagaaggaguuugcggcaucagaucagcgacuagacuugaaaauauuauguggaagcagaucuccaacgaauuaaaucacauacucuuagaaaacgacaugaaguucacgguuguuguuggggacgcaaacggcaucuuggcacaaggaaagaagaugauacggccacaaccaauggaacauaaauauagcuggaaaagcuggggaaaagcaaaaaucauaggagcggacauccaaaauacaacuuucauaauagacggaccagauacgccagaauguccggauaaccaaagagcuuggaauauaugggaaguagaagauuauggguuuggcauauuuacaacuaacauauggcucaaacuacgggauucauacacacaaaugugcgaucaucgccuuaugucagcggcuauaaaggacaguaaggcgguucaugcggacauggguuauuggauagaaucagagaaaaaugaaaccuggaaacuugcgagggcaucauuuauagagguuaagaccugcacauggccaaaaagccauacguuguggucuaaugguguucucgagagugaaaugauaauaccaaaaauuuauggagguccaauaagucaacacaauuaucgaccugguuauuucacccaaacugccggacccuggcauuuaggaaaauuagaauuggauuuugaccuuugcgaaggaacaacaguagucguagacgaacauugcgggaaccgcggcccuaguuuaagaacuacgacggucaccggaaagacuauacaugaaugguguugccgaucguguacuuuaccuccacugagauuucgaggagaagauggaugcugguacggaauggaaauaaggcccguaaaggaaaaggaagaaaaucucguaagaaguauggucagugcggguucuggugagguggauucuuuuagcuuaggcauacuaugcgccucaauuaugauagaagaagucaugcgaucacgauggagucguaagaugcuaaugacaggcacacuagccguauuucuguuacuaauaaugggacaauuaacauggaacgaccuaauacggcuaugcauuaugguaggagcaaacgcgagcgaucgaaugggcauggggacuacuuauuuagcucucauggcaacguucaaaaugcgaccuauguuugcugucggccugcuguuccgucgccugaccuccagagaaguacucuugcucacaauaggucuaucucucguagcaagcguggaacugccaaacucgcuagaagaacugggagacggucuagcaaugggaauaaugaugcuuaaauuauugaccgaguuucaaccccaccaacuguggacaacucuccucucucuaacuuuuauaaaaacgacucugucccuugauuacgcauggaaaaccacugccauggcauuaaguauuguaucauuguuuccuuuaugucugaguacuacaagccaaaagacaacuuggcuaccagugcuacuagguagcuuuggauguaaacccuuaacuauguuucugauaacugagaauaagauuugggggcgcaagagcuggccauuaaaugaagguauuauggcuaucggaauaguuaguauauuauuaaguagcuuacucaaaaaugacguuccucuagccgguccuuuaaucgccggugggaugcuaauagcuugcuacguaaucucaggaaguucggccgacuuaucucuagaaaaagccgcugaaguaucaugggaacaggaagccgaacauucagguacaucgcacaacauauuaguggaaguacaagacgacgguacgaugaagauuaaagacgaggaacgagaugauacucuuacuauacuauuaaaagcgacacuuuuggcuguuucuggcguauaccccaugucaauaccugccacauuauuuguaugguacuuuuggcagaagaagaaacaaagaucaggaguauuaugggauaccccgagcccaccugagguagagcgugccgugcuggaugacgguauuuaccguauucuacagcgagguuuacuaggaagaucgcaagugggggucgguguuuuccaagacggaguauuccauacaauguggcacgucacgcgaggagcgguucuaauguaucaagggaaacgauuagagccuaguugggcaagcgucaagaaagaucuaaucucauauggcgggggauggagauuucaagguucuuggaacacaggggaggaaguacaaguuauagcuguugagccaggcaaaaauccgaaaaacguacaaaccacgccggguacuuuuaaaacgcccgaaggagaaguaggugcuauagcgcuagacuucaagcccggcacgucuggcucacccauaguuaacagagaaggaaagauaguagguuuauauggaaauggaguuguaacuacaagcgguacguauguaucggcgaucgcucaagccaaagcaagccaagaaggaccgcugcccgaaaucgaagaugaaguuuucaagaaacgaaaucuuacaauaauggauuuacauccagguucaggcaaaacaagaagauaccuuccagccauaguacgagaagccauaaaacgcaaacuuagaacccuaauacuagcacccacacgggucgucgcgucagaaauggcagaagcguuaaaaggcaugcccauacgguaucaaacaaccgcaguaaaaagcgagcauacagguagagaaauagucgacuugaugugccaugcaacauuuacaaugcgccuucuauccccgguucgugugcccaauuauaauaugauaaucauggaugaggcacauuuuacggauccagcaaguauagcugcucgaggcuacauaucaacacgaguagguaugggagaagcagcagcgaucuuuaugacagcaacaccuccugguaguguagaagccuuuccucaaucgaacgcggugauacaggacgaggaacgggacaucccagaaagaaguuggaacagcggcuaugacuggauuacagauuuuccuggaaaaacaguaugguucguaccuucuauaaaaucaggaaacgauauagcuaauugccuaaggaaaaacgguaagagaguaauucaacuaucaagaaaaacauuugauacggaauaucagaaaacaaagaacaacgauugggacuacguaguuacaacugauauauccgaaaugggagccaauuuuagagcugauagagucauagauccgcgacguugccuaaagccagucauucucaaagauggaccagaaagaguaauauuagcugggccgaugccgguuacaguagcaucagcugcccaaaggagaggucgaauaggaaggaaucaaaauaaagaaggcgaucaauacguauacaugggucaaccucugaacaacgacgaggaccaugcucauuggaccgaagcgaaaaugcuucuagauaacauaaauacccccgaaggaaucauuccagcgcuguucgagccagaacgagagaaaagcgcugcuaucgacggagaauacagauuaaggggugaggcgagaaaaacauuugucgaacucaugaggaggggugaucuaccuguaugguuaaguuacaaagucgcaucggaagguuuccaguacucagaucgcagaugguguuuugauggcgaaagaaacaaucagguuuuagaagaaaauauggacguugaaauuuggacuaaagagggagaaagaaagaaauugagaccuagauggcuagaugcgaggaccuauucugacccucuugcgcuaagggaguuuaaggaauuugcggcaggaagaagaucuguaucuggagaucucaucuuagaaaucgggaaacugccacaacacuuaacacuacgagcccaaaaugccuuggauaacuugguaauguugcacaauucagaacaaggugguaaagcauacagacacgccauggaggaacuaccagauacuauugaaaccuuaaugcugcuugcacuaauagcuguacugaccggaggagucacuuuauucuuucucaguggcaaaggucugggcaaaacgucuauaggccuguugugcgugaccgcuucaagugcuuuacucuggauggcaagcgucgaaccacacuggauugcggcauccauaauacuugaguucuucuuaaugguauuacuaauuccagaaccugauagacaacguacaccacaagauaaccaauuggcuuacguuguaauaggccuacucuuuaugauuuugacaguugcggccaaugaaaugggacuauuggaaacuacaaagaaagaucucgggauaggacacguggcagccgaaaaucaucagcacgcuacuauguuagacguagaucuccgacccgcuucagcuuggacauuauaugcaguugcgacaacaguaaucacacccaugaugagacauacuaucgaaaacacaacugcgaacauaucucucacagcuauagcgaaccaagcugcuaucuuaauggguuuagacaaaggguggccaaucuccaaaauggauauaggagucccuuuguuagcucuaggaugcuauucacagguuaacccuuuaaccuuaacugcagcuguauuaauguuaguagcccauuaugccauuauagguccuggacuacaggcgaaagcaacaagggaagcgcagaaaagaacugcugcggguauuaugaaaaacccaacuguugacggaauagucgccauugaccuugauccagugguguaugaugcgaaauucgaaaagcagcugggccaaauaauguuauuaauuuuauguacgagucaaauacuuuuaaugcgaacuacaugggcgcuaugugaauccauaacucuugcaaccggaccucucacuacgcucugggaaggaucucccggcaaguuuuggaauacaacuauagcugucucaauggcaaacauauuuagagguucauaucucgcaggcgcagggcuugcauucucgcuuaugaaaagccuaggcggaggaagaaggggaacaggugcacagggcgaaacacuuggagagaaguggaaacgacaacuaaaucagcugagcaaaucggaauuuaacacauauaaacgaucuggaauuauggagguagauagaagcgaagcuaaagaaggguugaagagaggagaaaccacaaagcaugcggugucuagaggaaccgcaaaguuaagaugguuuguagaacgaaaccuggucaaaccugagggaaagguaauagauuuagguugcggacgaggcggcuggaguuauuacugugcaggacuuaagaaagugacagagguaaaaggauacacuaagggggugccagcacgcgaagaaccuauuccaauggccacuuauggguggaacuuaguaaaauugcauaguggcaaagauguauucuucaugccaccggaaaagugugauacauuacucugugacauuggugaaucuaguccuaacccaacgauugaagaaggcagaacauuacgcguauuaaaaaugguagaaccauggcuaagggggaaucaguuuugcauaaaaauuuuaaauccauacaugccaucugucguugaaacucuggagcaaaugcagagaaaacauggugguauguuaguucguaauccacugagucgaaauaguacccaugaaauguauuggguuucaugugguacugguaauauagugucugcgguuaacaugaccaguaggauguugcugaaccguuuuacuauggcucacaggaagccaaccuacgaaagggauguugauuuaggagcugggacaagacauguagccguugaacccgaaguagccaauuuagacauaauaggccagagaaucgaaaacaucaaaaaugaacauaaaucuacuuggcacuaugacgaagacaacccauacaagacgugggccuaccacggaucguaugaaguaaaaccaagcggcucugcaucauccaugguaaauggagugguaagauugcugacaaaaccuugggauguaauaccgaugguaacacaaauagcaaugacugacacaacaccauucgggcaacaaagaguauuuaaagagaagguggacacgcguacaccucgggcuaaaagaggaaccacucaaauaauggagguuaccgcuaaaugguuguggggcuucuugucgcgaaacaagaaaccaaggauuugcacacgagaagaguucacucggaaaguaagaucaaaugcggcaaucggagcgguguucauugacgaaaaucaguggaauagugcaaaagaagcuguagaagaugagcguuuuugggacuuaguccaccgagaacgcgagcuucauaaacaagggaaaugcgcuacauguguauauaacaugauggggaagcgagagaagaaguuaggggaguuuggcaaagcaaaggguucaagggcuauaugguacauguggcuuggcgcuagauuucuugaguucgaagcccuuggauuuaugaacgaagaccauugguucaguagagaaaacagcuuaucaggggucgagggagaaggccuacauaaguuagguuauauuuugcgugauauaagcaaaaucccaggaggaaauauguaugcggaugauaccgcgggaugggauacaaggguuaccgaggaugaccuacaaaacgaggccaaaauaacagauauuauggagccagaacaugcacucuuagccacgaguauauuuaaacugaccuaucaaaacaaaguaguccggguucagagaccagccaaaaacggcaccguuauggaugucauaucaaggcgagaccaacguggaucggggcaaguuggaacauauggauuaaacacauuuacaaacauggaaguccagcucauaaggcagauggagucggagggaauauucuugccaagugaauuagaaacaccuaaucuggcugaaaggguuuuggacugguuagaaaaacauggcgccgaacgacucagaaggauggcuauauccggugaugauugcgugguaaaaccgaucgaugacagauucgcgacagccuuaacugcacucaaugauauggguaaaguacgaaaagauauaccgcagugggagccuucgaaaggauggaacgacuggcaacaaguaccuuuuuguucucaucauuuucaucaauuaauaaugaaggacgggcgcgaaaucgucgucccaugucgaaaucaggaugaguugguuggucgagcgcgaguaucacaaggcgccggauggucucuacgagaaacggcuugcuugggcaaaagcuacgcgcagauguggcaguuaauguacuuccaucgacgugaucuaagacuugcagccaacgcuauauguucggcgguuccuguagauuggguccccacgucuaggacuaccuggucuauacacgcgcaucaccaguggaugacuaccgaagauauguuaucuguguggaaucgaguauggauagaagagaacccauggauggaagauaaaacucacgugucaaguugggaagaaguucccuacuuagguaaacgugaagaucaauggugcggcucccuuaucggacuaacagcucgagcaacgugggcaaccaauauacaaguggcuauaaaccaagucagaagguuaauaggaaaugaaaacuauuuggauuauaugacuuccaugaagcgcuucaaaaaugaaagugauccugagggagcccuuugguga

SEQ ID NO: 21320 - RNA, 9879 nt, Artificial Sequence
  derived and/or modified CDS sequence (opt6) from DENV-1__FJ024484__SS-prME
ucagucacuauguuguugaugcuucuaccaacggcguuagcauuucaccugacgacacgaggaggagaaccacacaugauaguaaguaaacaagaaaggggaaaaaguuuacuauucaaaacaagugcugggguuaacaugugcacacuuauagcgauggaccuaggagaacuaugugaagacaccaugacauacaaaugcccgcaaaucaccgaagcagaaccagaugauguggacugcugguguaaugcgacugauacauggguuacauacggaacauguucacaaacgggggaacauaggcgcgacaagaggucuguagcacuugcuccacauguaggucugggguuagaaacuagaacggaaacuuggaugaguuccgaaggagcauggaaacaaauucagagggucgaaacaugggcuuuaagacacccaggguuuacagucguagcauucuuuuuagcacaugcaauagggacaucaauuacucagaaagguauaauuuuuauucuuuuaaugcugguuacgcccucaauggcuaugcgguguguuggaaucgggaacagagauuucguagaaggauugucuggggcaacauggguagauguaguacuagaacauggaagcugugugacaacgauggccaaaaauaaaccaaccuuggacauugaacuucugaaaaccgaagugacaaauccugcuauccugcgaaaacuaugcauugaagccaaaauaucaaacacaacgacugauucccgaugucccacacaaggugaagccacauuaguggaagaacaggacgcaaauuucguuuguaggaggacauucguggauaggggaugggggaauggcugcggccuauuuggaaaaggaucacuacuaacaugcgcgaaguucaaauguguaaccaaauuagaaggcaaaauagugcaauaugagaaucuaaaauacaguguuaucguaacggugcacacgggagaucaacaccaaguggguaaugaaacgaccgaacacggaaccauagccacaauaaccccgcaagccccaacauccgagauacaauuaacagauuacggagcacuaacacuagacugcagcccccgaacuggucuggauuuuaaugagauggucuuauuaacuaugaaagaaaagucauggcuggugcacaaacaaugguuccuggaucuacccuuacccuggacaagcggagcuucgacgucucaagaaacuuggaauagacaagacuugcuagucacuuucaagacagcccacgccaagaaacaagaagugguagucuuagguucacaagagggugcuaugcacaccgcuuugaccggagcaacggagauacaaacaagcgguacgaccaccaucuucgcaggucacuuaaaaugccgguuaaaaauggauaaacuuacucuaaaaggcacaagcuacguaauguguacagguucuuuuaagcuagaaaaagaagucgcagaaacucagcauggcaccguccuggugcaaguaaaguaugaagggaccgaugcuccauguaaaauaccauuuaguacgcaagacgaaaaaggaguaacccaaaaugggagacuuauaacugcgaauccuauuguuacagacaaggagaaacccgucaauauagaaaccgagccaccauucggagagucauauauagugauuggggcuggggaaaaggcauuaaaauuaucgugguuuaagaaagggaguaguauagguaaaauguucgaagcaaccgcacgaggugcacggagaauggcaauacugggagauacagcaugggauuuuggaucaauaggcggaguauucacaagcguugggaagcuaguacaucaaguguucggaacagccuacggaguccuguucucgggcgucagcuggacgaugaaaauagggaucggcauccuacuuacuugguugggguuaaauucaagaucaacaagccucucuaugacuuguauugcaguagggaugguaaccuuauauuugggaguaaugguacaagcugauagcggcugcguaaucaacuggaaggggcgcgaauuaaaauguggaucaggaaucuucguuacuaaugagguacauacuuggaccgaacaauauaaguuccaggccgacucuccgaaaagguugucugcugcgaucggcaaggcaugggaagaagggguuugcggaaucaggagugcaacacgacuagaaaacauaauguggaaacagaucucaaaugaauugaaccauauacucuuggaaaacgauaugaaauuuacuguaguaguaggggaugcaaauggaauauuagcacaaggcaagaaaaugauaagaccucaaccaauggaacacaaguauaguuggaaaucgugggguaaagcgaaaaucauaggugcggauauacaaaacacgaccuucauaauagauggaccagauacaccggaauguccggacgaucaaagagcuuggaacauuugggaagucgaagacuaugguuucggcaucuuuacgacuaacauauggcucaaacuuagagauaguuauacgcagaugugugaucauagacuuaugucggcugcgauuaaagauuccaaagccguacaugcagacauggguuauuggauugaaucggagaaaaaugaaacuuggaaacuagcucgggcgagcuuuauagagguaaaaaccuguacuuggccaaaaucucacacccuguggaguaacggaguauuagaaagcgagaugauaauuccaaaaaucuauggcgggccgauaagucagcacaacuauagaccgggauauuucacccaaacagcgggaccauggcaucuaggaaaacuggaauuagacuuugaccucugugaagguacuacgguuguaguugacgaacauugcgguaauagaggaccaucauuacguacuacaacaguaacaggaaaaauaauccacgaaugguguugccguucuugcacacugccaccucuaagauuccgaggagaagauggauguugguauggaauggagaucaggcccguaaaagaaaaagaggagaaucuagugcguuccauggugagugcagguagcggugaaguggauaguuucagccuaggaauauuaugcgcgucaauaaugauagaagagguuaugcgcuccagguggagucguaaaaugcugaugacggguacucucgcuguguuuuuguuacuaaucaugggacaacucaccuggaaugaucuuauaagauuguguaucaugguuggagcaaacgccagugacagaaugggaaugggcacgacauaucuagcccucauggcgacauuuaagaugaggccgauguucgcagucggacuacuauucaggagguuaacuagcagagaaguacuccuacuaacaauaggccucagcuuggucgccucggucgagcugcccaauucuuuagaagaauuaggugauggauuagcgaugggaauuaugauguugaaauuacuaacagaauuucagccgcaucaauuauggacuacccuccugucccuaacauucauaaaaaccacacuuagcuuagacuaugcguggaaaacaacugccauggcucucuccauaguaucauuguuuccauugugcuuaaguacuacaagucagaaaacuaccugguuaccaguacuuuugggcucauuuggcugcaaaccuuuaacgauguuucuuauaacagagaauaaaauuuggggccguaaguccuggccuuuaaacgaaggaauaauggcaauugggauugucucaauacuuuugaguagucuuuugaaaaacgauguaccucuagcgggcccacuaauagcaggaggaaugcuuaucgcuugcuacgugaucucgggaucuuccgcagaucuaagccuggagaaagcagccgaggucaguugggagcaggaagccgaacauagcggaacaucacacaauauauuaguagagguacaagaugaugggacaaugaaaauuaaggacgaagagaaagacgauacacucacuauuuuacuuaaggcgacuuugcuugcgguuucuggaguauacccaaugaguauucccgccacuuuauuuguuugguauuucuggcagaaaaagaaacaacggaguggaguuuuaugggauacaccuuccccaccagaaguugaacgagccguuuuagaugacggaauauaccgcauacuccaaagaggauuguuaggucguagucaggucgguguaggcguguuccaagauggcgucuuucauacgauguggcauguaacaagaggggcugucuuaauguaccaggguaaacgcuuagaaccuaguugggcaagcgugaaaaaggauuugauaucauauggaggcggauggagauuucaaggauccuggaauaccggugaagaaguacaggucauagcuguagaaccgggcaaaaaucccaaaaauguucaaacaacgccugggacauucaagacaccagagggggaaguuggagccauagcuuuagauuuuaaaccaggcaccagugguucucccauuguaaauagagaaggcaagauagucggauuauaugguaacggaguagugacgaccucaggaacauauguaucugcaauugcgcaagcgaaagccagccaggaggggccauuacccgaaauugaggacgaaguauuuaaaaagagaaauuuaacuauaauggaccuacacccuggaagcgguaaaacgaggagguaucuacccgcaauagucagagaagcuauuaagagaaaauugagaacacuaauauuagcgccaacacgagugguagcgucagaaauggcagaggcuuuaaaaggaaugccuaucagauaccagaccacagccguaaagucagaacauacuggacgagaaauugucgaccuaaugugucaugcaaccuucacgaugcgucuauuaucuccggucagaguaccaaauuacaacaugauaauaauggaugaggcccauuuuacagacccagcaucuauagcagcacgggguuauauaagcacacgugucggaaugggagaagcugcggcaauauuuaugaccgcgacaccaccaggaaguguagaggcuuuuccucaaucaaacgcagucauacaagacgaggagagggacauaccagaacggucauggaauaguggcuacgacuggauaaccgacuuuccugguaagacaguuugguuuguuccuagcauaaaaucugguaaugauauagcuaacugucugcguaaaaauggaaagcgaguuauacagcuuucuagaaagacuuucgauacggaguaucagaagacgaaaaacaacgacugggauuacguuguuacaacagauauaagcgagaugggagcuaauuuuagagcagcacggguaauugauccaagaaggugucuuaagccagugauuuuaaaggaugggccggagcgagugauccuugcaggaccgaugccgguuaccguagcuucagcugcgcaaagaagaggaagaauaggcaggaaucagaacaaagagggugaucaguaugucuauaugggucaaccauuaaacaacgaugaggaucacgcucauuggacggaagcaaaaauguuauuagauaauauuaauacacccgagggcaucauaccugcgcuguucgaaccagaacgagagaaaagcgcagcuauagacggagaauacagacuaagaggggaagcucgcaaaacuuucguugaauuaaugcgaaggggugauuuaccugucuggcucucauauaaagucgcaucugaaggguuucaauauagcgauaggcgauggugcuucgauggagaacgaaauaaucagguuuuagaagagaauauggacguugaaaucuggacaaaggagggagaaagaaagaaauuaaggccacguugguuggaugcaaggacguauucagauccguuagcccuaagagaguucaaggaauuugccgcaggaagacgaucagugucuggcgaccugauauuagaaaucggaaaauuaccucaacauuuaacguuaagagcucaaaacgcauuagacaauuuaguaaugcugcauaacucggagcaagggggaaaggcauauagacaugcuauggaagaguuaccugauacuauagagacuuugauguuauuagcuuuaauagcgguauuaacugggggugucacauuauucuuccuuagcggaaaaggacuggguaaaaccucaauugguuuacuuuguguaacggcaagcagugcgcucuuauggauggcaucugucgaaccgcauuggauagccgcuucaauuauacuggaguuuuuccugaugguucucuugauaccggaaccugauaggcaacgaacaccacaagauaaucaacuugcuuauguagugaucggauuauuauucaugauucucacagucgcugcuaaugaaaugggguugcuagaaacuacaaagaaagauuugggaauuggacauguagccgcagagaaccaccagcaugcaaccaugcuagacguagaucugaggcccgcaucggcauggacauuguaugcggucgccacaacagucauaacuccuaugaugcgucauacaaucgagaauacgacagcgaauauuucgcuuaccgccaucgcaaaccaagcggcgauucuuauggguuuagacaaaggauggccaauaucaaaaauggauauaggggucccacuacuagcguugggauguuacucacaagugaacccacuuacacucacagcagcaguucuaauguuggucgcacacuacgcaaucauaggcccaggacuccaagcuaaggcuacaagagaagcacagaaaaggaccgcagcaggaauuaugaaaaaccccacugucgauggaauuguagcaauugaucucgaccccguagucuaugacgccaaauuugaaaaacaacuuggucagauuaugcuccuaauucuaugcaccucucaaauacuuuuaaugagaacaacuugggcucugugcgagaguauaaccuuagcaacaggaccguuaacgacucuaugggaagggucaccagggaaauuuuggaacacaaccauagcagucucuauggccaauauuuuuagaggcucauacuuagcuggugcaggauuagcauuuagucuaaugaaaaguuuaggagguggaagacgaggaacgggagcacagggugaaacacuuggagagaaguggaagaggcaauuaaaccaacuaacaaaauccgaguucaacacauacaaaagaagcgggauaauggaaguugaucgaagcgaagccaaagaaggauuaaagagaggagaaaccacuaaacaugcaguaagcaggggaacagcaaaauugagaugguuugucgaaaggaacuuaguaaagccagaaggaaaagucaucgaccuaggaugugguagagggggcuggaguuacuacugcgcaggacuuaagaaaguaaccgaaguaaagggauacacaaaagggggaccuggacaugaagaaccaauuccuauggcuacuuauggauggaaucuugugaaacuucauagcggcaaagacggcuucuuuaugccgccugaaaaauguggcacacuucuuugugacauaggugagucgucgccaaauccuacaauugaagagggaaggacacuccggguucuaaaaaugguagaaccauggcuacgagguaaucaauuuuguauaaaaauucuaaauccauacaugccaaguguaguagaaacacuugaacaaaugcagcggaaacauggugguauguuagugagaaacccuuuaucccgcaauaguacucacgaaauguauuggguuucauguggaacaggaaacauaguuucggcugugaauaugacaaguagaauguuacugaaccguuucaccauggcgcauaggaagccgacuuacgaaagagacguggauuugggagccggaacgcgucauguggcgguagagcccgaggucgcgaaucuugacauaauaggacagagaauagaaaauaucaaaaacgaacauaagucaacauggcauuaugacgaagauaauccuuauaaaaccugggcauaucaugggucguacgagguaaaaccuucuggaagugcgucaagcaugguaaacggaguugucagacuucuaacaaaaccaugggacguuauaccgaugguaacccagauagcuaugacagacaccaccccauucggacaacaaaggguauucaaagaaaaaguagauaccagaacaccuagagcgaagcgaggaacgacacaaauaauggagguaaccgccaaguggcuauggggcuucuugucuaggaauaagaaaccgaggauuuguacaagggaggaauuuacacggaaaguaagauccaaugcugcaaucggagcaguuuuuguugaugaaaaccaauggaacucagcaaaagaagccguagaagacgaacgcuucugggaccugguacaccgugagagagaacuacacaaacaaggcaaaugcgcuacaugugucuauaacaugauggggaagagggagaagaaacuaggagaguucgguaaagccaagggaaguagagcaauaugguauauguggcuuggagcuagauuccuagaguuugaagcguuagguuucaugaaugaggaucauugguuuucgagagagaauagucuuaguggcguagagggugaaggacuacauaaauuagguuacauacuaagagauaucucuaaaauaccuggagggaauauguacgcagacgauacugcaggaugggauacgagaaucacagaagacgaucuucaaaaugaagcuaaaauaacagacauaauggaaccugaacaugccuugcuugcgacuucuauauuuaaacugacuuaucaaaauaaaguaguuagagugcaaaggccugccaaaaaugguacgguuauggauguaauaucacgaagagaucagagaggcagugggcaagucggaacuuacggucugaacacauuuaccaauauggaggugcaacuaaucagacaaauggaaucagaagguauauuuuuaccuucagaacuugaaacgccuaauuuggcaaaacgaguucuagauugguuagaaaagcauggagcugaaagguugaaacguauggcuauaucaggcgaugauuguguuguuaaaccgauagaugacagauuugccacagcacucacagcacuaaacgauaugggcaaaguaaggaaagauauuccacagugggaacccucuaaagguuggaaugacuggcaacaagugccauucuguagucaucauuuucaucagcuaauuaugaaagacggacgagaaauuguuguaccaugucgaaaccaggaugagcuaguaggucgagcccggguuucucaaggggcuggcuggagcuugagggaaacagcgugccucggaaagaguuaugcacaaauguggcagcucauguauuuucaucgucgcgauuuaagauuagcagccaacgcaauuugcagcgccguaccaguagacuggguaccaacaagccguacaaccuggucuauacaugcacaucaccaguggaugaccaccgaggacaugcuaaguguguggaacagaguguggaucgaagaaaacccauggauggaagacaaaacucacguaagcaguugggaagaaguacccuaccuaggcaaaagagaagaccagugguguggcucuuugauuggacucacagcuagagccaccugggcaacaaacauacaaguggcgaucaaucaaguaagaagacuuaucggaaacgaaaacuaucuugauuauaugaccaguaugaagcguuucaagaacgaaagugauccugaaggagcucuaugguag

SEQ ID NO: 21321 - RNA, 9879 nt, Artificial Sequence
  derived and/or modified CDS sequence (opt6) from DENV-1__EU596503__SS-prME
agcguaacuauguuauuaaugcuauuaccuacagcgcuagcauuucauuuaacaacaagaggaggggagccccacaugauaguaagcaaacaagaacgagguaaaucucuacuuuuuaaaacuucagccgggguuaauauguguacguugauagcgauggaucuaggagaguuaugcgaagauacgaugacauauaaauguccgcaaauuacagaagcagagccugaugauguggauugcuggugcaaugcaacagauacguggguaacuuaugguaccuguucacaaacuggcgaacauaggagggacaaacguagcguagcgcuagcaccucauguugguuuaggguuggaaacacgaacugaaacuuggaugagcagcgagggcgcguggaaacaaauacaaagggucgaaaccugggcauugagacauccaggguuuacuguuauagccuuauuuuuagcccaugcgauagguacguccauaacucaaaaagguauaauauuuaucuugcugauguugguaacuccuagcauggcaaugcgaugcguagguauugggaaccgggauuuuguagaaggacugaguggagcaacauggguggaugucguauuagaacaugguuccuguguaacuaccauggccaaaaauaaaccuacauuagauauagaacuauuaaaaacagagguaaccaaccccgcuauacuccgaaaauuauguauagaagcaaaaaucaguaauacaacaacggacagcagaugucccacacaaggugaagcaacauugguagaagaacaagacgccaauuuuguuugucgcagaacauuuguggacaggggaugggggaacggauguggauuauuugggaaagggucauuacuaacgugugcaaaauucaaaugcguaacgaaacuggagggaaaaauaguccaauacgaaaauuuaaaauacucaguaauugugacuguucauacgggagaccagcaucagguaggcaacgaaacaacagaacauggcacuauugcaaccauuaccccacaagccccaacaucagaaauucagcuuacugauuauggcgcauugacuuuggauugcucuccucgaacaggucuugauuuuaacgagaugguucuacuuacaaugaaagaaaagucauggcuuguucauaaacaaugguuucuagaucucccgcuccccuggacaucaggugcuaguacuagccaggaaacguggaacagacaagaucuacucguaacuuuuaaaacugcacaugcuaagaaacaagagguagucgucuuaggcucucaagaaggagcaaugcacacagcauuaacaggcgcuacagaaauacaaacaaguggaacaacuacaauuuuugcaggucaucuuaaaugccggcucaaaauggacaaacugacuuuaaaagguacaaguuacgugaugugcauaggaaguuuuaaacuggagaaagagguugcggaaacucagcaugguaccguucuuguacaggugaaguaugaaggaacggacgcuccuugcaagaucccuuucucaacucaagacgaaaaggguguaacucaaaauggacguuugauaacagcaaacccuauagugacagauaaagagaaaccuguaaauaucgaaacagaaccaccuuuuggggaaucuuauauaguaguaggcgcaggcgaaaaagccuugaaauuaucaugguucaaaaaggguuccaguauugggaaaauguuugaggccaccgcaaggggugcacgaagaauggcaauccuuggcgauacagcaugggauuuuggcucaaucggagguauguucacgucaguuggcaaacuuguucaucagguauucggcacugcguaugguguauuguuuuccggcgucucauggacaaugaaaaucggcaucgguaucuuauugacuuggcugggauuaaacucuagaagcacgagucuaaguaugacguguauagcuguuggaaugguuacgcuuuacuugggaguuauggugcaagcugauagcggaugcguaaucaauuggaaagguagagaauuaaaaugcggaucagggaucuucguuacaaacgaagugcauacauggacggagcaauacaaauuccaagcagauaguccuaagcgacuaucugcagcuauaggaaaagcaugggaggaaggaguuugugggauaagaucagcaacuagguuagaaaauauuauguggaaacagauuaguaaugaauuaaaccacaucuuacuugagaaugacaugaaauuuacaguggugguuggagaugcuaacggcauuuuagcccaagguaaaaagaugauccggccacagcccauggaacauaaauauagcuggaaaagcuggggaaaagccaaaauaauuggagcggauauucaaaauacaaccuucauaauagauggccccgacacaccagaguguccggauaaucaacgagcuuggaacaucugggaagucgaagacuacggcuuugguauuuuuacaacuaauauuuggcuuaaacucagggauaguuauacgcaaaugugcgaccauagguuaaugucugcagcaauuaaggacucaaaagcuguccaugcagacaugggauacuggaucgaaucagagaaaaaugaaacauggaaguuagcaagagccagcuuuaucgaagucaaaaccugcacauggcccaaaucacauacacuuuggaguaauggaguuuuagaaucagaaaugauuauacccaagauauauggagguccgauuucacagcacaacuauagaccuggauacuuuacacaaaccgcuggcccauggcauuuaggcaaacuagaauuagacuuugacuuaugugaggggaccacgguagucguugaugaacauugugggaauagagggccaucccuuagaacuacuacaguuacuggaaaaauaauucacgaauggugcugucgaaguuguacacuuccaccucuacguuucaggggagaagauggaugcugguaugguauggagauuagaccuguuaaggaaaaagaagagaacuuagugagaucuauggucucagcggguaguggagaaguugauucauuuucacuaggcauccuaugugcaucgauaaugauagaagaaguaaugcgaagcagauggagcagaaaaaugcuaaugacaggcacguuagcaguauuuuuauuauugauuacaggucagcuaacuuggaaugaccuuauacguuuaugcauuauggucggagccaacgcgucggaccggaugggaauggguacgaccuaucucgcgcuaauggccacuuucaaaaugagacccauguucgcuguaggauuacuauucaggcgguuaacuagcagagaaguccuguuacuaacuauaggauugaguuugguagcgucaguagaauuaccaaauagccuagaagaacuaggagacggacucgcgaugggcauuaugauguugaaacuucuaacagaguuucaaccccaucaauuauggacaacucucuuaagucuaacguuuauaaaaacuacauuaaguuuagauuaugccuggaaaaccaccgcaauggcucuuuccauugugaguuuauucccacucugccuaagcaccacuucucagaaaacaaccuggcuaccggugcuucucgggagcuucggguguaaaccacucaccauguuccuaauaacugaaaauaaaauuuggggacgaaaguccuggccacuuaacgagggaaucauggcgauuggcauaguaaguauucuauuaucgucauugcuaaagaaugauguaccauuagcagggccacuaauugcaggcgguauguuaauagcgugcuauguaaucaguggauccucugcagaccugucacuugagaaagccgcggagguuucuugggaacaagaagcggaacacagcggaacaagucauaauauuuuaguggaaguacaagacgaugggacaaugaaaauuaaagacgaggaacgugaugauacgcugacgauucuacugaaggccacguugcuagcgguuaguggcguuuacccgaugucaauuccagccacacuguuugucugguacuuuuggcagaagaagaaacaacguucgggcguauugugggauacacccucuccgccugagguugaacgcgcaguacuugaugacggaauauauaggauccuucaaagagguuuguuaggaagaagccaaguugguguugguguauuucaagacggagucuuucauacaauguggcacguaaccaggggugcuguacuaauguaccaagguaaaaggcuagaaccaucuugggcuucggugaagaaagauuuaauaagcuauggaggcggguggagauuccaaggaagcuggaacacuggagaggaagugcaagucaucgccguggaaccgggcaaaaauccuaagaauguacaaacaacaccggguaccuuuaagacgccggaaggagagguuggagcaaucgccuuagacuucaaaccuggcacgucuggcaguccuauagugaacagggaagggaaaaucgucggucuguaugggaauggcguugucacaaccucuggaacguauguaucagcuauagcccaggcgaaagcaucacaggaagguccacuccccgagauugaggacgaagucuuuaagaaacgaaauuuaacaauaauggaccuacaucccgguagcggaaaaacucgaagauaccugccggccauuguacgagaagcaauaaaaaggaaacuuagaacacucauacuagcuccaacuagaguaguugcuucugaaauggcugaagccuuaaaagguaugccuauuagauaucaaacaacugcggucaaaucagaacacacaggaagagaaaucguugaccuaaugugccacgcuacauuuacgaugcggcuauugucuccaguacggguuccuaauuacaacaugauaauaauggaugaggcacauuuuacugacccugcuagcaucgcagcgagagguuacauaucuacaagagugggcaugggagaagcagcugcaauuuucaugacggcaacaccaccuggguccgucgaagcauuuccacaaucuaaugcggugauucaggaugaagaaagagauauuccagaaaggaguuggaauaguggauaugacuggauuacugauuuucccggcaaaacuguaugguuuguacccaguauuaagucagguaaugauauagcaaacugccugaggaaaaauggaaaaagggucauccaacuaucacgaaaaacuuuugauacagaguaucagaaaaccaaaaauaacgauugggauuacguaguaacgacugacauaucugaaaugggggcaaauuuucgcgcagauagagucauagauccaaggcgaugucugaaaccagugauccugaaagauggccccgagagaguaauuuuagcaggcccaaugccagucaccguagccagugccgcucaacgaagggggaggauuggacgaaaucaaaacaaggagggagaccaauauguuuauaugggacagccucugaauaacgaugaggaccacgcccauuggacagaagcaaaaauguuauuagauaacauaaauacgccugaagggauuauaccagcuuuauuugaacccgaacgagagaaaucugcugcgaucgauggagaauacagauuaaggggagaagccaggaagacauucguagaacuuaugcgcagaggggacuuacccguguggcucuccuacaagguagcguccgagggauuucaauauucagacagacgcuggugcuucgacggggaacggaacaaucaagugcuugaagaaaauauggacguagaaaucuggaccaaagaaggcgaaagaaagaaacuacguccacgauggcuugaugcaagaacguauuccgacccuuuagcuuugagagaauuuaaagaauuugcagcuggucgaagaagcguuagcggcgauuuaauauuggaaauaggcaaauuaccacaacauuugacauuaagagcccaaaaugcgcuggauaaccuuguaaugcuacauaauagugagcaagguggaaaggcuuaccggcacgccauggaagaacuaccagacacaaucgagaccuuaaugcuuuuagcacuuauagcuguccugacuggaggcguaacucucuucuuuuuaagcggaaaggguuuaggcaagacuagcauuggacuacuuuguguaacggcuaguagcgccuuacuuuggauggcaagugucgaaccacauuggauugccgccucaauaauucuagaguucuuucuaaugguacuuuuaauaccagaaccagauagacagagaaccccacaagacaaccaacuagcauacgucgugauaggucuauuguucaugauauuaacaguugcagcaaaugaaaugggcuuacuugaaaccacaaagaaagacuuaggaauaggccacgucgcagccgaaaaucaccaacacgcuacgauguuggacguugaucuacgacccgcaagcgcuuggacucuuuaugcaguagcuacaacagugauaacaccgaugaugagacauacaauagaaaauacuacagcgaacaucagcuugacagcuauagcuaaucaagcagcaauauuaaugggccuagacaagggauggccaauaaguaaaauggauauagguguaccccuguuggcccucggaugcuauucacaaguaaacccauuaacccuuaccgcggcuguuuuaauguugguagcgcauuaugcgauaauagggccaggccuacaagcgaaagcaacucgugaggcacagaaaaggacugcugcaggaaucaugaaaaacccaacugucgacgggauaguagcaaucgacuuggauccaguuguuuaugacgcaaaguuugagaagcagcuaggacaaauuaugcuacuaauucuguguacaagccaaauauuauuaaugcgcacaacgugggcucuaugugaaaguauuacgcuagcaacagguccauugacuacuuuaugggagggaaguccuggaaaauuuuggaauacaacaauagcaguaaguauggcaaauauauuuagaggaagcuacuuggcuggggcaggacuagccuucucacuaaugaaaucacugggagggggacguagagguacaggugcucagggugaaacauuaggagaaaaguggaaacgacaauugaaccaacuuaguaaaucugaauuuaacaccuauaaacgaaguggcauaauggaggucgaucguucagaagcuaaagaaggcuuaaaaagaggggagacaacaaaacacgcgguaucccgcgguacugcgaaacucagaugguucgucgaaagaaaccuggugaaaccagaaggcaaaguuaucgaucuaggauguggacgaggaggcuggucguacuauugugcaggauuaaagaaaguaacugaaguaaaaggauacacuaaagguggaccagggcaugaggaaccaauuccgauggcuaccuauggauggaauuuagucaaacuacauagugggaaggauguguucuucaugccacccgaaaaaugugacacccucuugugcgacauuggagagagcagucccaaucccacaaucgaagaggguagaacuuugagaguauuaaaaauggucgagccguggcuaagggguaaucaauucuguauaaagauacuaaacccguacaugccaucugucgucgaaacucucgaacaaaugcaacgaaagcacggugggauguuaguacgcaacccauugucuagaaauaguacgcacgagauguacuggguuagcugcggaacaggaaauauaguauccgccgugaauaugacaagcagaauguugcuuaaucgauuuaccauggcccacaggaaaccuacauacgaacgugaugucgaucuaggugccggaacacgucaugucgccgucgaaccggagguugccaacuuagacauaauuggacaaagaauagaaaauauuaaaaaugaacauaaguccacauggcauuacgaugaggacaauccauauaaaacaugggcauaucaugggucauacgagguaaaaccguccgguagugcaucaagcaugguaaauggaguugugcgacuguuaaccaagcccugggaugucauacccauggugacacaaauugcuaugacagauacaacccccuucggccaacagaggguuuuuaaggagaaggucgacacuagaacacccagagcaaaacgcgggacgacccaaauaauggaagugacugccaaaugguuauggggauuuuuaagccgaaacaagaaaccacguauauguacccgagaagaauuuacccguaaaguacgaucaaacgcagcaaucggagcgguauucguugaugagaaccaauggaacuccgccaaggaagcuguagaagaugagagauucugggauuuaguacacagagaacgagaauuacauaaacaaggcaagugcgcuacuugcgucuacaacaugauggguaaaagggagaagaaauuaggagaauuuggaaaggccaaaggaaguagagcgauaugguauauguggcucggcgccagauuuuuagaauuugaagcacuagguuuuaugaacgaagaucauugguucucacgagaaaacucauugaguggaguggagggcgaaggguuacauaaacugggauauaucuuacgagacauaucaaagaucccaggagguaauauguacgcagaugacaccgcgggaugggacacacgaauaaccgaagaugaccuacaaaacgaagcgaagaucaccgauaucauggagccugagcaugcacuauuggcaacuucaauauucaaauugaccuaucaaaacaaagucguccgaguucagcgaccugcuaaaaaugguacaguuauggauguuauuucaagacgagaucaaagggggaguggucaaguggggacauauggacucaacacuuuuacaaacauggaagugcaacugauaaggcaaauggaaagugaaggaauuuucuuaccgucggaauuagaaacacccaaucucgcugaaagaguuuuagauuggcucgaaaaacacggugcggaaagguuaaagcgaauggcuauaucuggggacgauugcguaguuaaaccgauagacgauagauuugccaccgcucuuacugcauugaacgauauggguaaaguuagaaaagacaucccccaaugggaaccaucuaaaggauggaacgauuggcaacagguuccauucuguucccaucauuuucaccaacugauaaugaaagacgguagggaaaucguuguaccaugucgcaaucaagaugaguuggucgggagggcuagagucucucaaggcgccggguggucacuaagggaaaccgcaugccuaggaaaaucauaugcucaaauguggcaacuaauguauuuucaucgcagagacuuacgccuagcagcuaacgcuaucugcagugcuguucccgucgacuggguuccuacaagcaggacuacuuggaguauacacgcucaucaccaguggaugacgacugaagacauguugucaguauggaaccgaguuuggauugaagaaaauccauggauggaagauaaaacacacguaucauccugggaggaaguuccauauuuagguaaacgggaggaucaauggugcgguuccuuaauaggauuaacugcgagagcaacaugggcaacuaacauccaagucgcgauaaaucaaguaagaagauuaauugguaacgaaaauuauuuagacuacaugacuucaaugaagcgauucaaaaaugaaucggacccggaaggagcacuaugguaa

SEQ ID NO: 21322 - RNA, 9879 nt, Artificial Sequence
  derived and/or modified CDS sequence (opt6) from DENV-1__FJ024479__SS-prME
ucagucacaauguuguuaauguuauugccuacugcauuagcguuucaucugacaacaagaggaggagaaccccauaugauagugucaaaacaagaacgcgguaaaucacuauuauucaaaacaucggcuggcguuaauaugugcacauuaaucgcgauggaucucggagaacuaugcgaagacacgaugacauauaaauguccacaaauaacugaagcugaaccggaugauguugauuguuggugcaaugcaacugacacuuggguaacuuauggcacuuguucgcaaacgggagaacauagaagagauaaacgaaguguagcacuagcaccacaugugggacuugggcuagaaacuaggacagaaaccuggauguccagugaaggcgcauggaaacaaauacaacgagucgaaaccugggcgcuacgucauccuggcuuuacuguaauagcuuuauuucuagcacacgcgauuggaaccuccauaacccaaaaagguauuauauucauacuucucaugcugguaacgccaucaauggcaaugcguugugucgguauagggaaccgagacuuuguagagggacuuucuggugcaacauggguugauguaguguuggaacaugggaguuguguuacuacgauggccaaaaacaaaccuacucuagauaucgaauuacuaaagacggagguaaccaauccggcgaucuuaagaaaacucugcauagaagccaaaauuaguaauacgacuacggauucaagguguccaacccaaggggaggcaacgcuaguagaggaacaagaugcaaauuuuguaugccgcaggacuuucguggacagaggaugggguaacgguuguggacuuuucggcaaaggcucguuacuaaccugugcaaaauucaagugcguaacgaaacuagaaggcaaaauaguacaauaugaaaauuuaaaauauagcgugauaguaaccgugcacacaggggaucaacaccaagucgggaaugaaacgacagaacauggcacaauagcuaccauaacaccccaggcuccaacaagcgagauucaacuaacagauuacggcgcacuuacuuuggauuguuccccaagaaccggccucgauuucaacgaaauggucuuauugaccaugaaagaaaagucuugguuggugcacaaacaaugguuucuugaucucccucuaccguggacaaguggagccagcacaucccaagaaacauggaacagacaggauuugcuaguaaccuucaagacagcccacgcuaaaaagcaagaaguuguaguccuuggaucacaagaaggagccaugcacaccgcuuuaacuggugcuacugaaauacagacaucaggcacaacaacgauauucgcagggcaccucaaguguagacuaaaaauggacaaauuaaccuuaaaagguacaaguuauguaaugugcacaggaaguuuuaaguuggaaaaggaagucgcugaaacucaacacggaacaguucucguacaagugaaguaugaagguacagaugccccgugcaaaauaccauuuaguacucaggacgaaaaggguguaacgcaaaacgggagauuaauaacagccaacccaauugucacagauaaagaaaaacccguuaauauagagacugagccgccuuuuggcgaaagcuauauaguugugggagcaggagaaaaagcauugaaacuuucaugguuuaagaaaggaucaucgauaggcaaaauguuugaggcaaccgcacguggagcuaggaggauggcaauucuaggagauacggccugggacuuuggaucaauagggggaguuuuuacgucaguuggcaaacuuguacaucaaguguucggaacagcuuauggcguuuuauuuaguggcguuuccuggacgaugaaaauuggcauuggaauauuacuaacauggcuagggcuaaauagccggaguacuucacuaaguaugacguguauagcuguaggaaugguaacccuauaucuaggagucaugguucaggcugacucgggaugugucauaaacuggaagggcagagaauuaaaaugcggaucagggaucuuuguuacuaaugaaguacauacauggacagaacaguauaaguuccaggccgacucaccaaagagauuaucagccgcaauagggaaggccugggaagaaggaguuugcggaauaagaucagccacacgccuugaaaauauaauguggaaacaaauaucuaacgaguugaaucauauacuauuagagaaugauaugaaauuuaccguaguggugggcgaugcgaauggcauuuuagcccaaggcaagaaaaugaucagaccacaaccaauggagcacaaauacaguuggaaaaguugggguaaagcuaaaaucauaggugcagauauacaaaacaccacuuuuaucaucgauggaccggauacacccgaauguccagacaaccaaagagccuggaacaucugggaaguugaggauuauggauucggauuuuucacaacaaacaucugguuaaagcuaagagauuccuauacucaaaugugcgaccauaggcugaugucagcagcuaucaaagauagcaaagcuguacaugccgacaugggcuacuggauagaaucugagaaaaacgaaacuuggaagcuagcaagagccagcuuuauagaaguaaaaacuuguacauggccuaagucacauacacuauggucgaacggagugcucgaaagugagaugaucauacccaaaauuuacgguggcccgauaagucaacauaauuacaggccaggguacuuuacgcaaacagcgggaccguggcauuuagguaaacuugaauuggacuuugacuugugugaagguacaacaguaguuguugacgaacauuguggcaauagaggcccgucucugcggacaacaacugugaccgggaaaauaauacaugaaugguguuguaggaguuguacuuuaccaccccuuagauuccguggagaagacggguguugguauggaauggagauacggccagucaaagaaaaagaggaaaaucugguuagaucaaugguaucagcugggucgggagagguggauucauucucacuugggauuuuaugcgcaucuauaaugauagaagaaguaaugcguagcagauggucaagaaagaugcuaaugacaggaacuuuggcuguauucuuguuauugauuaugggacagcugacuuggaaugaccuaauaagacuuuguaucaugguuggcgcaaaugcaucagaucgaaugggaauggguacaacauauuuagcuuugauggcuacauuuaaaaugagacccauguucgcaguuggacucuuauuucggagacuaacgucaagagaaguucuauuacuuacuauaggccugagcuuaguagcaucuguugaauugcccaauaguuuagaagaauugggcgauggauuagcuaugggcauuaugaugcuaaagcuauugacagaauuucaaccucaccaacuuuggacuacucuauuaagucuaacauuuauaaaaacuacccuaucuuuggacuaugcguggaagacugcagcaauggcuuugucaauagugagcuuauuuccauugugucuaaguacaacuucccaaaagacaaccuggcuaccaguacuccuugggucuuuuggaugcaaaccauugacuauguuucuuauaacugaaaacaaaauaugggggagaaaaagcuggccguugaacgaagguaucauggcaauaggaaucguuucaauauuacuaaguucauuauugaaaaaugauguuccucuagcgggaccacugauagccggaggaauguugauagcguguuacguaauaagcgguucauccgcagaccuuaguuuggagaaagcagcugagguuagcugggagcaagaggcugagcauagcgguacaagccauaauauacucguagaaguacaagaugauggaacaaugaaaaucaaggaugaggagagggaugacacccuaacaauacuccuaaaggcgacgcucuuagccguuucaggcguuuacccaaugucaauaccagcaacauuauucguaugguauuuuuggcagaagaagaaacagcggucaggcguacuaugggacacccccucgccaccagagguagaacgugcagucuuagacgacggcauauacagaauacugcagagaggacuauuaggacgaucacaagugggaguaggaguauuucaagauggcguauuccauacgauguggcaugucacucguggugcaguauuaauguaccaaggaaaacgucuagagccaaguugggcaagcguuaagaaagacuuaaucuccuaugggggaggauggcguuuucaagguuccuggaacaccggagaagaagugcaaguaauagcuguagaaccagguaaaaaucccaaaaauguacaaaccacuccaggcaccuuuaagacacccgagggagaaguuggagcgauagcacuagauuucaaaccggguaccucggguucaccgauaguaaaucgagaagguaaaaucguaggcuuauacgguaauggcgugguuacaacauccggcaccuaugugucggcaauagcacaagccaaagcgagccaagaaggccccuuaccugaaauagaagaugaaguauuuaagaaaagaaaccuaacaauuauggaucuucauccgggcaguggcaagacaaggagauaucuacccgcaauagucagagaagcgauaaaacguaaguuaagaacauuaauucuagcaccaacaaggguuguagcgucagaaauggcagaagccuuaaaagguaugccaaucagauaucaaacaacagccgugaaaagugaacacaccgggcgcgaaauuguugauuugaugugucacgcuacguuuaccaugcgacuucucuccccgguuaggguucccaacuauaacaugauaauaauggaugaagcucauuuuacggacccagcaucaauagcggcacgcggguauauaaguacgcgcguaggaaugggagaagcagccgccauuuuuaugacagccacaccgccagggagcguugaagcauuuccacaaagcaacgccgugauucaggaugaggagcgggauauaccagagcggaguuggaacucgggguacgauuggauuacugauuuuccaggaaaaaccguuugguucguuccgagcauuaaaucagggaaugacauugcaaacuguuuaaggaaaaauggcaagaggguaauacaacuaucacguaaaacauuugauacagaguaucagaaaacaaagaacaacgauugggacuacguaguaaccacagacauuucugaaaugggagcgaauuucagagcugcgagagugauagauccuagacggugucuuaagcccguaauauuaaaagauggcccugaaaggguuauacuagccgguccaaugccaguaacgguugcuuccgcggcacaaagacgcggucguauagggagaaaccaaaauaaagagggugaucaauacgucuauaugggccaaccacuaaauaacgaugaagaccacgcacacuggaccgaagcgaaaaugcuucuugacaacauaacuacgccagaagguaucauaccagcacuauucgaaccugaaagggaaaagagugcagcaaucgacggagaaaguagauuaagaggagaaccgcgaaaaaccuuuguugaguuaaugcgucgaggugaccuuccggucuggcucaguuauaaaguugcaucggaaggauuccaauacucagauagacguuggugcuuugauggcgagcgaaacaaucaaguucuagaagaaaacauggauguagagauuuggcccaaagaaggagagcgaaagaaauugcgaccaagaugguuggaugcacguacuuauucggauccauuagcgcucggugaguucaaagaguucggcgcuggacggagaaguggcagcggagcuuugauucuagagauuggaaaauuaccacaacacuuaccucuucgagcgcagaauggccuagacaaccuugucaugguacauaauagugaacagggcggaaaagcauaucgacaugcgauggaagaacuccccgacacaaucgaaacacugaugcuguuggcauugauugcuguccucacaggcggcguaacuuuguucuuucucuccggcaaaggacuaggcaaaaccucgauaggccuuuugugcguuacagccucuucagcacuauuauggauggcaucaguagagccacauuggauagcagccucaauaauauuggaguucuuuuuaaugguucuucuaauaccagaaccagaucggcagagaaccccacaagacaaccagcucgcauauguaguaauaggacuucuguuuaugauauuaacuguugcagcaaacgaaaugggacugcuagaaacuaccaagaaagacuuggguaucggccauguagcggcugagaaccaucagcacgcaaccaugcuggacgucgacuugagacccgcgucugcauggacauuauaugcuguagcgacaacgguuauaacaccuaugaugcgacauaccauagaaaacacgacugccaauauuagccuaaccgcgauagcaaaucaagcugcuauauuaauggggcuggccaaggguuggcccaucuccaaaauggauauuggaguuccacuacuggcucuaggauguuauagccaaguuaaccccuuaacccuaaccgcggcaguauugauguugguagcgcauuaugcaaucauuggaccaggacuccaagccaaggccacaagagaagcacagaaaagaacagcggcuggcauaaugaaaaauccaacuguugaugguauaguagccauagaucucgacccagucgucuaugacgcuaaauuugagaaacaacuagggcaaauaaugcuucuuauacucuggacuucucaaauccuguuaaugagaacuacgugggcgcuaggggagucuauuacucuagcuacgggaccuuuaacuacccugugggaaggcucccccgguaaguucuggaauacuacaauagcugucucuauggcgaauauauuucgagggucguaucucgcuggagcaggauuagcauuuucacucaugaagucauuagggggaggacgcagagggacaggugcacaaggugaaacucuuggagaaaaauggaaaagacaguuaaaucaacuaagcaagagugaguucaauacauauaaaagaaguggcaucauggaaguagaucgaucugaagcaaaggaaggcuuaaaaaggggugaaacgacaaaacacgcaguaaguagagguacggcaaaacuaaggugguucguggagaggaaucugguaaacccagaagguaagguuauagaucuuggcuguggacgaggaggauggucuuacuacugcgccggauugaagaagguuacugagguuaaagguuacacaaaaggaggaccuggccacgaggaacccauucccauggcuaccuacggauggaacuuggucaaguugcauucaggaaaagauguauuuuucauaccaccggaaaaaugugacacacuguuaugugauaucggggaaucaaguccaaaucccacaaucgaagaagguagaacucuacgaggucugaaaaugguagagccaugguugcgcggaaaucaauuuuguauuaagauuuugaacccguauaugccuaguguuguagaaaccuuagaacaaaugcagagaaagcacggagggaugcuaguucguaauccguuaucgcggaauagcacgcaugagauggacuggguuaguuguggaacugguaauauagucuccgcugugaauaugacgagcagaaugcuucuaaacagauucacgauggcucacaggaagccgacauaugagcgagacguggaucuaggugcugggacaagacacguugcaguugaaccagaagucgcuaacuuagacauaauugggcaaaggauagaaaacaucaaaaaugaacacaaaagcacguggcauuacgacgaggauaauccauauaaaacaugggcuuaucauggaaguuacgagguaaaaccauccgggucagcaucaagcaugguuaacgggguaguuagacuguugacuaaacccugggaugucauaccaauggugacacaaauugcgaugacagauacaaccccauuuggacaacaaagaguguuuaaggaaaaaguagauaccagaacaccaagagcuaaacgaggcaccacucaaauuauggaagucacagcaaaaugguuaugggguuuucugucgcggaacaagaaaccacgaaucuguacacgugaggaauuuacgcgaaaaguuagaaguaaugcagcuauuggggccguaguuguagacgagaaucaauggaauagcgcgaaagaagccggagaggaugagagggugugggaucuaggagaucgagaaagagaacuacauaaacagggaaaaugugcaaccugugguuauaauaugauggggaaacgugaaaagaaauuaggugaguuuggaaaagccaaagguaguagggcgauuugguauauguggcuaggcgcaagguuuuuagaguuugaagcauugggauucaugaacgaagaucauugguucagcagagaaaauucacugaguggaguagaaggagaaggucuucauaaacuaggauauauucuacgagauauaaguaagauacccggcggaaauauguaugccgaugacacagcaggcugggauacuaggauuacagaagaugaucuacagaaugaggcuaaaauuacugacauaauggaaccagaacaugcucugcuagccacauccaucuucaaguuaaccuaucagaacaaggucguaagaguucaaagaccugcgaaaaacggaacaguaauggacguuauuaguaggagggcccaaagagguucaggucagguggguaccuauggacugaacaccuucaccaacauggagguacaacugauacggcagauggaaagugagggaaucuuucuuccuagcgaacuagagacaccuaaucuagcagaacguguuuuagauugguuagaaaagcauggcgcagaacguuugaagagaauggcuaucagcggagacgacugcguuguuaaaccuauagaugaucgauucgcuacugcucuuaccgcauuaaaugauaugggcaaagucagaaaggauauaccccagugggagcccagcaaagguuggaaugauuggcaacaagucgccuuuuggucccaucacuuucaucaguuaauaaugaaagaugggagggaaauuguaguaccuugcagaaaucaggacgaacuaggggguagagcacgagucagccaaggagcggguuggagccuccgggaaacugcaugucucgguaagucuuacgcacagauguggcagcuaauguacuuccaucguagagaucuacgauuagcggcaaaugcaauuuguucugcagucccuguagauuggguuccgacaucucguacgacauggucaauccacgcccaucaucaauggaugacaaccgaggauauguuaagcguauggaaucgaguuuggauugaagaaaauccuuggauggaagacaaaacccacguuaguaguugggaagaagugcccuaccuaggaaaacgagaagaccaauggugugggagucuaauaggccuaacugcacgagcaaccugggcaacaaacauacaaguggcuauuaaucaaguuagacguuuaauaggcaacgaaaauuaucuagacuauaugacaaguaugaagagauuuaaaaaugaaucugauccggaaggagcauuaugguaa

SEQ ID NO: 21323 - RNA, 9879 nt, Artificial Sequence
  derived and/or modified CDS sequence (opt6) from DENV-1__FJ182002__SS-prME
agugucacgauguuauugauguuguugccaacagcuuuagcauuccacuuaacaacacgaggaggugaaccacauaugauaguaucaaaacaagagagagguaagagcuugcuauuuaaaacuuccgcaggaguaaauauguguacuuuaauugcaauggaccuuggugaacuaugugaagauaccaugacauauaaaugcccucaaauaacagaagcagaaccagacgacguagauugcuggugcaaugcgacagacaccugggucacuuauggaacaugcucacaaacuggagagcauaggagagauaaacgaagcguagcacuggcaccacauguaggauuagggcuagagacuaggacggaaacauggaugucguccgaaggagcauggaaacaaauccaaagaguugaaacuugggcucugagacauccaggguuuacaguuauugcuuuauuuuuagcacacgcuauaggaacuucuauuacucaaaaggguauuauauuuauauuauuaauguuaguaacacccucaauggccaugaggugcguaggaauuggaaaucgagauuuuguugaaggauugucaggagcgacauggguggauguaguucuggaacauggaaguuguguuacaacaauggcgaaaaauaaacccacccuagauaucgaacugcucaaaacugagguaacaaacccugcaauuuuacgcaaauuaugcaucgaagccaaaauaucgaacacgacgacugauucgagauguccgacccaaggagaagcgacauuaguugaagaacaagaugcaaauuucgugugccggcgaacguuugucgaucgaggaugggggaauggaugcggacuauuuggaaagggaaguuugcuuacuugugcuaaauucaaaugcgugaccaaacucgaagguaagauuguucaauacgaaaauuugaaauacucaguaauaguuacagugcacaccggugaccaacaucaagucggaaacgaaacaacagagcauggaacuaucgcaaccauaacaccucaagcgccaacaucagaaauacaacuaaccgacuauggugcuuugacccuagacugcucaccucguaccggauuagacuuuaaugaaaugguuuuacucacuaugaaagaaaaguccugguuaguacauaaacaaugguucuuagauuugccguuaccuuggacuucuggagcuagcacuucgcaagagacuuggaaucgucaggaucucuuggucacauuuaaaacugcccacgcuaagaaacaagaaguaguaguuuugggcagucaagagggagcaaugcacacugcacuaacuggagcuacggagauacaaaccuccgggacuaccaccaucuuugcaggacauuugaaauguagguuaaaaauggacaaacuuacauuaaaaggaaccucauauguuauguguacugggucuuucaaacuggaaaaagagguugccgaaacccaacauggaacaguacuuguccaaguaaaauaugaaggaacagaugcaccguguaaaauaccauuuucaacacaagacgaaaaaggcguaacucaaaauggaagacuaauaacagcgaaccccaucguaaccgacaaagaaaaaccaguuaacauugaaaccgagccacccuuuggagaauccuacaucguagugggcgcaggagaaaaggcuuuaaaauuaucaugguuuaaaaagggaucuagcauagggaagauguucgaggcuacagcaagaggagcaagaagaauggcuauccuaggggauaccgccugggacuuuggauccauuggugguguguuuaccucgguuggcaaacuuguacaucagguauuuggcacggcguaugguguucuuuucaguggggugucuuggacaaugaagauaggcauugggauccuuuugacuugguuaggccuaaauucacgaaguacgucuuuaaguaugacgugcauugcaguagguaugguaacacuuuacuuaggaguaaugguucaagcagacucaggaugcguuauaaauuggaagggucgagaauugaagugcggaagcgguaucuuuguuacaaaugaaguccacacauggacagaacaauauaaauuucaggcagauagccccaaaagacuuucagcugcaauaggcaaggcuugggaagaaggcguguguggaauccggucggcaacucgucuagagaacaucauguggaaacagauauccaaugaauugaaucacauauuauuagaaaacgauaugaaguuuacggucguuguuggagaugcuaaugggauccuugcacagggcaagaaaaugauuaggccccaaccgauggaacauaaauacaguuggaaaagcugggggaaagccaaaauuauaggagcggacauacagaacacuacauuuauuauugauggaccggauacccccgagugcccugacaaucaaagggcuuggaauauuugggaaguagaggauuauggcuuugggauauuuacaacuaauaucuggcucaaguugagagauaguuauacacaaaugugcgaccaccgacuaaugucagcagccauaaaagacucaaaggcuguacaugcagacauggguuauuggauagagucagagaaaaaugaaacguggaaacuugcaagagccagcuuuauugaagucaaaacaugcacguggccaaaaucucauacauuguggaguaacggcguccuggagagcgaaaugauaauaccaaaaauauacggaggaccaauaagucaacauaauuaucgaccagguuauuuuacacagacagcaggaccguggcaccuagguaaacucgagcuagauuuugacuuaugcgaagguacaacagucguagucgacgagcacugcggaaaucgcgggcccuccuuaagaacaacgacgguuacaggaaaaauaauucacgagugguguugucguagcuguacgcuacccccauugcgcuuuagaggggaagauggauguugguaugggauggaaauucgcccuguaaaagaaaaggaagaaaacuuggugcgaucuaugguuagugcaggaaguggugaaguggauucguucucgcucgggauccuuugugccagcauaaugaucgaagaagucaugaggucaagauggaguaggaaaaugcuuaugaccggaaccuuggccguguuucuauuacuaauaacaggucaauugacauggaaugaucuaauaaggcucugcauuauggugggugcuaacgcaagcgauaggaugggaaugggaaccacuuaccuagcucuaauggcuacguucaaaaugaggccaauguuugcgguuggauuacucuucaggaggcuaacaucucgagagguacuacuuuugacaauagggcugucacuugucgcgucaguggaacuuccuaauucauuagaagaauuaggcgauggccucgccaugggaauaaugauguuaaaauugcucacagaauuucagccgcaccaacuauggacuacgcuacuaucauugaccuucauuaaaacaacccuaagucuggauuacgcuuggaaaacuaccgcaauggcuuuaucaauuguaaguuuauucccccuauguuuaaguacuaccucacagaaaacuacuuggcuuccuguacuuuuaggcagcuuuggaugcaaaccacuaacgauguuccuuaucacugagaauaaaauuuggggcaggaaaucauggccuuuaaaugagggaauaauggcaauuggaaucgugucaauacuauuaucuuccuuacucaaaaacgacguuccacucgcagggccacuuaucgcuggcggaaugcugaucgcaugcuaugugauaucugguucaucugcagaucuaucucuugaaaaggcagcagagguaucgugggagcaagaggccgaacacucuggcacaagucacaauauauugguagagguucaggaugacgggacgaugaaaauaaaggaugaagaaagggaugacacauuaacaauauuauuaaaagcaacccuauuggccgucucaggcguuuaucccaugagcauuccggccacucuuuucguaugguauuucuggcagaagaaaaagcagcguucuggggugcuaugggauacuccuucgccgcccgaaguagaaagagcggucuuagaugaugggauuuauaggauauuacagaggggauuguugggucgaagccaaguuggagugggaguuuuccaagacggcguguuccacacgauguggcacgugacaagaggggcgguucugauguaccaaggaaagagauuggaaccuagcugggcguccguuaagaaagaucuaaucucuuauggagggggauggagauuucaaggaagcuggaauacaggagaggagguacaggugauagcugucgaaccgggcaaaaauccgaagaauguacaaacgacuccaggcacauuuaaaacaccugagggugaagugggugcuauugcucuugacuuuaagccagguacuucaggaagcccaaucguuaacagggaagguaagauaguuggccuauacgggaacggggucgucaccacuagcggcacauacgugagugccauagcucaagcgaaagcuagucaggaagggccauugccugaaaucgaagaugaaguauucaagaaacguaauuuaacaauaauggaucuccacccugguaguggcaagacaaggcgguauuuaccagccauaguuagggaggcgauaaagcgaaaauuaaggacgcuuauccuagcaccgacacgaguuguagcuagugaaauggcagaagcacuaaaggggaugccaauacgauaccaaacaacggcagugaagagugaacauacuggaagagagauagucgaucugaugugucaugcgacauucaccaugcgccuuuuaucgccgguaagaguuccaaauuauaacaugauaauaauggacgaagcucauuucacugacccagcuuccauugcggcacgaggauauaucucgacaagaguuggaaugggcgaagcagcggcuauauuuaugacggcuacaccacccggcucgguugaggcuuuuccacaaucaaaugcaguaauccaagaugaagaaagagauauacccgaaagauccuggaauagcggauacgauuggauaacggacuuccccgguaaaaccguaugguucguaccaaguauuaaaucagguaaugauaucgcaaauugccuaagaaagaaugguaaacgaguaauacaacucucaagaaaaacguucgauacugaauaucagaaaacaaagaauaacgacugggauuauguggugacaacugauauauccgaaaugggggcaaacuuccgagccgauaggguuaucgauccuagaagguguuuaaaaccaguuauacugaaagacggcccggaaagaguaauccuagcaggaccuaugccaguaacuguagcuuccgcugcucaacgccguggacggauuggacgaacacagacuaaagaaggggaccaguauguguacaugggccaaccgcuuaauaacgacgaagaccacgcccauuggacagaagcgaaaaugcuguuggcuaacauuaauacaccagaagggauuauacccgcucuauuugagccagaaagagaaaaaucgccugcuaucgacggcgaauaccguuuaagaggagaagcaaggaaaaccuuuguagaacuuaugaggagaggggauuugcccguauggcucagcuauaaaguagcaagcgaaggcuuccaguauagugauaggcgcuggugguuugauggugagcgaaauaaccaaguacuugaagaaaauauggaugucgaaauauggacaaaagaaggugaaaggaagaaacucaggccccgaugguuagaugcuagaacauauuccgacccgcuggcacuuggugaauuuaaagaauuuggugcgggaagaagguccgguaguggagauuuaauucuagaaauaggcaaacuaccucagcaccuaacguuacgagcucagaacggucuagacaauuuaguaaugguccauaacucugagcaaggugggaaagcauauaggcaugcuauggaagaacuuccagacacaaucgaaaccuugaugcuccuagcauugauagccguacuaacaggcggagucacacuauucuuucuuaguggaaaagguuugggaaaaaccucuaucgggcuuuugugcgugacagcaucaucugccuugcucuggauggccucaguagagccacacuggauagcagcaaguauuauacuugaguucuuuuuaaugguacuauuaauuccagaacccgaucggcagcgcacaccucaagauaaucaauuggcuuauguagugauaggacuucuauuuaugauccuuacuguagcagcaaaugaaaugggucuuuuagaaaccacuaagaaagauuuagguauaggucaugucgccgcggagaaucaucaacaugcaacaaugcuagaugucgacuuacguccagcgagugcauggacacuauacgcaguugcgaccacugugauaacuccaaugaugagacacacaauagaaaacacaacagcaaacauaagccuuaccgcaauagccaaucaggcugcgauacuaaugggguuggacaaaggauggccaaucucaaaaauggacauaggaguaccauugcuagcuuuaggaugcuauagccaggugaauccccuaacccuaaccgcagcuguauuaaugcugguagcucacuaugcgauuaucggaccagggcuccaagcuaaagcgaccagagaagcacagaaaagaacagcagccgguauaaugaagaauccaacuguagacgguauaguggcgaucgaccuagacccaguuguauacgaugcaaaauuugagaaacaguuaggucaaauaauguuacuaauacuuugcaccagucaaauauuacuaaugaggacuacuugggccuuaugcgaaagcauaacucuagcuacagguccuuugacaacacuaugggaagguaguccuggaaaauuuuggaauacuacaauagcuguaucuauggcaaauauauucagggggaguuaucuagcaggagcggggcuugcauuuucucuaaugaagaguuuaggagguggcagaaggggcacaggagcccagggggaaacucucggcgaaaaguggaagagacaacuuaaccagcuaucaaaaucugaauuuaauacauauaaaagaucgggaaucauggagguagauagaagcgaggccaaagaagggcucaaaagaggugaaacaacuaagcaugcgguaaguagagguacugcaaaauuaagaugguucguagaaagaaacuuaguaaaaccggaaggaaaaguaaucgauuuaggauguggccgcggagguuggaguuauuacugcgcaggcuugaagaaaguaacggaggucaaaggguacacaaaaggagguccuggucaugaagaaccaauaccuauggcuacauacggauggaauuugguuaaacuccauuccgguaaagacgucuucuuuaugccaccagagaagugcgauacgcuauugugcgacauaggagaauccucgccaaauccgacaauagaagaaggaaggacuuuaagaguacuaaaaaugguugaaccuuggcuccgagguaaucaauuuuguauuaagauccuaaacccguauaugccaaguguaguugagacauuagaacaaaugcagcguaaacauggaggaaugcuaguacggaacccucugucaagaaauucaacacaugaaauguacugggucaguugugguacggguaauauuguaucggcaguuaauaugacaucucguaugcugcucaauagauuuacgauggcacaucguaaaccuacuuaugaaagggauguagacuuaggugcagguacaagacauguagcaguagagccagaaguagcaaacuuagacauaauaggacaaagaaucgagaauauuaagaaugaacauaagaguacuuggcauuacgaugaagauaauccuuauaaaacuugggcguaucacggaucuuaugagguaaaacccuccggaagugcaagcucuaugguuaacgguguuguacgauugcuaaccaaaccgugggacguuauaccuaugguaacgcaaauugccaugacugauacaacgccguuuggacagcaacggguauuuaaagaaaaaguagacacccgaacucccagagcgaagcguggaacaacacagauaauggaaguuacagcaaaauggcuuuggggcuuuuugagccggaauaagaaaccuaggauuuguacgagagaagaguuuacgcgaaaaguaagaagcaacgcugcgauaggagccguguucguagaugaaaaucaguggaauagcgcaaaagaagcuggugaggaugaaagagucugggaucucguagauagggaaagagaacuucacaaacaagggaaauggggaacuggaggguauaauaugaugggaaagagagagaagaaacuuggagaguucggcaaagccaaaggaucccguggaauaugguacaugugguuaggugcaagauuuuuagaauuugaagcacuaggauuuaugaacgaagaucauugguucaguagggaaaauagccuauccgguguugaaggcgaaggguugcacaaauuaggcuauauccugagagauaucucaaaaauaccugguggaaacauguacgcagacgauacagcaggcugggauacacgaauuacugaagacgaucuucagaacgaagcaaagauaacggacauaauggagcccgaacacgcacuguuagcaacgucgaucuuuaaauuaacauaucaaaauaaaguugugaggguacaaagacccgcgaaaaaugggaccgugauggauguaauauccaggagggaucaaagaggaucagggcaagugggcacguacggauuaaauacuuuuacuaauauggaaguccaacuuauacgucaaauggaaagcgaagguauauuuuugccuucugaguuagaaacacccaaucuugcugaacgugucuuagauuggcuugaaaaacauggagcagagagguuaaagcguaugccaauaaguggugaugacugcguaguaaaaccgauagaugacagguucgcgacugcauuaacugcacuuaaugacaugggaaagguucgcaaagacauaccgcagugggaaccaagcaagggauggaacgacuggcagcaaguuccuuuuuggucacaccauuuucaucaauuaauuaugaaagacggaagagagauuguaguaccaugccguaaucaagacgagcuaguuggcagagcuagagucucacagggcgcuggcuggagucugcgagaaacagcauggcuuggcaaaagcuaugcacagaugggccaauuaauguacuuccacagaagagacuuaagauuagcugccaacgcaauauggucagcaggaccaggagacuggguucccacgucucgcacgacguggucaauacacgcgcaucaccaauggaugacaacagaagauaugcucucugucuggaauaggguauggauugaggaaaacccuuggauggaggauaaaacacaugugagcaguugggaagaagugccguauuuaggaaagcgagaggaucagugguguggaagccuuauugguuuaacagcgagagcaacaugggccaccaauauucaaguugcuauaaaucagguacgaagauuaauaggaaacgaaaacuaucuagauuauaugaccuccaugaaacgcuuuaaaaacgaauccgauccagagggagcucuaugguaa

SEQ ID NO: 21324 - RNA, 9879 nt, Artificial Sequence
  derived and/or modified CDS sequence (opt6) from DENV-1__FJ024482__SS-prME
aguguaacuaugcuguuaaugcuauugccaacugcacuggcuuuucaucuuaccacacgaggaggugaaccacauaugauuguuaguaaacaggaaagagguaaaucauuacucuuuaaaacaagugcaggaguuaauaugugcacuuuaauagcaauggaccuuggagaacuuugcgaagacacaaugacauauaaauguccacaaauuacugaagcagaaccagaugauguugacuguuggugcaaugcaacagauaccugggugacguauggaacuuguucacaaacgggggaacacaggagggauaaaaggucuguugcauuagcaccacacguaggauuaggucuugagacaagaacggaaacuuggaugagcagugaaggcgccuggaaacaaauccaacggguggaaacgugggcacugaggcauccagguuuuacaguuaucgcuuuauuuuuagcacaugcuaucggaaccucaaucacacagaaaggcauaauuuucauauuacucaugcucgucacaccaagcauggcaaugagaugugucggaauaggaaauagagauuuuguagaaggauuaucaggggcaacauggguggauguugucuuggaacacgggucaugugugaccacuauggcgaaaaacaaaccuacauuggacaucgaauuguuaaaaaccgaagugacaaacccagccauuuuacguaaacucuguauugaagcaaaaaucaguaauaccaccacugacagucggugccccacgcaaggagaggcuacauuaguagaagaacaagaugcaaacuuuguuugccguagaacguucgucgaucgagguuggggaaauggcugcggauuguucgguaaaggaucacuucuaacaugugcaaaauuuaaauguguaacuaaauuggaaggaaaaauaguucaguaugaaaacuuaaaauauucaguaauugucacagugcacacgggcgaccagcaccaaguagguaacgagaccacggaacauggaacuauagccacaauaacgccccaggcaccaacaucugaaauacaacuaacugauuauggugcauuaaccuuggacuguucaccaaggacagguuuggauuuuaaugagaugguauuacuaacaaugaaagaaaaauccugguuaguacauaaacaaugguucuuagauuuaccacuuccauggaccagcggugcuucuacuucacaagaaaccuggaacaggcaagaucuauuaguuacguucaaaacagcccacgcuaagaaacaagaagucguaguauugggaucgcaggaaggagcuaugcauacagcgcuuacuggggcaacagaaauccaaacauccggaacgacuacaauuuucgcaggacauuugaaaugccgacuaaaaauggauaaacuuacacucaaaggaacgaguuacguuauguguacggguucuuucaaauuagagaaagaaguagcggaaacacaacaugguacgguucuuguucaagucaaauaugagggcaccgacgcacccuguaaaaucccauuccuuacucaagacgaaaaagggguaacacaaaauggucguuugauuacagcaaauccaauaguuacagauaaagagaaaccagugaacauagaaacggaaccaccuuuuggugaaucauauauaguggucggugccggagaaaaggcuuuaaaauuaagcugguucaagaaagggaguucgaucggaaaaauguuugaagccacagcuagaggagcaagaaggauggccauauuaggagacacugcgugggauuuuggaucaaucggaggaguuuucacuucaguugguaaguuaguucaucaaguguuuggaacggcauacggaguccuuuucucuggaguuucauggacuaugaaaaucggaauagguauacuguuaacauggcuuggauuaaacucgagguccacuucacugucaaugaccuguauagcuguaggaauggugacacuguauuuagguguuaugguucaagcagacagcggaugcgucauaaauuggaaagggcgggagcuuaaaugugggagcggaauauucgucacaaaugaaguacacacauggaccgagcaauauaaauuccaggcugacucaccaaagcgauuauccgccgccauaggaaaggcaugggaggaggggguuuguggcauacgaagugcaacuagauuagaaaauauuauguggaaacaaaucucaaacgaacucaaucauauccuauuagaaaaugauaugaaguuuacaguggugguuggagacgcaaaugguauauuagcacaagggaagaaaaugauacgaccucaaccuauggaacacaaauauucauggaagucguggggcaaagcuaaaauaauaggagccgauauccaaaacacaacuuucaucauugacggaccggacacaccagaauguccagauaaucagagagccuggaacaucugggaaguagaagauuauggauucggcauauucacaacaaacauauggcuuaaauuacgcgauucuuauacucagaugugcgaucaucggcuuaugucugccgcaauaaaagacaguaaagcagugcacgcugauaugggauauuggauagaaagcgagaaaaaugaaaccuggaaacuagcgcgugcaucuuuuauagaaguuaaaacuugcacuuggccuaagucacacacuuuauggagcaauggcguuuuagaaucagaaaugauaauaccaaagauauauggaggaccuaucucacaacauaacuauagaccaggcuauuucacccagacugcaggaccguggcacuugggaaaauuagaacuagauuucgauuuaugcgaaggaacuaccguggugguagaugagcauugcgguaaccgaggaccauccuuaagaacaacaacuguaacaggaaaaauaauucacgagugguguugccgcuccuguacuuuaccuccuuuaagauuucgaggggaagauggauguugguacggaauggaaaucagaccgguaaaagaaaaggaagaaaaucuaguaaggagcauggugucugcggguaguggagaagucgacucguuuucauuaggaauacuuugcgcaucgaucaugauugaagaaguaaugcgaucaagauggagcaggaaaaugcugaugacaggcacucuugccgucuuuuuacuucugauaaugggacaacuaacauggaaugaucuaaucagacuauguauuauggugggugccaaugcaagugaucgaauggguauggggacgacguauuuagcccuuauggccacauuuaaaaugaggccuauguuugcagucggacuacuuuuccgaagauuaacuucaagagagguucuccuucuaacgauagguuuaagccuaguagcaagcguugaacuuccaaauucccuagaagaguuaggugauggauuagcgauggguauaaugaugcucaaauuacuuacagaauuucaaccacaccaacuuuggacgacuuuacuaaguuuaacauuuaucaaaacaacuuuaagccucgauuaugcauggaaaacaacagcaauggcauuaagcaucguaucuuuauucccccuuugccuaucaacuacaucucagaaaacaacaugguuacccguacuuuugggauccuuuggaugcaaaccacuaacuauguuccucauaacggaaaacaaaauuuggggucguaaaagcuggccacuuaaugaaggaaucauggcgaucgguaucguaucaauacuauuaaguucauugcuaaagaaugauguaccauuagcaggaccuuuaauugccggugggauguuaauugcaugcuaugucauuuccggaucaagugcagaucuaucacucgaaaaagcagcugaggugaguugggagcaagaagcagaacacucaggcacgagccauaacauccuuguugaaguucaagaugacgguacuaugaaaaucaaagaugaggaaagagaugacacgcuuacuauacuccuuaaagcaacacuuuuggcaguaucaggaguuuauccaaugucaaucccugcgacuuuguuugugugguacuuuuggcagaaaaagaaacaaaggucaggcguauuaugggacacaccaucgccgccagaaguagaacgcgcaguucuugacgaugguauauauagaauauuacagcgaggacuucuuggccgaucacagguagguguaggugucuuucaagauggagucuuccacacuauguggcacgucacuagaggugcuguauugauguaccagggaaagcgauuggaaccaucgugggcgucagugaagaaagauuugauaucuuauggaggaggauggcgcuuucagggaucauggaauacaggagaggaaguccaaguaauagcaguagagcccggcaaaaaccccaaaaacguucagacaacacccgggacauucaaaacaccggaaggggaggugggagcaaucgcacuugacuuuaagccaggaacaucuggauccccuauagugaauagagaagggaaaauaguaggccuuuacggaaauggaguugucaccacaucuggcacguauguaagugccaucgcacaagcaaaggcaagccaagaagggccauuaccggagaucgaagaugagguauuuaagaaacgcaaucucaccaucauggaccuucaucccgguaguggaaagaccagacgcuacuugccggcgaucguucgagaggcgaucaagcgaaaacuuaggaccuuaauucucgcgcccacuagagucgucgcaucagagauggcagaggcacuaaaaggaaugccgauaagguaucaaacgacagcaguaaaaucagaacauacgggaagagaaauaguagacuuaaugugccaugccacauucacaaugcgguuacugucaccuguucgaguuccaaauuauaauaugauaaucauggacgaggcgcauuucaccgaucccgccagcauagcagcaaggggguauaucucuacacgcguagggaugggagaggccgcagcgauauucaugacugccacacccccugggaguguagaagccuucccccaaucaaaugccguuauacaggacgaagaaagagauauaccugagagaucauggaacucggguuaugauuggaucacggacuucccuggcaaaacgguuugguuuguaccaucaaucaaaucagguaaugacauugcgaauugucuaaggaagaauggcaagcgaguaauacaacuuucgaggaaaaccuucgacacugaauaucagaaaacuaaaaauaacgauugggacuauguaguuacaacagauauuuccgaaaugggagccaauuuuagggcagauagaguuaucgacccacgcagaugcuuaaaaccaguaauauuaaaggacgggcccgaacgcguaaucuuagccgguccaaugccgguaacuguugcaucugcugcacaaagacgcggacgaauuggccggaaccagaauaaggagggagaucaauacguauauaugggccaaccacuaaauaacgaugaagaucacgcucacuggaccgaagccaaaaugcuucuagacaauauuaauacaccugagggaauaauuccagcgcuauucgagccggaacgcgagaaaagugcagccauagauggggaguaucguuugcgaggagaagcaagaaagaccuucguagagcuaaugagaagaggcgaucuacccguuugguuaaguuauaagguagcaagugaaggguuucaauauucggaccgcagaugguguuuugauggagaaagaaauaaccaagugcuggaggagaauauggacgucgaaauauggccgaaagaaggagagaggaagaaauuacgaccccguugguuagacgcacgaacguauucugauccucucgcacuacgagaauuuaaggaauuugcugcaggcagacguaguguuucuggggaccuaauuuuggaaauagguaaauuaccacaacacuuaacccugcgggcucagaacgcauuggauaacuuaguaaugguacauaauagugagcaaggcggaaaagcguacaggcacgcuauggaagaauugccggacacuauagaaacuuuaaugcuacuugcauugauugcagugcucacuggaggagugacgcuauucuuccugaguggaaaagguuuagguaaaacaucgauaggccuccuguguguaacagcuaguucugcccuucuauggauggcauccguugaaccccacuggaucgcagcuucuauuauauuggaguuuuuccuaaugguauuguugauccccgaaccugaucgacagagaaccccacaagauaaucaauuagcuuacguagugauuggucuccuauuuuuaauauuaacaguggcagccaacgagaugggccuauuggaaacuacuaagaaagauuuagguauaggacauguugccgcugaaaaccaucaacacgcuacuaugcuggaugucgaccuucguccggcuucggccuggacgcuauacgcgguagcuacgacaguaauuacaccgaugaugagacacacuaucgaaaacacaacagcgaauaucagccugacugcuauagcaaaucaggcugccauauugaugggguuagacaaagguuggccgauuuccaaaauggacauaggcguaccccuuuuagcauuggguugcuacagucaaguuaacccccucacccucacagcagcaguccuaaugcuaguagcucauuaugccauaauagguccuggcuuacaagcuaaagcuacacgggaagcacaaaagcgaacagcagccgggauuaugaaaaacccuaccguagauggaauaguagcuauugaccuagacccaguuguauacgauacgaaguucgaaaaacaguuaggccaaauaauguuguuaauuuuguguacaucucagauacugcugaugagaacgacaugggcguuaugcgaaaguauaacauuagccacgggcccacugacuacucuuugggaaggaagcccaggaaaauucuggaauacuacuauugcugucagcauggccaauaucuuuaggggaaguuauuuggcaggagccggacuugcauuuaguuuaaugaagucuuuagguggaggucggagggguacuggugcacaaggcgaaacgcuuggagaaaaauggaaacgccaguuaaaucaauuaaguaaguccgaguucaacacuuacaaacgcagcgggaucauggaaguugacaggagcgaagcaaaagagggauugaaaagaggugaaaccacaaaacaugcgguuucaagaggaaccgcuaaauuacgaugguucgucgaacgaaaccuggucaaaccggaaggaaaagucaucgaccuuggcuguggaagaggaggguggucuuauuauugugccgggcuaaagaaaguaacagaaguaaaagguuacacuaaaggagggcccggccacgaggaaccuauaccuauggccacuuauggauggaauuuggucaaacuucacagcggaaaagauguauuuuucaugccaccugagaaaugugacacccuccugugugacauaggagaaucaucacccaauccaacaauagaagaagguagaacuuuacgaguacucaagaugguagaaccauggcuacggggaaaucaauuuuguauuaagauacucaacccuuacaugcccucagugguugagacauuagagcagaugcaaaggaagcacgggggaaugcuaguacgaaacccccucaguaggaauaguacucaugagauguacugggugagcuguggaacaggaaacauugugucagcaguaaauaugaccucucgcaugcuauugaauagauucacgauggcucaccgaaagccuacuuaugaacgggauguagauuuaggggccgggacacgacaugucgcgguagagccugaaguagcaaaucuugauauuauaggucaaaggauagaaaacaucaaaaaugagcauaaaucaacuuggcauuaugacgaagauaaucccuauaaaaccugggcauaucacggaucauaugagguaaaaccaagcggguccgcaaguucuauggugaacggggugguuagauuacuuaccaagccaugggauguuauaccaaugguaacucaaauagcuaugacagauacuacgccuuucggacaacaaaggguauuuaaagaaaaaguagauacaagaacaccucgugcuaaaaggggaaccacacaaaucauggaaguuacagcaaaaugguuauggggguuccugagcagaaacaaaaagccgagaauauguacaagagaagaauuuacgaggaaggugagaucuaacgcagcuauaggcgcggucuuuguugacgaaaaccaauggaacucagcaaaagaagccgucgaagaugagcguuucugggauuugguacaucgcgagagggaacuacauaaacaaggaaaaugugcuacuugcguuuacaauaugauggguaagcgugagaagaaauuaggagaguuuggaaaagcaaagggcagucgcgcaauaugguauauguggcuaggagcacguuucuuagaguucgaggcauuaggcuuuaugaaugaggaucauugguucucacgugaaaauucuuuuucuggagucgaaggcgagggauuacauaaacuuggguacauauuaagagacauaagcaaaauacccggaggaaauauguacgcugacgacacggcggggugggacacaagaauaacagaagaugaccugcaaaacgaagcaaaaauaaccgauaucauggaacccgaacacgcguuacuugcaacuucuauuuucaaacuaacauaccaaaacaaaguuguaaggguccagaggcccgccaaaaauggaacagucauggauguaauaucucggcgcgcacaacgaggaaguggacaagugggcacuuacggacuaaauacauucacaaacauggagguacaacuaauuagacaaauggaauccgaggguauauuucuaccaucagaacuggaaacuccgaaucuagccgaacgggugcuagauuggcuagaaaaacauggugcugagagacugaaaaggauggcuauaaguggagacgacugugugguuaaaccuaucgaugaccgguucgcuacugccuugacggcacuaaacgcaauggguaaaguacggaaagacauaccccaaugggagccaucuaaaggauggaaugacuggcaacaagucccauucugcagucaucauuuucaucaacuaauaaugaaggauggaagagagauaguaguacccugucgaaaucaagaugaacuuguaggacgggcucguguaucacagggugcgggauggagcuuacgcgaaaccgcauguuugggaaagucauaugcacaaauguggcagcuuauguacuuccacaggagagacuuaagacuugcagcgaaugcaauaugcagcgcaguuccuguugacugggucccaaccagucggacaacuuggagcauacaugcucaccaccaauggaugaccacugaagauauguuauccguauggaacagaguauggauagaagaaaaucccuggauggaagauaagacucacguuaguaguugggaagaaguaccauaucuaggaaagcgagaagaccaaugguguggcagcuugaucgggcugacugcacgggcaaccugggcuacaaauauacaaguggcaauuaaucaggucagaagacuaauagguaacgaaaauuaucuagacuacaugaccucgaugaaacgguucaagaaugagagcgauccagaaggcgcacugugguga

SEQ ID NO: 21325 - RNA, 9879 nt, Artificial Sequence
  derived and/or modified CDS sequence (opt6) from DENV-1__EU596501__SS-prME
aguguaaccauguugcucauguuguuaccuaccgcauuagcuuuucauuuaaccaccaggggaggcgaaccucacaugaucguaucuaaacaagaacgagggaaaucccuuuuauucaaaacaagugcuggaguuaacaugugcacguuaauagcaauggaccugggugaguuaugugaagacacaaugacuuauaaauguccccaaauaacugaagccgagccggaugacguugauuguugguguaaugcuacagacaccuggguaacauacgggacaugcagccaaacuggugaacaccgaagggacaaaaggagcguagccuuagcuccacauguagggcuagggcuugagacuaggacagagacauggaugucauccgaaggagcauggaaacaaauucaacgaguagagacgugggcuuuaagacauccggguuucacaguaaucgcauuauuccucgcacaugcgaucggaacaucgaucacucaaaaaggaauaauauuuauacuuuugaugcuaguuacaccaucaauggccaugcgaugugucgguauaggcaaucgcgauuuuguugaaggauuaucuggagccacauggguugacguagucuuagaacauggaucuuguguaacuacaauggccaaaaauaaaccaacauuggauauagaacugcuuaaaacggaagucaccaaucccgcuauauuacgaaaacuuuguauugaagcgaaaauuucuaauacaacgaccgauucacguuguccaacccaaggagaggcaacauuaguagaagaacaagaugcaaacuuuguuugccggagaacauucguagauaggggcugggguaacgguugcggauuauucggcaaaggaucacuccuaacaugugcuaaauuuaaaugugugacgaaacuagaagguaaaauaguucaauaugaaaaccuaaaauauucaguaauaguuacaguacacacuggagaucaacaccaagucggaaaugagacaacagagcauggaacgauugcaacuauaacaccucaagcacccacaucagagauacaacuuacagauuauggagcguuaacacucgauugcucaccaagaaccggauuggacuucaacgagaugguucuucucacaaugaaagaaaaauccuggcuaguccauaaacaaugguuucuugaucugccuuugccuuggaccucgggagcaagcacaucccaagagacguggaacagacaagacuugcuagucacauucaaaaccgcucacgccaagaaacaagaagugguaguauuggguagccaggaaggugcaaugcauacugcacuuaccggugcuacagaaauucagacuuccgguacaacuacuaucuuugcaggucacuugaaaugucggcuaaaaauggauaaacugacgcugaaaggcacgaguuacguaauguguacugguucauucaaauuggaaaaagaaguggcagaaacacaacacggcacgguuuuaguacaagugaaauaugaagguacugacgcaccauguaaaauacccuucagcacacaggaugaaaagggaguuacacaaaacggaagacucauaaccgccaauccaauuguuacggauaaagagaaacccguuaacauagaaaccgaaccgccauucggagaaaguuauaucguaguaggggcaggcgaaaaggcuuuaaaauugucaugguuuaagaaagggucgaguauugguaaaauguuugaagcaacugcacggggagcuagaagaauggcaauauuaggcgauaccgccugggauuucgguucuauaggcgguguguucacaucagucggaaaauuaguucaccaaguauucggaacugcuuauggagugcuguuuucaggcgugagcuggaccaugaagaucgggauuggaauccuccuuacauggcuuggacuaaauucuaggaguacaucuuuaucgaugacuuguaucgccguaggaaugguaacucuguaccucggagucaugguacaagcagacagcgggugcgucauaaacuggaaagggcgagaauuaaagugcggaaguggcauuuuugucacuaaugaaguacauacauggacugaacaguacaaauuccaggcagauucaccaaagagguuaucagcagcaauagggaaagcgugggaagagggcguaugugguaucaggagugcaacccgauuggaaaauauaauguggaagcaaauaaguaacgaacuaaaccacauucuucuggagaaugauaugaaauuuacggucguugugggggacgccaacggcauccuggcccaagguaagaaaaugauaagaccccaaccgauggaacauaaauacagcuggaaaucgugggguaaagcuaaaauaauaggugcggauauucaaaauacgacauuuauuauagacggcccugauacaccagaaugcccagauaaccaaagagccuggaauauaugggaaguggaggauuauggguuuggcauuuuuacaaccaauauaugguuaaaauuaagggauagcuauacucaaaugugcgaucaucgucuaaugucggcagcgauaaaagauucgaaagcagugcaugcugauaugggauacuggauugagucagagaaaaaugagacauggaaauuagcaagggcuaguuuuaucgaagucaaaaccuguacauggcccaaaucacauacacugugguccaacgguguguuggaaagugaaaugauaauaccaaaaauauacggaggcccaaucagucaacauaauuaccgucccgguuacuuuacucaaacugcgggcccguggcaccuaggaaagcucgaacuagauuucgacuuaugugaagggaccacuguggucgucgacgaacacuguggcaacaggggccccagucucagaacuaccacuguaacuggcaagauaauacaugaauggugcuguagauccuguacacugccuccccuuagguuucgaggcgaagauggaugcugguaugguauggagauacguccuguaaaagaaaaggaggagaacuuagucagauccauggucuccgcgggaucaggugaagucgacucguucucucuugguaucuugugugcuucuauuaugauagaagagguaaugcguagccgauggucaagaaaaaugcucaugacgggaacucucgcaguguuucuucuccuuauaaugggacaacuaacauggaaugaucuuauacgucucuguauaaugguaggcgcuaaugcaagugauagaauggggaugggaacaacauaccuugcucuuauggcgacuuuuaagaugaggccuauguuugcgguaggguuguuauuucgaagacuaacgucaagggaaguacuguugcucacaauuggauugucguuaguagcaagcguugaauuaccaaauucacucgaagaacuaggagauggauuagcaauggggauuaugauguugaaguuacuaacagaauuucaaccccaccaacuauggacgacacuuuuaucgcuaacauucauaaaaacaacacuuucucucgauuacgcguggaaaacgacugcgauggcccucucaauuguuucccuguugccccuauguuugucaaccacaucacagaaaacaacauggcuacccguuuuguuagguaguuuuggauguaagccucuuaccauguuuuuaauaaccgaaaauaagauaugggggagaaaaucguggccucuaaacgaagggauuauggcaauagguauaguuagcauucucuuaucgagccuacuuaaaaaugaugucccacuagccggaccgcuuauagccggagguaugcugauagcauguuauguaauaucugguuccagcgcagaucuaucgcuugagaaagcugcagagguuucaugggaacaagaagccgaacacaguggaacuucucauaacauacucguugaaguacaagaugaugguacgaugaaaauuaaagacgaagaaagagaugacacauugaccauacuauugaaagcaacgcucuuagcagugucuggaguuuacccuaugucaauaccggcgacauuauucguaugguacuuuuggcaaaagaaaaagcaacgaucagggguauuaugggacacaccaucaccgccggaaguagaacgugcgguauuagaugacgguauauacagaaucaugcaaagagguuugcuuggaagaucucagguaggcguaggaguauuucaggauggaguuuuucacaccauguggcaugugacacgaggagcagugcuaauguaucaaggcaaaagguuagaaccaucgugggcaucaguuaagaaggaccuaauuaguuauggcgggggcuggagauuucagggaucauggaauacaggagaagaaguacaaguaaucgcaguugaaccagggaagaauccuaaaaauguucaaacaacuccaggaacauuuaaaacacuagagggagaaguaggagcaauagcguuggacuuuaaacccggaacuucuggaucgccaauagugaauagagagggaaagaucgucggguuauacggaaacggaguagugaccacaagcgggacauaugucucagccaucgcgcaagccaaggcuucccaagaggguccguuaccugaaaucgaagacgaagucuuuaagaaaagaaaucuaaccauuauggauuuacacccagggagugggaaaacaaggcgauaccuuccugcaauugugagggaagcaauuaaaagaaaguuacgaacucuaauccuagcucccacacgaguuguugcaucagagauggcugaagcgcuuaaggggaugccaauaagauaccaaacgaccgcaguuaaaucugagcacacaggacgcgaaauaguugaccugaugugucacgcaacauucacaaugagauuacuauccccaguacguguucccaauuacaacaugauuauuauggaugaagcucauuucaccgauccugcuucaauagcugcaagaggauauauaaguacuagaguugguaugggggaggcagcagcuauuuucaugacagcaacgccuccaggaucaguagaggcuuucccucaaucgaaugcaguaauccaggaugaagaaagagacauuccggaaagaucauggaacucugguuaugacuggauuacagauuucccugguaaaacugugugguuuguacccagcauaaaauccgguaacgacauugcuaacuguuuaaggaaaaauggcaaacgugucauacaacucucgcgaaaaacauuugacacagaauaccaaaagaccaaaaauaacgacugggacuauguaguuacuacagauauuuccgagaugggagcuaauuucagggcggacagagugauagacccaaggagguguuuaaagccaguaauccuaaaagacgguccugaaagaguuauauuagcgggaccaaugccugugacuguagcaucugcugcgcagcgacggggacguauuggaagaaaucaaaauaaggaaggcgaucaguauguuuauauggggcaaccucuuaacaacgacgaagaucaugcacacuggacugaagcgaaaaugcuacuagauaauauaaauaccccagagggaauaaucccugcucuauuugaaccggaaagagaaaaauccgccgcaauugacggcgaauaucgccucaggggagaagcacggaaaacauucguugaauugaugcgcagaggagaucuuccaguauggcugaguuauaaaguggcgucagaaggauuccaauacagugaccgacgcugguguuuugauggggaacgaaauaaccagguacuugaagagaauauggauguagagauauggacaaaagaaggugaaagaaagaaguuaaggccccgauggcuagaugcgcguacauauagugauccucuagcuuuacgugaauuuaaagaauuugcggcagguagaaggucaguaucaggagauuuaauauuggagaucggaaaacuaccacagcauuugaccuuacgcgcacagaaugcucuagacaauuuagucauguuacauaauucugaacaagguggaaaggcauacagacaugccauggaggaacuaccugauacuaucgagacgcuaauguuauuagcacuaauagccgugcugacagguggugugacguuauucuuucuuucuggaaaggggcuuggaaaaacaucaauaggauugcuaugcguaacagcgaguagcgcacuccuauggauggcauccguagagccccacuggaucgccgcuucaauaauauuggaauuuuucuuaaugguauuguuaauaccagagccggauagacaacgaacaccgcaagacaaucaauuagccuacguggucauaggucuacuuuuuaugauauuaaccguggcagcuaacgaaaugggauuauuagaaacuacuaagaaggauuugggaauaggccaugucgcagcagaaaaucaccagcaugcuaccauguuagaugucgaucuuagaccagccucagcguggacccucuaugcgguggcaacgacugucauaacaccaaugaugcgacauacgaucgaaaauaccacugcaaacauaaguuuaacagcuauugccaaucaggcagcaauauugaugggacuagacaaaggguggccuauuucaaaaauggauauaggagugccuuuacucgcacucggaugcuacagccaagucaauccgcugacccuaacagccgcaguacucauguuggucgcucauuacgccauaaucggcccgggucuccaggcaaaagcgacaagagaggcacagaaaaggacugcagcagggauaaugaaaaauccaacagucgauggaaucgucgcuauugauuuggauccgguaguuuaugaugcaaaauuugaaaagcaacugggacaaauaaugcugcuaauauuguguacaucccaaauauuauugaugcgcacuacgugggcacuuugugaaucgauuaccuuggcaaccggcccgcuuacaacauugugggaaggcucacccggcaaauuuuggaauacuaccaucgcugucaguauggcaaacauuuucagaggauccuacuuagcaggggcagguuuagccuuuuccuuaaugaaaaguuuaggcggagguagacgggggacaggggcgcagggggagacuuugggagaaaaguggaagcggcaauuaaaucaacucucaaagagcgaauuuaauacuuacaaaaggaguggcauaauggaaguggauagaucggaagcuaaagaaggucugaagagaggagaaaccacuaaacacgcuguaucaaggggcacagccaaacuuagaugguucguugaacgaaaccuaguuaaacccgaagggaaaguuauagaucuaggguguggucgaggagguuggucuuauuauugugcaggauuaaagaaaguaacagagguaaaaggauauacaaaagguggucccggccaugaggaaccgauaccaauggcuacauacgguuggaauuuggucaaauuacauucaggaaaagacgucuucuucaugccaccugaaaagugugauacgcuacuaugcgacauuggagaaucuaguccaaaccccacuauagaagaaggcagaacuuugcgagucuuaaaaaugguggaaccuugguugagagguaaccaguuuuguauaaaaaucuuaaaucccuacaugccauccguuguagaaacacuugaacaaaugcaaagaaaacauggugggauguuaguacguaacccgcuuaguagaaauucgucacaugaaauguauugggucagcuguggaacugggaacaucguaucagcuguaaacaugacgagucgaauguuacugaauagauuuacuauggcucacagaaaaccuacguaugagagggaugucgacuugggagcagguacaagacauguggcaguagagcccgaggucgcuaaucuagacauaauuggccaacgaauugaaaacauaaagaaugaacauaagucuacguggcacuaugaugaagacaacccauacaaaacaugggccuaccaugguaguuaugaaguaaagccgucaggaucagccaguuccaugguaaaugguguagugcgcuuacuuacuaaacccugggaugucauuccaaugguuacucaaauagcgaugacagacacaacacccuucggucaacaaaggguauuuaaagaaaaaguagauacgaggaccccaagggcuaaaagagggacuacgcaaaucauggagguaacagcaaagugguuauggggauuuuugucucgaaauaagaaaccgagaauaugcacaagagaagaauuuacaagaaaggucagaucgaaugcagccauuggagcaguauuuguagacgagaaccaauggaacucugcaaaagaagcuguggaggacgaaagauuuugggaucuuguacaucgagagcgugaacuccauaaacaaggaaagugugcgacauguguauacaauaugaugggcaagcgcgagaagaaacuuggugaauuuggaaaagcaaaaggcagucgagcuauaugguauaugugguugggcgcuagauucuuagaauuugaagcccugggauuuaugaaugaggaucauugguuuucacgugaaaauagcuuaagcggcgucgagggugaggggcuccacaaacuagguuacauucuacgagacaucagcaaaauucccggaggaaauauguacgcugacgauacagcagguugggauacacgaauaacugaagaugaucuccaaaaugaggcuaagauaacugauaucauggagccugaacacgcucuuuuagcaacauccauauucaaacuaacguaccaaaacaagguagucagaguccaaaggccugcuaagaauggaacuguaauggaugucauuuccagaagagaucaaagaggaagcgggcagguuggaacuuauggucuuaacacuuuuacaaauauggaaguucaacuaauacgacaaauggagucggaagguauauuuuuaccuucagaguuagaaaccccaaauuuggcagaaagagugcuagacuggcuagagaaacauggagcggagaggcuaaaaaggauggcaauuaguggcgacgauugcguuguaaaaccuauagaugauagauuugcaacugcuuugaccgcccugaacgacauggguaaaguuagaaaggacaucccucaaugggaaccaucaaaagguuggaaugacuggcaacaagucccauuuuguucacaucauuuccaccagcuaauuaugaaggauggccgcgaaauaguuguuccuugucguaaccaagacgaauuagucgggagagcgagaguaucccaaggagcugguuggucacuaagagaaacugcauguuuagguaaaagcuacgcgcaaauguggcaacugauguauuuucaccguagggaucuaagacucgcagcgaaugcuauauguucggcagucccaguagacuggguccccacuucaaggacuacguggucaauacaugcacaucaccaauggaugaccacugaggacauguuaucuguauggaacagaguauggaucgaggagaauccauggauggaagacaaaacucauguaagcaguugggaggaaguuccguaucuugggaaaagggaagaucaguggugcggaagccuuaucggacuaacggcaagggcgacaugggcuacaaacauccaagucgcaaucaaccaggucagacgauuaauagggaacgaaaauuauuuagacuacaugaccucuaugaaaagguuuaagaacgaaagcgauccagagggagcuuugugguaa

SEQ ID NO: 21326 - RNA, 9879 nt, Artificial Sequence
  derived and/or modified CDS sequence (opt6) from DENV-1__FJ898437__SS-prME
ucaguuacgaugcucuuaaugcuacuccccacugcguuagcuuuucacuuaaccacuagagggggcgaaccccauaugauaguaaguaaacaagaacgagggaaaaguuuacuauuuaaaaccagugccgguguuaauauguguacauugauagcuauggaccucggagaauugugugaagauaccaugacauacaaaugcccccaaauaacagaagcagaacccgaugauguagauugcuggugcaacgcaacagacacuuggguaacauacggcaccuguucccaaacuggggaacaucgccgugauaaacguucggucgcacuagcaccacauguaggucucggcuuagaaacgaggaccgaaacauggaugaguucagaaggugcuuggaaacaaauucagagaguggaaacaugggcauuacggcaccccggauuuacagucaucgcacuauuuuuggcccacgcaaucggaacuucaauaacucaaaaaggcauaauuuuuauacuccugauguuaguuacaccgaguauggcuaugcgcugugucggaauaggaaaccgcgauuuuguugaaggguuaucaggagcaaccuggguagauguaguuuuagaacaugggucuuguguaacaacaauggccaaaaauaaaccgacccucgacaucgaacuacucaaaacugaagugacgaauccggcgauauuacgaaaacuuugcauugaagcaaaaaucucaaauacaacaacagauucuagaugcccaacccaaggugaggccacuuuggucgaggagcaggaugcaaauuuuguuugucgacguacauuuguagaucgaggaugggguaauggcuguggauuguucggaaaaggaucacugcucacgugugcaaaauuuaaaugugucacaaaacuggaaggaaaaauaguucaauaugaaaacuuaaaauauucaguaaucguaacaguacauaccggugaucaacaccaaguuggaaaugaaacaaccgaacauggaaccaucgcgacuauaacaccacaagcacccacaagugaaauucaauugaccgauuauggcgccuuaacacuagauugcagcccacguaccgguuuagauuuuaaugaaaugguacugcuaacuaugaaagagaaaucauggcuaguccauaaacaaugguucuuagacuugcccuuaccguggacaucgggggcaaguacaucccaagaaacuuggaaucgucaggaccuccuaguaacauuuaaaacugcccaugcuaagaaacaagaaguaguaguacuuggaagucaagaaggcgcaaugcauacagcgcuaacuggagcaacagaaauacaaacgucgggcacaacuaccauauucgcaggacaucuaaaaugucgacuaaaaauggauaaacucaccuugaaaggaacaucuuauguuaugugcacaggaucauuuaaauuagaaaaagagguagcagaaacucaacacggaacagugcugguucaaguaaaauacgaagguacagacgcuccauguaaaauccccuucucaacacaggacgaaaaaggagucacacaaaacggccgcuugaucacagcaaaccccauaguaacugauaaagagaaaccaguaaauauagaaacagagccuccauuuggugagucguacaucguuguuggugcuggagagaaagcccuuaaacuaucgugguuuaagaaaggaaguucuauuggaaaaauguuugaggcaacugcuagaggagcaagacgcauggcaauucuaggggacacagcaugggacuuugguucaauagguggaguauucacgucgguaggaaaguuaguucaucagguauuuggaacagcauacggaguacucuuuucuggcguuucauggacaaugaagaucgguauaggaauuuuacuaacauggcucgggcuuaauucacgcaguacaucgcuaagcaugaccuguauagccguaggaaugguaacacuauaccucggaguuaugguacaagcagauagugguugcguaauaaauuggaaaggaagggaauugaaguguggcagugggauuuuuguaaccaaugaaguucacacauggacugaacaguacaaauuucaggccgacaguccaaaaagacuuucagcagcaaucgggaaagccugggaggaaggugugugcgguauuaggagugcaacacgcuuggaaaacauaauguggaaacaaauaagcaacgagcuaaaucacauuuugcuagaaaaugauaugaaauuuacaguagugguuggcgaugcaaauggaauacuugcacagggcaagaaaaugauacgcccacaacccauggagcacaaauauucuuggaagucuuggggaaaggcuaaaauaauaggcgccgauauccaaaauacaacauucauaauagauggaccugauacuccagaaugcccggacaaccagcgggcauggaacauuugggaaguagaagacuauggguuugguauauucaccacuaauauauggcuuaaauuacgugauuccuauacacaaaugugcgaucauagacuaaugucagccgcaauuaaagauucuaaagcaguccacgcagauauggguuauuggauagaaucugagaaaaaugaaacguggaaauuggcacgugcgucuuuuauagaaguuaagacauguacguggccaaaaucacauacgcuuuggagcaauggaguacucgagagugaaaugauuaucccaaaaauauauggaggaccaauuucgcaacacaacuacagaccaggauauuucacucagaccgcugggccauggcauuugggcaaacuggaacuagauuuugaccucugugaaggaacuacgguagucguggaugaacacugugguaauagagguccuagucuccguacaacuacagugaccggaaaaauaauacaugaguggugcuguaggaguuguacuuugccuccccuaagauuccguggugaagaugguugcugguacggaauggagauuagaccuguuaaagagaaagaagagaaccuggucaggagcauggugucagcugggucgggcgaaguugauaguuuuucuuuggguaucuugugugccaguauaaugauagaagagguuaugagaagucgauggagcagaaagauguuaaugacaggaacacucgcaguauuucuacuacucaucaugggacaacuaacauggaaugaucuuauaagauuguguauaaugguuggagcaaaugcaucagacagaaugggaauggguaccaccuaccuagcauuaauggcgacuuucaaaaugcgaccuauguucgcggucggccuccuauuucgacgauuaacgagccgagaaguucugcuauuaaccauuggacuuagucuuguagcaucggucgaauuaccgaauaguuuagaagaauuaggcgauggacuagcaaugggcauaaugaugcugaaacuauuaaccgaauuucaaccacaucaacuguggaccacucuacugucauuaaccuucaucaaaacaacauuaaguuuagacuacgcauggaaaacaaccgccauggcuuuaaguaucguuagucuuuucccauuaugccuaaguacgacuucgcagaaaacuaccugguuaccggugcuacuagguucauuuggauguaaaccgcugacaauguuccuaauuaccgaaaauaaaauuuggggccguaaaucauggcccuugaaugaagggauaauggcaaucgggauaguaucaauacuuuuaucaagucuucuaaagaacgauguuccauuagcuggaccucuuauagcaggcgggaugcuuauagccuguuauguuauuuccgggaguagugcugaucuuucguuagaaaaagcggcugaaguuucaugggaacaagaggcagaacauagcgguaccucgcacaauauucugguagaaguacaagaugacgggacaaugaagauuaaagaugaagaaagagaugauacuuuaacaauuuuguuaaaagcaacauugcuugcaguaaguggaguguacccaaugucaauaccggcuacacuauuugucugguacuucuggcagaagaagaaacagagaagcggcguucuaugggauacaccaucgcccccagagguagaaagggcugugcuugacgauggaauauaucgcauccuccaacgcgguuuacuagggcguagucaggugggcguaggugucuuccaggacgggguuuuucauacaauguggcauguaacuagaggagcuguucugauguaucaaggaaaacgacuggagccaaguugggcaagugucaagaaagaucuaauauccuauggaggaggauggagguuccaaggaaguuggaacacaggcgaagaaguucaagucauagcuguagagccagggaaaaacccgaaaaauguucaaacgaccccagguacauucaaaacucccgaaggugaaguaggugcgauugcucuagauuuuaaaccagggacgagcggauccccuauaguaaacagggaaggaaaaaucguaggauuguaugguaauggcguaguaacuacaucagggacguacguaagcgcuauugcccaggcuaaagcaagccaagaaggaccauuaccagaaauugaggacgagguguucaagaaaagaaaucucacaauaauggaccuacauccggggucggguaaaacuagacgcuauuuaccugcuauuguacgcgaagccauaaagagaaagcugagaacacuaauucucgcgccaacacgagugguagccagugaaauggcagaagcccucaaagggaugccuauacgauaucaaacaacagcgguaaaaucagagcacacaggacgcgaaauaguagacuugaugugucacgcaacauuuacuaugagguuacuuagcccaguacgcguuccaaauuauaacaugauuaucauggaugaggcucacuuuacagacccugcaucuauagcagcgcguggguauaucaguacacgagugggaaugggugaggccgcggcaauuuuuaugacugcaaccccaccgggaagcgucgaggcuuucccccaaucgaacgccguaauacaagaugaagaacgggauaucccugaaagaucuuggaacucggguuaugauuggauuacugauuucccagguaagacaguuugguucguuccuucaauaaaaagcggaaacgauauugcaaauugccuuaggaaaaaugguaagagaguaauucaauuaucaaggaaaaccuuugacacugaguaucagaaaacgaagaauaaugauugggauuaugucguaacuacugacauuucggaaaugggugcaaacuuccgagcugauagagucauagauccacgacgaugcuugaagccaguuauacuaaaagacggaccugaacgcgugaucuuagccggaccaaugccugugacugucgcuucagcugcgcaaagaaggggacgaauuggacggaaccagaauaaagaaggggaucaauacguguacaugggucaaccgcuaaacaaugacgaggaucacgcccacuggacggaagcaaaaauguuacuugacaacauuaacacuccagaagggauaauaccugcuuuauuugagccggaacgcgagaaauccgcggcaaucgauggagaguaucgguugagaggagaagcgagaaaaacauucguagaguuaaugaggagaggagaucuacccguaugguuaucauacaaaguugcgucagaaggauuccaguauucugaccgccgauggugcuucgauggugaacguaacaaucaaguacuagaagaaaacauggaugucgaaauauggacaaaggaaggagaaaggaagaaauugagaccaagauggcuagacgcucgcacauacucggauccauuagcacuucgagaauuuaaagaauuugcugcaggaagaagaagcguaucaggugaucugaucuuagagauaggcaaguuaccacagcauuuaacguuacgagcacagaaugcuuuggauaaucuaguaaugcugcacaacagugagcaagguggcaaggcuuacagacaugcuauggaagaguugccagacacuauagaaacucugaugcuguuagcgcuaaucgcgguucugacaggaggagucacuuuauucuuuuuaaguggcaaaggacuagguaaaacaucuauuggcuuauugugugugacggcgucaagugcgcuucuauggauggcaaguguagagccacauuggauagcggcaagcauuauucucgaguucuucuuaaugguauuauuaauaccagaaccagauaggcaaagaacaccgcaagauaaucaauuggcauauguaguaaucgggcuucucuucaugaucuuaacgguagcagcaaaugaaaugggguugcuugagacaaccaagaaagauuuaggcauaggucauguagccgcagagaaucaccagcacguaacuaugcuugauguagaucuuagaccagcaagugcauggacgcuuuaugcggucgcgacuacaguaauaacaccuaugaugcgacacaccauugaaaauacaacugcgaauauuucuuuaacagcaauagcuaaucaagccgcaauucuaauggguuuggacaaggguuggccgauuucgaaaauggacauugguguuccacuacuagcucuaggguguuacucccaaguaaauccuuuaacguuaacggccgcuguauuaauguuagucgcucauuaugcaauaaucggucccggauuacaagcgaaggcgacgcgagaagcucagaagcgaaccgcagcaggaauaaugaaaaacccaacgguagacgggaucguagcaauugauuuagauccugugguguacgacgcaaaauuugaaaagcaacucggacagauaauguuguuaauacucuguaccucacaaaucuuauuaaugaggacgacaugggcuuuaugugaaaguauuacccuugcaaccggcccacucacaacucuaugggaaggcagcccaggaaaguuuuggaauacuacaaucgccguaucuauggccaauauauucagaggaucauauuuggcaggcgcagguuuagcuuucagcuuaaugaaaaguuuaggcggaggccguaggggcacuggcgcacaaggagagacgcuaggcgaaaaauggaaacggcaauugaaucaauuaagcaaaagugaauuuaauacauacaaacgaaguggaaucauggaaguagaucggucggaggcuaaagaaggccuuaaaagaggugaaacgacaaagcaugccgugucaagaggaacugcaaaguuaaggugguucguugaacguaauuuagucaaaccggaggggaaaguuauugacuuggguugugggaggggagguuggaguuauuacugugcaggucuaaagaaaguaacugagguuaaagguuacacaaaaggcgguccaggacaugaagaaccaauaccgauggcaacauacggcuggaaucuaguuaaacuacauuccggaaaagauguauuuuucaugccuccagaaaaaugugauacgcugcuuugcgauauaggugagucgagccccaacccgacaauagaagaaggacggacucuucgaguuuuaaaaaugguggaacccuggcuccgugguaaucaauuuuguauaaagauuuuaaaucccuauaugccuaguguaguggaaacauuagagcaaaugcaacguaaacaugguggaauguugguaagaaacccauuaucccgcaauucaacccacgaaauguauugggucucuugcgggacagguaacauaguuagcgcuguuaauaugaccagucguauguuacuuaaccguuuuacaauggcucauagaaagccuacguaugaacgagauguugaucuaggggcuggaacacgucacguggcaguagaaccagagguagcaaauuuggauauaauuggccagcgcauagaaaacaucaaaaaugaacacaaauccacauggcauuaugacgaagacaauccuuauaaaacgugggcguaccacggaaguuaugaaguaaaacccagugggucggccaguucaauggugaauggcguuguucggcuacuaacuaaaccaugggacguaauucccaugguuacacagaucgcuaugacagacacuacaccauucggccaacaaaggguuuuuaaagaaaaaguugauacuagaacaccuagggcuaaaagagggacaacccaaauuauggaaguaacagcgaaaugguuauggggauuccuaucgaggaacaagaaaccucggauaugcaccagagaagaguuuacucgaaaaguccgcuccaaugccgcaauaggagccgucuuuaucgaugaaaaucaguggaauagcgcuaaagaagccguagaagaugaacgauuuugggacuuaguucauagagaaagagaguuacauaaacagggcaaaugugcaacauguguuuauaacaugaugggaaaaagagaaaagaaguugggcgaguuugggaaagcaaaagggagucgcgcaauuugguauauguggcugggggcacgauuuuuggaguucgaggcauugggcuuuaugaacgaggaucauugguuuaguagagaaaacuccuuaucagguguggagggagaaggacuccacaaauugggauauauacuucgagacaucucaaagauucccgguggaaacauguacgccgaugauacagccggaugggacacaagaguaacagaggaugaccuucaaaacgaagcuaaaauaacggauaucauggaaccagaacaugcacuacuggcgacauccauauuuaaacuaacauaccagaauaaaguaguacguguccagcgaccugcaaagaacggaacgguaauggaugugauaucccggagagaucagagagggucgggacaaguaggcacguacgggcugaauacauucaccaauauggaaguacaacucauacgucaaauggaauccgaagggauauuccuaccaucggaacuagaaacaccgaaccuggcagagagaguuuuagauugguuagagaaacacggagcagagcgccuacgucggauggcaauaaguggagaugauugcgugguaaaaccaauugacgacagguuugccaccgcacugacagcacugaacgacaugggaaaaguacgaaaagauauuccccagugggaaccaucuaaaggauggaaugacuggcagcaagugccuuuuuguagucaccauuuccaucaguuaauaaugaaggacggcagagagaucguuguuccauguagaaaccaagaugaauuggucggacgugcuaggguuagucaaggagcuggauggagucuaagagaaaccgccuguuuggguaagucauacgcacagauguggcaauuaauguacuuccaccgaagagaccugcggcucgcggcaaaugcaauuuguagugcagugccaguggacuggguuccaacaucacguaccacuuggucgauucaugcccaccaucaauggaugacuaccgaggacauguuaagcguauggaauagaguuuggauagaagaaaauccuuggauggaggauaaaacucacguuaguaguugggaagaagucccauaucuuggaaagagagaggaccaauggugugguagucucaucgggcuaacagcgagagccacgugggccacaaacauacaaguggcuauaaaucaaguuagaagauugaucgguaacgagaauuacuuggauuacaugacaucgaugaaaagauucaaaaacgagucugauccagaaggggcacugugguga

SEQ ID NO: 21327 - RNA, 9879 nt, Artificial Sequence
  derived and/or modified CDS sequence (opt6) from DENV-1__FJ024480__SS-prME
ucaguaaccaugcuccucaugcuucugccaacggcuuuagcauuccauuugaccacucgugguggugaaccgcauaugauaguuucaaaacaggaaagagggaaaagccuguuauucaaaaccagugccggaguaaauauguguacucuuauagcaauggauuuaggggaacuaugugaagauacuaugacguauaaaugcccacaaauaacagaagcagaaccagaugauguugauugcuggugcaaugcaacggacaccuggguuacuuauggaacauguucacaaacaggagaacauagaagagauaaaagaucaguugcacucgccccacaugucggacuaggauuagaaacgagaacagaaacauggaugucuagugaaggugcauggaaacagauucagagaguagaaacaugggcauuacgacauccuggguuuacagucauagcguuauuccuagcacacgcuauaggaacuucgaucacgcaaaaaggaauaaucuucauauugcuaaugcuuguaacucccucuauggcgaugcgaugcgucggaauugguaaucgagacuuuguagaaggacuuuccggagcgacaugggucgauguagugcuagaacacgguucaugugucacgacaauggcuaaaaauaaaccaacguuagauauagaauuauuaaaaacugaaguaaccaauccagcaauuuugagaaaauuaugcaucgaagccaaaauaucaaauacuacaaccgauucacguugucccacccagggugaagcaacccuaguagaggaacaggacgcaaauuucgugugccguagaacuuucguagacagaggaugggggaauggguguggcuuauucggaaaaggaucacuacucacaugcgcaaaauucaaaugugucaccaaacuugagggaaaaaucguccaauaugaaaaucucaaauauucuguaauuguaaccgugcacacaggagaucagcaccaaguaggcaaugaaacuacagaacauggcacaauagcgacgauuacaccacaagcucccacuucggagauacaacuaacggauuauggagcgcugacucuagauuguaguccucguacaggacuagauuuuaaugaaaugguucucuuaacgaugaaagagaaaaguugguuaguacauaaacagugguuuuuagaucucccauuaccauggacaagcggcgcgucgacgucucaggaaacuuggaaucgacaagaucuucuuguaaccuuuaaaacggcucacgcuaagaaacaggaaguugucguuuuaggcucgcaagaaggagcgaugcauacggcgcuaacaggcgcaacggaaauacaaacaagugguacuacuacaauauuugcuggucacuuaaaaugcagacuaaaaauggacaaauuaacucuuaaagguacuagcuacgugauguguacuggauccuucaaacucgaaaaagagguugcagaaacacaacaugguacgguuuugguucaagugaaguacgaggguaccgacgcaccuuguaaaauuccuuuuagcacucaggaugaaaaagguguuacucagaauggaaggcuuauaacagccaauccaauaguaacugauaaagaaaaacccgucaauauagaaacagaaccuccuuuuggggaaucuuauauuguugucggagcaggagaaaaagcacuuaaacucaguugguuuaagaaaggaagcucgauagguaaaauguucgaagcaacagcucgcggagcucgaagaauggcuauacugggcgacacugcuugggauuucgggucuauaggugggguauuuacaucaguugguaagcuaguccaucaaguauuuggaacagccuacggaguauuguuuagugggguuaguuggacuaugaaaauugguaucggaauauuauuaacauggcuaggccuuaacucuagaaguacaagucuuuccaugacauguauagcaguggggauggugacccuauauuugggcgucaugguccaagcggauucaggauguguaauuaauuggaaaggccgagaacuuaaguguggcucugguauuuuuguaacgaaugaaguucacaccuggacggaacaguauaaauuccaggcagauucaccaaaaagauuaagugccgcuauuggcaaagcaugggaggaagguguuugcggcauucggagcgcaacaagacuugaaaauauaauguggaaacaaauaaguaacgaauuaaaucauauccuauuagagaaugauaugaaguucacgguugugguuggagaugccaaugggauccuugcacaagguaagaaaaugauaagaccgcaaccaauggaacauaaauauuccuggaaaagcugggguaaagccaaaauaauuggggcugacauacagaauacuaccuuuaucauagauggaccggacacuccggaauguccugacaaucaacgagcauggaauauaugggagguagaagacuacggauuuggcauauuuacgacaaauauaugguuaaaauugagggacaguuauacccaaaugugugaucauaggcuaaugagcgccgcaaucaaagauaguaaagcuguucaugcugacauggguuauuggauagagucagagaagaaugagaccuggaaguuagccagggcuucauucauagaggugaagacuuguacguggccuaaaucacacacacuuuggagcaauggaguucuagaauccgaaaugaucauaccgaaaauuuaugguggaccgauaucacagcauaacuaccgaccaggguauuuuacccaaacagcgggacccuggcacuuagggaaauuggaacuagacuuugacuuaugugaagguacaacaguaguaguggaugaacacugcggcaauagagguccaucucugcggacaaccacaguuacaggaaaaauaauccaugaaugguguuguagaaguuguacuuuaccaccauugcgauuuagaggagaggaugguuguugguacgguauggagauccgaccuguaaaagagaaagaagaaaauuugguccguagcaugguaagugcaggcagcggagagguggauagcuucagccuggguauuuugugcgcaucaauaaugauagaggaagucaugcgaagucgcuggucgcgcaaaauguuaaugacuggaacacuugcagucuuuuuauuacuaauuaugggucaacuuacauggaaugaucucauacgauuauguauaaugguaggggcgaacgcuagcgacaggauggggauggggacaacuuauuuagcacucauggcaacauuuaagaugaggcccauguuugcaguaggcuuacuuuuccgacgauuaacauccagagaaguacuauuacuaacaauugggcugagccuaauggcgucggucgaacuaccuaauagucuagaagaacuaggcgauggccuugcaaugggcaucaugaugcuuaaacuccucacagaguuucagccacaccaacuuuggacaacacuccuaucuuuaacguucaucaaaaccacacuaagucuggauuaugcauggaagaccacugcaauggcccuaucuauaguuucauuguuuccccugugccucagcacaacaagucagaaaacuacuuggcuaccaguauuacucgguuccuuugggugcaaaccauuaacaauguuccuuauuacagaaaacaaaauaugggguagaaaaucauggccccuaaaugaagggauuauggcuauuggaaucgucucuauuuuauuaagcagcuuguugaagaaugaugucccuuuagcaggaccauuaauugccggugguaugcucauagcaugcuacguuauaucaggaaguucugcugacuuaagccuagagaaagcagccgaaguaaguugggaacaagaagcggaacauagcggaacuucucauaacauacugguugaaguacaagaugacgguacuaugaagauaaaagaugaagagagagacgacacauuaacgauacuccugaaagcgacacugcuggcgguuagcggaguuuauccuaugagcauuccugcuacucuauuugugugguauuuuuggcagaagaagaaacaaaggaguggagucuuaugggauacaccaucaccuccugaaguagaacgagccguacuggacgaugguauauauaggauucugcaaagaggucuuuuaggacguucacaagucgggguaggaguauuucaagauggaguauuccauaccauguggcacgugacgcgaggagcaguacuuauguaccaaggcaaaagacuagagccuuccugggcaagcguuaagaaagaucuuauaucuuacggugguggauggagauuucaggguucguggaacaccggagaagaaguucaagugaucgccguagaaccuggcaaaaaucccaaaaauguacagacaacaccuggaacauucaagaccccugagggggaaguaggagcgauagcauuggauuuuaaaccuggaacaucuggaagucccaucgugaacagagaaggaaaaauugucggcuuauauggaaauggggucgugacaacuagcgguacguacguaagugcuauugcacaagccaaagcaucgcaagaaggcccauuaccagagauagaagaugagguauuuaagaaaagaaacuugacuauaauggauuuacauccaggcucgggaaaaacaagaagauauuuacccgcgaucgucagggaagcaauaaaacgcaaacucagaacuuuaauauuggcuccaacgagagucguagcaucugaaauggcagaagcucuaaaaggcaugccaauacguuaucaaacaacugccguaaaauccgaacacacaggcagagagauaguggauuuaaugugccaugcaaccuuuacaaugagacuuuuaucuccgguaagaguccccaacuauaacaugauaauaauggaugaggcccacuuuacagauccagcaucgaucgcagcccguggauacauaucaacgagagucggaaugggcgaagccgccgcaauuuucaugacagcaacucccccaggauccguugaggcuuuuccccaaucuaacgcagugauacaagaugaagaaagggauauuccugaacgaucauggaauaguggauaugacuggaucacagauuuucccgguaagacagucugguucguccccaguaucaaaucaggaaaugacaucgcaaacugucuuaggaaaaaugguaaaagagugauacaauuaucuagaaaaacguucgacacugaauaucagaaaacuaagaauaaugacugggauuauguggucacgacagauauauccgagaugggggcaaacuucagagcagaucgagugauagacccacguagaugccucaaaccuguaauacuaaaggauggcccggaacgugucauacuugcaggaccuaugcccguaaccguagcuucagccgcacaacggcguggucguauaggaagaaaucagaauaaagaaggugaucaauacguauauaugggucaacccuuaaauaacgaugaggaucaugcgcauuggacggaagcaaaaaugcuacucgauaauaucaauacaccagaagggauaauccccgcgcuauucgaaccagaaagagaaaaguccgcagcgaucgauggagaguacagguuacguggugaggccagaaagacuuuuguagagcucaugaggaggggagaccuaccaguauggcuaagcuauaaagucgcgucagaagguuuucaguacagcgauagacgauggugcuuugauggcgagagaaauaaccaaguguuagaagaaaacauggauguugaaauauggacaaaagagggagaaaggaagaaacuacgaccacgauggcuagacgcaagaacuuauagugauccauuagcacuacgagaauuuaaggaauuugcagcuggucgacgaaguguaucuggagacuuaaucuuggaaauuggcaaauuaccccaacacuugaccuuaagggcacaaaaugcgcuggacaaucuagugaugcuucauaacagugaacaggguggaaaggcauacagacaugcuauggaagaacuaccggacaccauagagacauugaugcuccucgcccugauugcuguacucaccggggguguaacucuauuuuuccugucgggaaaagggcucgguaagacgucaauuggccuguugugcguaacggcuucuucggcgcuauuauggauggcuucuguggaaccacacuggauagcagcgagcauaauacuugaauuuuuccugaugguucuucuuaucccggagcccgauaggcagagaacaccccaagauaaucaacuggcauauguaguaaucgguuuacuuuuuaugauuuugacaguugcagcuaaugaaaugggguuauuagagacaacgaagaaagacuuggguauaggccauguugccgcggaaaaccaccaacaugccacaaugcuggauguagauuuaagacccgcaucugcguggacacucuaugcaguggcgacaacuguuauuacuccuaugaugaggcacacuauagaaaauacgacugcaaauauaucucucacugccaucgcaaaucaagcugcuauacuuaugggcuuagauaaaggauggccaauauccaagauggauauaggcguaccgcugcuagcccuaggcuguuauagucagguuaauccauugacacuaacugcugcagugcuaaugcuggucgcgcauuaugcaauaaucggaccuggacuccaagcaaaggcuacuagagaagcacagaaaagaacggcagcagguaucaugaaaaauccuacaguagacggcauaguagcgauagaccucgauccaguggucuaugacgcuaaguuugaaaaacaacugggacaaauaaugcuacuaauauuaugcacaagucaaauucuauuaaugcgcacaacaugggcauuaugugaaagcauaacgcuugcuacaggaccucucacaacccuaugggaagguaguccuggcaaauucuggaacacaacgauagcaguaaguauggcaaauauauucagaggauccuacuuggcuggugccggucuagcuuuuagcuuaaugaagagucucgguggaggcagacgagggacaggagcccaaggugaaacacuaggagagaaauggaaacgacaacuuaaccaauuaagcaaaagcgaauuuaacaccuacaaaaggagugggauaauggaaguugaucggucugaggcuaaagaagguuuaaaacgaggagaaacuacuaagcacgcggugucccguggaacugccaaguugaggugguucguugaaagaaaucuuguuaaacccgagggcaaggucauagaccuagguugcgggagggguggauggucguauuauugugcaggauugaagaaaguaaccgaaguaaaaggauacacuaaaggcgguccgggccaugaggagccgauaccgauggccaccuauggcuggaauuuaguaaaacuacacaguggcaaagacguauuuuucaugccaccugaaaaaugugauacauuauuaugugauauaggugaaagcucuccaaauccaacgauugaagaaggucguacacuacguguauugaaaaugguggaaccguggcuucgcggaaaucaguuuuguauaaaaauucuaaaccccuauaugccuucagucgucgaaacauuggaacaaaugcagagaaagcauggggguaugcucgucagaaaucccuugagcagaaauaguacucaugaaauguauuggguauccugugguacuggcaauauaguaucugccgugaauaugaccucgcgaauguuauuaaacagguucacaauggcucauaggaaaccaacuuacgaacgagauguggaucuaggagcgggaaccaggcauguagcaguagaacccgaaguggcuaauuuggauauuauuggacagaggauagaaaacaucaaaaaugaacauaaaaguacuuggcauuaugacgaagauaacccuuacaaaacaugggcauaccaugguaguuaugaaguuaaacccaguggaagugcaucgagcauggucaauggaguagugaaguuacugaccaagcccugggacguaauaccaauggugacgcagauugcaaugacagacacuacaccauucggucaacaaagaguauuuaaggaaaagguagacacucguacaccgcgugcaaaacgcgguacuacacaaaucauggaaguuacagcaaaauggcucuggggauuccuuucaagaaauaagaaaccucgaauaugcacuagagaggaguucacgaggaaaguacgaucaaaugcagcuaucggugcuguuuuuguagaugaaaaucaauggaacucugcgaaagaagccguagaagaugaaagguucugggaucuaguacauagggaacgagaacuucacaaacaaggaaaaugugcaacgugugucuauaauaugaugggcaaacgugagaagaaacuaggugaauuugguaaagcaaaaggaagcagagccaucugguacauguggcuaggcgccagauuccuagaauuugaggccuuaggauuuaugaacgaagaccauugguucagucgugaaaacucucuaucagggguagaaggggaaggguuacauaaauuaggauacaucuugcgggacauaucuaaaauuccgggaggaaauauguacgcagacgacacggccggaugggauacucggauaacggaagaugaccugcaaaaugaagcuaaaauaaccgacaucauggaaccggagcaugcacucuuagcuacaaguaucuucaaauuaacguaucaaaauaaggugguacgaguucagcggccggcaaagaacgguaccgugauggacgucauaagccguagagaccaacgaggaaguggccaaguaggaacauaugggcuaaacacauucacgaacauggagguucaauuaauucgucagauggagucagaaggaauauuccuuccauccgaguuggaaacuccaaaccuagcugaaagaguacuagauugguuggaaaaacacggggcugaacgauuaaaacggauggcgauaucaggcgaugauugugucguaaagccaauugacgaucgauucgccacagcauuaacggcuuuaaaugauauggguaaaguaaggaaggauauuccccaaugggaaccaucuaaggguuggaacgauuggcaacaagugccguucuguucacaccauuuucaccaacuaauaaugaaagauggaagggagaucguagugccauguagaaaucaggaugaacugguuggacgugcccgagucucacagggagcagguuggucauuacgagaaacugcaugucugggcaaaaguuaugcgcaaauguggcaauugauguauuuccauagacgugauuuacgacuagcggcaaacgcuauuugcuccgcuguuccugucgauuggguaccaacaagucguacaacauggucgauucaugcccaccaucaauggaugacuacagaagacauguuaucuguuuggaauagaguguggauugaagagaacccauggauggaggauaagacucaugucagcucgugggaggaaguuccauauuuagguaaaagagaagaucaaugguguggauccuuaauuggccugacagcaagagcaacaugggcuacaaauauacaaguggccaucaaucaagugcguagacucauaggaaacgagaacuaccuagauuacaugacgucaaugaaaagguucaaaaaugaaucugauccagagggggcucuaugguag

SEQ ID NO: 21328 - RNA, 9879 nt, Artificial Sequence
  derived and/or modified CDS sequence (opt6) from DENV-1__FJ873814__SS-prME
ucagugacuaugcuguuaauguuacugccgacagcauuggcauuucacuuaacaacaagagggggagaaccacacaugauagugaguaaacaagaaagaggaaagagcuuacuguucaaaacaagcgccgguguaaacauguguacacuuauagccauggacuuaggagaacuaugugaagacacaaugacguauaaauguccacaaauaacagaagcugaaccagaugacguggacuguugguguaacgcaacggauacuuggguaacauacgggaccugcagccaaacuggagaacaucgaagagacaaacguucaguugcucucgcaccacacguuggauuagguuuggaaacucguacugaaacauggaugagcucagaaggagccuggaaacaaauacaaagaguagaaacaugggcacuaagacauccaggguuuacagugguagccuucuucuuagcacacgccauaggaacgaguauaacacaaaaaggaauaaucuuuauccucuuaauguuaguaacuccuucaauggccaugcgaugugucggaauuggaaaccgcgauuucguagaagguuuaucgggagcuacuuggguagacgucguacuugaacacggaagcugugugacuacaauggcgaaaaacaaaccuacucuagauauagaacuauuaaaaacagaaguuacuaaucccgcaauacuaaggaaacuaugcauagaagcaaaaauaucgaacacaacaacugacucucguuguccuacucaaggggaagcaacacuggucgaagaacaagaugcaaacuucguaugucggcggacuuucguagauagagguuggggaaacggauguggucuguuuggcaaaggcagcuuacucaccugugcaaaauuuaaaugugucaccaaauuagaaggcaaaaucguacaauacgaaaaccuaaaauauucuguaauaguuacuguacacacgggcgaccaacaucaaguagggaacgaaacgacagaacaugggacuauagcuauaauuaccccacaagcgccaacaucggaaauacaacucaccgacuacggggcucuaacgcuagauugcuccccgagaacaggacuagacuuuaacgaaaugguucuacuaacuaugaaagagaaauccuggcugguucauaaacagugguuuuuagauuuaccauuaccuuggacaucaggagcuucgacuagccaagagaccuggaauagacaagauuuguuaguaacauucaaaacagcacaugcaaagaaacaggagguagucguccuugggucacaagaaggggccaugcacacugcuuuaacaggagccaccgaaauucagacaagugggacgaccacuaucuucgccggacacuuaaaaugccgauugaaaauggauaaacugacucugaaaggcacauccuacguuauguguacaggcaguuuuaaacuugagaaagaaguagccgaaacucaacaugggacugucuuagugcaagugaaauaugaagguaccgaugcacccugcaaaaucccauucagcacacaagaugagaaagguguaacacagaacggcagauuaauaacagcaaacccuauaguaaccgauaaggagaagcccguaaauauugaaacagaacccccguucggagagucguauauaguuauuggugccggagaaaaagcucucaaacuaucgugguucaagaaaggauccucuauugggaagauguucgaagcuacagcgagaggcgcgcguagaauggcgauuuugggagauaccgcaugggauuuugggaguaucgguggaguguuuacauccguuggaaaauuaguucaucaaguuuuugguacagcauauggaguguuauuuucuggcguguccuggacaaugaaaauaggaaucggaauuuuacucacaugguugggccuuaauaguaggucaacuucuuugaguaugacuugcauugcaguuggaaugguuacuuuguaccucgguguuaugguacaagcagauucagguuguguaauaaacuggaaagggagggagcuaaaguguggcaguggcauauuuguuacuaacgaaguacacacguggaccgaacaauauaaauuccaagcagauucucccaagcgguuguccgcagccauagguaaagcgugggaagaaggaguuuguggcauuagaucagcaacacguuuagaaaauauaauguggaaacaaauauccaacgaacuaaaucacauucuacuggagaacgacaugaaauucacagucguagugggggaugcuaaugggauauuggcacaaggcaagaaaaugauaaggccacagccgauggagcacaaauacuccuggaaaucuugggggaaggcaaagauuaucggggcagauauacaaaacacgacuuuuaucauagacggaccugauacaccagaauguccagaugaucaacgcgcuuggaauauaugggaaguggaagacuauggauuugguauauuuacaaccaauauuuggcuaaaauugcgcgauaguuauacacagaugugugaccacaggcuuaugagcgcagcgauaaaagacucaaaggccguccaugccgauaugggauauuggaucgaaucggaaaagaacgaaacguggaagcuagcgcgcgccucauucauagagguuaagacgugcacuuggccuaaaucucauacauuauggucaaauggaguauuggaauccgaaaugauaauuccaaaaauuuaugguggaccaaucucgcaacacaauuauaggccgggauauuucacacaaacagcugggccguggcaccuaggaaaacuagagcuggauuuugaccucugugaaggcacaacaguaguagucgaugaacauuguggaaauagaggaccuagucuaagaaccacuacaguuacaggcaaaauuauccaugaauggugcugucgaucuuguacguugccuccguuacgauucagaggugaagacggaugcugguaugggauggagauaagaccuguaaaagaaaaagaggaaaauuuaguaagaucaaugguaucagcagggucaggugaagucgauaguuuuagcuugggcauucugugcgccuccauaaugauagaggaaguaaugagaucacgcuggagccguaagaugcuuaugacaggaacguuagcaguguucuugcugcuuaucaugggccaacuuacauggaaugaucuaauccgucucugcauaaugguuggcgcuaaugcuagugauagaaugggaauggggacuacguaccuugcgcuuauggcuacuuuuaagaugagaccaauguuugcaguuggcuuauuauucaggagacuuaccagcagagaaguauugcuauuaacaauuggccuuagucuagucgcaucaguggagcuaccaaauagucuggaagaacucggagacgggcuagcaauggguaucaugaugcuuaaacuacuaacugaguuccaaccucaccaauuauggacgaccuuguuaagccuaacuuuuauaaagacaacuuuaagccucgacuaugcuuggaaaaccaccgcaauggcacucagcauuguuucauuauucccuuuaugucuaucuacaacaucacaaaagacaacaugguugcccgucuuacuaggcaguuucggaugcaagccauuaacaauguuucugaucacagaaaauaaaauauggggacgcaaaagcuggccacuuaacgaaggaauaauggcaauagguauaguuucaaucuuauugagcaguuuacugaaaaacgacguuccacucgcuggcccauuaauugcgggaggaaugcucaucgcauguuauguuauauccggcucaagugccgaucuaucccucgaaaaagccgcugaaguuucuugggaacaagaggcugaacacucaggaacaucacauaauauacuugucgaagugcaagacgauggaacgaugaaaauuaaggaugaagagaaagacgauacauuaacaauacuucuaaaagccacgcuuuuagcaguaucagguguguacccaaugagcauaccugccacguuauuuguaugguauuuuuggcagaagaagaaacagcguaguggcgucuugugggacaccccauccccaccagaaguagagcgugcuguauuggaugacggaauauaccgaauuuugcagagagguuuauuaggaagaagucaaguaggaguuggggucuuucaagauggaguauuccacacuauguggcauguaacuagaggggcuguuuuaauguaccaaggaaagagauuggagccuaguugggcgagugucaagaaagacuuaauaucauacggagguggcuggcguuuccaaggcuccuggaacacaggcgaggagguacagguuaucgcuguugagccagggaagaauccgaagaacguacagacaacaccagguacauuuaagacgccagaaggugaagugggagcuauugcgcuugauuuuaaaccugggaccagugguagucccaucgucaauagagaaggcaagaucguaggcuuauauggaaaugggguaguaacaacgaguggcaccuauguuucagcaaucgcacaagcuaaagcuagucaggaaggaccucuaccugaaauagaggaugaaguauuuaagaaacgaaaccuuaccauuauggauuugcauccuggaagcggaaaaacuagacgauacuuacccgcaauaguaagagaggcaauaaaaaggaagcugagaacccuaauucuagccccgaccagagucguagcgucugaaauggcugaggccuugaaagguaugccaauucgauaucaaacaacugcgguaaaaagugaacacacuggucgggagauuguugaucucaugugccacgcaacuuucacaaugcggcuguuaucacccguaagaguaccuaacuacaauaugauaauaauggaugaggcccacuuuacggauccggcauccauagcggcaaggggauacauuagcacccgagugggcaugggagaggcagcggcuaucuucaugacagcaacaccuccaggcucuguagaagcguuuccccaaucaaacgcaguaauucaagaugaagaacgggauauuccugaaagaagcuggaacaguggcuaugacuggaucacggacuuucccggcaagacgguuugguuuguuccgucgauaaaaucaggaaacgacauugcaaauuguuuacguaagaacggaaagcgcguuauacaacuaagcaggaaaacauuugauaccgaauaccagaaaaccaaaaauaacgauugggacuacguuguuacuacugauauaucugagaugggggcaaauuuuagagcagacagaguaaucgauccaaggagaugucuaaaaccugugauucuuaaggauggaccagaacgagugaucuuagcaggaccaaugccaguaacaguagcuagugcagcucaacggagaggccggauaggaagaaaccaaaacaaagaaggagaucaguauguuuacaugggucaaccauuaaauaacgaugaagaucacgcacacuggacagaagcaaaaauguuauuagauaacauuaacacuccagaggguauaauuccugcauuguuugaaccggaacgugaaaagucugcggcgauugauggugaauaucgcuugagaggggaggcacgcaaaacauuuguagaauugaugaggcgaggcgaucuuccaguauggcuaucauacaagguugcaucugaaggauuucaguauucugaccgucgauggugcuuugacggggaacgaaacaaccaaguauuagaagagaacauggacguugaaauuuggaccaaagagggagaaagaaagaaauuacgaccucgguggcuugaugcgcgaacguauucagauccucuagcgcuccgagaauuuaaagaauuugcugcagguagaagaucagugagcggagacuuaauacuagagauugguaaguuaccacaacaucuaacauugagggcacaaaacgcacuugacaaucuugucaugcuucacaauagugagcaaggugguaaagcguauagacaugcaauggaggagcuccccgacacaauugagacauugaugcucuuagcauuaauugccguucuuacugguggaguaacuuuauucuuucuaagcggaaaaggauuagggaaaacaucuauuggcuuacuaugcguaacagcuaguagcgcuuugcuuuggauggcuagcguggaaccucauuggaucgcagcuucuauuauucuagaguucuuucuaaugguauuauuaauuccggagcccgaucgacaaagaaccccacaagacaaccaauuagcuuacguggugauaggacuccuauucaugauacuaacaguagcugcaaaugaaaugggauuauuagagacuacuaaaaaggaucuaggaauaggucauguagcagcagagaaccaucaacaugcgacuauguuagaugucgaccuucguccggcaucugcguggacguuauacgcuguugcuacaacugucauuacucccaugaugagacacacuaucgagaauaccaccgccaacauuagccuaacggcaaucgcaaaucaggcagccauuuuaaugggauuagauaagggcuggccgauuucgaagauggacauaggaguaccuuuauuagcuuuaggauguuacagucagguaaauccccuaaccuuaacugcagcuguacuaauguugguggcacacuaugcgauaauuggcccagguuuacaagcgaaagcaacucgagaagcgcagaaacgcacggcggcugggauaaugaaaaacccgaccgucgacgguaucguagccauagaucuugauccaguugucuacgaugcuaaguuugagaaacaguuaggacaaaucauguuacuaauucucuguacuucucagaucuuacuaaugcguacaaccugggcuuuaugcgaauccauuacucuugcgacugggccccuuaccacgcuaugggaaggcucuccggguaaauucuggaauacgacuauagcggugucaauggccaacaucuuuagaggaagcuauuuggcuggugccggauuagcauuuagucucaugaagucacuuggcggagguagaagaggaacgggcgcccaaggcgaaacccuaggggaaaaguggaagcgacaauuaaaccaacuuucaaaauccgaauuuaacacuuacaaacgcaguggcauuauggaaguagaucguagugaagcaaaagaaggcuugaagcggggagagacgacuaagcaugcagucagccggggaacagcaaaauuaagaugguucguagaacgaaauuuaguaaagccagaaggaaagguaaucgauuuaggaugcggaaggggaggguggucuuauuauugugcuggauuaaagaaaguaacagaaguaaaaggauauacaaaaggaggaccaggucacgaagaaucuauuccaauggcuacauacgcauggaaucucguaaaauuacauucaggcaaagaugucuucuuuaugccaccugaaaaaugugauacuuuacuaugugauauuggggagucaucuccaaacccaaccauugaggaaggacgaacccuaaggguauuaaaaauggucgaaccaugguuaagagguaaccaauuuuguaucaaaauuuuaaacccauacaugcccucaguggucgaaacgcuagaacaaaugcaaaggaaacauggcgguaugcugguaagaaaucccuuaagucgcaacaguacacaugaaauguacuggguuucuuguggaacagggaauaucguuucugcaguuaauaugacaucgagaauguuacuaaaucguuucacuauggcacaucguaaaccgacguacgagagagauguagaccuaggagccgguacgagacauguagcaguagaaccugaagucgcaaauuuagauauuauuggucagcgcauugaaaauauaaagaaugagcauaaaucuacauggcauuacgacgaggauaauccuuacaagacaugggcuuaucauggaaguuaugaaguaaaaccgucagguucagcuucuucgaugguuaacgguguaguacgucuacuuacuaagccuugggacguuauacccaugguaacacaaauagcaaugacagacacaacaccauuuggucaacaaagaguauuuaaggagaaaguagacacaaggacuccuagagcaaaaagaggcacaacacaaauuauggaagucacagcuaaaugguuguggggauucuugaguagaaacaagaaaccucgaauaugcacaagggaagaauuuacaagaaagguacguuccaaugccgcuauuggcgcaguauuuguugacgaaaaucaguggaacucugccaaagaggcuguugaggacgagagauuuugggaccuuguacauagggaaagagagcuacauaagcaaggaaaaugugcuacaugcguauauaauaugauggggaaacgagagaagaaacuuggagaguucggaaaggcaaagggaagccgggcuauaugguauaugugguuaggugcacgguuucuagaauuugaagcccugggcuuuaugaaugaagaccacugguuuagcagggagaacucucuuucuggaguugagggugaagguuuacauaaauuggguuauauucuaagggauaucucaaagauuccagggggaaacauguacgccgaugauacggcaggaugggauaccaggauuaccgaagaugacuuacaaaaugaggcaaagauaacggacauaauggagccagaacacgcuuuguuagccacuuccauauuuaaauuaacuuaccaaaacaaagugguucgaguacaacgaccagcuaaaaauggaacuguaauggauguaauaucaaggagggaccaacgcgguaguggacagguagguacauaugggcuuaacacauucacaaauauggaaguacaauuaauacgacagauggaaucggaaggcauauuccuaccaucagaacuggaaacuccuaacuuagcaaaaagaguccuagauugguuggaaaagcacggagcugagcguuugaaacggauggcaauaucaggggaugacugcgugguuaagccgauagaugaccguuucgcaaccgcuuuaaccgcucuuaacgauaugggcaaaguuagaaaagacauuccacaaugggaaccaaguaaagguuggaaugauuggcagcaaguccccuuuuguucacaccacuuucaucaacuaauaaugaaggauggaagagaaauuguuguaccaugucgaaaucaggaugaauuaguuggucgcgcgagaguaucacagggagcaggauggucucugagagaaaccgcuugcuugggaaaaagcuaugcgcaaauguggcaguuaauguacuuccacagaagagaccuacgccuagcugcaaacgcaauauguucagcagucccaguugauugggugccgaccucaagaaccacaugguccauccacgcucaucaccaguggaugacaacagaggauaugcuaucuguauggaaucguguauggauugaagaaaauccuuggauggaagacaaaacacacguaucaucuugggaagaaguaccauaccuaggaaaaagagaagaccaaugguguggaucgcuuaucggauuaacugcacgagccacaugggcuacaaacauacaaguugcaauuaaccagguucgacgauuaauaggaaaugaaaauuaucucgacuauaugaccucgaugaaaagauuuaaaaaugaaucagauccagaaggagcauuaugguga

SEQ ID NO: 21329 - RNA, 9879 nt, Artificial Sequence
  derived and/or modified CDS sequence (opt6) from DENV-1__JN819403__SS-prME
uccguuacuauguugcuuauguugcugccaacugcauuagcuuuucaucucacaacuagaggcggugaaccacacaugauuguaucaaaacaggaaaggggaaaaucgcuuuuauuuaaaaccagugcggguguaaacauguguaccuugauagcuauggauuugggcgaacuaugcgaggauacaaugacuuacaaaugcccucaaauuacagaagcagaaccggaugauguugacuguugguguaaugcuaccgacacgugggugacuuauggaacauguagccagacaggggaacauaggagagauaaaagaaguguagcacucgcuccacauguuggauuaggacuagagacuagaacagaaaccuggaugucaagugaaggggcauggaaacaaauucaaagaguagaaacaugggcacuacggcacccagguuucacaguuauugcguuguuucuagcgcaugcaauaggaacuucgauuacacaaaaagguauaauauuuauacuccuaaugcuaguaacucccaguauggcuaugagaugcguaggaauaggaaauagggauuucguagaaggguuaucgggugcuacuuggguggauguagugcuagaacauggaaguugcguaacaacaauggcgaaaaauaaaccgacauuggauauagaauuauuaaaaacagaaguuacaaauccugcaauacucagaaaauuauguauagaagccaaaauaucaaauacuacuaccgauaguagauguccgacccaaggagaagcaacgcuuguagaagaacaggaugcaaacuuuguauguagaagaacuuucguagauagaggauggggaaacggaugcgguuuauuuggaaaaggcucauugcuaacaugugcuaaauuuaaauguguuacaaaacuagaagguaaaaucguacaauaugagaaccugaaauauuccguuauaguaacaguccacacaggggaucaacaccagguagggaaugaaaccacagaacacgguacuauagccacgauaacaccccaagcgcccacuagcgaaauacaauugacggacuacggagcucuuacguuggauugcuccccaagaaccggacuagauuuuaaugaaaugguucugcugacaaugaaagagaaaagcugguuaguucacaaacaaugguuuuuagaucuaccucugccauggacuucuggagcaucaacuucucaggaaacuuggaauagacaagaccuauuagugacguucaaaacagcacaugcuaagaaacaggagguagugguacuaggaucacaggagggcgcgaugcauacugcauuaacgggggcaacggaaauacaaacuucuggaacgacuacuauauucgcaggccaucugaaaugcagguugaaaauggacaaacuaacauuaaaaggaacaaguuaugucaugugcacagguucguuuaaacuugagaaagaagucgcggagacccagcaugggacagugcucgugcaaguuaaauaugagggaacagaugcaccuuguaaaauaccauuuaguacgcaagacgaaaaaggaguuacucaaaaugguagauuaauaaccgccaacccaauugucacagauaaagaaaaaccaguaaauauagaaaccgagccacccuucggagaaucauacauugucguuggugcaggcgaaaaagcauuaaaauugucaugguuuaaaaagggaucuucuauuggaaaaauguucgaagcaacggcaagaggcgcaagaagaauggcgauucugggagacaccgcuugggacuucgggagcauaggggguguguuuacaucggugggaaaauuaguccaucagguauuugggacggcguauggaguuuuauuuucaggugucaguuggaccaugaaaauaggcauugguauacuauuaacauggcuaggauuaaauagcagauccaccucacuaaguaugacauguaucgcaguagggaugguuacccuauaucuagguguuaugguccaagcagauucuggcuguguaauuaacuggaaaggaagagaauuaaaguguggaagcggaauauuuguuacaaacgaaguacacacauggacugagcaauacaaguuucaagcagauucacccaaacgcuuauccgcagcaauagguaaagccugggaggaaggcguguguggaauacgcucggccacaaggcuagaaaacauaauguggaaacagaucucuaacgagcuaaaucauauuuuguuagagaaugauaugaaauucaccguggucguuggugaugcuaaugggauucucgcgcaaggaaagaaaaugauaagaccacaaccuauggaacauaaguauucauggaaaucauggggaaaagcaaagaucaucggugcagauauacagaacacuaccuucauuauugacggaccagauacgccagaaugucccgacaaccaaagagcauggaauaucugggagguagaagacuacggauucggaauauucacaacgaauaucuggcuaaaguuaagagacucauacacccaaaugugugaucaccgguugaugucagccgcaauuaaagacagcaaagcgguucaugcugauaugggauauuggaucgagagugagaaaaaugaaacauggaaacuugcaagggcuucguucaucgaaguaaaaacuuguacuuggccaaaaucacauacucuuuggucgaaugguguuuuggaaagcgagaugaucauucccaagauauauggcgguccuauuucccagcauaauuauagaccaggcuauuucacacaaacggcaggaccguggcaucucgguaaacucgaacuugacuucgauuuaugcgaaggaaccacaguuguaguagaugaacauugcggcaacagggggccuaguuuaagaacuacaacuguaacgggaaagauuauccaugaguggugcugucgaucauguacacuaccacccuuacgauuucgcggugaagauggcugcugguacggaauggaaauucgcccaguuaaagagaaagaggaaaaccuaguacguaguaugguguccgcuggaagcggcgagguggacaguuucagcuuagggauuuuaugugcgaguauuaugauugaggaagugaugaggucgagauggaguagaaaaauguuaaugacugggacauuagccgucuuucuacuccucaucauggggcaauuaacguggaaugaccugauuagacuguguauuaugguaggggcuaacgcuucggacagaauggggaugggcaccacguaucuagcccucauggcaacauucaaaaugagacccauguucgcggugggauuauuauuucgccggcuuacaaguagggaaguauuauuauuaacgauaggauuaagccuaguagcuaguguagaauugccuaauucauuagaagaacugggagauggacuugcaaugggcaucaugaugcuaaaacuacucacagaauuucaaccacaccagcuuuggacaacacuguugucguuaacguucauaaaaacaacguugagucuggacuaugccuggaaaacaacggcaauggcgcuaucaauaguuucauuauucccacucugccuaucaacgacgagucaaaagacuaccuggcugccagugcuacugggcucauuuggaugcaaaccauuaacaauguuccugauaacugaaaauaaaauuugggguagaaaguccuggccgcucaacgaaggcauaauggcuaucggcaucguaagcauucuacuaagcagcuuacucaaaaaugacgucccacuugcaggacccuugauugcuggaggaaugcugauagccugcuacguaauuaguggcaguucugcagauuugagcuuagaaaaagcugcagaaguaaguugggaacaggaggcugaacauagcggcacaagccacaacauucuaguagaaguacaagaugauggcacaaugaaaauuaaggacgaagaacgagacgauacgcuuacaauucuccuaaaagcaacccuacuagcaguaagcggaguauacccgaugagcauaccagcgaccuuguucguuugguacuucuggcagaagaagaaacaacguagcggcguccuaugggauacuccgucuccaccagagguagagcgagccguacuugaugacgggaucuaucgcauucuacaaaggggacugcuggguagaucucaaguagguguuggugucuuucaggacgguguuuuccauacaauguggcauguuacucgaggagcaguuuuaauguaucaaggcaaaagacuagaaccgagcugggccagcgucaagaaagauuuaauuucuuacgggggagguuggcgauuucagggaucuuggaacacaggagaagaaguacaagugauugcaguagagccaggaaagaaccccaaaaauguucaaacuacucccggaaccuuuaaaacuccagaaggugaaguuggagcaauugcuuuggauuuuaaaccuggaacaagcggcuccccaauaguaaacagggaagggaaaauaguuggacuauacggcaauggaguggucaccacaucagguacauacgucucggcgauagcucaagccaaagcaucacaggaagguccccuucccgagauagaagaugaagucuuuaagaaacgaaauuugacaauuauggaccuccacccuggaucaggaaaaacacgucgauacuuacccgcgauaguacgagaggcuauaaaacguaaacugaggacguuaauacuagccccaacacgcgugguagcaucagaaauggcagaagcacuaaagggaaugcccaucagauaucagacaacugcgguuaaaucagaacauacaggcagagaaauuguagaucugaugugccacgcaacuuuuacaaugcggcuucucagcccggugcgcguuccuaauuauaacaugauaauaauggacgaggcucauuucacggauccagcauccauagcggcgagagguuauauuucgacaagaguaggaaugggagaggcagccgcaauauuuaugacagcuacaccgcccgguaguguugaagcauuuccucaaaguaacgccguaauccaagaugaagaaagagacauaccggaacgaagcuggaacagcgguuaugauuggauuaccgacuuuccagguaagacuguaugguucguucccuccauaaaaucagguaacgauauagccaauugucuaaggaaaaauggcaaaagaguuauucaacuuucacguaaaacguuugauacagaauaucagaaaacgaagaacaacgauugggauuauguuguuaccacagacauuucugagaugggggcgaacuuccgcgcugaccguguuaucgacccuaggagguguuuaaaaccagugauauuaaaagacgguccagaaagaguaauacuagcaggaccaaugcccguaacaguugcgagcgcugcucaacgaagaggccgaauugguaggaaccaaaacaaagaaggagaccaguauguauauaugggacaaccacuaaacaaugaugaagaccaugcacauuggacggaggcaaagauguuguuggacaacauaaauacuccagaggguaucauaccugcuuuauuugagccugaaagggaaaaaucggccgcgauagauggagaguauagauuaaggggagaagcacgcaaaacauucguugaauugaugcgaaggggcgacuuaccagucuggcuuucauauaaaguggcgucagaaggauuccaauauagcgacagacgcugguguuucgauggugagaggaauaaccagguucuagaagaaaauauggauguugagauauggacuaaggaaggcgaaagaaagaaauuacgaccgcguuggcuagaugcgaggaccuacagcgauccccucgcguugcgagaauuuaaagaguucgcugcaggucguagaucaguuuccggggaucucauucucgaaauugguaaacuuccacaacauuuaacuuuacgagcucaaaaugcuuuagacaaccuuguuaugcuacauaauucugaacaaggggguaaggccuaucgucaugcaauggaagaauugccagauacaauagaaacgcucauguuguuagcccuuauagcgguauuaacagggggcguuacccuuuucuuucuuucagggaaaggucucggaaagaccaguauuggacuucucugugucacugcuucaucugcauuauuguggauggcaaguguagaaccccacuggauugcggcaucaauaauuuuggaguucuuuuuaaugguucucuuaauucccgaaccagauagacaaaggaccccgcaggauaaccagcuugcuuacguuguuauuggucuucuauuuaugauacucacaguagcagcgaaugaaaugggacuguuagaaacaacgaagaaagauuuagguaucggccacguugcggcagaaaaccaucaacaugcuaccauguuagaugucgaucuaagaccagcuucagcguggacauuauaugcgguggcaacaacaguaaucacaccaaugaugcgucauacaauagaaaauaccacagcaaacauuucgcugacagcaauugcaaaccaggcagcgauauugauggguuuagacaaagguuggccaaucaguaaaauggauaucggcgugccuuuauuagccuuagguugcuacucucagguaaauccuuugacacugacagcggcaguccucaugcucgucgcgcauuaugcaauaauuggcccggguuuacaagcgaaagcaacucgcgaagcacaaaagcgaacggcagcagggauuaugaaaaauccuacaguagauggaauuguugcgauagaucuagauccaguaguauacgauacuaaguuugaaaaacaacuaggacaaauaauguugcuaauauuguguacgucacaaaucuuacuaaugcgaaccacaugggccuuaugugaaagcaucaccuuagcaacuggucccuuaacaacucuaugggaaggaaguccagguaaguucuggaauacuaccaucgccgucaguauggccaacauuuuucguggaucguaucuugcaggagccgguuuagcauuuagccuaaugaaaucgcuaggaggaggucguaggggaacgggugcccaaggagaaacucuaggugaaaaauggaaaaggcaauuaaaucaauuaagcaaaagugaauuuaauaccuauaaaagaagcggaauuauggaaguugaccgcucugaggcuaaagaaggacuaaaacgaggugagacgacuaagcaugcagugucacgaggaaccgcgaagcuaagaugguuugucgaaaggaaccucguuaaacccgaagguaaagucauagaucugggauguggccgaggagggugguccuacuacugcgcugggcucaagaaaguuaccgaggugaagggguauacuaaaggaggaccaggccaugaagggccuauuccgauggcaaccuauggauggaaucuagucaaauugcacagugguaaagauguauucuucaugccaccagaaaaaugugauacuuuacuuugugauauuggagaaaguaguccaaacccuacaauugaagaagguaggacgcucagaguucuaaaaaugguugaacccuggcuacgcgguaaccaguuuuguauaaaaauccugaacccuuauaugccgagcguugucgaaacuuuggagcaaaugcaaagaaaauauggcggaaugcugguuagaaacccacucaguaggaacucuacccacgaaauguacuggguaagcuguggaaccgggaauaucguaagugcaguaaauaugacaagucgcaugcuuuuaaaccgguucacaauggcucacagaaaaccaacauaugaacgagacguggaucuaggagcaggaacuagacacguagcaguagaaccagaaguugccaaccuugauauuauuggacaaagaauugaaaacaucaaaaacgaacauaaaagcaccuggcacuaugaugaggauaauccauauaaaacaugggccuaccauggaagcuaugagguaaaaccuucugguuccgccagcucuaugguaaacgguguuguacgacuguugacaaaaccgugggacgucauaccaauggucacgcaaauagccaugacagacacuacgcccuucggccaacaaaggguauuuaaagaaaaaguagauacaagaaccccaagagcaaaaagaggaacaacucaaaucauggaaguaacggcuaaauggcuguggggcuuucuuuccagaaauaagaaaccccgcauaugcacaagggaggaauuuacgagaaagguacgaaguaaugcagcuauaggugcgguguuuguagacgaaaaccaauggaacucugcuaaagaagcuguagaggaugaacguuuuugggaccucguccacagagaacgugaacuacauaaacaagguaaaugugcgacguguguguauaacaugaugggaaaacgcgagaagaaacucggugaauuuggaaaggcuaaaggcucaagagcuauaugguacauguggcuuggugcuagguuucuugaguucgaagcauuaggauuuaugaacgaagaccacugguucucgagagaaaauagucuuucuggaguagaaggagaaggacugcauaaacugggguacauacucagagacauuaguaagauaccuggagguaacauguacgcagaugauacagcgggcugggacacgcgaauuaccgaagaugaccuucagaacgaagcaaaaauaaccgacauuauggaaccagagcaugcgcuacuugcuacgaguauauucaaauuaacuuaucaaaauaagguaguccgagugcaacgaccggccaaaaauggcacaguuauggaugucauaucaaggagagaccaacgcgguagcggucaaguuggcacguacggauuaaauaccuuuacgaauauggaaguucagcugauucgacagauggagucugaaggaauauuucuaccaagugaauuagagacaccaaaccuagccgagaggguucuagauuggcuagaaaagcacggugcggaacgccucaaaagaauggcuauaucuggagaugauugcgucgugaaaccuaucgacgaccgauucgcuaccgcacuaacagcucuaaaugacauggguaaaguaagaaaggauauaccacaaugggagccaucaaaaggauggaaugauuggcaacaaguaccuuuuuguagccaucauuuucaucaguuaaucaugaaagacgguagagagauagucgucccauguagaaaucaagaugagcucgucggccgagcacguguaucccaaggggcuggauggagucucagagaaacagccuguuuagggaaaagcuaugcgcaaauguggcaacuuauguauuuccacagacgggauuuaagauuagcagcgaaugcuauauguucagcgguaccuguggauuggguaccaaccucacgaacuacuuggucaauucaugcccaccaucaauggaugacgacugaggauaugcucucaguuuggaauagagucuggauagaagaaaacccguggauggaagauaaaacucauguuucaaguugggaagaaguuccuuauuuagguaaacgagaagaccaauggugcggguccuugauaggguugacggccagagccacaugggcaacaaacauucaaguagcaaucaaucaaguacgaagauugaucgguaaugaaaauuaccuugauuauaugacaucaaugaaaagguuuaaaaacgaaucggauccggagggcgcucucugguaa

SEQ ID NO: 21330 - RNA, 9879 nt, Artificial Sequence
  derived and/or modified CDS sequence (opt6) from DENV-1__KF973453__SS-prME
agcguaacuauguugcuaauguuacuccccacugcauuagcuuuccaucuuacaacacggggaggugaaccucacaugauugucagcaaacaagaaagaggaaaaagucugcucuuuaaaacaagcgcagggguuaacauguguacguugauugcaauggacuuaggugaacugugugaagacacaaugacauauaaauguccgcaaauaacagaagcagaaccugaugauguagauugcuggugcaaugcgacagacacgugggugacuuacggcacaugcagccaaacaggugaacauagacgugacaagaggagcguggccuuagcgccucacguaggauuaggauuagaaacgcgcacagaaacguggauguccagcgaaggcgcauggaaacaaauucaacgcguagaaacuugggcacucaggcacccaggguuuaccguaauagcuuuauuucuugcacaugcuauagguacuucaauuacacaaaaaggaauuauuuuuauucuccuuaugcuaguaacaccgagcauggcaaugcgcugugugggaaucgguaauagagauuucguggaaggccuaagcggugcuaccuggguagacguaguacuugaacacgguucaugcgucaccacaauggccaaaaauaaaccgacccuggacauugaauugcuaaaaacagaaguuacaaauccagcgauauuaagaaaauuguguauagaagcuaaaauuuccaauaccacaacagacagucgaugcccaacacaaggagaagcaacccucguugaagaacaagacgcaaauuuugucugucgacggacuuucguagacagagguuggggaaacgguuguggauuguucggaaaagguagucuuuugacaugugcaaaauucaaauguguuacaaaacuagaaggcaaaauuguccaauaugaaaaucuaaaauacaguguaauaguaacuguacacaccggcgaucaacaucagguagggaaugaaacaacagaacaugguacuauugcaacuauaacuccacaagcacccacgucugaaauucaacuuacggauuacggagcacuaacauuagacugcucaccacgaacgggucuugauuuuaacgaaaugguccuucuuacgaugaaagaaaaaucgugguuaguacacaaacaaugguucuuagauuuaccacuuccuuggacgucgggugcgaguacuucacaagaaacauggaacagacaagacuugcugguaacguucaaaacugcccaugcaaagaaacaagaagucguaguacuagggagucaagaaggagcgaugcacacagccuugacuggagcuacagaaauucaaacguccggaacuaccacuauauuugcuggacaccucaaaugucgucugaaaauggacaaauugacacuuaaagguacaaguuauguuauguguacugguucauucaaacuagagaaagagguugcagagacucaacacggaacagucuugguacagguaaaauaugaagggacugaugcgccaugcaaaaucccguuuuccacacaagaugaaaagggaguuacacaaaacggacgacuaauaacagcaaacccuauuguaacggauaaagaaaaaccggugaacauugaaacggagccuccuuucggagaaaguuacauaguuguaggagcgggugaaaaagcacuaaaacuuuccugguuuaaaaagggcucaagcauuggaaaaauguucgaggcuaccgcaagaggcgcccgaagaauggcuauacuuggugacacagcuugggauuuuggcaguauaggggguguguucacaagcguuggaaaacugguacaucaagucuuugguacagcauacggaguucuuuucucgggaguuuccuggacaaugaaaauugguauaggaauuuugcuaaccuggcucggacuuaauucaaggagcacaucauuaagcaugacaugcauugcuguaggaaugguaacuuuauacuuaggggugaugguacaagcugauucugggugugucauaaacuggaaaggaagagagcuuaaauguggaucuggaaucuucguuacaaacgaaguacauacauggaccgaacaauacaaauuucaagcggauucuccgaaacgcuuaagugccgccauaggaaaggcuugggaagaaggagugugcgguauaagaucagcuacuagguuagagaacauaauguggaagcagauuucuaacgaauuaaaccauauauuacuagaaaacgacaugaaauuuacaguaguuguaggagaugcuaacggcauacuagcacaagggaaaaagaugauaaggccccaaccuauggagcauaaauacuccuggaagucuuggggaaaagccaagauaauuggcgcugauauucaaaauacaacauuuauaauugaugggcccgacacuccggagugcccggacaaccaaagagcauggaauaucugggagguggaagacuacggguuuggaauauuuacaaccaauauauggcuaaaacuacgggauaguuauacacaaaugugugaccacaggcuuaugagugcagcaauuaaagauuccaaagcaguacaugcugauauggguuacuggauugaaagugaaaagaacgagacguggaaacuugcucgugcaaguuucaucgaagugaaaaccuguacguggccuaaaucacauacguuauggaguaauggcguccuagaguccgagaugaucauacccaaaauauauggcggaccuauuucucagcacaauuacaggccaggauacuucacacagacugcaggaccuuggcaccuaggcaaguuagaauuggacuucgaucuaugugaagggacuacuguaguagucgaugaacacugcggaaauagaggaccaagccucagaacgacaacaguaaccggaaaaauaauucaugaguggugcugcagaaguugcacacugccgccauuaagguucagaggcgaagaugguugcugguacggaauggaaauccgaccaguaaaggagaaggaagaaaaucuaguacgaaguaugguuucagcaggaaguggagagguagauaguuuuucgcugggaauacuaugcgcaaguaucaugauagaagaaguaaugcgauccagauggagucgcaaaaugcuuaugacagggacgcucgcgguguuucucuuauuaauaaugggacaacuaacguggaaugaucuaauccgcuuauguauaaugguuggcgcgaaugcuagugauaggaugggcauggggacuacguacuuagcucuuauggccacguuuaaaaugagaccaauguuugcuguaggacuacuauuuagaaggcuuacaucccgagaagugcugcuauugacuauagguuuaucuuugguggcaagcgucgaacuaccgaauagucuugaagaacuuggcgauggacuagcuaugggaauaaugaugcuaaaauuacugacagaguuccaaccucaccaacuauggacgacgcucuugagucuuaccuucaucaagacgacacuuagccuagacuaugcauggaaaacaacagcuauggcauuaucuauuauaucacucuucccauuauguuuaagcacaacaucucagaaaacgaccuggcuaccuguuuuauugggcuccuuuggaugcaagccuuuaacgauguucuuaaucacagaaaacaaaauauggggaaggaagucauggccccuuaacgaaggaauuauggcaauagguauuguaaguauccucuuaucgucacuauugaaaaaugacguuccucuagcugggccccuaauagccggagggaugcuaauagcuugcuaugugauaucgggaaguucggcugacuuaaguuuggaaaaagcggcugaaguuucaugggaacaagaagcagaacacucaggaacaucccacaauauucuuguggagguacaggaugacggaacaaugaaaauuaaggaugaggaacgagaugauacuuuaaccauacucuugaaagcuacguuacuagcaguuaguggaguguauccaaugaguauaccggcaacauuauuugugugguacuucuggcagaagaagaaacaaaggucugggguccuaugggacacaccuagcccacccgaaguagaaagagcuguauuagacgauggaaucuauagaauacugcaaagaggacuacucggacgaucucaaguaggcguuggagucuuucaagauggaguauuucacacgauguggcauguuacgagaggagcuguacuaauguaucaagguaaacgacuagagccaucuugggcaucuguaaagaaagacuuaauaaguuauggagggggcuggagauuucaaggaucguggaauacuggagaggagguucaaguaauagcagucgaaccagggaaaaaucccaaaaauguucaaacuacuccuggcacuuucaaaacuccggagggagagguaggcgcaauagcccuggauuucaaaccaggaacauccggcuccccaaucgugaacagggaggggaagauuguaggauuauacggaaaugguguaguuacgacaaguggaacuuacguaucagccauugcacaagcuaaagcaucacaagaagguccacuacccgagauagaggacgagguauucaagaaacguaaccucacuaucauggaucuucacccgggaucugggaagacccgaagguaucuaccagccauuguaagggaggcaaucaagaggaaacuacgaacuuuaaucuuggcaccuaccagaguuguagcaucagagauggcagaagcccuaaaagggaugccgaucagauaucaaacgaccgcaguaaaaucugaacauaccggucgggaaauuguugaucuuaugugucacgcuacuuucaccaugcguuuauuauccccggugaggguaccaaacuauaauaugauuauuauggacgaagcacacuucacggaucccgccaguaucgccgcacgcggcuauauaucgaccaggguagguaugggcgaagcagcagcaauuuuuaugacagcaacucccccaggcuccguagaagccuucccccaaaguaaugcaguuauacaagaugaagaacgagauauaccugaaagguccuggaauaguggcuaugacuggauaacagacuucccgggcaagacgguuugguuugucccgucuauaaaaaguggaaaugacauagccaauuguuuaaggaaaaacggaaaaagaguuauacaacugucuagaaaaacauuugauaccgaauaccaaaagacuaaaaauaaugauugggauuacguuguaacuacagacauaucagaaaugggagcgaauuuuagagcagaucgcguaauugauccuaggcgaugcuuaaaaccuguuauuuugaaagauggaccugagcgaguaauauuagcaggaccuaugccggugacgguagcuagcgcagcccagagaagaggucgcauagguaggaaccagaacaaggagggagaccaauauguauauaugggacaaccucuuaauaaugaugaagaucaugcacacuggaccgaagccaaaaugcuauuagauaauauaaauaccccggaaggaauaauaccagcguuguucgaaccggagagagagaaaagugcugcaauugauggagaauaucgauugcguggggaggcaagaaaaacuuuuguagaauuaaugaggcgaggagaucucccagucuggcuaucuuauaagguagcuuccgaagguuuccaauauucagauagacguugguguuucgacggagagagaaauaaucaaguauuagaagaaaauauggacguggaaauauggaccaaagaaggggaaaggaagaaacuucguccacgcugguuagaugcucggacauacagcgauccacuagcucuaagagaguucaaagaguucgcggccgggaggcgaaguguuucuggagaucucaucuuagaaauuggcaagcucccacaacauuugacauuaagggcucagaaugcucucgauaacuuaguaaugcuucauaauucugagcaaggggguaaggcguaucgucaugcuauggaggaguuacccgacacgaucgagacauuaaugcuauuagcacugauugcuguccuuaccgguggugucacauuauuuuucuuaaguggaaaggggcugggcaagacuucuauagguuuacuaugugucacagccagcucagcauuguuguggauggcauccguggaaccgcacuggauagcagccucaauaauccuagaguucuuuuuaaugguuuuauuaaucccugagccggaccgacaaaggacgccacaagacaaccaguuagccuacgucguuauaggucuuuuauuuaugauacugaccguugcagcuaaugaaaugggguuauuagaaacaacuaaaaaggaucuggggauuggucacguagcugccgaaaaucaucaacacgcgacaauguuagacguggaucugagaccggcgagugccuggacucuuuacgccguugcuacuacaguuauaacgccaaugaugaggcauaccauagaaaauacuacugccaacauaagucugacggcuauagccaaccaagcugcaauccuaauggguuuagauaaaggauggccgauaucaaagauggauauugggguaccauugcuagcauuaggaugcuauagccaagugaauccacuaacuuuaacggcagccguucuaaugcuaguggcccacuaugcaauaaucgggccagguuugcaagcaaaagccacacgugaagcccagaaaagaacagcggcaggaauuaugaaaaauccuacaguagacgggauuguagcgauagaucuagacccaguaguauaugacacuaaguuugaaaaacaauuaggccaaauaauguuacuaauucuaugcacaucccaaauauuguuaaugcguaccacgugggcucuuugugaauccauaacacucgcaaccgguccauuaacuacacucugggaagguucacccgguaaauucuggaauacgacaauugcggugucaauggcgaacauauuccgaggaucauauuuagccggagcgggguuagccuuuaguuuaaugaaaucuuuaggugggggacgcagagguacaggagcacaaggugaaacacuuggggaaaaauggaaacggcaacuuaaucaacugucuaaaagugaguucaacauuuauaaacgaucugguauaauggaggucgauagaagcgaagcuaaagaaggauuaaagagaggggaaacgacuaagcaugcugucagcagggggacagccaaauugagaugguuuguagaaagaaaucuagucaaaccugagggaaaaguaauugaccuagguugcggccgaggcggauggagcuacuauugugccggacugaagaaaguaacggagguaaagggguauacgaaagguggcccaggccaugaagaacccauuccaauggccaccuauggcuggaaccuugugaaacuccacucagguaaagauguauucuucaugccaccagaaaaaugugacacuuuacugugugauaucggagaaagcuccccaaauccaaccauugaagagggaagaacgcugcgagucuuaaagaugguagagccauggcuucggggaaaucaauucugcauuaaaauuuuaaauccauacaugccuucaguagucgaaacauuagaacaaaugcaaagaaaauauggaggaaugcuaguacgcaacccuuuaagucguaauaguacacaugagauguacuggguuucuugugggaccggaaauaucgucucugcgguuaauaugacuuccaggaugcuuuuaaauagauuuacuauggcccacagaaagccuacauacgaacgugauguugacuuaggcgcaggaacacgacauguagcuguugaacccgaaguagcaaauuuagauauaauaggacaacggaucgaaaauauuaaaaacgaacauaagaguaccuggcacuaugaugaagauaauccauacaaaaccugggccuaccaugggaguuacgaagugaagcccucagguucagccaguaguauggucaacggaguuguacgcuuacuaacuaaacccugggauguaauccccaugguuacucaaaucgccaugacugacacaacgccauucggccaacaacgggucuucaaggaaaagguagacacuagaacgccuagagcaaagcgaggaaccacacaaauaauggaaguuacagcgaaaugguuauggggcuuuuugaguaggaacaagaaaccacgaauuuguacaagagaagaguucacaagaaaaguuagaucaaaugcugccauuggcgcaguauuuguggaugagaaccaauggaauagugccaaggaagcuguggaagacgaacgcuucugggacuuaguacaucgggaacgagaguugcacaagcaagguaaaugugcaacuuguguuuauaauaugauggguaaaagggagaagaaauugggugaauuuggcaaggcaaaagguucuagagccauuugguauaugugguuaggugcaagauuuuuagaguuugaagcauugggauuuaugaaugaagaucauugguucagucgcgagaauagccugagcggagucgaaggagaagguuugcacaagcuaggauauauauuaagggacauuaguaaaauaccugguggcaauauguaugcugacgacacagcaggaugggacacgaggaucacagaagacgacuugcaaaaugaagcaaaaauaacagacauaauggaaccagaacacgcccuauuggcuaccucaauauuuaaguugacauaucaaaacaaaguagugcgcguccaacguccggccaaaaacggaacugucauggacguuauaucaagaagagaucaaaggggaucaggucaaguuggcacguaugggcucaauacuuucacaaauauggaaguucagcugauucggcagauggaaucagaaggaauuuuccuaccaucagagcuugagacgccuaacuuagcagaaagaguucuggauuggcuugaaaaacauggcgcugaacgucucaaacgcauggcgauauccggcgacgauugcguggucaagccaauugaugauagauucgcaacugcacuuacagcccuuaacgauaugggcaaaguuaggaaagacauuccccaaugggaaccaaguaagggcuggaaugacuggcagcaggucccguuuugcagccaucauuuucaucaauuaaucaugaaggauggaagggagauuguuguaccaugucggaaccaagaugagcuaguaggucgcgcuagaguaucgcaaggugcuggauggucucugagagaaacggcaugcuuaggaaaguccuaugcgcaaauguggcaacuuauguauuuucauaggcgcgaucucagacuagcagcgaaugcgauaugcagcgcaguaccaguagauuggguuccaaccagccgcacaacuuggaguauacacgcacaucaucaauggaugacuacagaggauaugcuaucaguuuggaauaggguguggaucgaagaaaauccauggauggaagauaaaacacauguauccaguugggaagagguuccauaucucgggaaacgugaggaccaaugguguggaucauugauuggacuaacggcucgggcaacaugggccacuaauauccaaguagcuauaaaucagguuagaagacuaauagguaaugaaaacuacuuggauuacaugacaaguaugaagcgguuuaagaacgaaucagacccagagggggcgcuaugguga

SEQ ID NO: 21331 - RNA, 9879 nt, Artificial Sequence
  derived and/or modified CDS sequence (opt6) from DENV-1__KF973454__SS-prME
uccguaacaaugcuuuuaauguuguuaccaacagcacuagccuuucaccucacuacuagaggaggugaaccucauaugauaguguccaaacacgaaagggggaaaucauuacuguuuaaaacaucaaccgggguaaauaugugcacucuuauugccauggaucugggugaauugugugaagacaccaugacguacaaauguccacgaauuacagaagcagaaccugaugauguggacugcugguguaacgcaacagauacuuggguaacauauggaacuugcucacaaacuggugaacaccgacgagauaaacguucaguugcgcuagcaccccacguaggacuaggacucgaaacacgcaccgaaacuuggaugucuucagaaggagccuggaaacaaauacaacgcgucgaaaccugggcuuuaagacauccagguuucacaguuauagcacuuuuucucgcacacgcgauuggaaccucgaucacucaaaaagggauaauuuucauucuacucauguuggugacccccucaauggcgaugcgaugcguuggcauuggaaaucgugacuuuguugaaggacugagcggcgccaccuggguagaugucguacuugaacacggaaguugcguaacgaccauggcuaaaaacaaaccaacacuugauauagaacuauugaaaaccgaaguaacaaaccccgcaguacuacggaaacuguguauagaagcaaaaauaaguaacacaacaaccgacagucgcugcccaacacaaggagaagcuacuuugguagaagaacaagaugcgaauuucguauguagaaggacccuaguggacagaggaugggguaacgggugcggccuuuuuggaaaaggcucccuacuaacaugugcgaaauucaaaugcguaaccaaauuagaagguaaaaucguacaauaugaaaaccuaaaauacucugucauagucacuguucauacaggugaucaacaucaaguagggaaugaaacuacugaacauggcacaauagcaacuauaacuccccaagcgcccacuuccgaaauccaacuuaccgauuauggugcauuggcguuagauuguucaccaagaacaggacuagauuucaacgaaaugguccuccuaacaaugaaagaaaaaucaugguuaguccauaaacaaugguuucuagaucuaccacugcccuggaccaguggugccagcacaagucaagaaacguggaacagacaagaccuauuaguuacauucaaaacggcgcaugccaagaaacaagaggucguaguuuuaggaagucaagaaggcgcaaugcauacagcauuaaccggugcgacagaaauacaaacaagugggacaacuacgaucuuugcaggucauuuaaaaugccgauuaaaaauggauaaacugacccuaaaagggacauccuauguaaugugcacagguaguuuuaagcuagaaaaagaagucgcugaaacucagcaugggacaguacuuguccaaguaaaauacgaagguacggacgcgccauguaaaauuccguucagcacacaagaugaaaaaggaguuacacaaaacggucgacuuauaacagcuaacccaauugucacagacaaagaaaaaccaguuaacauagaaacggagccuccauucggggaaucauauauaguuguuggcgcuggugagaaggcauuaaaauuaucuugguucaaaaaggggucauccauuggaaaaauguuugaagcuacagcuagaggcgccaggagaauggcaaucuugggagauacagccugggauuucggaaguauuggaggcguuuuuacgaguguaggaaagcucguacaucagguauucggcacagcauauggaguauuauucucaggcguaucuuggacaaugaaaauaggaauaggaauuuuacugacgugguugggacucaauuccagauccacaucgcugucuaugacauguaucgcggucgguauggucacuuuauauuuagguguuaugguacaagcggauagugggugugugauaaauuggaaaggucgagaauuaaagugcggaagcggcauauucguaacgaaugaaguucauacauggacagaacaguauaaauuccaagcggauucgcccaaaagacugucagcagccauuggaaaagcaugggaagagggggucugcggcauaagaucagccacaagacucgaaaauauuauguggaaacaaauaucaaaugaacuuaaucauaucuuauuagaaaaugacaugaaguucacugucgugguaggugaugcgaaugggauucuagcacaggguaagaaaaugauuagaccucaaccaauggagcauaaauauuccuggaaguccuggggcaaagcaaagauaauaggggcagacauucaaaauacgaccuucauuauagaugguccagauacacccgaauguccagacgaucagcgcgcguggaacauuugggaaguugaagacuaugguuuuggaauauuuacuacaaacauuugguuaaagcuaagagauucauauacacaaaugugugaucaucgguuaaugucagcagcuauuaaagauucuaaggcuguacacgcagacauggguuacuggaucgaaagcgaaaagaaugaaacguggaaauuagcacgcgcgucauuuauagaagucaaaacguguacauggcccaaaucucacacccuuugguccaacgggguacuagaaagcgaaaugauaauaccaaaaaucuauggaggccccauaucacagcauaauuauagaccaggauauuuuacacaaacugcaggaccauggcaccucggcaagcuagaacuagauuuugauuuaugcgagggaacaacggucgucguugaugaacacugugguaauagagggcccagccuacgcacuacuaccguaacggguaaaauuauacacgaaugguguuguaggucaugcacccuaccgccacucagauuccgcggggaagacggcuguugguaugguauggaaauaaggcccgugaaggagaaagaagagaacuuggugagaucaauggugucggcuggcucuggagaaguagauaguuucucuuuagguaucuuaugcgugaguauuaugauugaagaaguaaugaggucgcgauggucgcgaaagaugcuuaugacaggcacacucgcaguuuuucuucugcucauaaugggucagcuuacuuggaacgaccucauacguuuauguauuaugguaggugccaaugcauccgaccguaugggaauggguacaacguauuuagcauuaauggcuaccuucaaacuccgaccuauguuugcugugggaauacucuuucgucggcuaacuagccgagaaguacucuuauuaacaauuggucugucacucgucgcaucagucgaacuaccaaauagcuuggaagaacucggggauggguuagcuaugggcauaaugaugcuaaaacuacuaacugaauuucaaccacaucaauuguggacuacauuauuaagucucacuuucauuaaaacgacgcugagucuagauuaugcguggaaaacaacggcaauggcccuaucaauaguuagcuuauuccccauauguuuaaguacuacaucccagaaaaccacuuggcugccuguuuugcuaggauccuuugguuguaaaccucuuaccauguacuuaaucaccgagaacaaaauaugggggcgaaagucuuggccgauuaaugagggaauuauggcgauugguauuguaaguauacuuuuaucauccuuauugaaaaaugacguuccgcuagccggaccucuuaucgcugguggaauguuaauagcuuguuaugugauuaguggauccagugcagauuuaagccuugaaaaagcagccgaaguuucaugggaacaagaggcagaacauuccggaacgucacauaacauacuuguagaagugcaagaugauggaacaaugagaauaaaagaugaagaaaaagaugacacacuuacuauauuauuaaaggcuacauuacucgcagugucuggggucuaccccaugucaauuccagcuacucuuuuugucugguacuucuggcagaagaagaaacagagaucaggaguauuaugggauaccccaagcccuccagaaguagagagagcaguguuagaugacggaaucuaccguauacuucagagaggucuuuuggggagaucacaaguagguguuggcguuuuccaagaugggguuuuccauacaauguggcacguaacacgaggagcuguauuaauguaucagggaaaacgacuagagccauccugggcaagcgucaagaaagacuuaaucagcuacgguggcggauggagauuucagggaagcuggaauacuggagaagaaguacaaguaauugcaguagaaccggguaaaaaucccaaaaaugugcagacgacgccugggacauuuaaaacaccagaaggagaaguuggggcaauagccuuagauuuuaaaccaggcacaucugggaguccuauuguaaacagagaaggaaaaaucgucgguuuauaugggaauggggucguaacaaccucagggacuuaugucuccgcgauagcacaagcaaaagcaagucaagagggcccguuaccugaaaucgaagaugaaguauuuaagaaacggaauuuaacaauuauggauuuacacccuggcucaggaaaaacgagacgauaucugccagcaauaguccgugaagcaauaaaacguaaauugagaacauugauucuggcucccacgcgcguuguagcaagugaaauggcugaggcacuuaaagggaugccaaucagauaucaaacuacagcugugaaaagugaacacacagguagagaaauuguugaucugaugugucaugccacauuuacgaugagauuauugucgccuguaagagucccaaacuauaacaugauaauuauggacgaggcucacuuuacagauccagcuaguauagcagcacgagguuacauaucaacucguguuggcaugggugaagccgcagcuauuuuuaugacagcaacaccuccugggagcgucgaagcguucccacaaucaaaugcgguaauucaggacgaagaacgcgauauacccgagcgaagcuggaacucugguuaugauuggauuacggacuuuccugggaagacugucugguuuguuccgaguauaaaaucuggaaaugauauugcaaacugucuuaggaaaaacgguaaacguguaauccagcuuucacgcaaaacauuugacaccgaauaucagaaaacgaaaaacaacgauugggauuaugucguuaccacagauauaucggaaaugggagccaauuucagggcagaucggguuauagacccgagacgaugucucaaaccggucauauugaaagauggaccugaaagaguaauucuagccggacccaugccuguaacaguagcaucugcggcccaacggcgcggacgcauaggaagaaaccaaaacaaagagggugaccaguauguuuacaugggucaaccucucaauaacgaugaagaucaugcucauuggacugaagcaaaaauguuacuagauaauauaaauacaccugaggggauaauaccggcucuauucgaaccagaaagagagaaaagugcagcuaucgauggagaauaucgucuuaggggcgaagcacgaaaaacuuuugucgagcuaaugagacgcggugaucuaccuguauggcucaguuauaaaguggcaucagaaggauuccaauauagcgacaggcgauggugcuuugauggagaacgaaauaaccagguacucgaagagaauauggauguagagaucuggaccaaggaaggugagagaaagaaacugcgaccacggugguuagacgcaaggacguacucagacccguuggccuuaagagaauuuaaagaauuugcggcaggacgcagaucuguuucaggugacuugauuuuagagauagggaagcugccucagcaucuuacacuuagggcucaaucugcacuugauaauuuaguaauguuacacaauucggagcaaggagguaaggcuuaccgacacgccauggaagaacuucccgauaccaucgaaacuuuaauguuacuugcucuuaucgcaguucuuacaggagguguaaugcuguucuuuuuauccggcaagggauuagguaaaacaucaauuggucugcugugcguuacugcgaguucagcccuucuauggauggcaucaguugagccccauuggauugcagcuucgauaauuuuagaguucuuuuuaaugguauuacugauaccggaacccgaucggcaaagaacaccccaagacaaccaauuagcuuacguaguaauaggacugcuuuucaugauccucacuguugccgccaaugaaaugggcuuacuagagacaacuaaacgagaccuugguauaggucauguggcagcagaaaaucaucaacaugcaacaauguuagacguagauuugagaccagcauccgcauggacacuauacgccguggcaaccaccguaauaacaccaaugaugagacauacuaucgaaaacacgacugcgaauauuucucucacagcaaucgcuaaucaggcagcaauauuaaugggucuugauaagggauggcccauaucuaaaauggauauugggguaccucuauuggcuuuaggauguuauucgcaaguaaauccauuaacauuaacggccgcaguacuuaugcucguugcgcauuaugcgaucauuggaccuggacuucaagcgaaggccacccgagaggcucaaaaacggacagcagcugggauuaugaaaaacccaacagucgacggaauaguagccauagaucucgauccaguuguauacgaugcaaaauucgaaaaacaacuugggcagauuaugcuucucauauuauguacaagucaaauacuauugaugaggacaacaugggcccugugcgaaucgauaacguuagcuacuggaccacucacaacucuaugggaaggcucgccaggaaaauuuuggaauacuacaauagcaguuucgauggcuaauauauuccgugggucuuaucuagcaggcgcuggccucgcauucuccuuaaugaagucauugggaggaggccguagaggcaccggagcucaaggagaaacacugggcgagaaguggaagagacaacuuaaccaguuauccaaaccggaauuuaacacuuacaaaaggucaggaauaauggaagucgacagauccgaggcuaaagagggacuuaaaaggggugagaccaccaaacaugcaguuucuaggggaacugccaagcuaagaugguucgucgagaggaaccugguaaagccggaagguaaagugauagaccuaggcugcggaagaggagguugguccuacuacugugcuggacuaaagaaaguuacugaaguaaagggauauacuaaaggagguccaggucaugaggaaccaauaccgauggcgacuuaugguuggaaucuagucaaacuacacucugggaaggacguauucuuuaugccgccagaaaaaugugauacccuccucugugauauaggggaaaguucccccaacccuacaauugaagaagguagaaccuuaagaguuuuaaaaauggucgaacccugguuacgugguaaccaauucugcaucaaaauauuaaaucccuauaugcccagugucguagagacacuugaacagaugcaaagaaaacauggaggaauguuaguucggaauccacuaucaagaaacucaacacacgaaauguauuggguuagcugcggaacuggaaauauuguaucagcaguaaauaugacgucaagaauguuguuaaaccgauuuacaauggcgcauaggaagccuacuuaugaacgcgauguagaucucggagcuggaacuaggcaugucacaguugagcccgaaguugcaaaccuagauauaaucggucaacguauagaaaauaucaaaaaugaacacaaaucuacuuggcauuaugaugaagacaacccauauaaaacuugggcuuaucacggaucuuacgaagucaaaccuucagguucggcuucuucuaugguuaauggaguaguccgauuguuaacaaaaccuugggacguaauacccauggucacccagauugcgaugaccgauaccacacccuuuggacagcaacgggucuucaaggaaaaaguggauaccagaaccccuagagcaaaaagagguaccacucaaauaauggaagucacggcaaaauggcuauggggauuucucucaagaaauaagaaaccuagaaucuguacacgcgaagaauuuacaagaaaaguuagaagcaacgcggcgauaggggcgguauucgucgaugagaaucaguggaacagugcgaaagaagcuguagaagacgagcguuuuugggauuuaguucauagagaaagagagcuucacaaacaaggaaaaugugcuacaugugucuacaacaugaugggaaaaagggagaagaaacuaggggaguuugguaaagcuaaagggucgcgcgcuauuugguauaugugguugggcgcuagguuccuugaguucgaggcuuugggauuuaugaaugaggaucauugguuuucgcgagaaaacucguugucggguguggaaggcgaagggcuacauaaacugggcuacauacugagggacauaucaaaaaucccaggaggaaacauguaugcugacgauaccgcgggcugggacacacgaauuaccgaagaugaucuucaaaaugaggcaaaaauuaccgacauuauggaaccagagcaugcccuguuagcaacuuccauauucaaacuaacuuaccaaaauaaaguuguuaggguucaacgcccagcaaagaaugguacagugauggauguuauuucuagaagagaccaaagaggauccggccaaguuggcacguauggcuugaacaccuuuaccaacauggaaguucagcuuauaaggcaaauggaaagcgaaggaaucuuuuugccaagugaacuugagacacccaaucuugcagaaaggguacuagauugguuagaaaaacauggugcagaacgcuuaaaacgcauggcgauaucgggagaugauugugucguaaaacccaucgaugaucguuuugccacagcacucaccgcucugaaugauaugggaaagguuaggaaggauauuccgcaaugggaacccuccaaaggguggaacgacuggcaacagguuccguuuugcucacaccacuuucaccaacuuauaaugaaagacggcagagagaucguaguaccuugcagaaaucaagacgaguuaguuggacgagcacgaguuucgcaaggugcgggauggucacuuagggagacagcuugcuuaggcaaauccuacgcacaaauguggcaauuaauguauuuucauagaagagacuuaagguuagcagcaaaugcuauaugcucugcaguaccuguagauuggguuccaacauccagaaccacguggaguauucaugcucaucaccaauggaugacgacugaggauauguugagcgucuggaauaggguauggaucgaagaaaacccauggauggaagauaaaacucaugugucaucaugggaagaggugcccuaccuaggcaaacgcgaagaccagugguguggcagccuaaucgguuuaaccgccagagcaacgugggccacaaacauucaagucgccauaaaucaaguaagaagauugaucggcaacgaaaauuaucuagauuauaugacaucaaugaaaagguucaaaaaugaguccgaccccgaaggugugcuaugguaa

SEQ ID NO: 21332 - RNA, 9879 nt, Artificial Sequence
  derived and/or modified CDS sequence (opt6) from DENV-1__KF973455__SS-prME
agugugacuaugcuucuaauguuacuaccgaccgcauuagcguuucauuugacaacucgaggaggagaaccucauaugauagucagcaaacaugaaagaggaaaaagucuucuauuuaaaaccaguacaggagucaacaugugcacauuaauagcuauggacuuaggggaauugugugaagacacaaugaccuauaaauguccuagaauaacagaggccgaaccggaugacguagacuguugguguaacgcgacggacacuuggguuacuuacggcaccuguagccaaacaggcgagcauagacgagauaaacgaagcgucgcacuugcuccucauguugguuuaggucuugagacucguacagaaaccuggaugaguuccgaaggggcuuggaaacaaauacaaaggguggaaaccugggcgcucagacauccaggcuuuacugucauagccuuauuucucgcacaugccaucgguaccaguauuacgcaaaaaggcaucauauucauacucuuaauguugguaacaccaaguauggccaugcguugcguuggaaucgguaaucgugauuucguagagggcuuaucaggcgcgacauggguugacguggugcuagaacacgguucaugcgugacaaccauggcuaaaaauaaaccaacauuggauauagaauugcugaaaacagaagugacaaaucccgcgguguugaggaaacuauguaucgaagcaaaaauaaguaacacgacaaccgacaguagaugcccgacucagggagaagcgacuuuagucgaagaacaagaugcuaauuucgucuguagaagaacauuaguagaucgugguuggggaaauggcugcggucuauucggaaaaggaucacuguuaaccugugcgaaauucaaauguguaaccaaacuagaaggcaaaauuguccaauacgaaaaucucaaguacucuguuauagucacaguacacacaggugaucaacaccaaguuggaaaugagacaacagaacauggaacuauagcgaccauaacaccacaagcaccaacuucagaaauccaauugacagacuauggagccuuggcguuagauugcuccccacgaacgggucuugacuuuaaugagaugguccugcucacaaugaaggaaaagucauggcuaguucauaaacaaugguuucuagaccucccauuaccguggacaagcggagcgucaacaucccaagaaacguggaaccgacaagacuuauugguuaccuucaaaacggcacacgccaagaaacaagaaguaguagugcuagguucgcaagagggagcaaugcacacugcauuaacuggagcaacagagauucagacaucaggaacuacuacaauuuuugcgggucacuugaaaugucgcuugaaaauggauaagcuaacuuuaaaaggaacgucauauguaaugugcaccgguuccuucaaacuagagaaagaagucgcagaaacgcaacacggaacugucuuaguccaaguaaaauaugaaggcacagacgcuccaugcaaaauuccauuuaguacgcaagaugagaaaggaguuacgcaaaacggcagguuaauuacugcaaaucccauagucacagacaaagaaaaaccaguaaacauugaaacggaaccaccuuuuggagaaagcuacaucguugucggagcaggagagaaagcauugaaacuuucaugguuuaaaaaggguaguucgauuggaaagauguucgaagcaacggcucgcggggcuagaagaauggccauacuaggagacacagccugggacuuugguucaauaggcggaguuuuuacaaguguagggaaacuggugcaccagguauuuggaacugcguacggcguacuauuuuccggaguaucuuggacuaugaagauaggcaucggaauuuugcugacauggcuaggccucaauagcaggagcacuucauuauccaugacuugcauagcaguaggaaugguaacacuuuacuuaggugugauggugcaagcugauuccggaugcguaauuaauuggaagggaagggaacuaaagugcgguaguggcauauuuguaacuaacgagguccauacauggacggaacaauacaaguuccaggcagacucaccuaaacgucuaagugcagcuauuggaaaggcaugggaggaagguguuugcgguauucgcagugcaacacguuuggaaaauaucauguggaagcaaaucagcaaugaauuaaaccacauacuguuggaaaaugauaugaaauuuaccguagugguuggugaugcuaacgguaucuuagcucaaggcaagaaaaugauaaggccucaaccuauggagcauaaauacucauggaaaucauggggcaaagcaaaaauuauaggagcagacauacaaaauacgacguuuauaauagaugggccagacacaccagaaugucccgaugaccaacgagcauggaauauaugggaagucgaggacuauggauuugguauauuuacaacaaauauuuggcuuaaacucagagacucauauacacaaaugugugaucauagguuaaugucagcagcuauuaaagauagcaaagcuguacacgcagacaugggauacuggauagaaagugagaagaacgagaccuggaaacucgcaagggcauccuucauagagguaaaaacauguacguggccuaagagccauacguuauggagcaacggaguuuuggaaagcgagaugauaaucccaaaaaucuacggcggcccaauaucacagcauaacuaccgaccagguuauuucacacaaacagcaggaccguggcauuugggcaagcuggaguuagacuucgaccugugugaagguaccacggugguaguagaugaacauugcggaaacagggguccuaguuuaagaacaaccacaguaacaggcaaaauaauucacgaaugguguugccguagcuguacucucccaccguuacgauuuagaggggaagaugguuguugguaugguauggaaauucguccugucaaggaaaaagaagagaauuuagucagaagcaugguaucugcagggucuggagaaguggauaguuucucccuugguauuuuguguguaaguauuaugaucgaagaagugaugagaucaagauggucuagaaaaaugcucaugacagggaccuuggcaguauuuuugcuucuuauuauggggcaguuaaccuggaaugaucuaauccgacuauguauuaugguaggugcaaaugccucagacagaauggggauggguacuacuuauuuggcgcuaauggccacauucaagcuccgacccauguucgcagucggcauucuuuuuaggagacuaacaucacgugaaguauuacuucucacgauuggacugucguugguagccaguguggaacuaccgaauagucuagaagaguugggagauggccuagcuauggguauaaugaugcuaaaacuucuaacagaauuucagccccaccaacuuuggacuacucucuuaucccuaacuuuuauaaaaacgacucuaagccuugacuacgcauggaagacuacagcaauggcgcuuagcauaguuucauuauucccuauaugucuaagcaccacaucacagaaaacaacgugguuaccaguauuauuagggucuuucgguuguaagccccuaacaauguauuuaauuacagaaaauaaaauauggggacgaaagucuuggcccauuaacgagggcauuauggccauaggaauaguaagcauauuacugagcucccuauugaaaaaugaugugccgcuggcuggaccucuaauugccggugggaugcuaauugccugcuauguuauaucaggaucaagcgccgaccuaagucucgagaaagcggcggaaguaaguugggaacaagaagcagaacauagcggaacaagccauaacauucugguagagguucaagacgaugggacuaugaggauuaaagaugaggagaaagacgauacacuuacuauauuacucaaggcaacuuuacuugccgugucuggaguauacccaaugucaauaccagcuaccuuauucguaugguacuuuuggcaaaagaagaaacaacggucaggaguauuaugggauacacccucuccaccggaaguugaacgggcaguccuagaugauggaaucuaccgcauacuacaaagaggauuacuaggcagaagccaaguagguguugguguauuccaagacggaguuuuucacaccauguggcacguuacacgaggagcgguucuuauguaucagggaaaacgauuagagccaucaugggcuucggucaagaaagaccucauuagcuauggaggaggauggagauuucaaggcagcuggaauacuggagaagaaguacaaguuauugcagucgaaccaggaaagaaccccaaaaacguccaaacgacuccuggaacauuuaagacccccgaaggcgaaguuggggcaauagcacuagauuuuaaaccugggacuagcggauccccuaucguaaacagagaaggaaagauugucggccuauacggaaacggcgucguaacuacgucuggcaccuauguaagugcaauugcucaagcaaaggcuucacaagaagggccguuaccugaaauagaagacgagguauuuaagaaacgcaaucucaccaucauggaucuucacccuggaaguggaaaaacaaggagauacuuaccugccauugucagagaggcaauaaagcguaagcuccgaacgcuuauacuugcuccaaccaggguuguagcgagcgaaauggcagaggcacucaagggcaugccaauucgcuaccaaacaacggcgguuaaaagugagcauacaggacgcgaaauuguagaucuaaugugucaugccacuuuuacgaugagauuacuaucaccgguaagggucccgaacuacaauaugauaauaauggacgaagcccacuuuacagacccggcuuccaucgcugcucggggcuauauuucaaccaggguaggcaugggugaggcugcagcgauuuucaugaccgcuacuccaccaggaucuguagaagcguucccacaaucgaaugcaguaauacaggaugaggaaagggauauuccagaaagaucguggaacagugguuaugauuggauaacggacuucccuggaaaaacgguuugguuuguuccuagcauaaaaucagguaaugacaucgcaaacugccucagaaagaacggaaaaagaguaauacaauuaaguagaaagacuuucgacacugaguaucaaaagaccaaaaacaaugacugggauuauguuguaacaacagacauaucagaaaugggugcgaauuuuagggcagaccgaguaauagacccaagaagaugcuuaaagccaguuauacugaaagacggaccagaaagagugauauuagcgggaccuaugccuguaacgguagcgucagcugcucaacggcgugguagaauuggacguaaccaaaauaaagaaggcgaucaauacguauauaugggccaaccuuuaaacaaugaugaagaucaugcacacuggacagaagcuaaaaugcuacuagacaacauaaacaccccagaagggauaauacccgcgcuauuugagcccgaacgggaaaagagugcagcgauagacggugaguaucgguuacgcggagaagccagaaaaacauucguagaacuuaugagaagaggcgaccuaccaguauggcuuucauacaagguggccagcgaaggauuccaguauucugaucgucggugguguuucgacggagagaggaauaaucaaguuuuagaagaaaacauggauguggagauuuggacaaaggaaggggaaagaaagaaauuacguccgagauggcuugaugcacguacguauucugauccauuagcacugcgugaauuuaaagaguuugccgcaggaagaagauccguuuccggugaucuaauucucgaaauagggaaacuuccacaacaccugacauuaagagcacaaaaugcauuagacaaucuuguaaugcuucauaauucugaacaaggugguaaagcauaccgccaugcuauggaagaguuaccggacacaauagaaacuuuaaugcuauuagcauugauagccgucuugaccgggggaguuaugcuauucuuucuaucaggcaaaggacuaggaaagacaucuauagggcugcucugcguaacagccucuucugcacuauuauggauggcguccguagaaccacacuggauagcugcuucaauuauacuagaguucuuucuuaugguacuucucaucccagagccggacagacaacgaacuccacaagauaaucagcuagccuauguaguuaucggccuauuauucaugauacuaaccguagccgcuaacgaaaugggacugcuggaaacuacuaagagagacuuagggauaggucauguugcagcagaaaaucaucaacaugccacaaugcuagacguagauuuacauccggccagcgcguggacauuauacgcaguagcuaccacuguaauaacuccaaugaugcgacacaccaucgagaacacuacggcgaauaucucauuaacagcaauagcuaaucaggcugccauuuugaugggauuagauaaaggauggccuauuucaaaaauggauauuggcguaccuuuauuggcauuaggguguuauagucaagucaauccauuaacacuaacagcagcaguuuuaaugcuaguagcgcacuacgccauuauaggaccaggguuacaggcgaaagccacgagagaagcucagaaaaggacugcagccggaaucaugaaaaacccaacggucgaugguauuguagcaaucgaccuugauccuguaguuuaugacgcuaaauuugaaaaacaauugggacaaauaauguugcuaauacuauguacaagccaaauauuauugaugagaaccacuugggcauugugugaaucaauuacuuuagcuacaggaccccuaacuacucuaugggaggggagcccuggaaaauucuggaacacuacaauagccgucaguauggcaaauauuuuuagggggaguuauuuagcuggugcagggcucgccuuuucucugaugaaaagucugggagggggaagaagagguacgggagcacaaggugagacguuaggggaaaaauggaaacgucaacuaaaucaauuaucgaaaccggaauuuaacacuuauaaaagaaguggaauuauggaaguugaucgauccgaagcaaaagagggccucaaaaggggagaaacgacaaaacaugcugugucacgaggaacagccaaauuacgaugguucguggaaaggaaccucguuaaaccugaagguaaaguaauagaucucggcuguggccgaggaggauggucuuauuauugugcaggucucaagaaagucacagagguaaaaggguauacaaaaggagggccuggucaugaagaaccaauacccauggccacuuacggauggaaccuuguuaaguuacauagcggaaaagaugucuucuuuaugcccccagaaaaaugugacacauugcuaugugacaucggugaaucaaguccaaacccuacgauagaagaagggcguacguuacgcgugcuuaaaaugguggaaccaugguuacguggcaaucaauuuuguauuaaaauacugaauccguauaugcccucagucgucgaaacccuagaacagaugcaaagaaagcauggagguaugcuuguacguaauccucuaucgcgcaauucaacucaugaaauguacugggucaguugugguacagguaauauugucucagcagucaauaugacgucaagaaugcuacuuaacagauucaccauggcucaucgaaaaccuacuuaugaaagagaugucgacuugggggcaggaacgcgccauguaacuguugaaccagagguugccaauuuagauauuauaggucagcguauagaaaacauuaagaaugaacauaaaagcacauggcacuacgaugaagauaacccuuauaaaacuugggcauaccacgguucauaugaagugaaacccuccggaucugccaguucgaugguaaacggaguuguaagauuguuaacaaagccaugggauguaauaccgaugguaacacaaauugcgaugacagauacuacaccuuuuggccaacaaagggucuuuaaagagaaaguagauacacgaacaccaagggcaaaaagaggcaccacacaaaucauggaaguaacagcgaaaugguuguggggauuuuugagccguaacaagaaaccaaggauuugcacaagagaagaauuuacacgcaagguuaggucgaaugcagcaaucggugccguguucguugacgaaaaccaauggaacagugccaaagaggcggucgaagaugaacgguuuugggacuuaguccaccgggagagagaacuucacaaacagggcaaaugcgccacguguguauauaauaugaugggaaagagagaaaagaagcuaggagaauuuggaaaagcuaaaggaucuagagcaauuugguauaugugguugggagcgagauuucuggaauuugaagcacucggauuuaugaaugaagaucacugguucagccgugagaacucccucucagggguagaaggagagggauuacacaaauuaggcuauaucuugagggacauaucaaaaauuccagggggaaacauguacgcagacgacaccgcaggaugggacacacgcauuacagaagaugacuugcaaaaugaagcuaagauuaccgacauaauggaacccgaacaugcauuacuugcuacuuccaucuuuaaauuaaccuaccaaaauaaagucguaagaguucagaggccugccaaaaacggaaccguaauggacguaauuaguaggagagaucagagaggaucgggccaaguuggcacauacggcuuaaauaccuuuacuaacauggaaguacagcucauaagacaaauggaaagugaaggaauuuucuuaccaagcgaguuagaaacgcccaaccuggcagaacgagugcuagauuggcuagagaaacacggugcagaaagacuuaaaaggauggccauaucaggagaugauugcguggucaaaccgaucgacgaccgauucgcaacagcguuaacugcgcuaaaugauaugggaaagguccgaaaggauaucccacagugggaaccaucuaagggauggaaugauuggcaacaaguacccuuuugcagucaucauuuccaucaauugauaaugaaggacggaagggaaaucgugguaccuuguagaaaccaggacgaauuaguugguagagcacgugucucacaaggcgcgggcuggucccuaagagagacagcaugcuuaggaaaaucauaugcacaaauguggcaauuaauguauuuucacagaagagaccuccggcuagcugcuaaugcaauaugcucagcagucccagucgauugggugccaaccagucgcaccacauggucaauucaugcacaucaccaguggaugaccacagaagacaugcuuucaguguggaaccggguuuggauagaggaaaacccauggauggaagauaagacacauguuucuaguugggaagaaguaccauaucuuggaaagagagaagaucaaugguguggaucacugauuggauuaaccgcacgagcgacuugggcgacaaauauacaaguagcgauaaaccagguacgccgucucauugguaacgaaaauuauuuggacuauaugacaucuaugaagagauucaaaaacgagagcgauccggaaggagcucuuugguag

SEQ ID NO: 21333 - RNA, 9879 nt, Artificial Sequence
  derived and/or modified CDS sequence (opt6) from DENV-1__KF973456__SS-prME
ucagugacuaugcuacucauguuauuacccacugcucuagcauuucacuuaacuacucgagggggagaaccucauaugauuguaagcaaacaugaacguggaaaaucgcuccuauucaaaacaagcaccggagucaauaugugcacauuaauagcuauggaccuaggugaacuuugugaggacaccaugacauacaaauguccacgaauaacagaagcagaaccugaugauguugauuguuggugcaaugcaacggauaccuggguaacauacgggacuugcucccaaacaggggagcaccguagagacaaacgcaguguggcccuggcgccacacguuggucucgguuuagagacaagaacagaaacuuggaugaguuccgagggugcuuggaaacaaauacaacguguagaaacaugggcacuucggcacccaggauuuacuguaaucgccuuauuuuuagcacaugcaaucggaacaucuauaacacaaaaagggauaauuuuuauucugcuuauguugguaacacccaguauggcaaugagauguguggggauaggaaacagagacuucguugaaggacuaagcggggcaacguggguagacguugucuuagaacauggaagcugcgugacaacuauggccaaaaauaaaccaacauuagauauagaacuuuuaaaaacagaagugacgaacccagcgguuuugagaaaauuaugcauugaagcuaagauauccaauacuacuacagauucacgcuguccaacucagggggaggcuacccuaguugaagaacaggaugccaauuuuguauguagaagaacccuagucgacagagguuggggcaauggauguggucucuucgguaaaggaucucuauuaacgugcgcuaaauucaaauguguuacuaaguuagaagguaagauaguacaauacgaaaaucuuaaauauucgguuauuguaaccguccauacgggugaccaacaucaagucgguaaugaaacaacagaacauggaacuauagcaacgauaacuccucaggcuccuacaucggagauccaauuaaccgacuacggggcacuagcccuugacuguagcccaagaacaggauuagauuuuaaugaaaugguucuacuuacgaugaaagaaaagagcugguuaguucacaagcagugguuucuagauuuacccuuacccuggaccucaggugcuuccaccagucaggaaacguggaacagacaggaccuauuaguaacuuucaaaacagcacaugcuaagaaacaagagguagucguccuaggaucccaagaaggugccaugcacacagcuuuaacaggggcuacagagauacaaaccagcggaacaacgacuauuuuugcaggucauuuaaaauguaggcuuaagauggauaaauugacguuaaaggguaccucauauguaauguguacuggcagcuuuaaacucgaaaaagaaguggcagagacucagcaugggacggucuuaguacaagucaaauaugaggggacagacgcgccuuguaaaauaccuuuuucaacucaagaugagaagggaguaacucaaaaugggagauuaauuacggcaaacccaauagugacagauaaagagaaaccgguaaacauugaaacugagccuccauuuggugagaguuacauaguaguuggugcuggggagaaagcacucaaacuaaguugguuuaagaagggaaguagcauagggaagauguucgaagcgacugcaagaggugcucgcagaauggcgaucuuaggagauacugcaugggauuuuggaucuauuggaggagucuuuacaucaguugggaaacuuguucaucaaguguuuggaacagcauauggcgucuuguuuucagguguuuccuggacaaugaagauugggauagguauacuacugaccuggcuaggcuuaaacucuaggagcaccucgcuaaguaugacuugcaucgccguaggaauggucacacucuaucuagguguaaugguucaggcugauagcggaugcgugauuaacuggaaaggaagagaauuaaaaugugguaguggaauauucguuacaaacgaaguacacacauggacagaacaauauaaauuucaagcggauucgcccaaaagacuuucggcggcuaucggcaaagcgugggaggagggcguuugugguaucagaucugcaacaaggcuagaaaauauaauguggaaacaaauuagcaaugagcuaaaucauauucuuuuagagaacgacaugaaauuuacggugguaguaggggaugcaaauggaauacuugcacaaggcaagaaaaugauacgaccgcaacccauggagcacaaauauagcuggaaaaguuggggaaaagccaaaauaauaggagcugauauccagaacacaacuuuuauuauugaugggccagauacaccugaauguccggaugaucagagagcauggaauauaugggagguugaggauuaugguuuugguauauuuacaacaaacauuuggcuaaaauuaagggauucauauacucagaugugcgaucauagguuaaugucagcagcuauaaaagauucgaaggcuguucacgcagacaugggcuauuggauagaaucugaaaagaaugagacauggaaacucgcacgagcuaguuuuauagaagucaaaacauguacguggcccaagucucauacuuuauggucgaaugguguauuagaaagugaaaugaucauacccaaaauuuaugguggaccaauaucacagcacaacuacagacccggcuauuucacacaaacagcggggccuuggcauuuaggcaaauuagaauuagacuucgauuuaugugaggggacaacugugguuguagaugagcauugugguaauaggggcccaagucuuaggaccacuaccguuacagggaaaauaauacaugaaugguguuguagaucuuguaccuugccaccacugagauuucgaggagaggauggcugcugguauggaauggaaauuaggcccguuaaagagaaagaagagaaucugguuagaagcaugguuucugcagguagcggcgaaguagauucauuuagccuaggcauacuguguguaucuauaaugauugaggagguaaugaggaguagauggagucgcaaaauguuaaugacaggcacacuagcaguuuuucuauugcucauaauggggcaguuaacuuggaaugacuugauaagacuuuguauuauggucggugcaaaugcaucagaccguauggguaugggaacgacauaucucgcucuaauggcuacauuuaagcugaggccuauguucgcggugggcauuuuauucagaaggcuuacuucucgugaaguacuucuguugacgauuggauuaucguugguagcgucuguugaguuaccaaacucauuagaagaacucggagauggucuagcgaugggaauuaugauguuaaaacuucugacagaauuucagccacaucaauuauggacuacauuguugaguuuaacauuuauuaaaacaacacuuucccucgacuaugcauggaagacgacggcaauggcccuuagcauaguuucguuauuccccauaugucuuucaacaacgagucagaaaacgaccuggcuucccguguuguuagguucauucggaugcaagccuuugacaauguacuuaauuacugaaaauaaaauaugggggagaaaaucguggccaauaaaugaaggcauaauggcaauagguauuguaucuaucuuauuaucaucacugcugaaaaaugauguuccuuuagcgggaccucuaaucgcugguggaauguuaaucgcaugcuacguaauuaguggaucauccgcugauuuaucauuggagaaggcugcggagguauccugggaacaggaagcagaacacaguggaacaagucauaacauuuuaguagagguacaagaugauggaacaaugagaauaaaagacgaagagaaggaugauacuuuaacgauuuuacugaaagcaacguuacuggcuguaucaggaguuuauccuaugucgauucccgcaacacuauucgucugguauuuuuggcaaaagaagaaacaaaggagcggaguucuuugggauaccccaucuccuccagaaguagaaagggccguccuugacgaugguauuuauaggauauuacagcgcggauuauuagguagaagccaagucggaguaggcguauuucaagacggaguguuucauacuauguggcacguuacaagaggagcgguucuuauguaucaagggaagcguuuggaaccgaguugggcaucuguuaagaaagaucuuaucagcuauggcggaggauggagauuucaaggaaguuggaauacaggcgaagaagugcagguaaucgccguagaaccaggcaaaaauccuaagaauguacaaaccacgccuggaaccuucaaaacuccugaaggagaagucggggccauagcacucgauuuuaaaccgggcacaaguggcucucccauuguaaauagagaagggaaaauaguuggcuuauaugguaauggaguugugaccacaucuggaacuuauguuagugcaaucgcacaggcgaaggcuucucaagaagggccucuaccagaaauagaagacgaaguauuuaagaagcgcaauuuaacuaucauggaucugcacccaggcaguggcaaaacacgacgguacuuaccagcgauaguucgggaagcaauaaaaagaaagcugagaacacuaauacuagcaccaacacgagugguagcuucagaaauggcagaggcuuuaaaaggaaugccaauaagauaccaaacaaccgccguaaaaucagaacauaccggaagagaaaucguagauuugaugugucaugccacauuuaccaugcgcuugcuaucaccuguuagggugcccaauuauaacaugauaauuauggacgaagcacauuuuacagacccggcuuccauagcagcaagaggcuauauuuccacaagagucgguaugggugaagcggcugccauauucaugaccgcgacuccgccugguaguguagaggcauuuccgcaaaguaacgcagugauucaggaugaagaacgcgauauaccagaaagaucauggaacucuggauaugacuggauuaccgauuuucccgguaaaacuguaugguuuguaccaucgauaaaaucagggaacgauaucgcaaauuguuugcgcaaaaacggaaagagaguuauacaauuaaguaggaaaacauucgacacagaauaucaaaagaccaaaaauaaugacugggacuacgucguuacaacagacauauccgaaaugggcgcuaauuucagggcugauagaguaauagauccccguagaugccuaaaacccguuauucugaaagaugguccagaaagggucauacuugcaggaccaaugcccgucacaguugcgagugcagcccaaagacgaggucggauaggccguaaucaaaauaaagagggagaucaauacguguacaugggucaaccgcugaauaacgaugaagaucaugcccauuggacagaggcuaaaaugcuauuagauaauauuaacacacccgaagguauaauacccgcccuuuuugaaccagaaagagaaaagagcgcggcuaucgauggugaguauagacuaagaggcgaggcaagaaaaaccuuuguugaacuaaugcgacgcggagacuugccuguuugguuguccuauaagguugcaagcgaagguuuccaauauucugacagacggugguguuucgauggugagaggaacaaccagguucuggaagaaaauauggacguugaaaucuggacuaaggaaggagagaggaagaaacucagaccaagauggcuagacgccagaaccuauuccgacccgcuagcacuucgagaauuuaaggaauuugcugcaggcagacguaguguuucuggagauuuaauauuagaaauagguaaguuaccucaacaccuuacuuugcgcgcucagaacgcacuugauaaccuugucaugcuacauaauagugagcaagguggaaaagccuaucgacacgcaauggaagaauugccggacacuauagaaacucuuauguuauuggcuuuaauagcuguacuaacagguggcgugaugcuauuuuucuuaucugguaaaggacuugggaagaccucaauaggguuauugugcguaacugcaucaagugcccuccuuuggauggcguccguagagccacauuggauagcugccaguauaauuuuagaauuuuuccugauggugcuacugauaccagagccugacaggcagcguacaccucaagauaaccaguuggccuauguuguaauaggucuucuuuuuaugaucuuaacagucgcugcaaaugagaugggucuauuagaaacgacaaaacgggacuugggcauaggacauguagcagccgaaaaucaucaacaugcaacaauguuagacgucgauuuacgucccgccucagccuggacacuauacgcaguggcuacuacugucauaacuccaaugaugagacauaccauagaaaauacaaccgcaaauaucucauugacggcaauagcuaaucaagccgcaaucuugauggggcucgauaaaggguggccaaucagcaagauggauauagguguuccacuucuggcauugggauguuauagucaagugaauccauuaacauuaaccgccgcggugcuuauguuaguagcccauuacgcaauaauaggaccaggauugcaagcgaaagcgacucgugaggcucagaagaggacugcugcaggcauaaugaagaacccgaccguagacgggauuguagcgauagauuuggauccagugguguaugaugcgaaguuugaaaaacaacuuggacaaaucaugcugcuaauuuuguguacaucgcagauccuacuuaugaggaccacaugggcuuuaugugaaaguauaacauuggcgacagggccacucacgacuuuaugggaaggaucgcccggaaaauuuuggaauacaaccauugcaguuucgauggcgaacauauuccgcggaucguaucuugcaggagcuggccuagcauucucuuuaaugaaauccuuagguggaggacguagaggcacaggugcacaaggugagacauugggagaaaaguggaaaagacaacugaaucaguuaaguaagccggaguucaacacuuauaagaggagcgguauuauggagguugauagguccgaggccaaagaaggucugaaaagaggagaaacaaccaagcaugcuguuaguagaggcacugcgaaauugaggugguucguagaacgaaaccuaguuaagccagagggaaaaguuauagaucugggcugugguagaggaggcuggucuuacuacugcgccgggcucaagaaaguuacugaaguaaaaggcuauacaaaagggggaccgggacaugaagaacccauccccauggcaaccuacggauggaaccucguaaaacuccacucagguaaagauguuuucuucaugccgcccgaaaaaugugauacccucuuaugugauauuggugagucaucuccuaauccgacaauagaagaaggaaggacacuaaggguuuuaaaaaugguagaaccauggcuucgaggcaaucaauuuuguauaaagauacugaauccauauaugcccaguguaguugagacuuuggaacaaaugcaaagaaaacacggaggaaugcuaguacguaauccauuauccagaaacucaacucacgaaauguacugggugucuuguggcacgggaaauauuguaucggcaguaaauaugacaucuagaauguuacucaauagauuuaccauggcacauaggaaaccuaccuacgagagagauguggaccuaggagcagggacccggcaugucaccgucgagccagaaguagcuaaucuagauaucauuggacaacguauagagaacaucaaaaaugaacauaagucuacuuggcacuacgacgaagacaacccauacaagacgugggcguaucacggcaguuaugaagucaaaccaagugguuccgcuaguucgaugguuaauggggucgugagacuuuuaacuaagccaugggauguuauuccgauggugacacaaauugcuaugacggacacgacaccguuuggucaacaacgcguuuuuaaagaaaagguugauacgcggaccccucgugcaaagagggguacaacgcaaauaauggaaguuacagcaaaguggcuuuggggguuuuugucaaggaauaagaaaccaagaaucuguacuagagaggaguucacacgcaaggucagaucaaaugcagcgaucggagcugucuuuguagacgaaaaucaguggaauagcgcaaaagaggcaguugaggacgaaagguuuugggauuuaguccauagagaaagggaguuacauaagcagggaaagugugcaacauguguauacaauaugaugggaaaacgagaaaagaaacuuggagaauuuggcaaagcgaaggguucaagggcuauaugguacaugugguugggagccagauuucuugaguuugaagccuugggguucaugaaugaagaucacugguuuagucgagaaaacagcuuaucagguguagaaggcgaaggacuccacaaacuaggguauauucugcgcgauauaaguaaaauuccaggaggaaacauguacgcagacgauacugcagguugggauacaagaauaacagaagacgacuugcaaaaugaagcaaaaauaacggacauaauggaaccagagcacgcccuacuagcgacgagcauauuuaaacucacuuaucaaaauaaggucguaagaguucagcguccagccaaaaacggaacgguuauggaugugauuaguagacgugaucaacgggggaguggacaaguuggaacguaugggcuuaauacuuuuacaaauauggaaguacaacuaauacggcagauggaaucagaagggauauuucuuccuagugagcuugaaacaccaaaucuagcugaacguguucuggauugguuagaaaaacauggggcugaacgacuaaagaggauggcaauuaguggggaugacuguguuguaaaacccauagaugacagauucgccaccgccuugacugcccuuaaugauaugggaaaaguacgaaaggauauaccgcaaugggaacccucaaaaggauggaaugacuggcaacaagucccguuuugcucacaccacuuucaccaauuaauaaugaaggacggaagagaaauaguagucccauguagaaaucaagaugaguuggucgguagagcgcguguaucucaaggugcaggcuggaguuuacgggagacagcgugcuuggguaaaucauaugcacaaauguggcagcuuauguauuuccaucggagggacuuaagauuagcugccaaugcaaucuguucugcuguaccaguugauuggguacccacauccagaacaacguggagcauacaugcgcaccaucaauggaugacaacagaggauaugcuuaguguauggaaccgggucuggauugaagagaauccguggauggaagacaaaacucaugugucgucaugggaagaggugccuuauuuaggcaaacgagaagaucaaugguguggaaguuuaaucgguuuaacggcucgggcaacuugggcgacgaacauucaaguugcuaucaaucaagugaggagauuaauaggaaaugaaaauuaccuugauuauaugacgucgaugaagagguucaaaaacgaaagugauccagaaggagcauugugguag

SEQ ID NO: 21334 - RNA, 9879 nt, Artificial Sequence
  derived and/or modified CDS sequence (opt6) from DENV-1__KF973459__SS-prME
ucaguaacuauguuacuuauguuauuacccacugcacuagcauuccauuuaacaacaagaggcggcgagccacauaugauuguaucaaaacaagaaagagguaaaagucuucuauucaaaacaucagcugggguaaauauguguacacugauagccauggaucuaggugaauuaugugaagauacacuaacuuauaaauguccucaaauaacggaggcggaaccggaugacguagauuguugguguaacgcuaccgacacauggguuacuuacgguacgugcagucaaacuggagaacauagaagggacaaacggucaguagcuuuggcuccacacgugggauuaggguuagaaacacgcacagaaaccuggaugaguucagagggggccuggaaacaaauacaaaggguagaaacaugggcucugcgucauccaggauucacaguuauagcuuuguuucucgcacaugcuauagguacuucaauuacacagaaaggaauuauauuuauacuauuaaugcucguaacaccguccauggcuaugcgaugcgugggaauagguaauagggacuucguagaaggucuuucuggugcaacguggguugacguuguauuagaacauggaucuugcguaacgacuauggccaaaaauaaaccaacauuagauauagaauuacuaaaaacagaagugaccaacccugcuauuuuaaggaaacuauguauagaagcaaaaauuaguaauacaacuacagauaguagauguccaacucaaggugaagccacucugguagaagaacaagacgccaauuucguaugucggcgaacauuuguugacaggggauggggcaacggcuguggucuuuucggaaaagggucacugcuaacgugugcuaaauucaaaugcgucacuaaacuugaggggaaaauaguccaguacgaaaacuugaaguauaguguaauaguuacuguacauacgggagaccaacaucaagucggaaaugaaacaacagaacacggaacgaucgcuacaauaacuccgcaggcuccaacgucggaaauacaauuaacugauuauggugcuuuaacucuugacugcucaccucgcacaggucucgauuuuaaugagaugguguuacugacgaugaaagagaaaucuugguugguucauaaacaaugguuucuagaucucccucuuccauggacaaguggagccagcacgucacaagaaacguggaaucgacaagauuugcucguuacuuucaaaacagcccacgcuaagaaacaggaaguggucguacuuggaucacaggaaggcgcaaugcauaccgcucugacgggagcaacugagauacaaacaucaggaacgacaaccauauuugcaggacauuugaaauguagguuaaaaauggauaaacuuacacuaaaagguacuucauauguuaugugcacagguagcuuuaaauuagaaaaagaagucgcagaaacccaacauggaaccguuuuaguacaagucaaauacgaggguaccgaugcacccugcaaaauaccuuuuucaacacaagacgagaaagggguuacucagaacggucguuuaaucacugccaaucccauagugaccgacaaggagaaaccugucaacauagaaacagaaccacccuuuggugaaaguuauaucguggucggagcaggagaaaaggcgcuuaaacuuucaugguuuaagaaaggcucaucaauagggaaaauguucgaggccacagcacguggugcgcgccgaauggcaauccuaggugacacagcaugggacuucggaucaauaggggguguguuuaccucuguaggcaaauuaguacaucaagucuucggaacagccuacggaguauuauucucaggaguaagcuggacaaugaagauagggauuggaauuuugcuuacguggcuaggccucaacagucggucgacaagucugagcaugacauguauugcaguuggcaugguaacccuauauuuagguguaaugguccaggcagauucaggaugugucaucaacuggaaaggaagagaguuaaaaugugguagcggaaucuuuguaacuaaugaaguucauacauggacagaacaauacaaauuccaagcagacucaccaaaacgucuuucggcagccauagggaaagcaugggaagaagguguguguggcauaagaagcgcgaccagauuagaaaacaucauguggaagcaaauuucuaaugaacucaaccauauauuauuagaaaacgauaugaaauuuacugucgugguuggugaugcuaacggaauauuggcgcaaggcaagaaaaugauucgaccacagccuauggaacacaaauauagcuggaaauccuggggaaaggcuaagauuauaggcgcagauauccaaaacacaacauuuauaauugauggaccugacaccccagaauguccagacaaucaaagagcauggaacauuugggaaguugaggauuacgguuucggcaucuucacuacgaauauuugguuaaaacugagagauaguuacacgcaaguuugcgaucacagacuaaugagcgcggccauuaaagacucaaaggcaguccacgccgauaugggauauuggaucgaauccgagaaaaaugagacauggaaauuagcaagggcgucuuuuauagaaguaaaaacauguacuuggccuaaaucccacacguuauggagcaaugggguuuuagaaagcgaaaugauaauaccaaagauuuacgguggaccaauaagccaacauaauuaucgaccaggguacuucacacaaacugcagggccauggcauuuaggcaaacucgaacuagauuucgauuuaugugaagguaccaccgucgugguagaugaacacuguggcaaucgagguccaucauuaagaacuacaaccgucacagggaaaaucauacaugaauggugcuguaggaguuguacuuugccaccccuccgauuucgcggagaggauggguguugguaugguauggaaauaagaccaguuaaagaaaaggaggaaaaucuaguuagaucuaugguuucggccggaaguggugaaguugauucuuuaucuuuagggauauuaugcgccucaauaaugaucgaggaaguaaugagaagccguuggucuaggaaaauguugaugacgggcacacuagcuguuuuucuuuugcucauaauggggcaacugacguggaaugauuugauaagacuauguauuauggugggagccaaugcaucagauagaauggguauggguacaaccuacuuagcucuuauggcuacuuuuaaaaugcgucccauguucgcugucgguuuacuauuuaggagacuaacaaguagggaaguucuuuuauuaaccauaggacuuuccuuaguagcgucuguugaauuaccaaauagucuagaagaacugggugacggacucgcaauggguaucaugaugcuuaaauuauugacggaauuucaaccacaccaguuauggacaacacuuuuaaguuugacauuuauuaaaacuacacuaagccuagauuaugccuggaaaacuacugcaauggcucugagcauuaucucccuuuuuccuuugugccuaucgacgacaucgcaaaagacaacguggcuuccaguguuauuagggagcuucggauguaaaccacuuaccauguuccugauaaccgaaaauaaaauuuggggucguaagaguuggccucucaaugaaggcauuauggcgauagguauuguaaguauccuacuuucuuccuuacuaaagaaugacguaccuuuggccggaccauuaauagcuggugguauguuaauagcauguuauguaauaucaggguccucugcagacuugaguuuggaaaaagcagcagaaguaucaugggagcaagaagcagagcauuccggcacaagucauaauaucuuaguugaaguacaagaugacggaacuaugaaaaucaaagacgaagaacgagaugauaccuugacuauucuacuaaaggcgacccucuuggcagucaguggaguauacccaaugucaauaccugcaacauuauucgucugguauuucuggcagaagaagaaacaaagauccggcgugcucugggauacuccaucgcccccagagguagaacgagcaguucucgaugaugguauuuauagaaucuugcaacgaggacuacucgguagaagucaggugggugucgguguauuccaggacggugucuuucauacaauguggcacgucacacguggagcuguacuaauguaucaagguaagagguuagaaccaagcugggcaucagucaagaaagaucucauaucuuacgguggaggauggagauuucagggauccuggaacacuggugaggaaguacaagugauugcggucgaaccagggaaaaaucccaaaaauguacaaacaacuccaggaacuuuuaaaaccccugagggagaagucggugcaauagcccuugauuuuaaaccaggaacgucaggcucgccgauuguuaaucgagaaggaaaaaucguuggcuuauaugguaauggaguaguaaccacaucagguaccuacguuagugccauugcccaagccaaagucucacaggaaggucccuuaccagaaauagaggacgaaguauucaagaaaagaaaucuaaccauaauggacuuacauccaggauccggcaaaacacgcagauauuugccggcaauaguaagagaagcaaucaaacgcaaauuaagaacccuuauacuggcaccgacaagaguugucgccucagaaauggcugaagcacuaaaaggaaugcccaucagauaccaaacuacugcaguaaagagcgaacacacggggcgcgaaauuguugacuuaaugugucaugcgaccuuuacgaugcgucuccucucaccagucagaguaccaaauuauaauaugaucauaauggacgaagcucauuucacagauccugcaagcauugcugcacguggauauauaaguacacgagugggcaugggcgaagcugccgcaaucuuuaugacugccacaccaccuggaucugucgaagcguucccacaaagcaacgcuguuauucaagacgaggaacgggacauuccggagagaucguggaacucaggauacgauuggauaacagauuuuccuggaaaaacaguuugguuuguuccaaguauaaaaagcggaaaugacauugcuaacugucuuaggaaaaacgggaaaagaguuauccaauuaucacggaaaacguucgacacagaguaccagaaaaccaaaaauaacgacugggauuaugucguuacuacagauauuagugaaaugggagcaaacuuuagagccgaucgcguuauugacccaaggcgauguuuaaaaccaguuauuuugaaagauggcccugagcgagucaucuuagccggaccuaugccggugacaguugcgagugcugcccagaggagagggagaauuggacggaaucagaacaaggagggagaucaguacgucuacaugggacaaccauugaacaacgaugaagaucaugcucauuggacagaggcaaagaugcuauuagacaacauaaauacaccggaaggcauuaucccugcacuuuuugaaccggaaagggaaaaaucagcagcuauugacggagaauauagauugagaggcgaggcgaggaaaaccuuugucgaauugaugcgcaggggagauuuaccaguaugguugaguuauaaaguggcgucugaaggauuucaguauagcgauaggcgauggugcuuugauggggaaagaaauaaucagguacuggaagaaaauauggacgucgaaauuuggacaaaggaaggugaaagaaagaaacuacgcccaaggugguuagaugcacgcacauacagugacccccuagcacuucgagaauuuaaagaauuugcagcaggucgucguucaguaaguggagacuuaauacuggagaucggaaaacuuccucaacacuuaaccuuacgagcucaaaaugcccuugauaaucuagucauguuacauaacucggagcaaggaggaaaggcuuauagacaugcuauggaagaacugccagauaccaucgaaacucuaaugcuucucgcacugauagcaguacuaaccgguggcguaacacuauucuuucuuucggguaaaggacuaggaaaaaccagcauaggucuucuaugugugacagcgaguagcgcguuacuauggauggcuagcguagaaccgcacuggauugcugcaucuauaauauuagaauuuuuccucaugguucuauuaaucccugaaccagaccgacaaagaacaccacaagauaaucagcuugcguauguaguuauaggauuauuguucaugauccuuacagucgcugcaaacgaaaugggacuacuugaaacaacgaagaaagauuuagggauuggucauguugcugccgaaaaccaucagcaugcaacuaugcucgacguagaucuuagaccugcauccgccuggacauuauaugcagucgcuacuaccguaaucacaccaaugaugcgucacacuauugaaaauacgacagcaaauauuagcuuaacugcgaucgcuaaucaagcugcuauucuuaugggauuagacaaagguuggccuauaaguaagauggauauuggaguuccauuacuggcacuaggauguuauucgcaaguuaaucccuuaacccugacggcagcgguuuugauguuaguagcacauuaugcuauuauaggaccuggauuacaagcaaaagcuaccagggaagcucagaaacgaacggcugcaggaauuaugaagaauccaacaguagaugguaucguugccauagacuuggauccagucguuuacgacacuaaauuugaaaaacaacuaggacaaaucauguuacucauacuuuguacaagucaaauauugcuaaugagaaccacaugggcccugugcgagaguauaacacuugcaacugguccccugaccacucuuugggaaggaucucccgggaaauucuggaacacuaccauagcuguauccauggcuaauauauuccgagguucauacuuagcaggagcaggguuagcauucuccuuaaugaaaaguuugggaggcgggcgaaggggcacuggcgcgcagggcgaaacuuuaggcgaaaaguggaagaggcaacuuaaucaacucucaaaaagugaguucaauauuuacaaaagaucugguauaauggaaguagauaggagcgaagcgaaagaaggcuuaaaaaggggugaaacaacuaagcaugccguauccagggggacagcuaaacuacguugguuuguugagcgaaauuugguaaagcccgagggaaaagugauugaucucgguugcggaaggggaggcuggucuuacuauugcgcuggacuaaagaaaguuacggaaguaaaaggauacacuaaaggagggcccggccaugaggaaccaauaccaauggcaacuuacggauggaaucuaguuaaacuacacagcggaaaggaugucuucuuuaugccaccugaaaagugugacacauuauuaugcgauauuggggagagcucuccuaacccaacuauagaggaggggagaacauugcgaguacucaaaaugguugaacccugguuaaggggaaaucaauucuguauuaagauacuaaacccuuacaugccuuccgugguagaaaccuuagagcaaaugcaacgaaaauauggagguaugcuuguacgcaacccauugucaagaaauucaacucacgagauguauuggguaucuugugguacgggcaauauuguuuccgcuguaaacaugaccucaagaaugcuacugaaccguuuuacaauggcacaccguaaaccgacauaugaaagagauguagaccuuggggcagggacgagacauguagcgguugaaccagaaguagcgaaucuugacauuauaggccaacgaaucgaaaacaucaaaaaugaacacaaaagcacuuggcauuaugaugaggauaacccuuacaaaacaugggcauaucacgguucauaugaaguaaaaccaucaggaagcgccaguucuauggucaacggaguuguucgacuuuuaacaaagccaugggauguaauuccaauggugacccaaaucgccaugacagacacuacaccauucggacaacaacggguuuucaaggaaaaaguagauacgaggacuccgagagcuaaaaggggaacuacucaaauaauggaagugaccgccaaauggcucuggggcuuccuuagucgaaauaagaaaccgcgaaucuguacaagagaggaauuuacgcguaaagucagaucuaaugccgccauaggugcuguguuuguagaugagaaucaguggaauagcgcgaaagaggcugucgaggacgaacgcuucugggaucuuguacacagggaaagagagcuacauaaacaagggaaaugcgcuacuugcguuuauaauaugaugggaaagcgagaaaagaaguuaggugaauuuggaaaagcuaaaggaucaagggcuaucugguauauguggcuaggagccagguuuuuagaauuugaggcauuaggauucaugaacgaggaucauugguuuucacgugaaaauucacuuucagguguagagggcgagggacuucauaaguuaggauacauacugagagauauaaguaaaauuccaggugguaacauguacgcagaugauaccgcaggcugggacacucgaaucaccgaggacgaccuccaaaaugaagcaaagauaaccgauaucauggagcccgaacacgcauuacuugcuacuucaaucuuuaaacucaccuaccaaaauaaaguggugagaguccaacgacccgcgaaaaauggaacaguaauggacguaauuucucguagagaucaaaggggaagcggacaaguagggacauacgggcuaaacacauucaccaauauggaaguucagcuaauuagacaaauggaaagugagggaauauuuuuaccaagcgaacuagaaacgccaaauuuagcuaagaggguacuagacuggcuagaaaaacauggagcagaacgacuuaagagaauggcaauaucaggagaugauugcguugucaaaccaauagaugaucgauucgcgaccgcuuugacggcccuuaacgauaugggaaaaguaaggaaagacauaccucaaugggaacccaguaaaggauggaacgacuggcaacaagucccauuuugcagccaccauuuucaucaauugauuaugaaggaugggagggagauaguuguaccgugucguaaucaagacgagcuggucggucgggcccgaguuagucaaggugcgggauggucucuuagagaaacggcaugucuggguaagucuuacgcucaaauguggcaauuaauguacuuccacagaagagaucuuagauuagcagcuaaugccauuugcucagccguaccaguugauuggguucccacaucaaggacuacauggagcauucaugcgcaccaccaauggaugacaacagaagacaugcuaucuguuuggaaccgcguuuggauagaagagaacccauggauggaggauaagacacauguaucgaguugggaggaggucccuuaccucggaaaacgagaagaucaauggugugguagucugauuggguuaacagcaagggcaacaugggcgacgaauauacaaguggcaaucaaccaagucagaaggcuaaucgggaaugaaaauuaccuagacuauaugacaagcaugaagcgguucaagaacgaaucugauccagaaggagcucuaugguaa

SEQ ID NO: 21335 - RNA, 9879 nt, Artificial Sequence
  derived and/or modified CDS sequence (opt6) from DENV-1__KF973460__SS-prME
agugugaccaugcuauugaugcugcuuccuacugcccuggcuuuucauuuaacuacuagagguggagaaccacauaugaucguaucgaaacaugaaagagggaaauccuuacuuuucaaaacaaguacuggagugaauauguguacauuaauagcuauggaucucggagaauuaugugaagacacaaugacguacaaaugcccgagaauaacagaagcugaaccagaugauguugacugcugguguaacgcaacagauacaugggugaccuauggaacauguagucaaacuggagaacauagaagggauaaaagaucuguugcccuagcgccacacgucggcuuaggauuggaaacuagaacagaaacauggaugaguucggaaggagcuuggaaacaaauucaaaggguggaaaccugggcacuaagacauccuggauuuacuguaauagccuuauucuuggcacaugcuauagguacuucaaucacccaaaaaggaauaauuuuuauacuauugauguuaguaaccccaucaauggcgaugcgaugcguagguauuggaaauagagauuucguggaaggauugucgggagcaacguggguggauguagugcuggaacacggaaguuguguaacuacuauggcuaaaaacaaaccuacauuggacauagaauuacuaaaaacggaaguuacgaacccugccguguugaggaaauuauguauugaagcaaaaauaaguaauacaacaacagacucaagaugccccacucaaggagaagcuacucucguggaagaacaagacgcuaauuuuguuugucgucggacuuuaguagaccgugguuggggaaacggguguggauuguucgguaaaggaucauuacuaaccugcgcaaaauuuaagugcguuacaaaguuagaaggaaaaauaguccaauaugaaaaccugaaauauaguguuauagugacagugcauacaggcgaucaacaucaagucggcaaugaaacgaccgaacacggaacaauagccacaaucacaccacaagcaccuaccagcgaaauacagcuuaccgauuauggagcauuggcacuagauuguucaccaaggacuggacuagacuuuaacgaaauggugcuucuaacgaugaaggaaaaaucuuggcuuguucauaaacaaugguuuuuggaucugccguuacccuggacuucgggugcuagcacaagccaggaaaccuggaauaggcaagauuuacuggucacuuucaaaacagcacacgcgaagaaacaagaaguuguaguucuggguucacaggaaggcgcuaugcauacggcguuaacuggugcuacggaaauucaaacgagugguacuacuacuauuuucgccggacaccuaaagugucgauuaaagauggacaaauuaacauuaaaagggacaaguuaugugaugugcacgggcagcuucaaacuugaaaaagagguugcagaaacacaacacgguacuguccuaguucaagucaaauacgagggcacagaugcgccaugcaaaauaccauucaguacgcaagaugaaaagggcgucacacagaacgguagauugauaacggccaaccccauagugacagauaaagagaaaccgguaaacauagaaacugaacccccuuuuggcgaaucuuacauuguggugggagcuggagaaaaagcucuuaaauuaucuugguucaagaaaggaucuucuauuggaaaaauguuugaggcuacugcucgcggcgcgagaaggauggccauauugggggauaccgcuugggauuuuggaaguaucgggggaguauuuaccagcguaggaaaguuaguccaucaaguauuuggaacugcuuauggaguguuauucucaggaguaagcuggacaaugaaaauuggcauagguaucuuauugacuugguuagguuuaaacuccagaucuacuuccuugagcaugacguguaucgcuguagggaugguuaccuuguacuuaggugugaugguacaagcagauucuggauguguuauaaacuggaaaggcagagaacuaaagugcgggucuggaauauuugugacuaacgaaguucauaccuggacagaacaauacaaauuucaagccgacaguccaaaaagauuguccgcggccauugggaaagcgugggaagagggcguguguggaauaagaucagcuacaagacuagaaaauauaauguggaagcaaauauccaaugaauuaaaucauauuuuguuggaaaacgauaugaaauuuacggucgugguaggugacgcaaaugggauauuagcacaagguaagaagaugauacgaccgcagccgauggaacacaaauacucauggaagucaugggguaaagcgaaaauaauaggugcggauauacaaaauaccacuuuuauuaucgaugggccagacacuccagagugcccggaugaucagcgugcuuggaauauaugggaaguggaggauuacgguuuuggaauauucacuacaaauaucuggcugaaauuaagggacucguacacgcaaaugugcgaucacagacucaugucagccgcuauaaaggauucaaaagcaguccaugccgacauggguuauuggauagaauccgagaaaaaugaaacuuggaaacuagcacgggcaucauuuaucgaagugaagacgugcacuuggcccaaaucccacacacuuuggaguaacggcguguuggaaagugagaugauaauaccgaaaauauacggaggcccuauaagucaacacaacuaucgcccagguuauuuuacacagacggcgggcccuuggcaucucggcaaauuggaguuagauuuugaucuaugcgaagguaccacuguaguaguagaugagcauugugguaaucgugguccuucccugcgaacgacaaccguaacaggaaagauaauacaugaaugguguugcagaucaugcacccuaccucccuuacgauuucguggugaagacggauguugguacggaauggaaauccgaccgguaaaggaaaaagaagaaaauuuggucagaucaaugguaucugcaggauccggagaagucgauagucuuaguuugggaauccuaugugucagcauaaugauagaagaggugaugagaaguagguggagccguaagauguuaaugacaggcacucuagcagucuuucuucuccugauaaugggacagcuuaccuggaaugacuuaaucagacugugcauaaugguuggcgcuaaugccagugauagaauggguaugggaacgacauaccucgcacucauggcaacauuuaaauuacguccgauguuugcaguaggcauucuauuuaggagacuaacaagcagagaaguuuuauugcuaacaauagguuuaucguuaguugcuaguguugaauuaccuaacucauuggaggaacuaggagaugguuuagcaaugggaauaaugaugcucaaacuguuaaccgaauuucaaccacaucagcuauggacuacuuugcuaucuuuaacauuuauaaaaacuacuuugucccucgacuaugccuggaaaacaacagcaauggcauuaaguauaguuagccuuuucccccuauguuuaaguacaaccucucaaaagaccaccuggcuaccaguuuuacuagggaguuucgguuguaaaccacuuacaauguauuuuauuacagaaaacaaaaucuggggucgaaagagcuggccuauaaaugaagggaucauggcaauagggauuguaaguauacuccugucuagucuccuaaagaaugaugugccuuuagcagguccccuaauagccggaggaaugcugauagcguguuauguuauaaguggaagcagcgcugacuugucguuagagaaagcagcagaagugucaugggagcaagaagcagaacauucaggaacuucccacaacauucuuguggagguacaagacgaugggacuaugagaaucaaagaugaggagaaagaugauacauuaacuaucuuauugaaagccacacuucuagcugugucaggagucuacccaaugucaauuccugcaacucuauuugucugguauuucuggcagaagaagaaacaacguucaggaguauugugggauacaccaucaccacccgaaguagaaagagcaguacuagacgaugguauauacaggauauuacaaagggguuuacuaggacgaagccaaguuggaguaggcguauuucaagauggaguauuucauacaauguggcacguuacgaggggagcuguauuaauguaccaaggaaaaagauuagaaccaucaugggcgaguguuaaaaaggacuugauaucguauggcggaggcuggagauuucagggcagcuggaacacuggugaagaaguacaggugauagcagucgagccaggcaaaaauccuaaaaacguucagacaacccccgguacauucaaaaccccagaaggagaaguaggagcaauugcuuuagauuucaaaccaggaaccucgggcucaccaauuguuaauagggagggaaaaauuguagguuuauacgguaacgguguuguuacuacauccggaacguacguuagcgccauugcccaagcaaaggcaucacaagaagggccacuacccgagauagaagaugaaguuuucaaaaagcgcaauuuaacuauaauggauuuacacccagguagugguaaaacacgucgauauuugccugcuauagugcgagaagcgauaaaacguaagcuaagaacccuaauacuagcgccuacuagaguaguugcaucagaaauggcagaggcuuugaaagggaugcccauccgauaucaaacaacugcgguaaaaucagaacacacuggacgggaaauaguugauuugaugugucacgcaacguuuacaaugcgauuauuaagcccgguaagaguaccuaauuauaauaugauaaucauggaugaagcacauuucacagacccagcgucaauagcagcuaggggauacauuucaacucgagucggaaugggcgaagcagcagcaauauuuaugaccgcaacuccuccugguucaguagaggcuuucccucagucaaaugcuguaauacaagaugaagaaagggacaucccugaaaggagcuggaauagcggauaugacuggauaacagacuucccuggaaagacaguaugguuugucccauccauaaaaucaggaaacgauauagcuaauugccugagaaagaauggaaagagaguaauccagcuuagucgaaaaaccuucgacacagaauaccagaaaacgaaaaauaacgacugggauuaugucguaacgacagacauaucagaaaugggggcuaauuuucgagccgacagaguuauagauccccgccguugcuuaaaaccagugauacucaaggauggaccggagagagugauacuagcagggccgaugccgguuacaguagccagcgcggcucaaagacgggggcguauuggaaggaaccagaauaaggaaggcgaucaguaugucuauaugggacaaccacuuaacaaugacgaagaccaugcccacuggaccgaagccaaaaugcuguuggauaauauaaauacuccagaaggaaucauuccagcccuauucgagcccgaacgcgagaaaagcgcagccauagacggcgaauaucgcuuaagaggugaagcucgcaaaacguuuguagagcuaaugagacgcggcgauuuaccaguguggcuuagcuauaaaguugccucugagggauuucaauauucugauagaagaugguguuuugauggugagaggaauaaucaaguucuugaagaaaacauggauguggaaauuuggacgaaagaaggagaaaggaagaaauugcgaccucgauggcuggacgcuagaacuuacagugauccucuagcacuucgcgaguucaaagaauuugcugcaggaagaaggucuguuucaggagaucuaauacuagagauugguaaauuaccacaacacuuaacuuugcgagcacaaaacgcucuugauaaucuugucaugcuacauaauucagaacaaggaggaaaagcauacagacaugccauggaagaacugccagauacuauagaaacucucauguuguuggcccuaauugcagucuuaacggguggagugacuuuauuuuuccuaagugguaaaggcuuaggaaagacaagcaucggccuucuguguguuacagcuuccagugcgcuguuauggauggcauccgucgaaccacauuggauugcagcaagcaucauacuagaauuuuucuugaugguauuacucaucccugaaccagaucgccaaagaacaccacaggauaaucagcuugcauacguaguuauuggacugcuauucaugauuuuaacaguugcagcaaaugagaugggacuacuagaaacaacaaaaagggaucucgggauaggacauguugcugccgaaaaucaucaacaugcaacaauguuagacguugaccuuagaccugcaucugcauggacacuguacgcaguggcaacaacgguuaucacaccgaugaugagacacacuauagagaacacaaccgcaaacauaagucuaacagccaucgcaaaucaagcagccauacucauggguuuagacaaaggauggccgaucucgaaaauggauauugguguuccauuauuagccuuaggcuguuacagucaggugaauccacucacguuaacagcagcaguauuaauguuaguugcacauuaugcgauaaucggaccagguuuacaggcgaaggcuacccgagaggcucagaaaagaaccgcagcaggcauaaugaaaaacccaacagucgaugguauaguagcuauugaccuggaccccgugguauacgacgcuaaauucgaaaaacaauuaggacagauaaugcuucucauccuaugcaucucccaaauauuauuaaugcgaacgacaugggcacuaugugagucaauaacauuggcaaccggaccauugaccacauuaugggaagggucuccggguaaauucuggaacacaacaaucgccgugucaauggcaaacauauuuagaggaaguuaccucgccggagcgggucucgcauuuucacuaaugaaaucauuagggggaggucgaagaggaacuggagcgcaaggugaaaccuuaggggagaaguggaaaagacaauugaaucaacuuaguaaaccagaguuuaacacuuauaaaagaucugguauaauggaaguugauagaucagaagcaaaggaaggacuuaaacguggagaaacuacgaaacaugcuguuaguagggggacagcaaaauuacggugguuugucgagagaaauuuaguaaagccggaggguaaaguaauugauuugggauguggcagaggagguuggucuuacuacugugcugggcuaaagaaagucacugagguaaaaggauauacuaaaggagguccgggucaugaagaaccuauuccuauggcuacuuacggguggaaucuggugaaauugcauucugggaaagauguuuucuuuaugccucccgaaaaaugcgacacucuuuugugcgacaucggagaaucaucgccaaauccaaccauugaagaaggaaggacauuaagaguucugaaaauggucgaaccaugguugagaggaaaucaauuuugcauaaagauacuuaauccauauaugccgucaguaguggaaaccuuagaacaaaugcagaggaaacauggaggcaugcuggucagaaacccucuaucacgcaacuccacacacgaaauguauuggguaucaugcgguacaggcaacauuguuagcgcaguuaacaugaccucaagaaugcuacuaaaccgauuuacaauggcacaucgaaaaccaacauaugaacgggauguagacuuaggggcggguacgcgacacguagccguagaaccagagguugcuaacuuagacauuaucggacagcguauagaaaacaucaaaaacgaacauaaaaguacuuggcacuacgaugaagauaacccauacaaaacuugggcauaucauggauccuaugagguaaaaccuucaggaagcgccaguucaaugguaaaugguguagugagacuucucaccaaaccaugggauguaauaccgaugguaacucaaaucgcgaugacggacacaacgcccuucggacagcaaaggguguuuaaagaaaagguagauacaaggacaccuagggcuaaaagaggaacaacacaaauuauggaaguaacugcgaaaugguuauggggauuuuuaucucguaauaaaaagccacgaauauguaccagagaagaguuuacuagaaaaguucgcagcaaugcagccauaggugcaguauucgucgaugaaaaucaauggaacucagcaaaggaagcagucgaagaugaacgcuucugggaucugguccaccgcgaaagggaacuucauaagcaaggcaaaugcgcgaccugcguauauaauaugauggguaagcgugagaagaaacuuggcgaauuuggaaaggcgaaggggagcagggccauuugguauaugugguugggggcaagauucuuggaauuugaagcacuaggguuuaugaacgaggaucauugguucagucgugagaacagcuuaucaggaguagagggagaaggauuacauaaguuaggauauauucucagagacauuaguaagauaccuggagguaacauguacgcugaugauaccgcgggaugggauacuaggauaacugaagacgauuuacaaaaugaagcaaaaauaacagauauaauggaacccgaacaugcguuacuggccacaucaauuuuuaaguugacguaucaaaacaaaguugugagaguacaaagacccgcuaagaacgggacggugauggacguuauaucacgacgggaucagcgcggaagcggacaggugggcacuuacggguuaaacacauuuaccaacauggaaguucaacucauccgacagauggagucagaaggaauuuucuuaccaucugaauuagagacuccaaacuuagcagagaggguacuugacuggcucgaaaaacauggcgcugaacgcuugaaaagaauggcaauauccggugaugacuguguagucaagccuauagaugauagauuugcuacagcguuaacugcauuaaacgacauggguaaaguaagaaaggauauaccacaaugggagccaucuaaaggauggaacgauuggcagcaaguacccuucuguucccaccacuuccaccaauuaauaaugaaagauggccgggaaauuguaguuccgugucgaaaccaggaugaauugguagggagagcacgaguuucacaaggagcaggauggucacuuagagaaacugcaugucuagguaaaucuuacgcucaaauguggcagcuuauguacuuucaccgucgugaccuuagacuagccgcuaaugcaauauguucugcgguaccaguagacuggguuccgacaucucgaacgaccuggagcauacaugcgcaccaucaguggaugacaacugaagacaugcuaaguguauggaauaggguuuggauagaagaaaauccguggauggaagacaagacacauguuucauccugggaggagguuccuuauuuaggaaagcgagaagaucaauggugugguagccucauaggauuaacugccagagcaacaugggcuacuaacauacaaguagcaauaaaucaagugcgaagacuaaucgguaaugaaucauauuuagauuacaugaccucaaugaagcgcuucaagaaugagucugauccagagggugcuuugugguaa

SEQ ID NO: 21336 - RNA, 9879 nt, Artificial Sequence
  derived and/or modified CDS sequence (opt6) from DENV-1__KF973461__SS-prME
ucaguaacuaugcuacucauguuauuacccacagcucuugcguuucaucuaacgacgagaggaggagaaccacauaugauuguuaguaaacaagaacgaggaaagagcuuauuauucaaaacgucagcaggaguaaauaugugcacuuuaaucgcuauggaucuuggagaacugugugaagacacaaugacauauaaaugcccucaaauaaccgaagcagaacccgaugauguggauuguugguguaaugcuacagauacgugggugaccuaugggacauguucucaaacuggagaacauagacgugacaaaagaagcguagccuuagcuccccauguuggguuaggacuagaaacacgaacggaaacuuggaugaguagugaaggagcuuggaaacaaauucaaagaguagaaacaugggcacucagacauccaggauucacaguaauugcacuguuucuugcacacgcuauaggaaccagcauuacgcagaaagggauuaucuucauccuacuaaugcuaguaacuccaaguauggcaaugcguuguguuggaauuggaaauagagauuucguggaagguuuaucuggugcgaccuggguggaugucguacucgaacacgggucauguguaacuacaauggccaaaaacaaaccaacacuagacauugaacuacuaaaaacugaaguaacgaacccagcaaucuuacgaaaauugugcauugaagccaaaauauccaauacaaccacggauuccagauguccaacucaaggagaagcaaccuuaguagaagaacaagaugcuaauuucguauguagacgaacauucguugacagaggaugggggaaugguuguggucuuuuugggaaagggucguugcuaacgugugcaaaauucaaaugugucacgaaacucgaaggaaaaauaguucaauaugaaaaccuaaaauacucaguuauaguaacuguucacacaggugaucagcaccaaguagguaaugaaacuaccgaacacggaacaauugcgacaauaacaccccaagcgcccacaucagaaauucaguugacagacuauggagcacucacauuagacuguaguccaaggaccggccuugauuuuaaugaaauggugcuauuaacaaugaaagagaaaaguuggcucguccauaaacaaugguuccuagaccuacccuuaccguggacgucgggggcuaguacaagccaggaaacauggaauagacaagaucucuuaguaacguucaaaacagcacaugccaagaaacaggaagucguuguauuaggaagucaagaaggggcaaugcauacugcguuaacuggcgcaacagaaauacaaacuagcgguaccaccaccauuuuugcuggacaccugaaaugcagauugaaaauggauaaacugacuuugaaaggaacaucauauguaauguguacaggcucuuuuaagcuagaaaaagagguggcugagacacaacacgggacgguacuuguccaagugaaauacgaggguacugaugcccccugcaaaauucccuuuaguacacaagacgaaaagggaguaacgcaaaauggccgucuaauuacagcaaauccaaucguaaccgauaaagaaaagcccguuaauauagaaacagagccgccauucggagaaucuuacauuguagucggugccggcgagaaagcauuaaaguugucuugguucaagaaaggcucaucuaucgggaagauguuugaagccacagcaagaggagcacguagaauggcuauuuuaggagacacagcuugggauuuuggaaguaugggaggugucuuuacaaguguaggaaagcuaguacaucagguuuuuggaacggcauacgguguccuguuuagugggguuaguuggacgaugaaaauagguauagguauucuauuaacaugguuagggcucaauucgagaagcaccucacugucaaugacgugcauagcugugggaaugguuacauuauaccucggaguaaugguacaagcugacagcggaugcguaauuaauuggaaaggacgugaauuaaaauguggaucagguauauucgugacuaaugaaguacacacauggacggaacaauacaaguuucaagcugacagucccaaaaggcuuagugcagcaauuggcaaagcgugggaggaaggagugugcgguauaagaucagcgacgagacuagaaaauauaauguggaaacaaauaaguaaugaacuuaaccacauucuccuagagaacgacaugaaauuuacagugguggugggagacgcaaacggcauucuggcacaagguaaaaagaugauacgcccgcaaccuauggaacauaaauauucuuggaaaagcuggggcaaagcaaaaaucauaggagcugacauccaaaacacaacuuucauuaucgacgggccagacacuccggaaugcccagauaaccaacgugcguggaauauaugggaaguagaagacuacggauucggcauuuuuaccacuaauauuuggcuuaaacuaagggauucguauacccaaaugugugaucacaggcuuaugagugcugcuauaaaagacucaaaagcaguucaugccgauaugggauauuggauugagucagagaaaaaugaaacguggaaacuugcacgugcuagcuuuaucgaagugaaaacauguaccuggccgaagucucacacucuaugguccaaugguguguuagaaagugaaaugauaauacccaaaauauacgguggcccuaucucacaacauaacuauagaccagguuauuuuacucaaacugcgggaccauggcaucuaggaaaacuugaauuggauuucgaacuaugugaagguacaacaguaguuguggacgaacauuguggcaaucgaggucccucucuuagaacgaccacaguaacggggaaaauaauacaugaaugguguugucggaguugcacacuaccuccuuugagguuccguggagaagacggcuguugguacgggauggaaauaagacccgugaaagaaaaggaggaaaaccucguuagaucgaugguaucggcggggagcggggaaguugauagcuuuuccuuagguauauuaugugccucgauuaugauagaagaaguaaugcgcagccgcuggagccguaagauguuaaugaccgguacgcucgcgguauuucuauuacucauaaugggacaacuaaccuggaaugacuugauuaggcuguguaucaugguuggcgcaaacgcuagugaucggaugggaaugggaacaacuuaucuagcuuuaauggcgacauuuaaaaugagaccgauguucgcaguuggccucuuauuucgcagacuuacgucgagagagguacuacuccuuacuauaggacuuuccuuaguagcaagugucgaacuccccaauagucuagaggagcugggagauggucuggccaugggaauuaugauguuaaaauuacuuacugaauuucaaccgcaccagcuguggacuacgcuauuaagccuaaccuuuauuaaaaccacuuugucucuagauuaugccuggaagauaaccgcaauggcucucucaauaauauccuuauucccuuuaugcuuaagcacuacgagucagaaaacgaccuggcugccugugcuauuagguucauuuggauguaaaccuuuaacaauguuucugauaacugaaaauaagaucuggggcaggaaauccuggccguuaaacgaaggcauuauggcgauaggaauuguuucuauacuacuaucaagccucuuaaagaaugacguaccccuggccggacccuuaauugcuggagguaugcuaauugcguguuauguaauaaguggauccucagcugauuuaucauuggagaaagcagcagagguuaguugggaacaagaagcggaacacucuggaacaucucacaacaucuuaguugaggugcaagacgauggaaccaugaaaaucaaagacgaagaacgugaugacacacuuacaauauuacuuaaagcaacacuauuagccgucagugguguauauccaaugagcaucccugcaacacuuuucguaugguauuucuggcagaaaaagaaacaacgauccggcguucuuugggacacaccuucaccaccagaaguugaaagggcaguacuugaugaugggaucuauaggauuuuacaacguggguuauuggggagaucacaaguaggcguagguguuuuccaagacggaguauuucauacuauguggcaugugacuaggggcgcuguucucauguaucaaggaaaacgauuggaaccuucuugggcaucugucaagaaagauuuaauuaguuacggaggcggcuggcgauuucagggaucauggaacaccggggaagaaguacaaguuaucgccguagaaccaggaaagaaucccaaaaacguacaaacaacuccaggaacuuuuaagacgccugaaggugaaguaggugccauagcauuagauuucaaacccgggacuucaggcucaccuaucguaaacagagaaggcaaaaucgucggacuauacgguaaugguguagucaccaccuccggcacauauguaagcgcgauagcacaagcgaaggcuucacaggaaggaccauugccugaaauagaagaugaaguuuuuaaaaagagaaaucuaaccauuauggauuuacacccagguucggggaaaaccaggagauauuuaccagcaauaguuagagaagccauuaaacgcaaacuucguaccuuaauccuagcgccaacucgcgugguagcuagcgaaauggcagaagcacuaaaaggcaugccaaucagauaucaaacaacugcugugaaaagcgaacacacaggucgcgaaauaguagaucuaaugugucacgcaacauucacuaugagacucuugucaccgguuagagucccaaacuauaauaugauuauuauggacgaagcccacuucacugacccugcaucgauagcagcaagaggcuacauaucuacgagaguaggaaugggagaagcagcagcuauuuuuaugacugcgacgccucccggaaguguugaggcauucccccaaucaaaugcagucauacaagaugaggaacgagauauacccgagagaucauggaacucaggauaugacuggauuacagauuucccgggcaaaacuguuugguuugucccaucaaucaaaagcgggaacgacauugccaauugcuuaaggaaaaaugguaaaagaguaauacagcucucuaggaaaacauucgauacggaauaccaaaagacuaaaaauaacgauugggauuaugucguaaccacugauauaagugagaugggagcaaacuuccgggcagaucgaguuaucgacccccgacguugucuaaaaccaguaauauuaaaagauggaccggagagagucauccuagcaggaccaaugcccgucacaguagccucggcugcccaacguagaggucguauuggacgaaaucaaaauaaagaaggagaccaguauguuuauaugggucaaccacuuaacaaugacgaagaucaugcacacuggacugaagcuaaaaugcuauuagauaauauuaauacuccagaaggcauaauaccugcucuauuugagccggagagggaaaaaucagcggcgaucgauggcgaauaccguuuaagaggagaagcacguaaaacguuugucgaacuuaugagaaggggugauuuaccgguauggcuaucauauaaaguagcuagugaagguuuucaauauuccgacagacggugguguuucgacggugaaaggaauaaccaggugcuagaggaaaauauggacguagaaauauggacaaaagaaggggagaggaagaaacugagaccaaggugguuggacgcccguacauacucugauccacuagcccuacgcgaauuuaaggaguuugcagcugggaggagaaguguuucuggagaucucauucuggaaauagguaaacuaccacaacaucuaacuuuacgagcucagaacgcuuuagacaaccuugugaugcuacacaauucagaacaaggugggaaagccuauaggcacgcuauggaggaguuaccagauacaauagaaacccuaaugcuguuagcccuaauugcaguauuaacgggaggagugacauuauucuuucucuccggaaagggacugggaaaaacgagcauagguuuacugugcgucacagcaaguuccgcccuauuauggauggcaaguguagaaccccauuggauagcagcaucgaucauccuugaguucuuuuuaaugguauuauuaaucccagaaccggaccgacaacguacgccgcaggacaaccaauuggcauacgucguaauuggucuuuuguucaugauacuuacaguggcagcaaacgaaaugggucuuuuagaaacgacgaaaaaggaccuaggaauuggucauguggcggcagaaaaucaucagcaugcaacaauguuagauguugaucuaaggccugcgucagccuggacauuauacgccguagcgacgacgguuaucacacccaugaugcgccacacuauagaaaacacuaccgcuaacauaagucuaacugcuauagcaaaucaagcagcgauccucauggguuuagauaaagguuggccaauuaguaagauggacauaggugugccauugcuagccuugggcuguuacucacaggucaauccauugaccuuaacagcagcagugcuaauguugguagcgcauuaugcgauaauuggcccgggguuacaagccaaagcuacgagagaagcucaaaaacgcacagcagccggaauuaugaaaaacccuacgguagacgguauaguagcgaucgaccucgauccaguaguuuaugauaccaaauuugaaaaacaacuaggacagauaauguuacugauccuaugcaccucacagauuuuauugaugagaacaaccugggcccuaugugaaucgauuacauuagcgacaggcccccuaacgacucuaugggaaggaaguccaggcaaauuuuggaauaccaccauagcaguuucaauggcuaacauauuucgcggcaguuacuuagcgggagcaggucuagcauuuucauuaaugaaaucuuuaggaggaggucgacguggcacaggagcucagggugaaacauugggcgaaaaguggaaacgccaguuaaaccagcuaagcaagucggaauuuaauauuuauaaacgaucaggaauaauggaaguagaucguucggaggcgaaagaggguuugaaacguggugaaacaacuaaacaugcuguaucgcgcgguaccgccaaacuacgaugguuuguugagagaaacuuagucaagccagaagguaagguaauagacuuaggaugcgggaggggaggauggagcuauuacugugccggucuaaagaaagugacugaaguaaaagguuacacaaaagggggaccgggacacgaggaaccaaucccuauggcaacauaugguuggaaccuaguaaaacugcauagugguaaagauguauuuuucaugccgccggaaaaaugcgauacauuacuaugugauaucggggaaucgucacccaauccaacaauugaagaagggcgaacauuacgcguauuaaagaugguggaaccaugguuaaggggaaaccaauucuguauaaagauucugaacccauacaugccuaguguaguagaaacuuuagaacaaaugcaacgaaaauacggugggauguugguucggaauccguugucacguaauucuacacaugaaauguacugggugucauguggaacggguaacauaguuucagcagugaauaugacaagcaggaugcuacucaaucgcuuuacgauggcacauagaaagccaacauacgaaagagacguagaucucggagcuggaacucgccauguugcuguagaacccgagguggcgaacuuagacauuaucggccaaagaauagagaacauuaaaaaugaacauaaaucaacauggcauuaugaugaagauaacccguacaaaacuugggcauaccaugggucuuaugaaguaaaaccaucaggcagcgcuaguucuauggucaacggaguggugcgucuuuuaacuaaacccugggacgucauaccgaugguuacgcaaaucgccaugacagauaccacuccauuuggucaacaaagaguuuuuaaagaaaagguagacacucguacuccaagagcgaaaagagguacaacccaaaucauggagguaacggccaagugguuauggggauuuuugucacguaacaagaaaccgcgaauuugcacuagagaagaauuuacacgcaagguacguucaaacgcagcgauaggugcaguguucgucgacgaaaaucaauggaacucugccaaagaggcuguagaagacgaaagauuuugggaucuagucagaagagaaagagaacuacauaaacagggaaaaugugcuacuugcgucuacaacaugauggguaaaagagagaagaaacuaggggaauuuggaaaagcuaaaggaucacgagcaauaugguacauguggcugggcgccagauuccucgaauuugaggcuuugggcuucaugaaugaggaccacugguucucgagagagaauagucuaucggggguagaaggugaaggacuacauaaguuaggguauauucuaagggacauaucuaagauuccaggcggaaauauguaugcggacgauacagcugggugggacacacgcauaacagaagaugacuuacaaaacgaagcaaaaauuacggacauaauggagccagagcacgcauuacucgccacaagcauauucaaguugacauaucagaacaaagucguuagaguacaaagaccagcuaaaaacggaacaguaauggauguaauaucaaggcgagaucaaaggggaaguggccagguugggacauacggacuuaauacguucacaaacauggaagugcaacuaaucagacaaauggaaagugaaggaauauuuuuacccucagaacuagaaacaccgaacuuagcugagcgaguccucgauugguuagaaaaacauggagcugagcgccuuaaacgcauggcuauaagcggcgacgauuguguugucaaacccauagaugauagauucgcuacagcacuaacagcauuaaaugacaugggcaaaguaaggaaggauaucccccaaugggaaccuucuaaaggauggaaugauuggcaacaaguuccauuuuguucacaccacuuucaucaauugauuaugaaagacggacgagagauagucguaccauguagaaaucaagaugaguuaguuggcagagcuagaguuagucagggcgcaggguggucauugagggaaacagcaugccucggaaagagcuacgcucagauguggcaacuuauguauuuccauagaagagaucuaagauuagccgcaaaugcaauauguucggccgucccaguugacuggguuccgacaucaaggacgacaugguccauucaugcucaccaucaguggaugacaacagaagacaugcuauccguauggaaucguguguggaucgaggaaaauccguggauggaagauaaaacacacguuagcaguugggaggaagucccuuauuuaggcaagagagaagaucaguggugcggaagccuaaucggcuugacagcuagagcaaccugggcgacaaauauccaaguugccaucaaccaaguacgaagguuaauugggaaugaaaacuaucuagauuacaugacuucgaugaagcgauuuaagaaugagucagauccugaaggagccuuaugguag

SEQ ID NO: 21337 - RNA, 9879 nt, Artificial Sequence
  derived and/or modified CDS sequence (opt6) from DENV-1__KF973462__SS-prME
ucagucacuauguuauuaaugcugcucccaacugcgcucgcuuuucaccuuacaacacggggaggugaaccucacaugauaguaucgaaacaagaacgaggaaaaagucuauuauuuaaaacaagugcugguguuaauauguguacauuaauugcaauggaucucggugaauuaugugaagacacauugacguacaaauguccccaaaucaucgaagcggaaccagaugauguagauugcugguguaacgcaacagauacuugggugacauaugguacauguagucaaacgggugaacaccguagggauaaaagauccgucgcacuagcaccucauguagggcuuggacuagagacuagaacugagacuuggaugagcagcgaaggggccuggaaacaaauucaacguguggaaacaugggcuuuaagacacccagguuucaccgugaucgcccuuuucuuggcacaugccauagguacuucaauaacacaaaaaggaauaauuuucauauuauuaauguuagucaccccgucgauggcgaugcgaugcguugguaucggcaacagagauuuuguggagggucucucaggugcuacauggguagacguuguguuagagcauggaucauguguaacaacuauggcuaaaaacaaaccaacucuugauaucgaacugcuuaaaaccgagguaacuaacccagcuauacugagaaaauuguguauagaggcaaaaauuucgaauacuacuacggacucacgcugcccaacucaaggagaagccacuuuaguagaggaacaagaugcgaacuuugugugcagacgcacuuuugucgacagagguuggggaaacggaugcggguuauuugguaaagguagucuacuaaccugcgcgaaauucaaaugugugacuaaacucgagggaaaaauaguucaauaugaaaaucuuaaauauucugucaucguaaccgugcauacuggggaucaacaucaaguugguaacgaaacuacagagcaugggacuauagcaacaauaacgccucaagcuccaacuucagaaauccaacugacagacuacggcgcgcugacauuagacuguucuccacgaacuggacuagauuucaaugagaugguucuguuaacgaugaaagaaaaaucuuggcuuguacauaaacaaugguucuuggaucugccacuucccuggacaaguggugccucgacaagccaagaaaccuggaaccgucaagaccuucuagucacuuuuaaaacagcgcacgccaagaaacaggaagugguaguccucggaucacaagaaggagcuaugcauaccgcauuaacuggugcaacugaaauucaaacuagcgguaccaccacaauauuugcaggacacuuaaaaugucgccuaaaaauggauaaacucacauuaaaaggaacaucauauguuauguguacuggauccuuuaaacuagagaaagaaauggcagagacucaacacggcacaguguuaguccaagucaaauaugaaggcacugaugcaccaugcaaaauaccuuuuuccacacaggaugaaaagggaguuacacaaaacgggagguugauaacagccaauccaauugugacugauaaggaaaaaccaguuaauauagagacagaaccaccauucggagaauccuauaucguaguuggggcaggagagaaggcuuuaaaguuaucaugguuuaagaaagguagcucuaucggaaaaauguucgaggcaaccgcaagaggagcaagaaggauggcuauuuuaggugauaccgcaugggacuuuggcagcauaggagguguauuuacauccguaggaaaauuaguucaccagguuuucggcacggcguauggagugcuauuuaguggaguaucauggacaaugaaaauaggaauugggauccucuuaaccugguugggguuaaauucuaggucaaccucccucucuaugaccuguauagcgguaggaaugguaacauuguaccuuggagucaugguucaggccgacuccggaugcgucaucaacuggaaaggacgagagcugaaaugcggaucugggauauucguuacuaaugaaguucauacguggacagaacaauauaaauuccaagcugauucuccuaaacggcuaucugcagcuaucggcaaagcgugggaagagggugugugcgguauacguagcgcaacacgauuggaaaauauaauguggaaacaaauauccaaugagcuaaaucauauacuacucgagaaugauaugaaauucacuguaguugucggagaugcaaacggaaucuuagcacagggcaagaaaaugauacguccccaaccgauggaacacaaauacaguuggaaaucuuggggcaaggcaaaaauaaucggagcugauauccaaaacacuaccuucaucauagaugguccggauacgccagaauguccggauaaucagagggcauggaacauaugggaaguagaagacuacgguuuugggauauuuacaacaaauaucuggcucaaauuacgagauucauauacacaaguuugugaccaccgccuaaugagugcagcaauuaaggauaguaaagcuguucaugcagauauggguuauuggaucgaaagugagaaaaaugaaacauggaaguuggcuagagcuucauuuauugaaguuaaaacgugcacauggccgaagucacacacauuauggaguaacggaguauuggaaucagagaugauuauucccaaaauuuacggggguccgauuagucagcauaauuauaggccaggauauuuuacucaaacggcgggaccauggcacuugggcaaacuagagcucgacuuugauuuaugugaagguacuacugucguaguugaugaacacuguggaaauagaggucccucguugcgaacaacuacgguuacagguaaaauuauacaugaguggugcugucgaaguuguacucuaccgccauuaagauuccgcggggaagacggcuguugguacggcauggaaauccguccgguaaaggagaaagaggaaaauuuggugagaaguaugguuucagcaggaaguggggaaguugauucuuuuagucuagggauucuuugugcaucaaucaugauagaagaaguuaugcgaucgagauggucaaggaaaauguuaaugacggguacauuagccguauucuuauuacuaaucaugggacaacuuacauggaacgaccucauaagacuuugcauaaugguaggcgccaaugcaucagauagaauggguauggguacgacauaccucgccuuaauggcuaccuucaaaaugaggcccauguucgcugugggguuacucuuccgccguuuaaccucaagagaaguccuauuguugacaauugggcuaucccuagucgcaaguguugagcugcccaauucauuagaagaacucggagauggcuuagcaaugggaauuaugaugcuaaaacuacuuacugaauuucaaccacaccaacuguggaccacccuccucucuuuaacauuuaucaaaacaaccuugucucuggauuaugccuggaaaaccacagcgauggcguuauccauaauaucauuguuccccuuaugucuaaguacaacaucucagaaaacuacaugguuaccaguuuugcuggguucguuuggaugcaaaccuuuaacaauguuuuuaauaacugagaauaagaucuggggucgcaagucguggccccugaaugaaggaauaauggcaauuggaauuguuagcauacucuuaucuucuuuauugaaaaaugaugucccgcucgccggaccgcuaauagcugguggcaugcugauugcuuguuaugucauaucugggaguagugcagauuuaucccuugaaaaagcggcagaaguaagcugggagcaagaagcagaacacucugguacaagucauaauauccucguugaaguucaagacgauggcaccaugaaaauaaaagacgaagagagagacgauacacucacuauauuacugaaagccaccuuauuagccguaucaggaguguacccgaugaguauaccagcgaccuuauuuguaugguauuuuuggcagaagaagaaacaacgaagcgguguauugugggacacuccaucuccaccagaaguagaaagagcuguauuggacgauggcauauaucguauucugcaacguggauuauugggccguucucaagucggcguugguguauuucaagaugggguauuucauaccauguggcauguaacccgaggcgcgguuuugauguaucaagguaagagacuagaaccaaguugggcgucuguaaagaaagaucuaauauccuauggagguggauggcguuuucaggguagcuggaacaccggagaagaaguucaagugauugccguggaaccuggcaaaaaccccaaaaacguccagacuacaccaggaaccuucaaaaccccggaaggcgagguaggagccauagccuuagauuucaaaccgggaacaaguggcucuccaauuguaaaucgugaggggaaaaucguuggguuauauggcaauggaguaguuacaacguccgguacguacguaucagcaaucgcgcaagcaaaaguuucacaggaagguccacugcccgagauagaggaugaaguguuuaaaaagaggaacuugacaauaauggaucugcauccgggcaguggcaagacuagaagauauuuacccgcaauaguuagagaagcaauaaagagaaaacucaggacucuaauucuggcaccgacaagagucguugcaucagaaauggccgaggcauuaaaaggcaugccaauuagauaucaaaccacagcagugaaaagcgaacauacuggaagagaaaucguggauuuaaugugucaugcaacauucacaaugcgacuacuaucacccguacgaguaccaaauuacaauaugauaauuauggaugaggcacacuuuaccgacccagcuucaauagcggcucguggauauauaucaacaagaguaggaaugggugaggcagcagcuauuuuuaugacagcuacaccacccgguucgguagaggcauucccacaauccaacgcagugauacaggacgaagaaagagacauaccagagcgaagcuggaacagcgguuacgauuggauaacugacuuuccggggaaaacugucugguuuguaccaagcauaaaaucagguaaugauaucgcgaacugcuuaaggaaaaacgggaaacgaguaauacaacuaucaagaaaaacauuugacacggaauaucagaaaacuaagaauaaugacugggauuacgucguaacaaccgauauaucggagaugggagcgaauuuucgcgccgauagaguuauugauccccgacgcugcuuaaagccaguuauucuaaaagaugggcccgaacgaguuaucuuggcggguccaaugcccguaacaguagccucagcagcacaacgcagaggucgcauaggccguaaucagaacaaagagggugaucaguacguauauaugggucaaccucuaaacaaugaugaagaucaugcucacuggacggaagcuaagaugcuauuagacaauauuaauacaccugaagguauaauuccugcacuauucgagccagagcgugagaaaagcgcagcaauugacggagaauaucguuuaagaggagaagcuagaaaaacauucguagagcuaaugagacgcggugacuuaccagugugguuaucauauaaaguagcaucggagggcuuucaauauucugauagacggugguguuucgauggcgaaagaaauaaccaaguacucgaggaaaacauggacgucgaaauuuggacuaaagagggugaacguaagaaauugcgaccaagauggcuagaugcuagaacuuauucggaccccuuagcacugcgcgaauuuaaagaauuugcugcaggucgccgaaguguguccggggaccuuaucuuagagauaggaaaguuaccacaacaccucaccuuacgggcacaaaacgcacuagauaacuuaguaauguuacacaauagcgaacaaggcgguaaggcguacagacacgcuauggaagaacugccggauaccaucgaaacccuaaugcuauuagcacuaauagcuguccuaacgggaggggucacccuauuuuuccuaagcggcaaagguuuaggaaaaacaaguauaggcuuacucugcguaacagcuucguccgccuuacuuuggauggcgucaguagaaccacauuggauugcugcauccauaauuuuagaguucuuuuuaaugguacuucuuauaccagaaccugaucgucaacggacaccgcaagauaaucaauuggcuuaugucguaauaggucuauuauuuaugauauuaacuguugccgcuaacgaaaugggauuauuagaaacuacaaagaaagauuuagggaucggucacguggcggcggaaaaucaucagcaugccacaaugcuagauguagauuuacgaccggcaucugcuuggacauuauacgcgguagcaaccacaguaauaaccccaaugaugcgucauacuauagaaaacacgacugcaaauaucagcuuaacggcgauugcgaaccaagcagcaauucuaaugggucuagacaaagguuggccuauaucgaaaauggauauagggguaccauuauuagcauugggcuguuauucacaagucaauccguuaacacuaacugcagcaguccuaauguugguagcacacuacgccauuauagggccuggcuuacaagcaaaagcaacgcgagaggcccaaaaacgaaccgcagccggcauaaugaaaaaccccacuguagacgggauagucgccauugaccuagaucccgugguauaugauaccaaauuugaaaaacagcugggccaaauaaugcuccucauucucugcacaucacaaauuuuauuaaugcguaccacuugggcucucugugaaaguauuacauuggcuacugguccauuaacaacacucugggaaggaucaccuggcaaauucuggaauaccacaauugcaguaucaauggcaaauauauuuaggggcuccuauuuggccggugcuggccucgcguuuucuuugaugaagucauuaggagggggaaggcgagggaccggggcucagggcgagacacuuggugaaaaguggaaaagacaacuaaaucaacuaucuaagucagaguucaacaucuacaaaagaaguggaauaauggaaguagaucguucagaagcgaaggaagguuuaaaacgcggcgaaacaacuaaacaugccgucucacggggcaccgcaaaacuuaggugguuuguagaaagaaauuuaguaaagccugaggggaaaguaauugaucucggguguggcagaggugguuggucguauuauugugcaggccuuaagaaaguaaccgaggugaaaggauacacaaaagguggaccagggcacgaagaacccaucccaauggcaacguauggauggaacuuaguaagacuacacucgggaaaagacguauucuuuaugccaccagaaaaaugcgauacauuacuaugcgauauaggcgaauccucuccuaauccaacgauugaagaaggucgaacccugcgagugcuaaaaaugguagaaccauggcuacgcggcaaucaauuuuguauuaaaaucuuaaacccguacaugccuaguguagucgaaacccuggaacaaaugcaaaggaaauacgggggaaugcuaguccguaacccauugucaagaaacaguacccacgaaauguacuggguuucgugcggaaccgggaauauuguaagcgcgguuaauaugacuucaagaaugcuacucaaccgauuuacaauggcacaccgaaaaccgacuuaugaaagagaugucgaccuuggagcugguaccagacacgucgcugucgaaccugaaguugcuaacuuagacaucaucggacagagaaucgaaaauauaaagaaugaacacaaaucgacuuggcacuacgaugaagauaacccguauaaaacuugggcauaucauggaucguaugaaguaaaacccuccgguucggcuucaucuaugguaaacggagucguacgacuuuuaacaaagccgugggauguuauaccuauggugacacagauagccaugacugauacaacgccauuuggacaacagcgaguauuuaaagaaaaaguagauaccagaacuccaagagcgaaaagaggcaccacacaaauaauggaagucacggcuaagugguuauggggauuucuaucaagaaacaagaaaccuaggauaugcacaagagaggaauuuacuagaaagguuagaagcaaugcagcaauaggugcuguauuuguggaugaaaaucaguggaacucugcaaaagaagcuguugaggacgaacgauuuugggauuuaguucaucgcgaacgcgaauuacacaagcaaggaaagugcgcaacauguguuuacaacaugauggguaaaagagagaagaaacuaggagaauuuggaaaagccaaaggaagcagggcuauaugguacauguggcugggagccagguucuuagaguucgaagcauugggcuucaugaaugaagaccauugguucucgagggaaaauagccuuaguggaguagaaggugagggauuacacaaauuaggauauauccuacgagacaucaguaaaauccccggcggaaacauguacgcagacgacaccgcaggaugggauacacgaauaacugaagaugauuuacaaaaugaagccaagauaaccgacaucauggaaccagaacaugcauuacuagcuacaagcaucuuuaaacucacuuaucaaaacaaagugguuagaguacagcggccugcuaagaacggaacaguuauggacguaauaaguagacgugaccaaaggggguccggacaaguuggaacauacggcuuaaauacauuuacgaauauggaaguacaauuaauaaggcaaauggaaagugaaggcauauuccuaccuucagagcuggaaacgccaaaucuugcaaaaagagucuuggauuggcuagaaaagcauggagcugaaagacuaaaacgaauggccauaucuggcgaugacuguguagucaagccuauagaugauagauuugcaacggcauuaacagcacucaacgacaugggcaagauucgaaaggauauaccgcaaugggaaccauccaaagguuggaacgacuggcaacagguaccuuucuguagccaucacuuucaccagcuaauuaugaaagacggaagggaaauuguuguuccgugcagaaaccaagaugaauuaguaggccgugcgcgaguaucucagggggccggauggagucuacgugaaacagcaugcuugggcaaaaguuacgcgcagauguggcaacuuauguauuuccaccgccgggacuuacgucuagcagcaaaugcuauaugcagugccguaccagucgauuggguuccgacauccaggacgaccuggucaauucaugcgcaccaccaauggaugaccacggaagauaugcuaucuguuuggaaucgaguuuggauagaagagaauccuuggauggaagacaaaacucauguauccagcugggaagaagucccauaucuaggaaaaagagaagaccaguggugugguaguuugauuggauuaacagcccgugcaacaugggcuacuaacauacaagucgcuauaaaccagguaagacgcuuaauuggaaacgagaacuaucuggauuacaugacaagcaugaaaagguuuaagaaugaguccgaucccgagggagcauugugguaa

SEQ ID NO: 21338 - RNA, 9879 nt, Artificial Sequence
  derived and/or modified CDS sequence (opt6) from DENV-1__KF973463__SS-prME
ucgguuacuaugcuucuaauguuaaugccaacugcgcuggcauuccaucuuacuacaagaggaggggaaccacauaugaucguaucaaaacaugaacgagguaaagcguuacucuucaaaacaaguacuggaguaaauauguguacauugauagcuauggaccucggagaacuaugugaagacacuaugacauauaaauguccgcgcaucacggaagcagaaccagacgacguugacugcugguguaaugcuacugacacauggguuaccuacggaacaugcagucaaacuggugaacaccgucgagauaaaagaaguguagcacuggcaccucacgucggacuagguuuagaaacacgaacggagacguggaugucuucagaaggagcauggaaacaaauacaacgagucgaaacuugggcauugcggcauccagguuuuacgguaaucgcacuauucuuggcacaugcaaucggaacgucuauaacacaaaaaggaauaauauucauauuacuaauguuagucacuccguccauggcuaugagaugcgucgggauaggcaacagagauuuuguugaaggccuuucuggcgcaacuuggguagauguagugcuggaacaugguucauguguuacaacaauggccaaaaacaaaccgacauuagauauugaauuacuaaaaacagaagugacaaacccagcuguccugagaaaacuauguaucgaagcgaaaauuucgaauacaacaacggauagcagaugcccgacacaaggggaagcaacgcuuguggaagaacaagaugcaaacuucguaugucgaagaacauuuguugaccgaggcuggggcaaugguugcggacucuuuggaaaaggcagucuguuaacaugugcgaaauucaaaugugucacaaaacucgaagggaaaauagugcaauaugaaaaucuaaaauacuccguaauugucacaguacacacuggagaccaacaucaaguaggcaacgaaacgacagaacauggaacuaucgcgacuauuacaccacaagcuccaaccucggagauacaauuaacggauuacggugcauugacauuagacuguaguccaagaacaggguuggauuucaaugaaaugguacuauugacuaugaaagagaaaucaugguugguacacaaacaaugguuucuugaccuaccauugccuuggacauccggagccucuaccucucaggaaaccuggaauagacaagacuuauuagucacguucaaaacagcccaugccaagaaacaagaagugguuguuuugggaagucaagagggagcaaugcacacagcacuaaccggggcaacagagauucaaacaagugguacaacaacaauuuuugcaggacauuuaaaaugcagauuaaaaauggacaaacucacauuaaaagguaccaguuacguaaugugcacagguaguuuuaaauuggaaaaagaaguagcagaaacucaacacgggacggugcuaguucaaguuaaauaugaggggacggaugcuccauguaaaauaccguuuucaacccaggaugaaaaagguguuacccaaaacggacgacuaauuacggcuaauccaaucguuacugauaaagaaaaaccuguaaauaucgaaacggagccuccauucggugaaucauacauaguaguaggagcuggugaaaaagcacucaaauugucuugguucaagaaaggaucaaguauuggcaaaauguuugaagcaacggcuagaggagccagaagaauggcuauacuuggagauacggcgugggacuucggauccauugguggugucuuuacaucugugggaaaauugguucaucaaguuuuugguaccgcuuacggaguacuauuuaguggaguuaguuggacaaugaaaauaggaauagggauucucuuaacauggcuaggacuaaauucaagaucaacaagccuaaguaugacauguauagcuguuggaaugguuacacuuuaccuaggcgugaugguacaagcagacagcgguugcgucaucaacuggaaaggaagagagcugaaaugcggaucugguauuuuuguaaccaacgaaguucauacauggaccgaacaguauaaauuucaagcagauaguccuaaaaggcuaagugcagcaauagguaaggcuugggaagaaggagucuguggcauacgaucagcgacacgauuagagaauauaauguggaaacaaauuagcaacgagcuaaaucacauacuucuugaaaaugacaugaaauuuacgguugugguuggagacgccaacggcauucuggcacagggcaagaaaaugauacgaccgcaacccauggagcacaaauauuccuggaaaaguugggguaaggcgaaaauuauuggugcugacauacaaaacacgacguuuaucauugacgggcccgauacuccagaauguccggacgaccaaagagcauggaacauaugggaggucgaagacuauggauucgguauauucacaacaaacaucuggcugaagcuacgggacucguauacgcaaaugugcgaccaucguuuaaugagcgcugcaauaaaagauucaaaagcaguccacgccgacauggguuacuggauugaaucagagaaaaaugaaacguggaaauuagcaagggccucguuuauagaagucaagacuuguacuuggccgaagagucauacauuauggagcaauggaguacucgaaagugaaaugauaauuccuaaaauauauggaggaccaauuucacagcauaacuaccgaccuggcuacuucacccaaacagcuggacccuggcauuuggggaaauuagaacuagauuuugaucuaugcgaaggaacaacaguuguuguugaugaacacugcgguaaccgaggucccucauuaagaaccaccacugugacgggaaaaauaauacacgaaugguguugccguucauguacucuaccgccacuucguuuuaggggagaggauggcuguugguauggcauggaaauaagaccaguuaaagaaaaggaagaaaaucugguucgcucuauggucucagcugguaguggagaggucgacagcuucucauuagggauucuaugcguuaguauaaugauugaggaagucaugcggucacgauggucuaggaaaauguuaaugacgggaacguuggcgguguuucuguuauuaauaaugggacaacugaccuggaaugauuuaauacgccuauguauaauggucggugcaaacgcaagugauaaaaugggaauggguacuacuuaucuagcuuugauggcaacguuuaaaaugagaccgauguuugccgugggaauccuauucagacguuugacaucacgggaaguacugcuauuaaccauaggacuaucguuaguggcuaguguagaacugcccaauucauuagaagaauugggcgaugguuuagcaaugggaauuaugaugcuuaaacuacuuacagaauuucaaccgcaucaacuauggaccacauuacuaaguuuaaccuuuauuaaaacaacgcuuucacuugacuaugccuggaaaacaacagcgauggcucuuagcauaguaucuuuauucccuuugugccuaucaacgaccagccagaaaaccacgugguugccaguacugcugggaucauuuggcugcaaaccacuuacuauguuuuugauuacugaaaauaagauuugggggcguaagucuuggcccauaaaugaaggcauaauggccaucggaauuguaaguauuuugcuaucaagccuccugaaaaacgacguaccacuugcagguccacugauagcaggaggaauguugauugcuugcuauguuauuucagguagcucugccgaccuaucauuggaaaaagcagcagaaguuaguugggaacaggaagccgaacauucuggcacaucacacaacauauuaguugaaguacaagacgaugggaccaugagaauuaaagaugaagaaaaggacgauacucuuacaauacugcuuaaagcgacuuuauuagcuguuucugggguuuauccaaugaguauaccugcaacuuuauuugucugguauuuuuggcagaagaagaaacaacgcucuggaguuuuaugggacacgccaucaccaccugagguugaaagagccguacuagacgacggcauuuacagaauauugcagcgagggcuacugggaagaucacaagucggaguagggguguuucaagauggaguguuccauacaauguggcacguaacacguggcgcaguauuaauguaucagggaaaacgacuagaaccaagcugggcgucaguaaagaaagaccucaucaguuacgguggaggauggagguuccagggaaguuggaauacuggugaagaaguccaaguaauagcggucgagccugguaaaaaucccaaaaacgugcaaacaacgccgggaacauuuaaaacaagcgaaggugaagugggagcaauugcucucgacuucaaaccugguacgaguggcuccccuauaguaaacagggaagggaaaauuguuggacuauaugggaauggaguaguuacaacaucagggacuuauguuucagcgauugcacaagccaaaacuagccaggaaggcccguuaccugaaauagaagaugaaguauuuaagaaacggaaccuaacaaucauggaucuccaucccggaaguggaaaaacaagaagauaucuccccgcaaucguaagagaagcaauuaagaagaaacuaagaacuuugauccuagccccaacgcgaguagucgccucagaaauggccgaagcacuaaaaggaaugccgauacgauaucaaacgacggccguuaaaucugaacauacaggaagggagauaguagacuugaugugccacgccacguucacuaugaggcuacucaguccagucagagucccaaauuacaauaugauaauaauggaugaagcccauuuuacagauccugcuucuauagcggccagagguuauaucucaacaaggguaggcaugggagaagcagccgcgauauuuaugacggcuacgccgccugguucaguugaggcguuuccacaaucgaaugcggugauacaagaugaagaaagagauaucccugagcgaucauggaauagcggauacgacuggauaaccgauuucccagguaaaacgguaugguucgucccaagcauuaaaucggggaaugacauugcgaauugucuaaggaaaaacgguaaaagagugauacaguugucgcggaagacguucgacacagaauaccagaaaacuaaaaacaacgauugggacuauguaguaaccacagauaucagugaaaugggcgcuaauuuucgcgcagaucgggugauagaccccagaaggugucuuaaaccaguaauuuuaaaggauggaccugaaagaguuauucuagccggaccuaugccaguuaccguagcuucagcagcgcaaagaagggggagaaucggacguaaccaaaacaaggaaggagaucaguacguauacaugggacagccgcuaaauaacgacgaagaucaugcacacuggacagaagcaaaaaugcuauuagauaauaucaauacucccgaagggaucauaccagcauuauucgaaccagaaagagagaaaagcgcugccaucgacggcgaguaucggcuacgcggugaagcgcggaaaacauuuguggaauuaaugcggaggggagauuuaccggugugguugucauauaagguagcauccgaaggauuccaguauagcgauagacgaugguguuuugacggggaacgaaauaaucaaguucucgaagaaaacauggauguagagauuuggacaaaagaaggcgagaggaagaaacuaagaccccgaugguuagacgccagaacauacagcgauccguuagcucucagagaauuuaaagaauuugcagcugggaggcggaguguaucaggggaucuuaucuuagaaauuggcaaacuaccacaacacuuaacccuaagagcacaaaacgcgcuugauaaucugguaauguuacauaacucagaacaggguggaaaagccuaucgacacgcaauggaggaacuuccugacaccauugagacguuaaugcuuuuggcauuaauugccguacuuacaggaggagugacccuauucuuccuaucgggcaaaggacuaggaaaaacaaguaucggccuguuauguguaaccgccucuucagcuuuacuauggauggcuucaguagaaccgcauuggauagcugcaucuaucauucucgaguucuuucugaugguauuacucauuccugaaccagacagacaacgaacaccucaggauaaucaguuagcauacguaguaaucggccuacuuuuuaugauacuuacaguagcggcuaaugaaauggguuuacuggaaaccaccaagcgagacuuaggaauaggacauguugcagcagaaaaccaccaacaugcgacaauguuggauguugaucuuagaccagccucagcauggacacuuuacgcaguugcaacuacaguaauaacaccaaugaugagacacacaauugagaacacaacagccaacaucucauuaacagcaauugcaaaccaggcugcaauacugaugggucuggacaaaggauggccuaucucuaagauggauauagggguaccuuuacuagccuuagguuguuauagccaaguaaauccacuaacuuugacagcagccguauuaauguuaguagcgcauuacgcuauaauagggcccggccuacaagcaaaagcuacaagagaggcccagaaaagaacggccgcagguauuaugaagaaccccacaguugacggaauaguugcuauagaucuugacccaguuguuuaugacgcgaaauucgaaaaacaauuaggacaaauaaugcuacuuauauugugcacuagccaaauucuguuaaugagaacaacaugggcuuuaugugagagcauuacauuagcaacuggaccucuaacaacuuugugggaaggaucuccuggaaaauucuggaauacuacaauagccguuaguauggcaaauauauuucggggcucguauuuagccggcgcaggucuugcuuuuucauuaaugaaaucucucggaggcggaagaagaggaaccggagcccagggggaaacgcuaggagaaaaauggaaacgucagcuaaaccaacuuucuaaacccgaauuuaacaccuauaagagauccgggaucauggaaguugaccgcagugaagcaaaagaaggucuaaaaagaggagagacaacuaagcacgcaguaucgcgaggaacugccaagcugcguugguucguagaaaggaaucuaguuaagccggaaggaaaaguuauugaccuagguugcggacguggagguuggucauacuauugugcaggucuuaaaaagguuaccgaagugaagggcuauaccaaagggggcccaggacaugaggaaccaauaccaauggcaaccuauggguggaauuugguuaaauugcacucaggcaaggauguuuucuucaugccuccagaaaaaugcgauacauuacuaugugacauuggggaaagcucaccgaauccaacaauugaagaaggccgaacucuaagagucuugaaaaugguugaacccuggcuucguggaaaccaauuuuguauaaaaauccucaaccccuauaugccaucaguaguugaaacauuagaacaaaugcaacgaaagcauggaggaauguuaguacgaaacccgcuaucacguaacaguacucacgaaauguacuggguuucuugcgguaccggaaauauuguaucugcgguaaauaugacaaguagaauguuguuaaauagauuuacuauggcgcauaggaaaccuacuuaugaacgggauguagaccuaggagcuggaacucgucauguugcaguagagccugaaguagcaaauuuagauauuauaggucaacguaucgaaaauaucaaaaacgaacauaaaaguacuuggcauuaugacgaagauaacccauauaagacaugggcguaucauggaucauaugagguuaaaccaucaggcagcgcgaguaguauggugaacggagugguucgguuauuaacgaaaccuugggaugugaucccuaugguuacucagaucgccaugacagacaccacuccauucggacaacagagaguuuuuaaagagaaaguagacacacgaacaccaagagccaaaagaggcacgacccagauaauggagguuacugcaaaguggcucuggggauuuuuaucucgaaauaagaaaccgcggaucugcacaagggaagaguuuacccgaaagguaagaucaaaugcugcgaucggugcgguuuuuguagaugaaaaucaauggaacagcgcaaaggaagccguugaagaugaaagguucugggaccuuguacauagggagcgggagcuacauaaacaagggaaaugugcaacgugcguuuauaacaugauggguaagagagagaagaaacucggcgaguucggaaaagcgaagggcagucgggccaucugguauauguggcuaggagcccgguuucuagaguucgaagcacuuggguuuaugaaugaggaucauugguuuucuagagaaaauagcuugucagguguugaaggcgaagggcuucacaaacuaggauauauacuaagagacaucucaaaaauaccagggggaaauauguaugcugaugauacugcaggaugggauacaaggaucaccgaagacgaucuucaaaacgaagcaaagauuacugauaucauggaaccagaacaugcauuauuggcuaccucgauuuuuaaacuaacuuaucaaaauaagguaguacggguacaaaggccagccaagaauggaacuguaauggacguuauuuccaggcgagaccaaagagguagcggacaagucggcacuuacggucuaaacacuuuuacaaauauggaaguacaauuaauccgccaaauggaaucagaggguauuuucuuaccuucagagcuggaaacccccaaucuugcugagcgggugcuagauuggcuagaaaagcauggagcagaaagauuaaaacguauggcuauuagcggugaugacugcgucguuaaaccuauagaugauagguuugcaacagcuuuaacagcuuuaaacgauauggggaaaguccgaaaagauauaccacaaugggagcccaguaaaggauggaaugauuggcagcaaguaccauuuugcagucaucauuuucaucaacugauuaugaaggauggucgcgaaauaguaguacccugcagaaaucaagaugaguuagucggccgggcgcgaguuucacaaggugcuggauggagcuugagagagacggcauguuugggaaagucauacgcucaaauguggcaacuaauguacuuccaccggcgggauuuaagacuggccgcaaaugcaaucuguucagcaguccccguugauuggguacccacuucacguacgacguggucaauccaugcacaucaccaguggaugacaaccgaagauauguuaaguguuuggaaucgaguauggauugaggaaaauccuuggauggaagauaaaacacauguuaguucaugggaggaaguaccauaccuaggcaagagagaggaucagugguguggaucgcugaucggguuaacugcaagagcgacuugggcuaccaauauucaaguagcuauaaaccaggucagacgccuaauaggaaacgagaacuacuuggacuauaugacgagcaugaaacguuuuaaaaaugagucagacccagaaggagcauugugguag

SEQ ID NO: 21339 - RNA, 9879 nt, Artificial Sequence
  derived and/or modified CDS sequence (opt6) from DENV-1__KF973464__SS-prME
ucaguuaccaugcuguugauguuguugccuacugcucuugcauuucaucuuacgacgagaggaggggaaccacauaugauaguuuccaaacaagaacgggggaaaagccuucuguucaaaaccucugcggggguaaauaugugcacucuaaucgcaauggaccuuggagaauuaugugaagauacaaugacuuauaaauguccacaaauuacagaagcagaaccagacgacguagauuguuggugcaacgcaacugacacauggguaacguauggaacaugcucacaaacuggggaacauagaagggauaaacgcucagucgcacuggcaccucacgucggacugggacuugaaacgagaaccgaaaccuggaugucaucagaaggagcuuggaaacaaauucaacgcguugaaacuugggcauuacgacacccaggguucaccguuauagcguuauuucuagcgcaugcuauaggaacauccaucacacaaaaaggaauuaucuucauacuauugauguuaguaacuccaucaauggcgaugagauguguaggaauuggaaaccgcgauuucgucgaaggcuuaucaggagcgacuuggguugaugugguucucgaacauggaucuugugugacuacaauggcuaaaaacaaacccacacucgauauagaacuucuaaaaacggagguaacaaaucccgcaauacuuagaaaacuaugcaucgaagccaaaauaagcaacacuacuacugauaguagaugcccuacucaaggagaagcuacucuaguagaggagcaagaugcuaacuucguuuguaggcgaacguucguagacagagguuggggcaauggguguggacuuuucggcaaaggcagucuucuuacaugugcaaaauuuaaaugugucacuaaacuagaaggaaaaaucguucaguaugaaaaccugaaauacagcguaaucguuacugugcacacuggagaccaacaucagguuggaaaugaaacuacagaacaugguacgauugcaacuauuaccccucaagcaccuacaagcgagauccaacugacugacuacggagcguuaacucuagacugcucuccucguaccggacuagacuuuaaugaaaugguacuucuaacaaugaaagaaaaaucuuggcugguccauaaacaaugguuucuggauuuaccacuaccguggacaucaggcgcaucgacgucacaagaaacguggaaucgccaagaucuauuaguaacuuucaaaacagcacaugccaagaaacaagagguagucguacuuggaagccaagaaggugccaugcauacggcgcuuacaggcgcgaccgaaauacaaacaagugguacuacgacuauuuuugccggccauuuaaaaugccguuuaaaaauggauaaacucacauuaaaagggacaucguauguuaugugcacugggucuuuuaaacucgaaaaagaaguggccgaaacucagcaugguacaguauuaguacaaguaaaauaugaaggaacugaugcaccaugcaaaauuccauucaguacacaagacgaaaaagguguuacacaaaacggacgauugauuaccgcaaauccaauagucacagacaaggagaagccaguaaacauugaaacggaaccacccuucggugaaagcuauauagugguuggugcuggugagaaagcauuaaagcuaaguugguucaagaaagggucaucaauaggaaaaauguucgaagccacagcucgaggugcuaggagaauggccauacucggggauaccgcuugggacuuuggaucgauuggaggcgucuucacaucuguagguaaauuagugcaucagguguuuggcaccgcauaugggguucuguucagcggaguaaguuggacuaugaaaauaggcaucggaauacuauuaacuugguuaggacuaaauucacgaucgacgucuuugucaaugacuuguaucgccguaggaaugguaacacucuacuuaggagugaugguacaagcagacucaggguguguaauaaacuggaaaggacgcgaacuaaaaugcggcucaggaauauuuguaacaaaugaagugcauacguggaccgaacaauacaaauuucaagcggauaguccuaaaaggcuuucagcagcuauaggcaaggcuugggaagaggggguaugcggaauuaggagcgccaccagacuugaaaacauaauguggaaacagauuucuaacgagcugaaucauauacuacuggagaacgacaugaaguuuaccguaguaguaggagacgccaacgggauacuagcccaaggcaagaaaaugauaagaccucagccaauggaacauaaauauucauggaaaucguggggaaaggcuaaaauaauuggagcugauauacaaaacacuacguuuauaauagacggaccugacacaccagaauguccugauaaccagagagcguggaauauuugggaaguugaagauuauggguuugguauauuuacaaccaacauuuggcugaaauuacgggauucguauacucaaaugugugaucacagacucaugagugcggcuauuaaggacucgaaagcaguucacgccgauaugggauacuggauagaaagcgagaaaaacgagacauggaaacuggccagagcaucguucauagaaguaaaaacauguacuuggccaaaaucacacacgcuuuggucuaaugguguauuagaaagugaaaugauaauuccgaaaauauauggaggacccauuucacaacauaacuaccgaccggguuacuucacucaaacggcggggccauggcauuuagguaaauuagaacuagacuucgacuuaugugagggcacaaccguuguuguugaugagcauugcggaaaucgugguccuagucuacggacuacuacgguaacaggaaaaauaauacacgaguggugcugucgauccuguacacucccaccauugcguuucaggggagaagauggauguugguaugguauggaaauuaggccagugaaggagaaggaagaaaaucuaguaagaucaauggucagcgcuggaucgggggaaguagacagcuucucuuugggcauacuaugcgcuucaauuaugauugaagaaguaaugaggucgagguggucaaggaaaaugcugaugacaggaaccuuagcaguuuuccuucuacuaauaauggggcaacugacauggaaugauuuaauaaggcuuuguauaaugguaggagcaaacgcuucagaucgaaugggaaugggaacaacguauuuagcacuuauggcuacauuuaagaugaggccgauguuugcaguuggacuauuauucagacgucuuacaucaagagaaguuuuauuacuaacaauuggucuaucguuaguugcuagugucgaacuacccaacucgcuggaagaauuaggagacggguuggcaauggggauuaugaugcugaaauuauugacugaguuucaaccacaucagcuuuggacuacauuacuaucauugacguuuaucaagacuacacuguccuuggauuacgccuggaaaaccacagcaauggcauuaucaauaauuagccuauuuccauuauguuugucgacuacaagccagaaaacuacuugguuacccgugcuacuagggagcuucggguguaaaccguuaacaauguuucuuauaaccgagaacaaaaucuggggacgaaaauccuggccguuaaaugaaggaauuauggcuauuggcauaguuucuauucuuuugaguucacuucuuaaaaaugauguaccacuagccggcccucuaauagccggcggaauguugauagcaugcuacgugauaucuggaucgagugcugacuugagcuuagaaaaagccgcagagguaucaugggagcaagaggccgagcacaguggaacgucgcauaauauacuugucgaaguccaagacgacgguacaaugaagauaaaggaugaggaacgcgacgauacucuaacgauacuccugaaggccacacuuuuagcaguuaguggaguguacccaaugucuauaccagcuacacuuuucguaugguauuucuggcagaaaaagaaacaaagaucuggggugcuaugggauacacccucuccaccagaggucgagcgugcggucuuagaugacggaauauacaggauauuacaaagaggccugcugggaagaucucagguugguguagggguuuuucaagaugggguuuuccacacaauguggcaugugacgcgaggggcaguauugauguaucaaggaaaacgucuugaaccaucaugggcgucgguuaagaaggaucugauaucuuacggaggaggcuggagguuccagggcaguuggaacacuggcgaagaagugcaaguaauugcuguagaaccagggaaaaaucccaaaaauguccaaacaacaccagggaucuuuaaaacccccgagggagaaguuggagcuauagcuuuagacuucaagccuggcacuagcggaucacccaucgucaaucgugaagguaaaauugucggauuauaugguaacggaguggugaccacaucagguacuuauguaagugcgauugcgcaggcgaaagcuagccaagaaggaccauuaccagagaucgaagaugaaguauucaagaagcgaaaccugaccauaauggauuuacaucccggaagugguaaaaccagacgauauuuaccggcaaugguuagggaggccaucaagagaaaacuuagaacguugaucuuagcacccacaagaguuguggcuucugaaauggcagaagcacugaaagggaugcccauuagauaucagacaacagcuguaaaaagugaacacaccgggagggaaauugucgacuuaaugugucaugccacauuuacgaugagacuuuuaaguccaguacgaguuccgaauuacaacaugauaauuauggaugaagcacauuuuacagauccggcaagcauugcugcaaggggcuauauauccacgcgcgucggcaugggugaggcagcagccaucuuuaugacugcaacgccgccagguucgguagaggcuuuuccucaaaguaacgcaguuauccaggacgaagaaagagacauaccagagaggucauggaacucuggauaugauuggauaacugauuuuccgggaaagacugucugguuuguaccaaguauaaaaucugggaacgacauugcaaacugccuccguaagaacgggaagagagucauacaauuaagucguaaaacuuuugauacugaauaucaaaagaccaaaaacaacgacugggacuacguaguuacuacggauauaucagagaugggcgcaaauuuuagagccgacagaguuauagauccacgacgaugucuaaaaccugugauacuaaaggacggaccugaaaggguuaucuuagcaggaccaaugccaguaacaguugcaucagccgcucaaagaaggggacgaaucggaagaaaccagaacaaagaaggagaccaauauguuuacauggggcaaccuuuaaacaaugaugaagaccacgcgcauuggacggaggccaaaaugcuacuagauaauauaaacacuccagagggaauaauaccggcauuauuugaacccgaaagagaaaagagugcagcaauagauggugaauaccguuuacggggugaagccagaaaaacuuucguagaguuaaugagaagaggagacuugccaguaugguuaucuuacaagguagcuucagaaggguuccaauacagcgauaggagauggugcuucgauggggaaagaaauaaccaaguauuagaagaaaauauggacguggagauuuggacaaaggaaggagaaaggaagaaacugcgaccacgguggcuggaugcgagaacauauucagauccuuuagcacuaagagaguucaaggaguucgcugcggggagaagauccguaucuggcgauuuaauauuagaaauagggaaauugccccaacaccugacuuuaagagcacaaaaugcccuagacaaucugguaauguuacauaacucagaacaaggugguaaagcguaccgucaugcaauggaggaguuaccagacacaauagaaacauuaauguuacucgcuuuaauagccguauuaaccggggguguaacucuauucuuuuugucggggaaagggcuagggaagacaagcauaggguuguuauguguuacagcauccagugcguugcuguggauggcaaguguugaaccacacuggauagcugcaucaaucauauuggaauuuuucuuaaugguucugcuuauaccugaaccugaucgacaaagaacuccgcaagacaaccagcuagcauacgugguaauuggacuuuuauuuaugauacuaacaguagcagcuaacgaaaugggacuauuagaaacuacaaagaaagaucuggggauaggucauguagccgcggaaaaccaccaacaugcaacaauguuagauguugauuugaggccagcaagcgccuggacauuauaugcuguggcaaccacuguuauaacgcccaugaugcgucacaccauagaaaauacaaccgcaaacaucucucuaacagcaauugcaaaucaggcagcuauccugauggggcucgauaagggauggccaauaaguaaaauggacauugguguuccauuguuggcucuaggauguuauagucaggucaauccucuaacauuaacugcagcuguacucauguuaguugcacacuacgcaauaaucggucccgguuuacaagcuaaagcaacaagggaggcacaaaaacgaacagccgcagggaucaugaaaaauccgaccguagaugguauuguugcuauagauuuagauccuguaguauaugauacuaaguuugaaaagcaguuaggucaaauaauguuauuaauauuguguacaucacagaucuuacucaugcgaacgacaugggcauugugugaaaguauaacauuggcgaccggaccccuaacuacacuuugggaaggcagucccgguaaguuuuggaauacaacuaucgcaguaaguauggccaauauauuuagaggaaguuaccuggccggugcaggcuuagcauuuucacuaaugaaaagccuuggaggcggucgacgggggacaggagcacaaggagaaacccuaggagagaaauggaagcgucaacucaaucaacuuagcaaaucagaauuuaauauauacaaacgaagcggcauuauggaaguagauagaucagaagcgaaagaaggguuaaaaagaggagagacuacaaaacacgcaguaucaagagguacugcuaaacuaagaugguuuguugagagaaaucuuguuaaaccagaagguaagguuauagaccuggguuguggaaggggaggauggucauauuacugugcuggacugaagaaagucacggaaguuaagggauacacaaaaggggguccaggacacgaagaaccuaucccgauggcaaccuacggauggaaucugguaaaacuacauucugguaaagauguguucuucaugccacccgaaaagugugauacacuccuuugcgacaucggugagucgagccccaaucccaccauagaagagggaaggacgcuuaggguacuaaaaaugguggagcccugguuacgcggaaaccaauucuguauuaaaauuuuaaauccauauaugccauccguuguagagacguuggaacagaugcaaagaaaguauggaggaauguuagucagaaauccauuaucgcgaaauaguacucacgaaauguauuggguuaguugcggcacaggaaauauaguuagcgccgugaauaugacaagccguaugcuauuaaauagguuuacuauggcacacagaaaaccgacuuaugaaagagacguagauuuaggugccgggacgaggcacguagcaguagaaccagaaguagcaaauuuggauauaauaggacaacgcauugaaaauaucaaaaacgagcauaagucaaccuggcauuacgacgaggauaaucccuacaaaaccugggcauaucacgguucauacgagguaaaaccaucggguucugcuagcaguaugguaaaugguguaguacgacugcuuacuaaacccugggauguaauaccuauggugacgcaaauugcuaugacagacacuacuccuuuuggucaacaacgcguguucaaggagaaaguagauacacgaacaccaagagcgaaacggggaacgacccaaauuauggaaguuacagccaaauggcuuuggggauuucuuucacgaaauaagaaaccaaggauauguacaagagaagaauuuacgcgaaaagucagaagcaacgcagcaauuggagcaguauuugucgaugagaaccaauggaauagugcuaaagaagccguugaggaugaaagguuuugggaccuaguucaucgugaaagagaacuacacaaacaaggaaaaugugcuacaugcguauauaacaugaugggaaaaagggagaagaaacugggugaauuuggaaaggccaaagggucccgugccauaugguacauguggcuaggagcuagguuucuagaauuugaagcucuaggauuuaugaacgaagaucacugguuuucacgggaaaacagccuuucagguguagaaggagagggccuccacaaacugggcuacauucuccgagauauuucaaaaauuccaggagguaauauguaugcagacgauacugcgggaugggacacuaggauuacugaagaugauuuacagaacgaggcaaagauuacugauaucauggagcccgaacaugcgcuguuggcaaccaguaucuuuaaguuaacguaucagaauaagguaguacguguccaaagaccugcuaaaaacggaaccguuauggauguaauuucuagaagagaccaaagagguuccggacaaguaggaacuuauggccucaauacauucacgaauauggaaguccaacugauccggcaaauggaguccgaaggaauuuucuuaccaagugaacuagaaacgcccaaucucgccgaacgcguccucgauugguuagaaaaacauggagccgagagauugaaaagaauggcuaucucaggcgaugauuguguaguaaaaccuauugaugacagauuugcuacggcucuaacagcucuaaacgacaugggaaaagucagaaaagauauuccucaaugggaacccagcaagggcuggaaugauuggcagcaaguaccguuuuguucgcaucacuuucaucaacuaauaaugaaagauggucgagaaauuguuguaccauguagaaaccaagaugaacugguagguagagcuagaguuucacaaggcgcaggauggagccugagagagacagcauguuugggcaagucauacgcacaaauguggcagcugauguacuuccauaggagagauuuaagauuggcagcaaaugccauaugcagugcaguaccaguugacuggguaccuaccucaagaacaacuugguccauacaugcacaucaucaauggaugacgacagaagauaugcucagugucuggaacagaguuuggauagaggaaaacccguggauggaggacaaaacgcacguaaguaguugggaggagguacccuaccuagggaaaagagaagaccaauggugugggucauuaauuggccuuacugcgcgagcaacgugggcuacaaacauucagguagcuaucaaccaaguccgacguuuaauagguaaugaaaauuaucuggauuauaugacaucaaugaagagguucaaaaaugaaucugauccagaaggcgcauuaugguaa

SEQ ID NO: 21340 - RNA, 9879 nt, Artificial Sequence
  derived and/or modified CDS sequence (opt6) from DENV-1__KF973465__SS-prME
ucuguuacuauguuacuaaugcuguuaccgacagcacuugcauuucacuugacgacacgaggaggagaaccucacaugauagugucaaaacaagaaagagguaaaucauuauuguuuaaaacaagugcgggagucaacauguguacacuuauagccauggaucuaggggaacucugugaagacacuaugacauacaaauguccccaaaucacagaagcagaacccgacgauguggauuguugguguaaugcaacagacacauggguaacauacggaacaugcagccaaacaggagaacaccgaagagauaaacgaucaguugcguuagcgccgcauguggguuuaggauuagaaacucgaacugaaacuuggaugagcagugaaggagccuggaaacaaauacaaagaguugaaacgugggcucugcgacauccggguuuuacaguaauagcucuguuuuuagcucacgcuaucggaaccucuauaacgcaaaaaggaauaauuuuuauauuguuaaugcuaguuacaccuucuauggcuaugagaugugugggaauugggaaucgcgauuucguugaaggucugaguggggcuacuuggguugacguuguacuugaacacgggaguugugugacuaccauggccaaaaauaaaccaaccuuggauauagaacuauugaaaacagaagucacaaauccagcgauacuacgaaaacuuugcauagaagcaaagauaagcaacacgacuacagacagcagauguccgacacagggagaggcaacucuaguugaagaacaagacgcuaauuuugugugcagacgaacguucguugaccgaggauggggaaauggaugcggguuauucgguaaagggaguuuauuaacuugugcgaaguuuaagugcgugacaaagcuagaagggaaaauugugcaauaugaaaaucugaaauauucaguuauuguaaccguccacaccggagaccaacaucaaguaggaaaugaaacaacggaacauggaacuauugcuaccaucacgccgcaagccccgacaucugaaauacaacuaacagacuauggagcacugacgcuugauuguaguccccgaaccggacuugauuucaaugagaugguucuguuaacaaugaaggaaaaaucauggcuaguucacaagcaaugguuucuagauuuaccacuaccauggacuagcggagcaagcaccucccaggaaaccuggaaucgacaagaucuauuaguuacuuuuaaaacagcacacgccaagaaacaagaaguaguaguuuuggguucacaagaaggagccaugcauacagccuugacuggcgcuacggaaauacagacuagcggaacuacgacaauauucgcgggacaucuaaaaugucgccuuaaaauggauaaauugacucuaaaagguacaucauauguuauguguacagguucguucaaacuugaaaaagagguagcggaaacucaacaugguacuguucucguacaagucaaauaugaagguacggaugccccaugcaaaauuccuuuuucaacacaagaugaaaaaggaguuacucagaauggucgacuaauaacagcgaacccuauugugacugacaaagagaaaccagucaauauugaaacggaaccacccuucggagaaaguuauauuguagucggggcaggagaaaaagcucuaaaauuaaguugguuuaagaaagguagcucaaucgggaaaauguuugaggcuacggcaagaggugcucggaggauggccauacuuggagacacagccugggauuuuggaucaaugggcggaguauuuacgaguguuggaaaauugguucaucaaguauucggaacagcguauggcguccuauuuucuggaguauccuggacgaugaagauaggcauuggcauauuacucacuuggcuaggacuuaauagucggucuacgucauuguccaugacguguauagcggucgguauggugacauuauaucuuggugugaugguucaagcagacucgggcugcguuauaaacuggaaaggacgggaacuaaagugugguagugguaucuuugucacuaacgaaguccacaccuggacagaacaauacaaauuccaagcugacucuccuaaacgguugucggcugcaauaggaaaagcaugggaagaaggcguuugcggcaucagaagugcgacgagguuagaaaauauuauguggaaacaaauaaguaaugaacugaaucacauauugcuugaaaacgauaugaaauuuacaguaguuguuggggacgcaaauggcauucucgcacaaggcaagaagaugauaagaccgcaaccuauggaacauaaauacagcuggaaauccuggggaaaagcgaagauaauaggagcagauauucaaaauaccacauuuauaaucgauggaccugacacuccagaauguccagauaaucaacgcgcguggaacaucugggagguggaagacuauggauucgguaucuucacgacaaacauuuggcuuaaacuucgcgauucguauacucaaaugugcgaucauagacuuaugagugcagcgaucaaagacucuaaagcuguccacgcggacaugggauacuggauugaaucagagaaaaaugaaacauggaaauuagcuagagcgaguuuuauagagguuaaaacauguacauggccuaaaagucauacacuguggaguaaugguguucucgaaagugaaaugauuauacccaaaaucuaugggggacccauuucacagcauaacuauagaccaggcuauuucacacagacugccggaccauggcacuuaggcaaauuagaauuagacuuugaacuaugcgaaggaaccacaguuguaguggacgaacacugcggaaaucggggcccuucccuaagaacaaccaccgucaccgggaaaauaauacaugaauggugcuguagaagcuguacccuaccaccuuuaagauucaggggcgaggacggcuguugguaugggauggagauaagacccguaaaagaaaaagaggagaaccuaguccgcuccauggucagugccgguucgggugaagucgauucauucucguuaggcauucuuugugcgucaauaaugauugaggaaguuaugagaagucgcuggucgagaaaaaugcuaaugacagguacauuggcgguauuucucuuauuaaucaugggacaauugacguggaaugaucugauccgacuuuguauaaugguuggggcuaacgcuucagaucggaugggaauggggacaacauacuuagccuugauggcuacauuuaaaaugaggcccauguuugcaguagguuuauuauuuagacgccuuacaaguagggaaguucuucuucuaacaauaggacuguccuugguagcuucuguagaauuaccaaauucucuugaggaauuaggggacggcuuggcgaugggaauuaugauguugaaacuacugacugaauuucaaccgcaucagcuauggaccacuuuauuaucuuugaccuuuauuaaaacaacgcucucacuugauuaugcauggaagacaacugcaauggcguuaucaaucauaucacuuuuuccacuaugucuaaguacaacgagucagaaaacaacuugguuaccaguuuuauuaggauccuuuggauguaaaccucucacaauguuucucauaaccgagaacaaaauauggggucguaaaaguuggccguugaacgagggaauaauggcuauaggaauaguuuccauacuacuaagcucauuauugaaaaaugauguuccacucgcagguccacuaauagcaggagggauguuaauugcaugcuacgugauaagcgggaguucagcagacuugagccuagaaaaagccgcagagguaucaugggaacaagaagcugaacacucugggacaucucauaauauucuuguggaagugcaagacgacggaacgaugaaaauaaaagacgaggagagagacgacacauuaacaauucugcuaaaagcuacuuuacuugccguuaguggcguauauccuaugucuauaccugccacacuguuuguaugguauuucuggcagaaaaagaaacaaagaaguggaguuuuaugggacaccccgagcccuccugaaguggaacgcgcgguauuagacgauggcauauaucgaauacuccagagaggguuauuaggacggucucaaguaggagugggcguguuucaagacggaguauuucauacuauguggcacguuacucgaggggcuguauugauguaccaaggcaaaaggcuagaaccaaguugggccagcguuaagaaagauuuaauuaguuauggaggcggauggagauuccaaggguccuggaauacuggagaggaaguucagguaauugccguugaacccggaaagaacccuaaaaaugugcaaacaacacccggcacguuuaaaacaccagagggugaggucggcgcaauugcacuagauuucaaaccggggaccuccggaaguccuaucguaaaccgggaaggaaaaauaguaggauuauacggcaacggcguaguaacaacuucggguacuuauguaucggcaaucgcacaggcaaaagcuagccaggaaggacccuuaccggaaaucgaggacgaaguauucaagaagagaaacuuaaccauuauggaucuacauccaggaagcggaaagacacgacgcuauuuaccagcuauaguuagagaggcuaucaagcggaaacucagaacauugauucuagcuccaaccagagucguagcaagugaaauggcagaagcccuaaaaggaaugccgauccgguaucagacaacugccguuaaaucugaacauaccggccgagaaauagucgaucuuaugugucacgccaccuuuacaaugagauugcugaguccuguucgcguuccuaauuacaauaugauuauaauggaugaagcucacuucaccgauccagcaucaauagcugcucgaggauacaucaguacgcgaguaggaaugggagaagcggcggcaaucuuuaugaccgcuacgccacccgggagugucgaagcauucccucaaucuaaugccguuauucaggaugaagaaagagauauuccugaaaggaguuggaacagcggguacgauuggauaaccgacuucccgggaaagacagucugguucgucccgucgauaaagucaggcaaugacauugcgaacuguuuacgcaaaaacggaaaaagaguuauacaauugucucgaaagaccuuugauacugaguaucagaaaacaaagaauaacgacugggauuacguaguaacaacugacauuagugaaaugggagccaacuuucgagcugauagaguuauagauccccgaagguguuugaaaccaguaauccucaaagacggaccagaaaggguaauacucgcagggccuaugccagugacagucgcaagcgcugcccaaagaaggggccguauuggaagaaaccaaaauaaagaaggcgaucaauauguauauaugggccaaccauuaaacaaugaugaagaucaugcccauuggaccgaagcuaagaugcuccuagauaauauuaacaccccggagggaauuauaccagcacuuuuugaaccugagagagaaaaaucggcugcaauagacggugaauauagauugcgaggugaggcucgaaagacauucgucgagcuaaugcgucguggugauuuaccaguauggcugucauauaaaguggcaagugaggguuuccaauacucagaucggagauggugcuuugauggagaacggaauaaucaaguauuagaagaaaacauggacgucgagauauggacaaaagaaggugaaagaaagaaauuacgaccgagauggcuagaugcgaggacuuacuccgauccauuggcguuacgagaauuuaaagaguucgcagcagguagaagguccguaagcggggaccuaauuuuggaaauugggaaacucccucagcauuugaccuuacgcgcgcaaaacgcucuagauaaucucguaaugcuacauaauucagaacagggaggaaaggcuuaucgccaugcuauggaagaacuaccagauacgauagaaaccuuaaugcucuuagcguuaauagcuguacugacaggcgggguuacacucuucuuucuaucggguaaagguuuggguaaaacaaguauugguuuauugugugucaccgcgucuagcgcacuacuguggauggcaaguguagagccacauuggauugcugccaguauuauacuagaguucuuuuuaauggugcuguugauaccggaaccagaccgccaaagaacgccacaagauaaucaacuagcuuauguagucauaggacuauuguucaugauacuuacaguugcugcgaacgaaaugggccuguuagaaacuaccaagaaagacuugggaaucggacacguagcugcugaaaaucaccaacaugcaacgaugcuagacguggaccuccguccggcuagcgcguggacuuuguaugcagucgccacaaccguuauaacuccuaugaugagacauacuaucgaaaauaccacugcuaauauaucgcuaacagcaauagcuaaucaggcagcaauuuuaaugggacuugauaagggcuggccaauuucaaagauggauauaggaguuccucugcucgcucuagguuguuauucccaagugaacccacuaacgcuaacugcggcagugcugaugcucguagcccacuacgccauaauaggaccuggauuacaggcaaaagccacgcgggaagcucagaagagaacagcagcaggcauuaugaaaaacccuacuguggacgguaucgucgcgaucgaucuagauccgguuguuuacgacacgaaauucgaaaaacaauuaggccagauaaugcuacucauauuaugcacaagccaaauacugcuaaugcgaacaacuugggcauuaugugagucaauaacacuagcaacuggaccauugacuacccuaugggaggggucaccaggaaaauucuggaauacaacaauugcgguuucuauggcaaauauauucaggggaucguaucucgcuggcgcagggcuagcguucagucucaugaagaguuuaggcgguggaagacgcggaacgggagcgcaaggagagacucucggagagaaauggaaaaggcaacuaaaccaauuaucaaaaucugaguucaauauuuacaaaagguccggaauaauggaaguggaucgcucagaagcaaaagaaggucuaaaaaggggugagacaacaaaacaugccguaagcagaggaacagcaaaguugcgcugguucguagaaagaaaucuaguaaagcccgaagguaaagucauagaucucgguugcgggcgugguggguggucauacuacugugcaggacuaaagaaaguaacagagguuaaaggauacacaaaagguggaccagggcacgaagaaccuauaccaauggccacuuacggauggaauuuaguuaaacuucauucggguaaagauguauucuuuaugccgccugaaaagugugauacguuguuaugcgacauaggugaaagcagccccaacccuacaauugaggagggacgaacguugaggguacuuaaaaugguugagccaugguuaagagguaaucaguuuuguauuaagauauugaauccguacaugccguccguaguggagacucuagaacaaaugcaacggaaauacggaggaaugcugguaaggaacccuuugucacgcaauaguacacaugaaauguauuggguaaguugcggaacgggaaauauagugagcgcuguaaauaugacgucuaggauguugcuuaacagauuuaccauggcacaccguaaacccacuuaugaaagagauguugauuuaggugccgguacaaggcauguggcaguagaacccgaaguagcuaauuuagauauaauaggacaaagaauagagaauaucaaaaaugaacauaagucaaccuggcauuaugaugaggacaauccauacaagacaugggccuaucaugggucguaugagguuaagccaucaggaagugcaucaucaaugguaaacggaguaguacgguuguuaacuaaaccuugggauguaauaccaauggugacucaaaucgcaaugacagauacaacaccauuuggucaacaaagaguauuuaaagagaaaguagacacuagaacuccucgagccaaaaggggaacaacacaaauuauggagguaacagcgaagugguuauggggguuuuugagccgaaauaagaagccucgaauuugcaccagagaagaguuuacgagaaaaguccggucaaaugcagccauaggugcagucuuugucgacgaaaaucaauggaacagugcuaaagaagcaguagaagaugaaagauucugggaucuaguucgacgggaaagagaacuccauaaacaaggaaaaugugcaaccuguguauauaacaugauggguaagagagagaagaaauugggugaguucggaaaggcaaaaggaagucgagcaauaugguauaugugguugggagcaagguuucuugaauuugaagcacuaggcuucaugaaugaagaucacugguuuucucgggaaaauagccuaucggguguagaaggagaaggauugcacaaacuagguuauauccuuagggauaucuccaaaaucccgggaggaaauauguacgcagaugauacagcgggaugggauacaagaauaaccgaggacgacuuacaaaaugaagccaagauaacagauauaauggaaccagaacaugcauuacuagcaacgucgauuuucaagcucaccuaccaaaauaagguaguuagaguccaacgaccggccaaaaauggaacuguuauggauguuaucucaagaagagaucagcgagggucaggacaaguugguacauauggauuaaacacuuuuacuaauauggaaguccaauuaauuagacaaauggaaucggagggcauuuuucuaccaagcgaacuggagacacccaaucuggccgaaagaguuuuagacugguuagagaaacacggggcagaaagauuaaagagaauggccauauccggggaugauuguguugugaaaccgaucgacgauagauuugcaacggcccuaaccgccuuaaacgacaugggaaaagugcguaaagauauaccccaaugggaaccgaguaagggcuggaacgauuggcaacaaguaccuuuuuguucacaccacuuccaucagcuuauuaugaaagaugguagggagauuguagucccgugucgaaaucaagacgaguuaguggguagagccagggucagucagggagccgguuggucccuacgggagacagcgugccucggaaaauccuaugcucaaauguggcaacuaauguacuuucacagaagagauuuacgucuggcugccaaugcgauaugcuccgcaguaccuguggacugggugccgaccucacgaacaacuuggucaauccaugcccaucaccaguggaugacgacagaagauaugcuaucuguauggaaucgcguguggauagaagaaaauccauggauggaagauaaaacacaugucaguucaugggaggaaguuccuuaccuaggaaaaagagaagaucaaugguguggcagccugauugggcuuaccgcaagagcgacgugggcaacaaacauacaaguugcgauaaaucaaguccgaagguugaucggcaacgaaaauuaucucgauuauaugacaaguaugaaaagguucaaaaacgaaagugaucccgaaggugcuuugugguga

SEQ ID NO: 21341 - RNA, 9879 nt, Artificial Sequence
  derived and/or modified CDS sequence (opt6) from DENV-1__KF973466__SS-prME
ucugucaccauguuauuaauguuaaugccgacggcguuagcuuuccaccucacaacaagagggggagaaccacacaugauaguaaguaaacacgaacguggaaaggcuuuauuauucaaaacaucuacuggcguaaacauguguacucuaauugcgauggacuuaggggaacuuugugaagauacgaugacauauaaaugcccaagaauaacugaagcagaaccggaugauguugauuguugguguaacgcaacugacaccugggugaccuacggcacauguagucaaacaggugagcauagaagagauaagcgaucaguggcucucgcaccacacguuggccuuggccucgaaacuagaacagaaacauggaugaguucagaaggggcauggaaacaaauacaaagaguugaaacaugggcucuaagacaccccgguuucacgguaauagcccuauuucuugcucacgcaauagggaccucuauaacgcaaaaaggaauaaucuuuauuuuacuaaugcuuguuaccccaaguauggcuaugcgaugcguggguauaggaaaccgagauuuugucgaagguuuaaguggugcuaccugggucgaugugguacuggaacaugguuccugcgugaccacuauggcgaaaaacaaaccuaccuuagacaucgaauugcuaaaaacggaaguaacaaauccugcaguauuaagaaaacuguguauagaagcuaaaauaucaaauacuacuacagacucuagaugcccaacucaaggugaagcuacccucguugaagaacaagaugcgaauuucguuugucgacguacguuuguugaucgagguugggggaaugguuguggucucuuuggaaaaggaucccuguuaacgugugcuaaauuuaaaugcgucacuaaauuggaaggaaaaaucguccaauaugaaaaucuaaaguauucgguuaucguaacaguucacacaggugaucagcaucaagugggaaaugaaaccacagaacauggaacaauagcuaccauaacaccacaagccccaacaucagaaauacaauuaacagauuacggggcacugacguuagacugcaguccaagaacaggacucgauuucaacgagaugguccuacuaaccaugaaagagaaauccugguuagugcacaaacaaugguuccuggaccuaccacuaccguggacaaguggagcuucaaccucucaagagacauggaaucggcaagacuuguuagugacuuuuaagacagcgcaugccaagaaacaggaaguaguaguauugggaagccaagaaggagccaugcacacugcuuuaacaggagcaacugaaauccaaacgagcgguacuacgacaaucuucgcgggccaccuaaaaugucguuuaaaaauggacaaacuuacauuaaaagggacuucuuacguuaugugcacaggcagcuucaagcuagagaaggagguagcugaaacacaacauggaacaguauuggugcaaguuaaauacgaagguacagaugcaccauguaagauaccauuuucuacgcaagaugaaaaaggcguaacucaaaacgguagauuaauuacagcaaacccuauaguaaccgauaaggagaaaccagucaauaucgagacagaacccccauuuggggaaaguuauaucgugguaggagcuggugaaaaagcauuaaaacuaucuugguuuaagaaaggauccaguauaggaaaaauguucgaggcaacugcgcgaggagcuagacggauggcuauucuaggugacaccgcgugggauuucggcagcauagguggaguauucacaucuguagguaaauuaguacaccaaguuuuugguaccgcauacggaguccucuucucuggcguaucguggacaaugaagauuggaaucgggauucuacugacuugguuaggacugaauagucggucaacaucccugucuaugacauguauagcaguggggaugguaacauuguaucuaggaguaaugguacaagcugacucagguugcguaauuaauuggaaaggacgugaauugaaauguggaucaggaauauuuguaacaaaugaagugcauaccuggaccgaacaauauaaauuucaagccgacucaccuaaacguuuaucggcagccauagggaaggcuugggaagaagguguaugugggaucagaagugccacccgccuagagaacaucauguggaaacagauuaguaacgaauuaaaccauaucuuacuagaaaaugauaugaaauuuacaguuguagucggcgaugcaaacggaauccuagcgcaagguaaaaagaugaucagaccacaaccgauggagcauaaauacucauggaaaucaugggguaaggcaaaaauuauaggagcugauauccagaauacuacauucaucauugacggaccagauacaccggaauguccagaugaccaaagagcguggaauauuugggaaguagaggacuauggauuugggauauuuacuacgaauauaugguuaaaacuuagagacucauauacgcaaaugugugaucacagauugaugucugccgcgauaaaagauucuaaggcaguacacgcugauaugggauauuggaucgaaucugagaaaaaugagaccuggaaauuagcaagggcaucuuuuauagagguaaaaacaugcacauggccuaaaagccacaccuugugguccaauggaguccuagagagcgagaugauaauacccaagauauauggcggcccuauuucucaacauaacuaucgaccgggguacuuuacacagaccgcugguccguggcaccuugggaaacuagagcucgacuuugacuuaugugaaggcacgacuguaguagucgaugaacauuguggaaaucgaggaccuucacuacguacaacaacugucacagggaaaauuauacaugaauggugcugccgguccugcacauuaccaccauuacgauuuagaggggaggauggcugcugguauggaauggaaauaaggccggugaaagaaaaagaagaaaaucuuguacgcaguaugguaagugcagggucaggagaaguagacucauuuucauuaggaauccugugcguuucgauuaugaucgaagaagucaugcggucuagauggagucgcaaaaugcuaaugacgggaacguuagcuguauuucuacuauugauaaugggccaauuaacuuggaaugaccuaauaagauuguguaucaugguaggugcuaaugcgucugacagaaugggcaugggaaccacuuauuuggcauuaauggcuacauucaagaugagaccuauguuugcugucggaauacuguuucgacgauuaacgaguagagaaguccuguuguuaacuauaggauuaagccuaguagcaagcguagaguuaccuaauucauuagaagaauuaggugauggacuugcaauggguauuaugauguuaaaacuacucacagaauuucaaccucaucagcuuuggacgacguuacuaucacuuacauuuauuaagacaacgcuuucgcuugacuaugcauggaagacaacggcaauggcucuuucaauaguaucguuguuccccuuaugccugaguacaaccucacagaagacaacaugguugcccguuuuguuaggaucguucggaugcaaaccacuuacaauguuuuugauaaccgagaacaaaauauggggccgcaagucuuggccaauaaaugaagguauaauggccauuggaauuguuagcauacuucucucaucauuauuaaagaaugaugugccacuugcagguccacuaauagcuggugggauguuaauagcaugcuaugugauaucuggaagcucagcagaucucuccuuagagaaagcagcugaaguauccugggaacaagaagccgaacacagcggcacuucacauaauauucuuguugaagugcaggacgaugggacaaugcgaauaaaggacgaagaaaaagacgacacuuuaaccauacuacuaaaagcgacacuucucgcaguuucaggcguguacccgaugucaaucccggcuaccuuauuugugugguauuucuggcagaaaaagaaacaaagaucugguguucuuugggauacccccaguccaccugaaguagaaagagcuguuuuagaugaugguauauauagaauacugcaacgaggccuucuggggagaucccagguaggagugggaguuuuucaggacggaguuuuucauacgauguggcauguuacucggggugccguacuuauguaccaaggcaaaagauuggaaccgaguugggcgucggucaaaaaggauuuaauauccuaugggggagguuggcguuuccaaggcaguuggaauacuggcgaggagguucagguaauagcaguugaaccuggaaagaaucccaaaaauguacagacuacacccgggacguuuaagacauccgaaggugaagucggugcuaucgcuuuagacuuuaaaccugggacaucuggaaguccuauuguaaacagggaagguaaaauagucggacuauacggaaaugggguaguuacuacgagugguacauauguuagcgcuauugcgcaggccaaaaccucgcaagaaggaccuuuaccugagaucgaggacgaagucuuuaaaaagagaaacuugacaauaauggauuuacauccaggcucagguaaaacacguagguauuuacccgccaucguccgagaagcuauaaaaagaaagcuaagaacgcuuauucuggcuccaacucguguaguugcaucugagauggcggaagcccuuaaggguaugccaauaagauaccagaccacugcaguuaaaagugaacacacaggucgcgaaauuguagaucuaaugugucaugcaacguuuaccaugcgcuugcuaucuccuguuagaguaccaaauuauaacaugauuaucauggaugaggcacacuuuaccgauccggcuucgauagcggcccgaggauacaucaguacuagaguaggaaugggugaagccgcugcgauuuucaugaccgcaaccccuccgggcagugucgaggcauuuccacaaucgaacgcgguaauacaggacgaggaaagagacauaccugaaagaaguuggaacuccggauacgauuggauaaccgauuucccagggaaaacaguuugguuuguuccuucgaucaaaucgggaaacgauauagcuaauugccugaggaaaaaugguaaaaggguuauacaauugucaagaaaaacauucgauacugaguaccagaaaacuaaaaauaaugauugggacuauguaguaaccacagauauaagugaaaugggagcgaacuuccgcgcagaccgcgugauugacccccgucgcugucugaaaccaguuauuuuaaaggaugggccagagagagugauacuugccggaccaaugccaguuacuguugcaagugcggcacaaagacgggguagaauaggucgcaaccagaacaaagagggugaccaauaugucuacauggggcaaccccugaacaaugaugaagaucaugcgcauuggacagaagccaaaaugcuucuugauaauauuaauacgccagagggcaucauaccggcacucuucgaacccgaacgagaaaaaucagcagccauagauggggaauauagauugagaggagaggcaaggaaaaccuucguugagcuuaugagacgaggugaucugccaguuuggcuuuccuauaaagucgcgagugagggauuucaauacagcgacaggcgaugguguuuugacggagaacgcaacaaucaaguauuagaggaaaauauggaugucgaaauauggacaaaggaaggcgaaaggaagaaauuaagaccucggugguuggacgcacggacuuacucugaucccuuagcacugagagaauuuaaagaguuugcagcuggucgccgaaguguuuccggugacuuaauacuagaaauaggaaaacugccgcaacaccugacauugagagcacaaaaugccuuagauaaucuaguaauguuacacaacucagaacaaggaggaaaagcauacagacacgcgauggaggaacuaccagacaccauagagacauuaauguuguuagcauuaauugcagucuugacaggaggugugacucuauucuuucuaucgggcaagggacuuggcaagacgaguauagggcuccuuuguguaacagcgaguucggcacuacuauggauggcaagcguggaaccacauuggauugccgcaagcauuauacucgaauuuuuccuaauggucuugcugauaccggaaccagaucgccaacgaacaccccaggacaaucaguuggcguauguuguuauaggcuugcucuuuaugauuuuaacagucgcugcgaacgaaaugggucucuuggaaacaacaaaaagggaccuggguauaggacauguagccgcagagaaccaucaacaugcuaccauguuagauguggauuugcggcccgcuagcgcguggacacuguaugcggucgcgacaacaguaauuacacccaugaugcgacacacaauagaaaauacgacugcaaauaucagcuugacagcaauagcuaaucaggcagcaauacuuauggguuuggauaaggguuggccgauuucaaaaauggauauaggagucccguugcuagcacuagguugcuacucacagguaaauccacugacacuuacugcugcaguacuaauguuagucgcacauuaugcaauuauuggaccgggauuacaagcgaaagcaacaagggaagcccagaaaagaacugcggcgggaaucaugaaaaacccaacaguugacggaauaguggcuaucgauuuagacccaguugucuacgaugcuaaauuugaaaaacaacuaggacaaauuauguuacuuauucucuguaccagucagauauuacuaaugcgcacgaccugggcucuaugcgaaaguauuacauuagcuacaggaccccuaacaacuuuaugggaagguucgcccgguaaguucuggaauacgacuauagcaguaucgauggcuaauauuuuuagagguaguuauuuggcgggggcaggacuagcauuuagcuuaaugaaaucucuuggaggaggaagacguggaacaggagcucaaggagaaacccuaggagaaaaguggaaaagacaauugaaucaacuaaguaaacccgaguucaacaccuauaaaaggucaggaauuauggaaguagaucgguccgaagccaaagaagggcuuaaaaggggcgaaaccacuaaacaugcggugagcagggggacagccaaguugcgaugguuuguggaaagaaauuuaguaaaaccggagggaaaagucauugaucucggaugugguagaggaggcuggucauauuacugcgcagggcuaaagaaaguaacggaaguaaaaggcuauacgaaaggaggcccgggccaugaagaacccaucccaauggcaacuuacggguggaauuuaguuaaacuccacaguggaaaagauguauucuuuaugccuccagagaaaugugacacgcuucugugcgacauaggggaaucaucuccaaacccuacgauagaagagggacggacucuuagaguguuaaaaauggucgaaccuuggcugagaggaaaucaguuuuguauaaaaauacuaaauccuuauaugccgucaguaguggaaacguuagagcaaaugcaaagaaaacauggagguaugcuggugaggaauccucucagccgcaacucuacacaugaaauguauuggguaaguugugggacaggaaauaucguaagugcgguaaauaugaccaguagaauguugcuuaaccgauuuacaauggcucauagaaaaccaaccuacgaaagagacguggaccuaggagcgggcaccagacauguagcggucgaaccugaaguggccaaucuagauauaauaggucaaaggaucgaaaauaucaaaaaugaacauaaaaguacauggcacuacgacgaggauaacccauauaaaacgugggcauaucacgguaguuaugaaguaaaaccuaguggaagugccucgucgaugguaaaugguguagucagauuacuaacuaagccaugggaugucauucccaugguaacucaaaucgcuaugaccgacacgacgccauuuggacaacaacguguuuucaaagaaaaaguggauacaagaacaccgcgugcaaagagaggaaccacccagauaauggagguuacggccaaguggcucuggggcuucuuaucgcguaauaagaaaccaagaaucuguacgcgugaagaauuuacuaggaagguuagaucuaaugccgcuaucggggccgucuucguggacgaaaaucaguggaauagcgccaaagaggcaguagaggaugaaagauuuugggacuuaguacaucgggaacgagaacuacauaaacaaggaaaaugugcaacuuguguauauaacaugaugggaaagcgagagaagaaacugggcgaguucgggaaagcaaaggguagcagggcuauaugguauaugugguuaggggcuagauuucuggaauuugaagcacuuggauuuaugaaugaagaccacugguuuucgagggaaaauagucuuaguggaguugaaggagaggguuuacauaaacugggauacauucuaagagauauuuccaaaauaccugggggaaauauguacgcugaugacacggcugguugggauacaagaauuacagaagacgauuugcagaaugaggcgaagauaacagauauuauggaacccgaacaugcccuucuugcuaccaguauauucaaacuaacuuaucaaaacaaaguagugagaguacaacgaccugccaaaaacgguaccguuauggaugucauaagccguagggaucaaaggggaucaggucaaguaggaacuuacggccuaaacaccuucaccaacauggaaguucagcuuauaaggcaaauggaauccgaaggaauauuucucccuagugaacuugagacaccaaauuuagcugaaaggguccuugacugguuagaaaagcauggagcggaaagguugaagagaauggcuauaucaggggaugacuguguugugaaaccaauugaugauagauuugcuacugcacuuacugcacugaaugauaugggaaagguaagaaaagacauaccacaaugggagccgaguaaaggauggaacgacuggcaacaaguaccguuuuguagucaucacuuccaccagcuaauaaugaaagauggaagggagauaguaguaccguguagaaaccaagaugaguuaguaggccgagcucggguaagccagggugccggauggucauuaagagaaacggcaugucuagggaaaagcuaugcacaaauguggcaauuaauguacuuccauagaagggaucuaagacuagcagcuaaugcaauaugcucagcagugcccguugacuggguaccaacaagccguacaacauggagcauacaugcucaucaccaauggaugacgacagaagacaugcuuucaguguggaauaggguauggauugaggaaaauccguggauggaagauaagacccauguaucaucgugggaagaaguaccauaucuggguaaaagagaagaccaauggugugguucguuaauugguuugaccgccagggcaaccugggcuacgaacauccaaguugcuauuaaucaaguucgucgacuaauugguaaugagaauuaccuagauuacaugacgaguaugaaaagguuuaagaaugaauccgauccagagggagcucucugguaa

SEQ ID NO: 21342 - RNA, 9879 nt, Artificial Sequence
  derived and/or modified CDS sequence (opt6) from DENV-1__KF973471__SS-prME
ucagugacuauguuauuaaugcuauuaccaacagcauuagcguuccaucucacaaccaggggaggagaaccucauaugauaguaucaaaacaagaacgagggaaaagucuucuauuuaaaacgagugcaggaguuaacaugugcacauuaauagcaauggaccuaggagaacuaugugaagauacaaugacguauaaauguccgcaaauaacagaagcagaaccggaugauguugacuguuggugcaaugcuacagacacauggguaacauauggaacuuguucucaaaccggugaacacagaagagauaaaagaaguguggcacuagccccucacguuggacuaggacuugaaacaaggacggaaacauggaugagcucagaaggagcauggaaacaaauacaacggguagaaacuugggcguuacgacacccaggauucaccguaauagcucuauuuuuagcucaugcaauuggaacgaguauuacucaaaaaggcauuauauuuauucuuuugauguuaguuacacccucgauggcgaugaggugugugggaauaggaaaccgugacuuuguagaaggguugucaggggcaacaugggucgauguaguccucgaacacggaucaugugugacuacuauggccaaaaacaaaccaaccuuggacauagaauuacuaaaaaccgaaguaacaaauccagcgauucuaaggaaauuauguauagaagcuaaaauaucuaacacgaccacugacucucguugcccuacucagggagaggccacgcuaguagaagaacaagaugcaaacuuuguauguagaagaacauucguagaucguggaugggguaauggcugcggacuuuucgggaaaggaucauuacuaacaugcgcaaaauucaaauguguuacuaaacuggaaggaaaaaucguucaauaugaaaaucuaaaauauagcguuauuguaacaguacacacaggagaucaacaucaaguaggcaaugagacuacugaacauggcaccauugcaacaauuacaccacaagcaccaaccuccgaaauacaauugacagauuacggugcacugacucuggauuguuccccgcguacggggcuagacuucaacgaaaugguacugcuaacaaugaaagaaaaaucauggcuugugcacaaacaaugguuuuuagaucuacccuuacccuggacaaguggcgcaagcacaucccaagaaaccuggaaucggcaagaccuacucguuacuuuuaaaacagcccaugcuaagaaacaagaagugguuguacuagggagucaagaaggugcgaugcauaccgcacuaacuggagcaacugagauccagacaagcgguacaacuacuauauuugcuggucaucuaaaauguagguuaaaaauggauaaacuaacauugaaaggaacaucauauguuauguguacagggagcuucaaacuagaaaaagaaguagcagaaacacagcacgguacugucuuaguucaagucaaauaugaaggcacggaugcgccauguaaaauaccguuuuccacucaagaugaaaagggugucacacaaaacggucgucucauuacagcaaacccaauaguaacugacaaagaaaaacccguuaauauagaaacggaaccuccuuucggagaaagcuacaucguugucggcgcuggcgagaaggcacuaaaacuuuccugguucaagaaaggaucuuccauuggcaaaauguucgaggcuaccgcaaggggcgcuagaagaauggcaauccuaggagauacagcgugggacuucggcuccauaggcggcguauucaccaguguagggaaacugguacaccaagucuuuggaacagcuuauggaguuuuauucaguggcgucucauggacaaugaagauaggcauagggauacuccugacaugguugggacuuaacucuagaucuacuagccuauccaugacuuguauagcagucgguaugguuaccuuauacuuaggaguaaugguucaagccgauagcggaugugugaucaacuggaaaggacgugaauuaaagugugguucaggcauuuucguuacuaaugaggugcauacauggacugaacaguauaaauuucaagcagauaguccaaaaagacuuucggcagcaauaggcaaagccugggaagaaggaguuugcggcauucguucagcaacacggcuagaaaacauuauguggaaacaaaucucaaaugagcuaaaucauauccuacuagagaaugacaugaaauuuacaguugucgugggagaugcuaacggcauucuagcacagggaaagaaaaugauccgaccccaacccauggagcauaaauacaguuggaaaucgugggguaaagcuaagaucauaggugcagacauacaaaacacaacguuuauuauagauggaccggauacucccgaauguccagacaaucagcgcgcauggaacauuugggagguggaagauuacgguuucggaauuuuuacaacaaacauaugguuaaaacuaagagauucuuauacccaaaugugugaccauagauuaaugucggcagcgauaaaagauaguaaggcuguccaugcagauaugggcuacuggauagagagugaaaagaaugagacauggaaacuugcuagggccucauuuauugaaguuaaaacgugcaccuggccuaagucccauacguuauggucaaaugguguccuagaaagugagaugaucauaccuaaaauuuacggagguccaaucucacaacauaauuauagaccugguuacuuuacccaaacagccgguccuuggcaccugggcaaacuagaauuggacuuugacuuaugcgaaggaacgacggugguagucgaugagcacugugguaaccgagguccuagccucagaacuacuaccguaacugggaagauaauacacgaaugguguugcagaagcuguacccuucccccauuaagauuccgaggagaagaugggugcugguauggcauggaaaucagaccuguuaaagaaaaagaagagaauuuggucaggucaauggucucggccgguucaggagaagucgacagcuucaguuuaggaauauuaugcgcuaguauaaugauugaagaggugaugcgguccagguggucgcgaaagaugcuaaugacagggacaccagcagucuuccuacuacuuaucauggggcagcuaacauggaacgaucuuauacgacuuuguauuauggucggagcuaacgcaucugauaggauggguauggggaccaccuacuuagcauuaauggcuacguucaaaaugcgaccgauguucgccguaggccuucuauuuagacgucugacgucccgagagguccuccuacuuacaauuggacuuagucuuguagccaguguugaacugccaaacucuuuagaagaguugggugauggauuagcaaugggaauuaugaugcucaaacuguugacggaauuucaaccccaucaauuauggacgacacuucuuagccugacauucaucaagacaacauuaucuuuagauuacgcauggaagaccacugcaauggcucucagcauuauuuccuuguucccucuuugucuaagcacaacuucacaaaagacuacauggcuuccuguucuguuagggagcuuuggaugcaaaccgcucacgauguuucuaauaacugaaaauaaaaucuggggucguaagucuuggccccugaaugaagggauuauggcgauaggaauagugaguauacuucucucaagccugcuaaagaaugacguaccauuagcagguccacucacggcuggaggcauguuaauugcuuguuauguaaucagugguucauccgcugaucugucacuggaaaaagcagcagaagucaguugggagcaagaagcagaacauucggggacaucgcauaacauccuaguagaaguucaagaugaugggacuaugaaaauaaaagaugaggagagggacgauacacuuacaauucuccuuaaagcaacacuucuagcagucagugggguauauccuaugucaauucccgccacgcuguuuguaugguauuuuuggcagaaaaagaaacagagaucgggaguuuuaugggauacaccaagcccaccagagguggaacgagccguccuagacgacgguauuuauagaauacuucagaggggccuauuggggagaagucaaguaggggugggaguuuuccaagaugguguguuucauacgauguggcacguaacccguggagcaguauuaauguaucaaggaaaacgauuagaaccaaguugggcaucugucaagaaagaucugauaucuuacggaggggguuggagauuucagggaucauggaauaccggugaagaaguucaagucaucgcagucgaaccagggaagaaucccaaaaauguucaaacuacacccggcacuuucaaaacacccgaaggagaggucggcgcgaucgcacuggacuucaaaccaggaacaucagggagcccaaucgugaauagagaaggaaaaauagucggauuauacggaaacgguguaguuaccaccucuggaaccuacguaucagcaauugcccaggcaaaagcgagccaagaaggcccucugccugaaauagaagaugaaguauuuaaaaagcgaaaccuaaccaucauggaccuacaccccgguagugggaagacaagaagauauuugccagcaauaguaagggaagccauuaaacguaaacugagaacauuaauccuugcaccaacgaggguuguagccuccgaaauggcagaagcgcuaaaaggaaugccaauacgauaucaaaccacugcugucaaaucggaacauacagggcgcgaaaucguggauuuaaugugucaugcgacauucaccaugaggcuacucucgccuguuagagucccuaauuauaacaugauaauaauggacgaagcgcauuucacugauccugcaucuaucgccgcccgaggauacauaucaacacguguugguaugggagaagcugcagcgauuuuuaugacugcuacaccacccggcagcguagaagcauuuccacaaaguaaugccguuauccaagaugaagaaagagacauuccggaaagaaguuggaacucuggauaugauuggauaacagacuuuccagguaaaacagugugguuuguaccaucaaucaaaagugggaaugauauugcaaacugucugaggaaaaauggaaaaaggguaauacaacugucgcgcaaaaccuuugacaccgaguaccagaaaacgaaaaacaaugauugggauuacguaguaacaacagacauauccgaaaugggugccaauuuccgugcagacagaguuaucgaccccagacgauguuuaaaaccaguaauuuuaaaggacgguccagaacggguuauauuagcugggccuaugccuguaacagucgcuagugcagcucaaagaaggggucgcauagggaggaaucagaauaaagaaggcgaccaguacguauauaugggucaaccacuuaacaaugacgaagaccaugcccauuggacagaagcgaaaaugcuuuuagauaacauuaauaccccggaaggaauaauucccgcucuauucgaaccagaacgugaaaaauccgcggcgaucgauggagaauauagacuucggggcgaagcgcgaaaaacuuuuguugaauugaugagaagaggcgauuuaccaguuugguuaucauauaaaguagcaucagaagguuuccaguauucagaucgacgcuggugcuuugacggagaaagaaauaaucaaguauuagaagagaauauggaugucgaaauuuggaccaaagaaggggaaagaaagaaacuuagaccacgcuggcuagaugcaaggacuuacagugauccccuagcacuuagagaauuuaaagaguuugccgccgguagaagaaguguaagcggugaccuuauuuuagaaauagggaaauuaccucaacaccucacucuaagagcgcaaaacgcauuagauaaucugguaaugcugcauaauagugaacaagguggaaaggcuuauaggcaugcuauggaagaauuaccggacaccauugaaacauuaauguuauuggcccucauagcaguguuaacuggaggcguaacacuuuucuuccuaucuggaaaaggacugggaaaaacuucgauagguuuacucugcgugacugcgagcagugcgcugcuauggauggcaagugucgaaccacacuggauagcagcaucaauuauacuugaguucuuuuuaauggugcuucugauacccgagcccgaccggcagaggacuccacaagacaaucaauuggcguaugucguaauaggacuauuauuuaugauacuaacgguugccgcaaacgagaugggucuauuagaaacgacaaagaaagaucugggaauugggcauguagccgcggaaaaccaucaacacgcaaccaugcucgauguagauuugcguccagcuagugcauggacacucuaugcuguagcgacaacaguuaucacaccaaugaugagacauaccauagaaaauacuacagcaaauaucucacugacugcuauagcaaaucaagccgcaauauuaauggggcucgacaaaggcuggccaauaagcaaaauggauauaggugucccacuucuugcauugggauguuauagccaagucaaccccuuaacauugacagcagcaguacuaaugcugguagcacauuacgccaucauagguccaggucuacaagcaaaggcaacaagggaggcgcagaaaagaacagcugcgggaauuaugaagaacccaacuguugaugguauaguagcgauugacuuagacccaguugucuacgauacuaaauucgaaaagcaacuaggucaaauaaugcuuuuaauuuuaugcacaagucaaauauuacuuaugcgaacgacgugggcauugugugaaucaaucaccuuagcaacagggccccuaacaacacuuugggagggaucuccuggaaaguuuuggaauacuacgauagcuguaucgauggcuaauauauuuagagggaguuaucucgcuggcgcaggacuagcauuuucccuaaugaaaucccucggaggagggcgccggggaacgggugcgcaaggcgagacccuuggcgaaaaauggaaaaggcaacuaaaucaacugaguaaauccgaauuuaacauauacaaacgaagcgguauaauggaagucgaccguuccgaggccaaagaaggacuaaaacgaggcgagacuacgaaacacgcagucucacgcggaacagcaaaacugcgaugguuuguagaacgaaaccucgucaaacccgagggaaaggucauagaccuaggaugugggagaggaggcuggucguacuauugugcagguuugaagaaaguuacugaaguaaaaggauauaccaaaggcgggccgggccacgaagaaccgauaccuauggcuacauauggauggaauuuaguuaaacuucauaguggcaaagauguauucuuuaugccuccagaaaagugcgauacucuuuugugugacauaggcgaaaguaguccgaacccaacaguagaagagggucggacuuuaagaguacuaaagaugguagagccuuggcucaaaggcaaucaauuuuguauuaaaauacugaaucccuauaugccuucagucguggaaacgcuagaacagaugcaacggaaauacggaggcauguugguacgaaauccacucucacgcaacucuacucaugaaauguacuggguuaguuguggaacaggaaauauaguaucagcaguaaacaugacaucucgaauguuacuuaacagauucacuauggcacauagaaaaccaacauaugagagagauguggaucuaggagcuggaacaagacauguugcaguggagccagaaguugccaaucuagauauaauugggcaacggauugagaauauuaaaaacgaacauaaauccacauggcauuacgaugaagauaacccuuauaaaaccugggcauaccaugguucauaugagguaaagccuaguggcucugccuccucuaugguaaauggaguuguacgcuugcucacaaaaccaugggauguuauuccaaugguaacacaaaucgcaaugacagauacuacaccauucggucaacaacgaguguuuaaggaaaaagucgacacccggacuccgcgggcuaaaaggggcacaacucaaaucauggaaguaacagcuaaauggcucugggguuucuuaagucgaaauaagaaaccacgaauaugcacaagggaggaguucacucggaaaguacgaucgaacgcagcuaucggggcaguuuuuguugacgaaaaccaguggaacagcgcaaaagaagcaguugaagacgaaagauucugggaccuaguacaucgugaaagagaauuacauaagcaaggcaaaugcgcaacuuguguauauaauaugaugggcaaaagagagaagaaacugggcgaauuuggaaaagcuaaaggaaguagggcaaucugguacaugugguuaggagcccguuuccuugaguuugaagcgcuuggcuucaugaacgaggaucacugguucucacgggaaaacagucuaagugguguggaaggugaaggucugcacaaauugggauacaucuugagagauauaucuaaaauuccagguggaaacauguaugcggaugauacagccggcugggacacucggauaaccgaagacgauuugcaaaacgaagcuaaaauaacagacauuauggaaccagaacaugcccuacuagcuacaucaauauucaaacucacguaccaaaacaaagugguacguguacaacguccugcgaaaaaugggacgguaauggauguaauaucaaggagagaccaaagaggcucagggcagguagguacuuacgggcucaauacauuuacgaauauggaagugcaacuaauaagacaaauggagagugaagguaucuuccuaccuucagaauuagaaacaccgaacuuagcugaacgcguacuagauugguuggaaaaacacggagcggaaagacucaaaagaauggcgauaagcggagaugacugcguagucaaaccaaucgacgauagauuugcgaccgcacugacagcacuaaacgacauggggaaggugagaaaggauauaccacaaugggaaccaucuaaggguuggaaugacuggcaacaaguuccuuuuuguagccaucauuuccaucaacucauaaugaaagacggacgugaaaucguaguccccugccgaaaucaggaugagcuaguaggucgagcacgagugucccaaggggcgggauggagccuacgagagacggcgugucuaggcaaaucauaugcccaaauguggcaacuaauguacuuccauaggagagauuugcgucuagccgcaaacgcaauaugcucagcaguaccuguagauuggguuccaacgagucggacaacuuggucgauacacgcucaccaccaauggaugaccaccgaggauauguuaucugucuggaauagaguauggauagaagaaaauccauggauggaagauaaaacgcauguaucaucuugggaagagguaccuuaucucgggaaacgagaagaucaaugguguggaucuuuaaucggacuaacggcuagggcgacaugggcgacuaauauccaaguggcaauaaaccaaguuagacguuugauaggaaaugagaacuauuuagacuauaugaccucaaugaagagauuuaaaaaugaaagcgauccugaaggcgcauuaugguga

SEQ ID NO: 21343 - RNA, 9879 nt, Artificial Sequence
  derived and/or modified CDS sequence (opt6) from DENV-1__KF973472__SS-prME
agugugacaaugcuucuaaugcuacucccuacugcauuagcauuucaucucaccacgcgagggggcgaaccacauaugauuguuucaaaacacgaaagagggaaaucgcuacuauuuaaaacaaguacagggguuaauaugugcacauuaauugcuauggauuuaggcgaacugugugaagauacuaugacuuacaaauguccacgcauaaccgaagcagaaccugaugacguggauuguugguguaaugcaacugacacgugggucacauacgguaccuguucucaaacuggugaacauaggcgcgauaaaagaucgguugcucuagcaccacauguuggccucggguuagaaacaagaacggaaacauggaugaguucagaaggcgcauggaaacaaauccaacguguggaaacaugggcucuacgacauccaggguuuacgguaauagcacuauuccuugcacacgccauaggaacauccauuacucaaaaaggaauaauauucauuuuacuaaugcucgucaccccuucuauggcuaugagauguguaggaauaggaaaucgcgauuucguugaaggacuaucuggugcgaccuggguugauguaguacuagaacauggcuccugcguaacuacgauggcgaaaaauaaacccacccuggauaucgaauuacuuaaaacagaagucacuaacccggccguacuuagaaaacuauguauugaagcgaaaauuagcaauaccacaacugacucaagaugcccaacacaaggagaagcuacucuaguggaagaacaggaugccaauuucguauguagaagaacgcuaguugacagaggaugggggaaugguuguggacuuuuuggaaaaggaucauuguuaacaugcgcaaaauucaaaugugugacaaaacuagagggaaagaucguucaauaugaaaaccugaaauauucagucauaguaacgguacauacuggcgaccaacaccaaguaggaaaugaaacaacggaacacggcaccauagccacuauuacaccgcaggcaccgacgagcgaaauccagcugacagauuauggcgcucuagcauuagauugcucgccuagaacaggccucgauuucaaugaaaugguacuauuaacgaugaaggagaaaagcugguugguucacaagcagugguuuuuggaccugccauuaccguggacuucaggagccagcacaucucaagagacguggaaccggcaagaccucuuaguuacauuuaaaacugcucacgcaaagaaacaagaaguaguuguccuaggaucacaggaaggggcgaugcacacagcacuaacgggugcaacugaaauccagacaucgggaacuacuacuauuuucgccggacauuuaaaaugcagauuaaaaauggauaaacuuacacucaaaggcaccaguuacguaaugugcacuggaaguuuuaagcuggagaaagaaguugcagaaacacaacacggaaccguacugguucaaguaaaauaugaagggacugacgcacccuguaaaauaccguuuucaacacaagaugaaaagggcguaacacaaaauggacgccucauaaccgccaacccaauaguaacagauaaagaaaagccaguaaacauugagacugaaccgcccuuuggagaaucauauauuguaguaggagcaggagaaaaagcucuaaaacugucgugguuuaagaaaggaucuucuauugguaaaauguuugaggcuacagcgcguggagcccgacguauggcuauucuaggugacacugccugggauuuuggaucaauaggagguguauucacgucgguagguaaguuaguccaucaaguguuugguacagccuacggggugcuauucuccggaguaucauggaccaugaaaauuggaauaggaauacuguugacaugguuaggacuuaauagcagaucaacaucgcugucaguuacaugcauugcagucggcaugguuacauuauaucuagguguaaugguccaagcugauagugguugcguaaucaauuggaaaggaagggagcucaaauguggaucagguauauuuguuacaaacgaagugcacacuuggacagagcaauauaaauuucaggcagauucaccgaagaggcuuagcgcugcuauagggaaagcaugggaagaagguguaugcggaauacguagugcaacgagacuagagaauauaauguggaagcaaauuucaaacgaacucaaccauauuuugcuugaaaaugauaugaaauuuaccguaguuguaggggacgcgaacgggauuuuagcacaggggaagaaaaugauacgaccucaaccgauggagcauaaauacucuuggaagucguggggcaaagcaaagaucaucggagcagacauccaaaauacuacauucauaauagauggaccugauacaccugaaugcccugacgaucaacgcgcuuggaacauaugggaaguugaagacuacggauuuggaauuuucacaacuaauaucuggcugaaacuaagggauucuuauacgcaaaugugcgaucaucgacugaugucugcagcaauuaaggacaguaaagcaguccaugcggauaugggauauuggauugaaucagagaaaaaugaaacuuggaaguuggcuagagcuaguuuuauagaaguaaaaacauguacguggccuaaaagccauacguuauggaguaaugguguccuugaaagugaaaugauuauaccaaaaaucuauggaggcccaauaucacagcacaauuauaggccugguuauuuuacacaaacugcagggccuuggcaucuaggaaaacuagaauuagauuuugaccuaugugaaggcacaacugucguuguagacgagcacugcgguaaucguggaccgaguuuacgaacuacaacaguuacaggaaagaucauccacgaauggugcugcaggagcuguaccuugccgccccugagauuccggggcgaagacgguuguugguauggaauggagauaagaccgguaaaagaaaaggaagaaaacuugguacgaucaaugguuagcgcugggaguggugaggucgauucuuucaguuuagguauacuuuguguaaguauuaugauagaagaaguuaugaggucccgauggucacgaaagaugcucaugaccgguacgcuagcaguuuuccuguugcuaaucauggggcaauuaacguggaaugaccuaauuagauuaugcauuaugguuggcgcaaacgccuccgauagaaugggaaugggcacaacguauuuagcucugauggcuaccuuuaaauuacgaccgauguuugcaguuggaauacucuuccguagauuaacaucgagagagguucuuuuauuaacaauaggucugagucuuguugcaucaguagaacuacccaauucauuagaggaauuaggugacggacuagcaaugggcauaaugaugcuuaaacuccuaacagaauuucagccacaucaguuauggacaacguuauuaagccuaaccuuuauaaggacaacacucucuuuagauuaugcuuggaagacgaccgcaauggcguuaagcauaguaucuuuguucccccuauguuuaaguacaacuucccagaaaacaacgugguuaccgguguuacucggauccuuuggguguaaaccauuaacaauguauuuuauaacggaaaacaaaauuuggggacgaaagucauggccgauaaacgaaggaauaauggcaauaggcauugugaguauacuacuauccaguuuacuuaaaaacgaugucccacuggcugguccucuuauagcgggugggaugcuaauugcauguuacgugauaucaggaaguagugcggacuuaucucuagaaaaagcugcggaaguauccugggagcaagaagcagaacauaguggcacaucgcauaacauacucguugaaguuagagacgauggaaccaugagaauaaaagaugaggaaaaggacgauacacuuacgauauugcugaaagcaacuuuacuagccguaagugguguguauccaaugaguauuccagcaacguuauucgugugguauuuuuggcagaagaagaaacaaagaucagguguauugugggauacuccuagcccaccugagguagaaagagcaguguuggaugauggaauuuauaggauauuacaaaggggacuucucgggagaagucagguugggguaggaguuuuccaggacggcgucuuccauacaauguggcauguuaccagaggggcaguauuaauguaccagggcaaaagacuugaaccgucuugggccagcguuaagaaagaucucauaagcuacggcggaggcuggcgcuuucaggggucauggaauacaggcgaggaaguucagguaauugccguagaaccagggaagaacccuaagaacguacagacuacacccgguacauucaaaacaccagaaggcgaaguaggagcaauagcauuagauuucaaaccagguacaucagguucacccauaguuaacagggaaggaaaaauagugggauuauaugggaacggcguagucacaacaaguggaacauaugugucugccauugcccaagcuaaagcgagucaggaggguccguugcccgaaauagaagaugaaguuuucaaaaagcggaauuuaacaauaauggaccuacacccagguucagguaaaacgagaagauaucuuccagcuauugucagggaggcaaucaaaagaaaacuucggacuuuaauacucgcaccaacaagaguuguugcaagcgagauggcggaggcucuaaaagguaugccuauacgguaucagacgacggcaguaaagucggaacacacaggacgagagaucguagaccuaaugugucacgcaacauucacaaugagauuacucucaccaguuagaguucccaauuauaauaugauaauaauggaugaagcacacuucacugacccagcgucaaucgccgcccgcggcuacauuaguacaagaguugguaugggugaggcggcugcaauauucaugacugccacuccucccggaucuguugaagcauuuccucagucuaacgcgguuauacaagaugaggaaagagauauacccgaacguagcuggaacucaggauacgacuggaucacagauuuucccgguaaaacuguaugguuuguccccagcauaaagagcgguaacgauauugcuaacuguuuaagaaagaauggaaaacgagugauacagcucagucguaaaacauuugauacggaauaccagaaaacaaagaauaacgauugggacuaugucguaacaacugauauaucugagaugggagcuaauuuuagagcggauaggguaauagacccaagacgaugccuaaagccuguuauauugaaggacgguccugaacgagucauacuagcuggacccaugccaguuacgguagcaucugcagcucaaagacgagguaggaucggaaggaaccaaaauaaagaaggugaccaauacguauauaugggucaaccgcuuaacaacgaugaggaucaugcacauuggacagaagcuaaaauguuacuagauaacauaaauaccccugaaggcaucauaccagcccucuuugagccagaaagagagaagucggcugccauugauggagaauaucguuugcggggagaggcaaggaaaacguuuguagaacuuaugagaagaggagacuugccagucugguuaaguuauaaaguugcgagcgaagguuuucaauacucagaucgaaggugguguuucgacggugaaagaaauaaucaaguguuagaagagaacauggacguagaaauauggaccaaggaaggagaacguaagaaauuaaggccccgcuggcuugaugcgcgcacuuauucagauccacucgcucucagggaguucaaagaguuugcagcggguaggagaagcguuagcggggaucucauucucgaaauaggaaaauugccucaacauuuaacacuaagagcucaaaacgcucuugacaaucuaguaauguuacauaacucagagcaaggcggaaaggcuuacagacacgcgauggaggagcuaccagauacgauugaaacguuaaugcuauuagccuuaauagcuguguuaacaggcggagugacucuauuuuucuuaucggguaaagggcuaggaaagacgucaauugguuuacuauguguaacagccucgagugccuuacuauggauggcaaguguugagccucacuggauugcugcaucaaucauacuagaguucuuucugaugguacuacuuauaccagaaccugaucgucagagaacaccucaggauaaccaauuagcuuacgugguuauaggauuacuauucaugauacugacugucgccgcuaacgaaauggguuuguuggaaacaacaaaaagagacuuaggaaucggacauguagcugcagagaaucaucaacaugcuaccauguuagauguagaucucagaccagccucagccuggacauuguaugcaguagcaacgacaguaauuacgccuaugaugcgacauacaaucgagaauacuacagcgaacauaagccuaacggcuauagcaaaucaagcagccauauuaaugggauuagauaaagguuggccaauaagcaaaauggacauaggaguaccuuuauuggcauugggaugcuacagccaagugaacccuuuaacccuuacggcggccguacugauguugguggcacacuaugcuauaauaggaccaggauuacaagcaaaagcgacccgggaggcacagaagcgaacugcugcggguauaaugaagaacccgacaguugacggaauuguagcaaucgacuuggacccaguuguauacgacgccaaauuugaaaaacaauuaggacagauaaugcuuuuaauucuuuguacgucucaaauauuacuaaugaggacuacgugggcauuaugugagaguauaacacuggcgacggguccauuaacuacacucugggaaggcucgccugguaaauuuuggaacacaacaauagcaguguccauggcgaauauuuuuagggguuccuaucuagccggugcuggacuugccuuuaguuuaaugaaaucacuuggagguggcaggagaggaacuggugcccaaggagaaacacuuggugaaaaguggaaacgacaacuaaaucagcucucgaaaccagaguucaacacauacaaacgaagugggauuauggaaguagacaggucagaagccaaagaaggauuaaaacgaggagaaacgacaaaacacgcagucagucguggaacagccaaacuucguugguuuguagagcgaaaucuagucaaaccagaaggcaagguaaucgaccuagggugcggcagaggaggcuggaguuacuacugugcugggcuuaagaaaguuacagaagucaaaggauacacaaaagggggcccgggacaugaagaaccuauuccaauggcaaccuauggauggaaucucgucaaacuucauucagggaaggauguguucuuuaugccaccugagaagugugacacccuuuuaugugauauaggagaaagcagcccaaauccaacuauugaagaagguagaacucuucgcguauuaaaaaugguagagccauggcuccgaggaaaucaauuuugcauaaaaauauuaaacccuuacaugccuagugucguagaaacacuugaacaaaugcagagaaaacacggaggaaugcuaguaagaaacccucuaucaagaaauucaacacaugaaauguacuggguuucaugcgggacuggcaauaucgugucagcaguaaacaugacaucucgaauguuacucaaucgguucacaauggcacaucgaaaaccgacguaugaaagagauguugaccuaggcgccgguacacgacauguagcaguggagccagaaguagccaaccucgacauuaucggacaaagaauagagaauauaaagaacgaacauaagagcacauggcauuaugacgaggacaaccccuauaaaacuugggcuuaucauggaaguuaugaaguaaaaccaucugguagcgccucaucaauggucaauggcgugguacgcuuacuuacaaaaccgugggauguaauaccuaugguaacgcaaauagcaaugaccgacacaacaccuuucggucaacaaagaguauuuaaagagaaaguagauacuagaaccccuagagcaaaacgcggcacgacucaaauaauggaagugaccgcaaaaugguuauggggguuuuuaucucguaauaagaaaccucgaauuuguacaagagaggaguuuacacgcaaagugcgaagcaaugcagcuaucggcgcaguguuuguagaugagaaccaguggaauagugcgaaggaagcaguagaggacgaaagguucugggaucuuguccacagggagcgagaacugcauaaacaagggaagugcgcuacuugcguauacaacaugauggguaaacgagaaaagaaacuaggugaauuuggaaaagcuaaaggaagucgcgcaaucugguauauguggcugggugcaagguuucuugaguuugaggcacucggauucaugaaugaggaucauugguuuucccgagagaacucuuuaagcggaguagaaggagagggauugcauaagcuaggguauaucuuaagagauauuaguaagauaccuggagggaauauguaugcagaugacacagcaggaugggauaccagaauaacagaggaugaucuucaaaaugaggcuaaaauuacggauauuauggaaccagaacaugcucuacuggcgaccucaaucuuuaaacuaacguaucaaaauaaaguuguuagaguacagaggcccgccaaaaacggcacaguuauggacguaauaagcagacgagaucaaagagggagcggacaaguuggaacauacggguuaaauacauucacaaauauggaagugcaacuaauaagacaaauggagagcgaaggcauauuucuaccaucagaacuagaaacuccuaauuuggcagaaagaguauuagacuggcuagagaaacacggcgcugagagacuuaagagaauggcuauuucuggggacgauuguguuguaaaaccuauagaugaccguuuugccacagcucuaacugcacugaaugacaugggcaagguaaggaaggacaucccccaaugggaaccaagcaaaggcuggaacgauuggcaacaaguaccguuuugcucgcaucauuuucaucaauugaucaugaaggauggcagggaaaucguaguucccugcagaaaucaggaugagcuaguuggacgcgcccguguaagucaaggugcgggguggucacuccgcgaaacugcuuguuuaggaaagaguuacgcacaaauguggcaacuuauguauuuucacaggagagaucuaaggcuugcagcaaaugcaaucuguuccgcagucccgguagauuggguuccaacaaguagaacaacauggucaauucaugcccaucaucaauggaugacgaccgaagacauguuaucgguauggaaucgaguguggauagaggaaaauccuuggauggaagauaaaacacauguaaguucaugggaagagguaccguaccuuggaaaaagggaagaucaauggugcggaucauugaucggccuaacagcgagagcaacaugggcaacuaacauucaaguagcaauuaaucaaguaagaagacuaauaggaaacgagucauaucucgauuacaugacuuccaugaaaagauucaaaaaugaaagugauccagaaggagcacuaugguaa

SEQ ID NO: 21344 - RNA, 9879 nt, Artificial Sequence
  derived and/or modified CDS sequence (opt6) from DENV-1__KF973474__SS-prME
ucuguuacuauguuacucauguuacuaccaacugcgcuagcuuuucaucuaaccacuagagggggagaaccgcauaugauaguaagcaaacaugagaggggaaaauccuuguuauuuaaaacaucaacagggguuaauauguguacacuaauugcaauggauuuaggagaauugugugaagacaccaugaccuauaaauguccacgcauuacugaagcagaaccggaugauguugacugcugguguaaugcaacugauacauggguaacauacggcacgugcagucagaccggagaacauaggagagacaaacgaucuguugcguuagcgccgcacguaggacuagguuuggagacgagaacggaaacauggaugagcagcgaaggagcauggaaacaaauacagcgaguugaaacaugggcacuuagacauccugguuuuacaguuauugcauuguuuuuggcucaugcaauuggaacuucaauuacacagaaaggaauuauuuuuauucugcucaugcucguaacaccuucuauggccaugcguuguguagggauuggaaaucgagauuuuguagagggccuaucaggugccacaugggucgaugugguccucgaacacgggucaugcgugaccaccauggccaaaaacaaacccacacuagauauagaacuauuaaaaaccgagguaacuaauccagcaguucuacguaaacuauguaucgaagcgaaaaucagcaacacaacuacagauagccguugucccacacagggugaagccacucuuguggaagaacaagaugcaaacuucguuugucgucgaacucuaguugauagagggugggguaacggauguggacucuuugggaaaggcucgcuauuaaccugcgcaaaauuuaaauguguaaccaaacuggaaggaaaaauaguucaauaugagaaccucaaauauagcgucaucguaacaguccacacuggggaucaacaucaagucgggaaugaaacgacagaacauggaacuauagcaacgauuacuccacaggcuccuacaucugaaauacaacugacugacuacggagcccuugcucucgacugcagcccuagaacgggccuagauuucaaugaaaugguucuauugacaaugaaagaaaaaucauggcuugugcauaaacaaugguucuuggaucuuccucuaccauggacgucuggagcaucaacaucacaagaaacauggaaucgucaggacuuacuugugacguucaaaacagcacaugcuaagaaacaagaagugguaguccuuggaucacaagaaggagccaugcacacugcccuuacaggugcaacggaaauucaaacaucgggaacaacuaccauauuugcagggcaccucaaauguagguuaaaaauggauaaacuuacgcuuaaagguaccaguuauguaaugugcacuggaucguucaaacuagaaaaagaaguugcagaaacacaacauggcaccguauuaguacaaguaaaauaugagggcacagaugcacccuguaaaaucccauuuucuacgcaagaugaaaaaggugucacacaaaauggcagauugaucacagcaaauccaauaguaacagauaaagaaaaaccuguaaauauagaaaccgagccacccuuuggggaaagcuacauuguaguaggugcgggugaaaaggcacuaaaauuaagcugguuuaagaaagguucuaguauuggaaaaauguucgaagcgacggcaagaggugcccguagaauggcuauauugggcgauacggcaugggauuuuggcucaauaggcggaguuuuuacgagugugggaaaauuaguucaucaaguauuuggcacagcauacgggguucucuucuccggggugucguggacaaugaaaauuggcauuggaauccuacuaacauggcuugguuugaauagcaggaguacaagccuaucuaugaccugcauagcuguaggaauggucacacuauaucuaggaguaaugguucaggcagauucgggaugcgugauuaauuggaaaggucgggaauuaaaaugcgguucaggaaucuuuguuaccaacgaaguacauacguggacugagcaguauaaguuucaagcugacuccccuaagcgucuaagcgcugcaauaggaaaggcaugggaagaaggagugugugguauuagauccgcuacacggcuagagaacaucauguggaaacaaauaucuaaugagcuaaaucauauuuuacuggagaacgauaugaaauucacagucgugguaggggaugcuaauggaauauuagcucaaggcaagaaaaugauccggccgcaacccauggaacauaaauacaguuggaaaaguuggggaaaggcaaaaauaauaggugcagacauucagaauacaacauuuauaauagacggaccugacacuccugaaugucccgaugaucaacgggcuuggaauauaugggaaguggaagacuauggcuucggcauuuucacuacuaauauaugguuaaaacuaagagauagcuauacacagaugugugaucaccguuugaugagugcggcaauuaaggacucaaaagcuguccacgccgauauggguuauuggauugaaagugagaagaacgaaacauggaaauuagcaagggcuucauuuauugagguaaaaacuuguacuuggccaaaaucacacacucuuuggaguaacggggucuuagagagugagaugauaauaccuaaaauauacggcgggccaauuucgcaacacaauuacaggccuggcuauuucacacaaacugcaggaccauggcaucuaggcaaguuagaguuagauuucgaucuuugcgaaggaacuaccguaguuguugaugaacacugcgguaaucgagguccaucguugcguaccacgaccgugaccggaaaaauaauacaugaguggugcugccgaagcuguacuuuaccaccacuaagauuucgaggagaagacggaugcugguauggaauggagauaaggccaguaaaagaaaaagaagagaauuuaguucgaucaaugguuucggccggaagcggugaaguugauucauuuucauuagguaucuugugcgucucaaucaugauugaagaagucaugaggaguagauggucaagaaaaaugcucaugacuggcacacuagcaguguucuugcuacuaauaaugggccaacuaacguggaaugauuugauacgccuaugcauaaugguaggagcgaaugcuucagaccggauggguaugggcacgacauaccuagcucucauggcuacuuuuaaacuucggccaauguuugcaguaggcauacuauuucgaagauuaacaucaagagagguauuauuguuaacuauuggacuaucguuaguagcgucgguagagcuaccgaacucguuggaagaacuuggagaugggcuggcgaugggaaucaugauguugaaacugcuaacagaauuucaaccacaccaauuguggacaacguuauuaaguuuaacguucauaaaaacuacauuaagucucgauuaugcuuggaaaacaacagccauggcuuuauccaucgugucacuguucccacuaugcuugucaacaacgagucagaaaaccacauggcuacccgugcuauuagguucauucgguuguaagccuuuaacaauguaccuuaucaccgagaauaagaucuggggacgaaaaucuuggccgauaaaugaaggaauuauggcgauaggaaucguaucaauauuguuaucaucacuauuaaagaacgaugucccacuagcaggaccauugauagcaggagggaugcuaauagcuugcuauguuauaucaggaaguagugccgaccugagcuuagaaaaggcagcugagguuaguugggaacaagaagcagaacacucuggaacaucgcauaauauucuagucgaggugcaggacgaugguacaaugcgaauaaaagaugaggaaaaagacgauacccugacuauauuauuaaaagcaacauugcuugccguuagugguguguauccaauguccaucccagcuacacuuuucguaugguacuuuuggcagaagaagaaacaacgguccgguguccuuugggauacccccaguccaccggaaguugaacgcgcaguacuggaugauggaauuuaucguauauuacagagaggauuauuaggaagaucccagguuggaguaggcgucuuccaagacggaguauuucacacgauguggcacguuaccagaggggcgguguuaauguaccagggcaaacguuuagaaccaucaugggccagcguuaagaaagaccuuaucaguuacggggguggauggagguuucagggaagcuggaacacaggcgaagaaguucagguaauugcaguagaacccgguaagaauccgaaaaauguacagacaacgccugggacuuucaaaaccccggaaggggagguaggugcuaucgcauuggauuuuaaaccggguacaagcggaucacccauugugaacagagaagguaagauaguugggcuauauggaaacggaguaguaacaaccuccgguacuuauguaucagccauagcgcaagccaaagcaagccaagaagguccacucccggaaauugaagaugaggucuuuaagaagagaaacuuaacaauaauggacuuacauccagguuccgggaagacaaggagguauuuaccugccaucgugagagaagcaauaaaacgaaaacuaagaacguugauccuggcgccaaccaggguagucgcuucggaaauggcagaggcccuuaagggaaugccaguaagauaucaaaccacagccguuaaaagcgaacauacuggaagagaaauaguagauuuaaugugucaugcgacguucacuaugcguuuacucucgccaguccgaguuccgaauuauaacaugauaauaauggacgaggcucauuucacggauccagcgagcauagcggcucgagguuauauaaguacacgaguuggaaugggggaggcggccgcaauuuuuaugaccgcgacuccgccuggaucuguggaagcauuuccucaaucaaacgcuguaauacaagaugaagaacgggacauaccagaaaggucauggaacucaggcuaugacuggauaacugauuucccggggaagaccgugugguucguaccgucuauaaaaucaggcaaugacaucgcuaacugcuuaaggaaaaacggaaaacgaguuauacaguuaaguaggaaaacauuugacacagaauaucagaaaacuaagaacaaugauugggauuaugucguaacuaccgacauaagugaaaugggggcgaauuuccgagcugaucguguuaucgaucccagaagaugcuuaaagccagucauauuaaaagauggucccgagcgaguaauuuuagccggccccaugccuguaacaguagcauccgcagcucagagacgggguagaaucgggcgaaaucaaaauaaagaaggugaucaauacguauacaugggacagccguuaaauaacgaugaggaucaugcacacuggacagaagccaaaaugcuucuggacaauauuaacacgccugaagggauaauaccugcccuauuugagccugaaagggaaaaaucugccgcgauagacggugaauauagauuaagaggugaggcaagaaaaaccuuuguggaacucaugcgaaggggugacuuaccaguaugguuaagcuacaaagucgcaagugaaggauuccaauacagcgaccgaagguggugcuucgacggugaaagaaauaaccaaguccuggaagagaacauggauguagaaaucuggacaaaggaaggugaacgaaagaaacugcgaccuagauggcuagaugcaagaacuuacucggacccacuugcacuaagagaauuuaaggaguuugcugcaggccguagauccguuucaggcgacuuaauacuggaaaucggaaaacuaccgcaacaucuaacguuacgugcucaaaacgcuuuagauaaccuaguaaugcuucauaacagugaacaagggggcaaggcuuacaggcaugcuauggaagaguugccggacacaauugaaacgcuaauguuauuagcacugauagcaguuuugacugguggagugacauuauucuuucuaucugguaagggacuaggcaaaacaucgauaggauuacucugcguuaccgcuucaucagcgcuccuauggauggcauccguggaaccucacuggauagcggcaaguauaauauuagaauuuuucuuaauggucuuauuaauuccagaaccagacagacaaaggaccccucaagacaaccaauuagccuauguuguaaucggucuucucuuuaugauauuaacgguggcagcaaacgaaaugggguuguuggaaacgacaaagagagauuugggaaucggacauguggcagcagaaaaccaucaacacgccacaauguuagauguggaccuuagaccugcgucagcauggacucuauaugcaguugcaacaaccgucauaaccccaaugaugaggcacacgaucgaaaacacaacggcaaauauauccuuaacugcuauagccaaucaagcagccauccugauggggcuagacaaaggcuggcccauaucaaagauggauauaggugucccucucuuggcauuagguugcuacucgcaagugaauccguugacccuaacagcagccguauugaugcuuguagcgcacuacgcuauaauagggccaggguuacaagccaaggcaacaagagaggcgcaaaaacggacagccgcgggaauuaugaaaaauccaacaguagacggaauaguagcuaucgaucuagaccccguuguauaugacgcuaaauuugaaaagcaacuagggcaaauuaugcuauugauucuauguacaucucaaauucuccuuaugcguacuacaugggcccuaugugagucuauaacucuagcgacuggaccgcucaccacguuaugggagggaagucccggaaaguuuuggaacacaacuauugcaguaagcauggcgaacauauuuagaggauccuacuuagcaggagcuggucuagcauuuucgcuuaugaagucuuuaggcggaggacgucgaggaacgggagcgcaaggcgagacgcucggagaaaaauggaaaagacagcuuaaccaauuaucaaagcccgaauuuaauacuuacaaacguagcggcauaauggaggucgaccggucagaagcuaaagaagggcuaaagagaggggaaaccacuaagcacgcuguuucacguggaacugccaaguugagaugguucgucgagcgcaacuuaguuaaaccggaaggaaaaguuauugacuuaggaugcgguagagguggguggucuuauuacugugcaggucuuaagaaggucaccgaagugaaagguuauacaaaaggcgguccuggacaugaagaaccaauacccauggccacuuacggcuggaaucuuguaaaacuacacucagguaaagaugucuuuuucaugccgccggaaaagugugacacucucuugugcgauauaggugaauccucaccaaauccaacuauagaagaaggucgaacauuacgggucuugaaaauggucgaaccaugguuacgaggcaaccaguuuuguaucaagaucuuaaauccauauaugccuucuguugucgagacgcuagaacaaaugcaacguaaacauggaggaauguugguaaggaauccauuaaguagaaauucuacacaugagauguauuggguaagcugcggaacagguaacauuguuucugcaguaaacaugacuagccgaauguuauuaaauagauuuacaauggcgcaucguaaaccaacuuaugaaagagauguagaucuaggagcgggcacuagacacguaacgguagaacccgaagucgcaaaccuugacauaauaggccagcguaucgaaaacauuaagaacgagcacaaaucgacauggcacuacgaugaagauaauccguauaaaaccugggcauaucacggaagcuaugaaguaaaaccaucagguagcgcgucaucaaugguaaauggcgugguuagacuucuaacuaaaccaugggaugugauaccaauggugacccaaauagcaaugacagacacgacuccguuuggucaacaaagaguauucaaggaaaagguugacacgaggacgccuagggcaaagaggggcacuacacagauaauggaaguaaccgccaaaugguuaugggguuuucuaucuagaaauaagaaacccagaaucuguacaagggaggaguucaccagaaaagucagaagcaaugccgcaauuggagcgguuuucguggacgaaaaccaauggaauagcgcaaaagaagcgguggaagacgaacguuuuugggaucugguacaccgcgaacgagaauugcauaaacaaggaaaaugugcuaccuguguguauaauaugauggguaagagggagaagaaauuaggugaauuuggaaaggcuaagggaagccgagcaaucugguauaugugguugggugcgcguuuccuagaguucgaggcacucggauucaugaacgaggaucauugguuuucgagagaaaacagccucagugggguugagggggaagggcuccauaaacucgguuacauccuuagggacaucucaaaaauuccgggaggaaauauguaugcugaugauacagcggguugggauaccagaauaaccgaagaugauuuacagaacgaagcuaagauaacagacauuauggaacccgaacacgcacuucuugcgacaagcauuuucaaacucacuuaccaaaacaaaguaguuagagugcaaagacccgccaaaaaugggacaguuauggacgugauuuccagaagggaucagcgaggcucugggcaagugggaacauauggguugaauacuuucaccaauauggaaguacaauugauuagacagauggaguccgaaggaauauuuuuaccuucagaauuagagacccccaaucuagcagagagaguuuuagacuggcuagagaaacauggagcagaacgguuaaaaagaauggccaucucuggugaugacugugugguuaaaccgauugacgacagauuugcaacagcuuuaaccgcccuuaacgauauggguaagguaagaaaagauauuccgcaaugggaaccaucuaaagguuggaaugauuggcaacaaguuccuuucuguucacaccacuuucaccaauugauuaugaaggauggaagagaaauagugguuccaugccguaaucaagacgaacucguuggaagggccaggguaagccagggagccggauggagucucagagaaaccgcgugccuaggaaaaaguuaugcacaaauguggcaauuaauguacuuucaucggagagauuuacgacuagcugcuaacgcaaucugcucagccguucccguagacugggucccgacaucacgaacaacuuggagcauacaugcacaucaucaauggaugaccacagaagacaugcuuagugucuggaaccguguauggaucgaagaaaacccguggauggaagauaaaacucacguaaguucgugggaggaaguuccguaucuagggaaacgagaagaccaauggugugguaguuuaauaggauuaacagcaagagcaacgugggcuacaaacauccaaguagcaauuaaccaaguaagaagacucaucgguaacgaaaacuaucuugauuauaugacuagcaugaaaagguuuaagaacgaaucugacccugaaggagcacugugguga

SEQ ID NO: 21345 - RNA, 9879 nt, Artificial Sequence
  derived and/or modified CDS sequence (opt6) from DENV-1__KF973475__SS-prME
ucagugacuaugcuccucaugcuuaugccaacagcuuuggcauuucaucuuacgacgcgaggaggugaaccacacaugauaguaucuaaacaugaacgaggaaaagcguuacucuuuaaaacgucuacuggugugaauaugugcacuuuaauagccauggaccuaggagaacuuugcgaagacacaaugacauacaaauguccacguauaacagaagcugaaccagaugacguagacuguugguguaaugcaacugauacaugggugacauauggaacauguucacaaacuggggaacauagacgggacaaacgaaguguugcccuggccccacacguagguuuaggacucgaaacacgcaccgagaccuggaugucgagcgagggagcauggaaacaaauacaacgagucgaaaccugggccuuacggcauccaggauuuacaguuauagcuuuauuuuuagcacacgccaucgggacaucaauuacucaaaaaggaauaauauucauucuguuaauguuaguaacgccuucuauggcuaugagaugcguaggcaucgggaacagagacuuuguugagggccucaguggggccacaugggucgauguuguccucgaacauggcuccugcguuacuacgauggcuaaaaacaaaccuaccuuagauaucgaacuguuaaaaaccgaagugacaaacccggccguucuaaggaaauuaugcauagaagcgaaaauaucaaauacuacgacugacucacgguguccuacacaaggugaagcuacuuuagucgaggaacaagacgcuaauuucguaugucgcaggacauuuguagauagaggcugggggaacggauguggucuauuuggaaaaggaucacucuuaacuugcgccaaauuuaaaugugugacuaaacuagaaggaaaaauuguacaauacgaaaacuugaaauacagugucauaguaacaguucacaccggggaucaacaccaaguagggaacgaaacaacugaacaugguacgauugcaacgaucacuccucaagccccaacgucagaaauacaauugacggacuauggagccuuaacgcuugacugcuccccuagaacagguuuagacuucaaugaaaugguacuucucaccaugaaagagaaaucauggcuuguccacaaacaaugguuuuuagaucuaccauugccauggacaucgggcgcuagcacaucucaagagacauggaaucgacaagacuuauuaguaaccuuuaaaacagcacaugccaagaaacaagagguaguaguauuaggaucacaggaaggggcuaugcacacagcacuuacuggggcaacugaaauucagacgagugggacuacaacgauuuuugcgggacaucuaaaaugucgauuaaaaauggauaaacuuacauugaaaggcacaucuuacgugauguguaccggauccuuuaaacuagagaaggaaguugcagaaacgcaacaugguaccguccuaguacaaguaaaauaugaggggaccgacgcacccuguaaaauaccguucuccacacaagaugaaaaaggaguuacacaaaacggucgguuaaucacagcaaauccgauaguuacagauaaagaaaaaccuguaaauauagagacugagccgccuuucggcgaaagcuauauaguagucggagcgggugaaaaggcgcuuaaacuaagcugguuuaagaaaggguccucaauaggaaaaauguuugaagcaacagcgcgaggggcaaggagaauggccauucuaggggauaccgcgugggauuuugguucuauuggaggggucuucacuagcguaggaaaauugguacaccaaguuuucggcacagcuuacgguguacuguucuccggaguuaguuggacuaugaaaauuggaauuggaauauuauuaacauggcuagguuuaaauucgcgcucaaccucacuuucaaugacaugcauagcuguaggcauggucaccuuguaucuugguguaaugguccaggccgauagcggguguguuauaaacuggaaaggacgagaauuaaaaugcgguagcggaauuuucgucacgaaugaaguacauacauggacagaacaauauaaauuucaggcagacuccccaaagcgucugagugcugcgauaggcaaagcaugggaagaaggaguuugcggcauccggucagcaacgcgucuugaaaacauaauguggaaacaaauaagcaacgaguuaaaucauauauuacuugaaaacgggaugaaauuuacagucguuguaggagaugcuaacggcauucuagcucaaggcaagaaaaugauacgaccacaacccauggagcacaaauauucauggaaaaguuggggaaaagcgaaaaucauaggggcagauauucagaacacaacguuuauuauugauggacccgauacacccgaaugcccggaugaccagagagcuuggaacauuugggaaguggaagauuauggcuucggaauuuuuacuacuaauauauggcucaaacugcgagacagcuauacccaaaugugcgaccaccgauuaaugagugcagcuauuaaagauucgaaagccguccacgcagauaugggcuauuggauagagagugaaaagaaugaaaccuggaaacuagccagagcaucuuuuauagaagucaaaacuugcacuuggccgaaaucgcauacacuguggaguaaugguguucuagagucggagaugauaauacccaaaauauauggaggaccuauaucacaacacaauuaucgucccggauauuuuacucagacagcaggcccguggcauuuaggaaaauuagaacuugauuucgaucucugugagggaacaacagugguuguugaugaacauugcggaaauagagguccuagucuuagaacuacaacaguaacgggaaaaauuauacaugaauggugcuguagguccuguacuuugccuccuuuacgauuucgaggggaagaugguuguugguacggcauggaaauaaggccaguaaaggaaaaagaggagaacuuaguuagaucgauggucucagcaggaaguggagaaguugauucauucucacugggaauauuauguguaucaauaaugauugaagagguaaugcgaucuagaugguccagaaaaaugcuuaugacggggacuuuagcugucuucuuguuauuaauaaugggccaauugacauggaaugacuuaauucgucuguguauaaugguaggagcaaacgccucagaccggaugggcaugggaacaaccuaucuagcucuaauggcgaccuucaaaaugcgucccauguuugcgguggggaucuuauucaggaggcucaccuccagagaaguuuugcugcuuacaauuggauugucacugguagcuucaguugaacuaccaaacucacuagaagaauugggagauggccuggcgauggguaucaugauguuaaagcugcuuacggaguuccagccgcaucaacuuuggacaacauuguugucacuaacuuucauaaagaccacauuaagucuugacuaugcguggaaaacaaccgcaauggcacucucaaucguaucucuuuuuccacucuguuugagcacaaccucgcagaaaacaacuuggcuuccaguccuccuagguaguuucgguugcaaaccauuaacaauguuccuaaucacagagaauaagaucuggggccguaaaagcuggcccauaaaugaaggcaucauggcaaucggaauaguaagcauuuuacugucaucauugcuuaaaaacgaugugccacuagcaggaccauugauagccggcgguauguuaauagcauguuaugucauaagcggcagcuccgcagaccucucuuuagaaaaagccgccgaaguaagcugggagcaggaagccgagcauucgggcacuagccacaauauacucgucgaaguacaagacgauggaaccaugcgcaucaaagaugaggaaaaggaugacacccugaccauacuacuaaaagcaacccuucuugcaguauccggaguauaccccaugucaauaccagcaacacuguucguaugguacuuuuggcagaagaagaaacaaagaaguggaguacugugggauaccccgaguccaccggaaguagaacgugcgguucuugaugauggaauauacaggauuuuacagagaggucuauuaggacgaagccaaguggguguaggcguguuucaagacggagucuuucacacuauguggcauguaacaagaggagcaguguuaauguaucaggguaagagauuagaaccgaguugggccucagucaagaaagaccuaaucucguaugggggcggauggagauuccaaggcucuuggaauacgggagaagaaguucaagucauagccgucgagccuggaaagaauccgaaaaaugugcaaacgacacccgggaccuucaagaccuccgaaggggaagugggugccauagccuuagacuuuaaaccaggaacgucgggcucuccaauaguaaacagagagggaaaaauaguuggacuguaugguaacggaguagugaccacgucaggcacguauguuagugcuauagcgcaagcaaaaacgucacaagaagguccgcuucccgaaauagaagacgaaguauucaaaaagagaaauuuaacaauuauggacuuacaucccggaagugguaaaacgcgaagauauuuaccggcaauuguucgagaagcaauuaagcgaaaacuuagaacauuaaucuuagcuccuacgcgcgucguugcaagugagauggccgaagcucucaaaggcaugccuauaagguaucaaacaacagcaguaaaaucugaacauacagguagggagauaguugaucuaaugugucaugccacuuucacuaugagguuacucucaccugugcgcgugcccaauuauaauaugauuaucauggacgaagcccauuuuacugacccagcuucgauugcggcgcggggauauauaucaacaagaguuggcaugggugaagccgcagcgauuuucaugacagcaacuccaccuggaucaguagaggcuuucccucaauccaaugcggucauacaagaugaagagagagauauaccugaaagaucuuggaacuccggauaugauuggauuacggauuuuccuggaaaaacagugugguuugucccuucaauuaagagcgggaaugacauagcaaauugccucagaaagaauggaaaaagaguuauacaauuaagcagaaaaacauucgauacugaguaucagaaaaccaaaaacaacgauugggacuacgucgucacaacagauauuucugaaaugggagcaaacuuuagagcugaucgaguuauagauccuaggagaugucuaaaacccgugauacuaaaagauggaccugaacgcguaauauuggcaggaccuaugcccguuacagucgcaucggcggcgcaaaggcgaggcagaauaggacgaaaucaaaauaaagaaggcgaccaguauguuuauauggggcaaccuuugaacaaugaugaagaucaugcccacuggaccgaagcgaaaaugcugcuugauaauauaaauacaccugaaggaauuauacccgcacuguucgagccagaacgugagaaaucagcagcaauagauggggaauaucggcuuagaggagaggcccguaaaacauucguggaacuaaugagacgaggagauuuaccaguuugguuaucuuauaaagucgccuccgaaggauuccaauauagugacagaagaugguguuucgauggugagagaaauaaccagguucuagaagaaaacauggaugucgagauuuggacaaaagaaggggaaagaaagaaauuaagaccacgaugguuggacgcccguacauauucagacccauuagcuuuaagggaguucaaagaauuugcagcgggaagacgaucugucaguggugaccuaauauuagaaaucggaaaguugccccaacauuuaacgcugagagcucagaaugcucucgacaacuuaguaauguuacauaauucggagcaagguggaaaagcguauaggcacgcgauggaggaacuaccagacacaauagaaacacugauguuacucgccuugauagccgucuuaacaggcggaguaacauuguucuuuuuaucugguaagggccucggcaagacgucaauuggauuauuauguguaacagccucaagugcacuacuauggauggcuaguguugaaccccacuggauagcggccuccauaauacucgaguucuuuuuaauggucuuauugauaccugaaccagauagacagcgcacuccacaagauaaccaacuagcuuacgucguuauaggucuacucuuuaugauuuuaacgguugcugcaaaugaaaugggacucuuagaaacaacaaagagagacuuaggaauaggucacguagcugcugagaaucaccaacaugcuaccauguuagacgucgacuugcgcccggcaagugcuuggacacucuaugcgguagcgaccacaguaauuacaccaaugaugcgccauacaauagaaaauacaacugcuaauauuagcuuaacagccaucgcaaaucaagcagcgauucucaugggacuugacaaaggauggcccaucaguaaaauggacauaggugucccacuacuugcuuuagggugcuauucucaaguaaacccccuuacacuuacagcggcuguuuuaauguuaguagcucacuacgcaaucauuggaccagggcuccaggcuaaagcuacacgugaagcgcaaaaacgaacggccgcaggaaucaugaaaaauccaacaguagauggaauaguagcuauugaccuagauccugucgucuacgacgcaaaauuugagaaacagcuaggucagauuauguuguuaauacucuguacuucucaaauauuauuaaugcgcacgacaugggcacuaugugaaaguauaacacuugccacagggccucugacuacucuuugggaaggaucuccgggcaaauuuuggaauacaacuauagcugugucaauggcuaacauuuucagaggcucguacuuggcgggagcgggacuagcauuuaguuuaaugaaaagccuaggaggagggcggcggggcacuggggcacaaggugaaaccuuaggcgagaaauggaaaagacaauugaaccaauuaagcaaaccagaguuuaacacauacaaacgauccggaauaauggagguggaccggagcgaggcuaaagaaggguuaaaaaggggagaaaccacaaagcacgcuguaucgcgaggaacagcaaaacucaggugguucguugagagaaauuugguaaaaccagagggcaagguaauagaucugggaugcggucgaggagguuggagcuacuacugcgccggauuaaagaaagugacugaaguuaaaggauauacgaaaggaggacccggacacgaagaaccaauuccuauggcaaccuaugguuggaacuuaguuaaacuucauagugguaaggauguauuuuucaugccaccugagaagugugacacccuacucugugacauuggugaauccucgccuaaucccaccauugaagaaggcagaacacuaaggguucuaaaaauggucgaaccuuggcuuagggguaaucaauucuguauuaaaauucucaauccauauaugccaucgguuguggaaacacuagagcagaugcaacgcaagcauggcggaauguuagugaggaacccuuuaucacguaacuccacacacgaaauguauuggguuagcugcgguacgggaaauauaguuagugcgguaaacaugaccucaaggaugcugcuaaaucgauucacaauggcgcacagaaaacccacguaugaacgagacguagaccuuggugccgguacaaggcacguagcagucgaaccagagguggcaaauuuagauauuauaggccaaagaauagaaaauauaaagaaugagcacaaauccacuuggcauuacgaugaagauaaucccuauaaaacuugggcguaccacgggucauacgaggugaagccuagugggucggcgagcucaaugguaaacggaguuguuagauuauuaacuaaaccgugggacguaauuccuaugguaacacagauagccaugacugacacaacaccauuuggucaacaaagaguauucaaagaaaaaguugacacaagaacaccaagagccaagaggggaacaacacaaauaauggagguaacagccaaauggcuauggggauucuuaucacggaauaagaaaccaagaauauguacaagggaagaguucacccgaaaagugagaucuaaugcagcuauaggugcuguuuuuguagacgagaaccaguggaacagugcaaaggaagccguugaggaugaaagguuuugggaucugguacauagagagagagaacuacauaaacaggguaaaugcgcgacuuguguuuauaacaugauggguaagagagagaagaaacuaggcgaguucgguaaagcuaaaggaaguagagcgauuugguauauguggcuuggagcacgcuuccuagaauuugaggcgcucggauuuaugaacgaagaucacugguuuucgcgagaaaauucgcugucuggcguagaaggggaaggcuugcauaagcuaggauacauacuucgggauaucucaaagauacccggaggcaauauguacgccgaugacacggcgggaugggauacccguauaacugaagaugauuugcaaaacgaagccaaaaucacagacaucauggaaccagaacacgcacuacuagcaacaucuauauucaaauuaacauaccagaauaaaguuguaagaguacaaagacccgcuaaaaacggaaccgucauggauguaaucucuaggcgagaucaaagaggaaguggacagguagguacauauggacuaaauacauucacaaauauggaaguccagcucauccgacaaauggagagugaagguauuuuccuuccgucagaauuagaaacuccaaacuuggcggaaagaguucuagacuggcuugaaaaacacggcgcugagcgucuuaaacguauggcuauuucgggagacgauugcguugucaaacccauagacgauagauuugcuacggcauuaacugcacuaaacgauaugggaaaagucaggaaagacauaccucagugggaaccaaguaaaggauggaaugacuggcaacagguccccuucugcagccaccauuuucaucaguuaauaaugaaagauggaagagaaauaguaguaccuugccgaaaucaagaugaacuuguugggagagcgagaguuagucaaggagcuggauggagcuuaagagaaacagcauguuuagggaaaucauacgcgcagauguggcaacuaauguauuuccaucggagagacuugagacuagcugcaaaugccauaugcagugcuguaccaguugauuggguaccgacgucacgcacaacgugguccauucaugcccaucaccaauggaugaccaccgaagauauguuaucggucuggaacaggguuuggauagaggaaaaucccuggauggaggauaagacucauguauccaguugggaagaagucccuuauuugggaaagagagaagaccaauggugcggauccuugauaggcuuaacagcgagagcaacaugggcaacuaauauacaaguugcaaucaaucaaguuagacgucuaauaggaaaugagaacuacuuagauuauaugacaaguaugaaaagauucaagaacgaauccgaccccgaaggggcauuaugguga

SEQ ID NO: 21346 - RNA, 9879 nt, Artificial Sequence
  derived and/or modified CDS sequence (opt6) from DENV-1__FJ898448__SS-prME
agcguaaccauguuauuaauguuauuaccuaccguuuuaacguuucauuuaaccacaagaggaggugagccccauaugauuguuagcaaacaagaaagggguaaaaguuuacuauucaaaacuucggcaggaguuaauauguguacucuuauugcuauggacuuaggugagcuaugcgacgauacaaugacauauaaaugcccgaggauuacugaaacagaacccgaugacguagacugcugguguaaugcaacagagacauggguaacguauggaacauguucacaaacaggagaacacagaagagauaaaagaucgguugcuuuggcgccacaugucggauuaggauuagagacccgaacggagacauggaugagcagcgaaggcgcguggcggcaaauacaaaaaguugaaacgugggcucucagacauccuggauucacuguuauugcauuauuucuggcacaugcaauagguaccagcauaacgcaaaaagguaucauauucauacuacugauguuagugacaccaagcauggcaaugcgauguguagggauagggaauagagauuuuguugaaggcuugaguggggcaacauggguagauguuguacuugaacauggaaguuguguaacaacgauggcgaaagauaaaccuacucuagacauugaauugcuaaaaacggaaguuaccaauccagcuguacuccgaaaauuaugcauagaagcaaaaauaucuaauacgacgacugauagcagauguccaacgcaaggggaagccacgcucguagaggaacaagauacuaacuuuguuugcagacguacuuucguugacagaggcugggggaaugguugcggccuuuucggaaaagguucacuaauuacuugcgcgaaauuuaaauguguuacaaaacuggaagguaaaaucguccaauacgaaaaccuaaaauauucugucauaguuacaguucauacaggagaccaacaccaaguagguaaugaaacaacagaacauggcacuauagcgacuauaacuccgcaagcgccuacgagugaaauccaauuaacagacuacggggcacuaacgcuagauuguagcccgcgaacaggcuuggauuuuaacgaaaugguguuauugacgaugaaagaaaaaucgugguuaguccauaaacaaugguuccuugacuuaccucucccguggacaagcggagcuucuacgucucaagagacuuggaaucgccaagauuuauuaguuacauuuaaaacugcacaugcuaagaaacaagagguggucguucuaggaagccaagaaggggcuaugcacaccgccuuaacaggggcuacagaaauacaaacaucaggaaccaccaccauuuucgcaggccaucucaaaugucguuuaaaaauggacaagcugacccuaaagggaauaagcuaugugauguguaccggcagcuucaagcuagaaaaggagguggcggagacucaacauggaaccguguuaguccaaguuaaguaugagggcacagaugcaccaugcaaaauuccguuuucuagucaagacgaaaaaggcguuacacagaacgggaggcugguaacugcuaaucccauagugacggauaaagaaaaaccuguaaauaucgaagcugaaccaccuuucggugaaucauauauuguaguuggcgccggggagaaggcacuuaaacuaaguugguucaagaaagguagcagcaucgguaagauguucgaagcgacugcaagaggugcaagaaggauggcuauauuaggagauacagcuugggauuuugguaguauaggugguguauuuacgucuguuggcaaacuuguacaccaaauuuucggaaccgcuuaugggguauuauucaguggcguaucauggacaaugaaaauugguauagggaucuuauuaacauggcuaggucucaauagcagaagcaccagcuuaaguaugacaugcauugcgguaggcauggugacuuuauacuugggagucaugguucaggccgauucaggguguguaauaaacuggaaaggccgugaacucaaauguggaucggggauuuucguuacgaaugaggugcacacuuggacagaacaauacaaauuucaggcagauucuccaaaacgucuaucugcugcgaucggcaaagccugggaagaaggcgucugcggcauucgcagcgcuaccagauuagaaaauauaauguggaaacaaaucucaaaugaauuaaaccauauccuauuagaaaacgauaugaaauuuacaguaguagucggagaugugucagggauacuagcacaaggcaagaaaacgaucagaccgcagccuauggagcacaaauacucguggaaaagcuggggaaaggcuaaaauaaucggugcagaugugcagaacacgacauucaucauagaugguccaaauacaccggaaugcccagacgaccaaagagcuuggaacauaugggagguugaggauuacggauucgggauuuucacgacuaauauuuggcucaaauuaagggauuccuacacacaagucugcgaucaccgccuaaugucagcagcuauaaaagacuccaaagcgguccacgcagacaugggcuacuggauugaaagcgagaaaaaugaaacuuggaaacucgcacgggccagcuuuauugaagugaaaacaugcguuuggccgaaaucucacacccuuugguccaaugggguacuugagucugaaaugaucauucccaagauauauggaggaccaaucucccaacacaauuacaggccuggauacuuuacccaaacugcuggcccguggcacuuagggaaauuagaacucgacuuugaccuuugcgaaggcacuacaguaguaguagacgaacacugcgguaacagagguccuucacuacgaacaacuaccguaacagguaaaauuauccaugaguggugcugcagaucguguacucuaccgccuuuaagauuuaaaggcgaagacgguuguugguaugguauggaaauaaggccugugaaggaaaaagaagagaauuuaguuaagaguaugguauccgccggaucaggggagguggauagcuucagucuaggacuucucugcauaaguauaaugauagaagagguaaugagaucacguugguccaggaaaaugcugaugaccggaacguuaguugucuuuuuacuucucacguuaggacaauuaacuuggaacgaucuaauuagguuauguaucaugguaggugcaaaugcgucugacaauaugggcaugggaacuacauaucuagcgcuaauggcuacuuuuagaaugaggccuauguucgccguuggucuacuguuucggcgucuaaccuccagagaagucuuauuacugaccguaggacucaguuuaguagcuucaguagaguuaccaaauucuuuggaugaauuaggcgacggacuagcuaugggcauaaugauacuaaagcugcuaacagauuuucagagccaucaauuaugggcgacauugcucucacugacuuucguaaaaacuacucugaguuuacacuaugccuggaaaacaauggcuaugauacuaagcauuguaucucuacucccacuuugcuuaaguacuacaagccagaaaacuaccuggcuaccaguuuuacucggaagccuaggaugcaaaccauuaacuauguuccuaauaacagagaacaagauuugggguagaaaaucguggccuuuaaacgaagguauaauggcaguagguauagucucuauucuacuaucuagucugcuuaagaacgaugugccgcuggcagguccacugauugcaggcggaauguugauagcauguuaugucauaagcggaucaucugccgauuuaucauuggagaaagcugcaaaagucucaugggaggaggaagcugaacauucgggugcaagucauaacauauugguagaaauacaagaugacgguacuaugaagauaaaagacgaagagagagacgauaccauaacgauccuuuuaaaagcaacacuucuugccauuagcggggucuacccaaugucaauaccagcuacacuuuucgucuggcacuucuggcagaaaaagaaacaaagaucagggguuuuaugggacacacccaguccucccgaaguggaaaaagcaguacuugacgacgguauauauagaauauuacaacgagggcuacuaggaagaucccaagucggaguuggagucuuccaggaagguguauuccauaccauguggcaugugacccggggugccguccuaauguaccaaggaaaacgauuagagccuagcugggcuagugucaagaaagaucugauuagcuaugguggcggauggagauuucaaggaaguuggaacacuggagaagaaguucaagucauagcgguagagccggggaagaaucccaaaaaugugcaaacagcaccaggaacauuuaaaacaagugaaggagaaguaggagcaauagcacuugacuucaaaccaggcacgagcgguucacccauagugaaucgcgaaggaaagauaguaggacuauauggaaacggaguaguuacuacguccgguacauauguaucagcaauagcucaagcuaaagcaagccaagaaggcccccugccugaaauagaagacgaggucuucagaaagcguaacuuaacgauaauggacuuacaccccgguaguggcaagacccgaagauauuuaccagcgauuguccgggaagcaauaaaaagaaagcuaagaacacuuguauuagcuccaacccgagugguagccucggaaauggcugaagcauuaaagggcaugccuauacgauaccaaacaacagccgucaaauccgaacauacaggcaaagaaauaguagaucuaaugugucaugcgacuuucacuaugcguuugcuaagcccgguuagaguaccaaauuacaacaugaucauuauggaugaagcacauuucacagaccccgcuaguaucgcagcaagggguuacauuucaacgagagucgggaugggagaagcagcggcuauauuuaugacugccacaccgccaggaaguguagaagcguucccacaauccaacgcaguuauucaggacgaagaaaaggauaucccagaaagaagcuggaacuccggauaugacuggauaacagauuuucccggaaaaacaguaugguuuguaccaaguauaaaauccggaaacgacauagcgaacugucuaaggaaaaaugguaaacgaguaauacaauuaagcagaaagaccuuugauaccgaguaucagaaaaccaaaaauaacgauugggacuaugucgucacgacagauauaucagaaaugggcgcgaauuuucgggcugaucgagucauugauccacgacguuguuugaagcccguaauucucaaagauggacccgaaagaguaauauuagcgggucccaugccaguuacaguugccuccgccgcacagagaagaggaaggauagguagaaaccagaauaaagaaggugaucaauauauauauaugggacaaccauugaacaaugaugaagaccacgcucauuggaccgaagcuaaaauguugcuugacaacauaaacacucccgaggggauaaucccugcacuuuuugagccagaacgggaaaaauccgcagccaucgauggggaguauagguugaggggagaggcgcgaaaaacuuuugucgaacuuaugagaagaggagaucuuccgguauggcuaucauacaaaguagcuucggaaggauuccaauauagcgauaggcgcugguguuucgauggugaaaggaacaaccaaguuuuggaagaaaacauggacguggagauauggacaaaagagggcgagcguaagaaacuacgaccaagauggcuugacgccaggacauauagugacccucucgcccugagagaguuuaaggaauuugccgcaggcaggaggagcguuuccggcgaucucauacuagaaauagguaaacuaccacaacauuuaacucaaagagcucaaaacgcguuggacaacuuagucaugcuccauaacuccgaacaaggagguaaagcguauaggcacgcuauggaagaauugcccgauacaauagaaacgauaaugcuauuggcccuaauagcuguccucaccggugguguuaccuuauucuuuuuauccggucgaggacuagggaaaacgaguaucggacuauuaugugucacaaguucuagcgcguuacuuuggauggcaucaguagaaccucacuggauugcugcgucaauuauacucgaguucuuucucaugguacuccuuauacccgaaccugaccgacagcgcacuccccaagauaaucaauuggcauacguuguaauaggacuuuuauuuaugauccuaacaguagcggcuaaugaaaugggacucuuagaaacaacuaagaaagaucucgguauaggccaugcggcggcugaaaaucaccaucaugccgcaaugcuugauguugacuuacaccccgcuagcgcauggacauuauacgcaguagccacuacgauuauuacuccaaugaugcggcacacaaucgaaaauacuacagcaaacaucagcuugaccgcuauagcgaaccaagcugcuauuuuaaugggucuagacaaaggauggccgauaucgaagauggacauaggaguuccguuauuagcacugggguguuauucacaagugaaccccuuaacacuaacagccgcggugcugauguuaguagcacacuacgcaauaauuggaccuggguuacaagcaaaagcaacacgagaagcacagaagagaaccgcagccggaaucaugaaaaacccgacuguugauggaauaguagcuauugauuuagauccugucgucuacgaugcaaaauucgaaaaacaacuuggucaaauaaugcuucugauacuauguacaucccaaauacuguuaaugaggacaacuugggcuuuaugugaaucuauaacucuagcgacaggucccuugacgacguuaugggaagguaguccuggcaaauuuuggaacacaacaauagcagucaguauggcaaacaucuucagaggaagcuaucuagccggagcugggcuagcuuuuucucuaaugaaaucuuuaggugguggccgaagagggacaggugcacaaggugaaacacugggagaaaaauggaaaagacaacuuaaucaacuguccaaaucugaauuuaauacuuauaagagaaguggaauuauagaaguugaucguucagaggccaaagaaggauuaaaacgaggggaaacaacgaaacacgcuguaucacguggaacagcgaaauuacgcugguucguggaacguaaccugguaaagccagaaggaaaagugauagaucuggguuguggaagaggugguuggaguuacuacugcgcaggucuaaagaaaguaacggaaguaaaggguuauaccaaaggagguccuggccacgaggaaccuauaccgauggcaacuuacggcuggaacuuagugaaacugcauucagggaaagacguauucuuuaucccuccagaaaaaugugauacguuacuaugugauaucggugagaguucgccgaacccuacaauugaagaaggaaggacgcuuagaguccucaagaugguagagcccugguuaagaggaaaucaauuuuguauaaaaauauuaaauccguauaugccaagcgucguugaaacccuagagcagaugcaacgcaaacauggagguauguuaguacguaacccauuaaguagaaacuccacgcacgagauguacuggguaaguugcggcaccggaaauaucguuagugcaguaaacaugacaaguagaaugcuauuaaaccguuuuacaauggcacauagaaaaccaacguacgagcgugauguagaucucggagcaggcacacggcauguugcagucgaaccagaaguugcgaauuuggauauuauaggucaaaggauugaaaacauaaagaacgaacacaaaaguacguggcacuaugaugaggacaauccauauaaaacuugggccuaucaugguuccuaugaaguaaaaccgagcggcucugcuucauccaugguaaaugggguaguuagacuacuuacaaaacccugggaugugauuccaauggucacucaaauagcuaugaccgacacgacacccuuuggucaacaacgugucuucaaagaaaaaguagacacucgaacgccgaaagcgaagagaggaacugcucagauaauggaagucacugcaaaauggcuauggggauuccuuagucguaauaagaaaccacggaucuguacccgagaagaauuuacuagaaaaguucgcuccaaugcugccauaggagccguauuuguggaugagaaucaauggaacucggcuaaggaagcgguugaagaugaaagguuuugggacuuagucaggagagaaagggaacugcauaaacagggaaaaugugcaacaugcguguauaauaugaugggaaaaagagaaaagaaacuaggcgaauuuggaaaagcaaaaggaucccgugcuauuugguauaugugguuaggagcgagauuccuagaguuugaagcacuaggauucaugaacgaggaucacugguucucccgagaaaauucacuuagugggguugaaggagaaggcuugcauaaacuggguuauauacuccgugauauuagcaaaauacccggggguaacauguacgcagaugauacggcgggcugggauaccagaauaacugaggaugaccuucaaaacgaagcgaaaauuaccgauauuauggaaccagaacacgcacuguuagcgacuucaaucuuuaaacuuacauaucaaaacaaagucguacgagugcaaaggccggcaaagaacgggacuguuauggaugugaucagcagaagggaccagcgagggucuggucagguugggacauauggucuaaacacauucacaaauauggaagcccaauugauaagacaaauggaaagugaaggaauauuuucucccagugaguuggaaacacccaaccuagcagggcgcguauuagacugguuagaaaagcacggcaccgaaaggcuacgcaggauggcgaucagcggugaugauugugucguuaaaccuauagacgaucguuucgcuacugcgcuaacagcacuaaaugauaugggaaagguacgcaaggauauaccccaaugggaaccuaguaaagguuggaaugauuggcaacagguaccauucugcucucaucacuuccaucaauuaauaaugaaggacgguagagaaauaguuguuccauguagaaaucaagacgaauuaguuggucgggcuagaguuucccaaggagcuggcuggagcuugagggaaacugcaugccucggcaaaucuuaugcucaaauguggcaauuaauguauuuccaccgacgugacuuaagauuagcggcuaacgcaauaugcagcgcugugcccguugauuggguacccaccagucgaacaacguggucaauacaugcgcaccaccaguggaugacaacagaagacaugcuuuccgucuggaaccguguauggauagaagagaacccauggauggaagauaagacucacgugaguagcugggaagacguaccauauuugggaaaaagagaggaucaauggugcggaucucucauugguuuaaccgcaagagcaacaugggcuacaaacauccaagucgccauaaaccaaguaagaaggcuaauugguaaugaaaauuaucuugauuauaugacaaguaugaaacguuuuaaaaaugaguccgacccagaaggcgcccuaugguga

SEQ ID NO: 21347 - RNA, 9879 nt, Artificial Sequence
  derived and/or modified CDS sequence (opt6) from DENV-1__GQ868602__SS-prME
aguguaacuauguuacuaauguuacuaccgacagcgcuagcguuucauuuaacaacacgaggaggggaaccucacaugauaguguccaaacaagaaagggggaaaagucuacucuuuaaaacaagugcgggaguuaauauguguacuuuaauagcuauggaucuuggugaauuaugcgaagauacuaugacguacaaaugccccagaauaacggaaacagaaccugaugaugucgauuguugguguaacgcaacagaaacuuggguaacauauggaacguguucccaaacaggugaacauagaagagauaaacgaucaguugcuuuagcuccgcacgucggauuaggucucgaaacgagaacagaaacguggauguccucagaaggagcauggagacagauacaaaaaguagaaacuugggccuuacgacauccagguuucacgguaauugcacuauuuuuagcacaugccauuggaacgaguauuacucagaaaggcauuauauuuauccuacuaauguuaguaacuccgaguauggcaaugcgaugcguuggaauuggcaaucgugacuuugucgaagguuuaucaggagcuacuuggguggacguuguacuagaacaugggucuuguguuacaacaauggcuaaagauaaaccaacauuggacaucgaauuacuaaaaacggaagucacaaauccugcggugcugagaaaacucuguauugaagcaaaaauuucgaacacgacaacagacucacgaugucccacacaaggugaagcuaccuugguugaagaacaagauaccaacuuuguaugccgcaggacuuucguagaccgagguuggggaaacggcuguggccuauucgggaaaggcucguuaaucacgugcgcgaaauuuaaaugugugacuaaacuggaaggaaaaaucguacaauaugaaaauuuaaaauauucaguaauagugacaguccacacaggugaccagcaccagguaggaaacgaaacuaccgaacacgguacaacagcuacaaucacaccucaggcaccaacgagugaaauacagcuaacugacuauggagcuuuaacucuugauugcucaccaagaacuggucuagauuuuaaugaaaugguacuacuaacaaugaaagaaaaaucauggcuggugcacaaacaaugguuuuuagaucuuccacugccauggacauccggagcgucgacuucacaagaaaccuggaauaggcaagauuuacugguuaccuuuaaaacggcgcaugcuaaaaagcaggaaguaguugugcuuggaucucaagaaggggcaaugcacaccgcguuaacuggagcaacagaaauucaaacaucagggaccacaacaaucuuugcagggcaccuaaaaugcagacucaagauggacaaacuaacucucaagggaguuuccuacgugauguguacggguucauucaagcuggaaaaagaaguagcugaaacacaacacggaacaguccuaguacaagucaaguaugaaggaacagaugcaccaugcaagauccccuuuucuagccaagaugaaaaaggagucacacagaacgggcgcuugaucacagcaaacccuauaguaacggauaaagaaaaaccagucaacauagaagcugaacccccauuuggagaauccuacuuaguuguaggugcaggggaaaaagcacuaaaacuaucuugguuuaagaaagguucaagcaucggcaaaauguuugaagcuaccgcaagaggcgcaagacguauggcaauucuaggcgacacagccugggacuuuggaaguauaggaggcguuuucaccagcguuggaaagcugauccaucaaauauucgguacugcauaugggguauuauuuaguggaguaagcuggacaaugaaaauagggaucggaaucuuacuuaccugguuggggcuaaacucgaggucaaccaguuugucaaugaccugcauagcugucggaaugguaacacuuuaccuaggggugauggugcaagcagacucaggauguguaaucaacuggaaagggagagaacuaaaaugcggaagcgguaucuucgugacuaaugaaguccauacuuggacagaacaauacaaguuucaggcugacaguccaaaaagacuaucagcugcaauaggaaaagcaugggaggaaggaguuugugguauucguucugccacuagacucgaaaacauaauguggaagcaaauuaguaaugaguuaaaucacauucuacuagaaaacgauaugaaauuuaccguaguaguaggagacgugaauggugucuuagcgcaagggaagaagaugauaaggccacagccaauggaacauaaauacuccuggaaaaguuggggcaaggcaaaaguaauaggagcugacguacaaaauaucacauucauaauugacggacccaauacucccgaaugcccagaugaucaaagagcauggaauaucugggaaguugaggauuacggcuucggaaucuuuacaacaaauauaugguuaaaauugcgggacaguuauacacaaguaugugaccaccgccuuaugucugcagcaauaaaagacucgaaagcgguucaugcggacaugggauauuggauagaaucagagaaaaacgaaacuuggaaauuaacacgcgcgucauuuauagaagugaaaacaugcauuuggccuaagucgcauacucuguggucaaacggaguuuuagagagugaaaugaucaucccuaagauauauggagguccaaucagucaacacaauuauaggcccggauacuucacccaaacagcgggcccuuggcaccucggaaagcuagaacuagauuuuggcuugugugaaggaacuacagugguagucgacgaacauuguggcaauagagguccaagccuaagaacaaccacaguuacaggaaaaauaauucaugaaugguguugucgguccuguacuuugccuccauuaagguuuaaaggagaagacggguguugguacggaauggaaauccgaccuguaaaagaaaaagaagagaaucuuguaaagagcaugguaucggcaggaucgggggaagucgauucguuuucauugggacuacucuguauaucaauaaugauagaggaagugaugcgcaguagauggaguaggaaaaugcuaaugacaggaacucuugcgguauuuuugcuacugaucaugggucaacucacauggaaugaccugauacgauuaugcauaaugguuggagccaaugcaagugauaagauggguaugggaacaacguacuuagcauuaauggcgacguucaggaugcgaccuauguuugcaguaggacuauuauuuagacgacuaaccucacgcgaaguacuauuacucacgguaggacuaucgcuaguagcuucaguagaauuacccaacagcuuagaagaguuaggugacggauuggccaugggcaucaugauguuaaagcucuuaacagauuuccaaagucaccaacugugggcaacucuucuaagccucacguucgugaaaacuacguucaguuugcacuaugcauggaaaacgauggcaaugaucuugaguauaguaucacuuuuuccuuuaugcuuguccaccaccucucagaaaacaaccuggcucccagugcuuuuaggaaguuuaggauguaagccauuaacaauguuccuaauaacagaaaauaagauuuggggacgaaaaucauggccguuaaacgagggaauaauggcaguuggcauuguaucuauacuccuuagcucacuauuaaagaacgacguaccuuuagcuggaccacucauugccggagggaugcuuauugcauguuaugucauaucgggaucgagcgcagaucuaucgcuugaaaaagcugcugagguuaguugggaagaagaagcugaacauaguggugcaucgcacaacauccucguggagguccaagaugaugggacaaugaagaucaaagacgaagaacgugaugacacgcuuacaauacuuuuaaaggcaacuuuguuagcuaucuccggaguuuaccccaugagcaucccagcgacacucuuuguaugguacuucuggcagaagaagaaacaaagaucagggguacuuugggauacacccucuccuccagaaguugagagagcaguacuggaugaugggaucuaucggauccuacaacgaggauugcuuggaaaaucccaagucggugucggaguuuuccaagaaggaguuuuucauacaauguggcacguaacacguggugcuguuuugauguaucaaggaaaaagauuggaaccauccugggcaucgguuaagaaagauuuaauaagcuauggugguggguggcgauuccagggaucauggaauaugggugaagaaguacaagucauagcugucgagccgggcaaaaaucccaaaaaugugcaaacagcaccugguacauucaaaacaccagagggagagguuggugcgaucgcacuagauuucaaaccaggaaccagcgggucuccaauagugaauagggaaggcaagauugucggacuuuacgguaacgguguugucacaacgucaggaacauauguuuccgcaauugcccaagcgaaggcaagucaggaaggaccacuccccgaaauugaagacgagguauuuagaaaacgaaaccuaacuaucauggauuugcacccuggaucagguaaaaccaggagauauuuacccgcuauugugcgugaagcuauaaaacgaaaauugagaacauuaguuuuagcaccgaccagaguaguugcaagcgaaauggcugaggcuuuaaaaggcaugccuauacguuaucaaacaacagcaguaaaaagcgaacacacgggaaaggaaauaguggaccugaugugccacgcuacuuuuacuaugcgacuucuuucuccagugagaguucccaacuauaauaugauaaucauggaugaagcacacuuuacagacccugcaaguauagcagcccgcggguauaucucaaccagggucggcaugggugaagcggcagcgauuuuuaugacugccaccccaccagggaguauggaagcguuuccgcagagcaaugcagccauacaagaugaagaaagagauauaccugaacgaucuuggaacucaggauaugauuggaucacggacuuuccaggaaaaacugucugguuuguuccaucaaucaaauccgguaaugacauugcgaauugccuuaggaaaaacgguaaaagaguugugcaauugaguagaaagacauucgauacagaauaccagaaaaccaaaaauaaugauugggacuaugugguuacuacagacaucuccgaaaugggagcaaacuuucgagcugacagaguuauagaccccaggagaugcuugaagccagugaucuuaaaggauggaccggaaagggucauauuagcugguccaaugccuguuacuguggcaucggcugcacaaaggcggggacguaucggccggaaucaaaauaaagaaggcgaucaauacauauauauggggcaaccguuaaauaaugaugaagaucaugcacacuggacugaagcgaaaaugcuccuugacaacauaaauaccccagaaggcaucauaccagcacucuuugaaccagagagagagaagucugcugccauagacggagaauaucgccuacguggugaggcaagaaaaaccuuuguggagcuaaugagacguggggaucuaccgguuuggcucaguuauaaaguagcaucagaagguuuucaauauucagaccgccgguggugcuucgauggugaacgaaauaaucaagugcuccuuaagaauauggaugucgaaauauggacuaaagaaggugaacggaaaaaguuaagacccagauggcuggacgcgagaacauacucagauccuuuagcuuuaagggaauuuaaggaauuugcggcaggccgaagaucugugaguggagauuuaaucuuagaaaucggaaaacugccccaacaucucacacaaagagcucaaaaugcacuagauaacuuggugauguuacauaacucugagcaaggaggaaaagcauaucgccaugcaauggaagaacuaccggacacgauugaaacacuaaugcuucuugcucugauagcgguauuaaccggcggagugacauuauuuuucuuguccggacgaggucuuggaaaaaccucuaucggucucuuaugcguuauggccagcagcgcccuacuuuggauggcgaguguagagccucauuggauagcagccucaauaauauuggaguucuuccuuaugguguuauugaucccagaaccagauaggcaaagaaccccucaagauaaccaacuugccuaugugguaaucgggcuguuauucaugauccuaacaguagccgccaacgaaauggggcuguuggagacuaccaagaaagacuuagguauuggacauguggcugcagaaucacaccaccaugcggcuauguuagacguggauuuacaccccgcgucagcguggacccuuuacgcaguugcuacgacgaucauaacaccaaugaugagacacacaauagaaaauacuacggccaacauaucucugacggcgauagcuaaucaagcggcuauacuuauggguuuggauaaaggcuggccaaucagcaaaauggauaucggcguuccauuauuagcucuaggcugcuacagccaggugaacccucuaaccuugacagcugcuguuuuaauguuagucgcucauuacgccauaauagguccaggccuacaagcaaaggcaacgagagaagcacagaaacgaacugccgccggcauuaugaaaaauccaacgguugaugggauaguugcaauagacuuagaccccguaguguaugaugccaaauucgagaagcaacucgggcagauuauguuauuaauacuuuguaccucucagauauuacucaugaggacgacaugggcacuaugcgaauccauaacucuagcuacagguccguuaacaacucuaugggaaggaaguccgggcaaauuuuggaauacaacaaucgccgucaguauggcuaauauuuucagggguucuuaccucgcaggagcugguuuggcauucucccugaugaaaucuuuaggcggagggagacguggcacaggggcccaaggggaaacacugggggagaaguggaagaggcaacuuaaucaauuguccaaaagcgaauuuaauacauacaaaagaucuggaauuauagaaguagaucgaagugaagcuaaagaaggucugaagcguggagaaacgaccaagcaugccguuagccgcgggacagcaaaauuaagaugguucguggaacguaacuuggugaagccugaaggaaaaguuauugaccuaggauguggcagagggggauggaguuacuauugcgcaggucucaagaaaguaacagagguuaaaggauauacuaagggagggccaggucaugaagaaccaauaccgauggcaacuuauggguggaaucucgugaaacuuuauaguggaaaagacguauuuuucacaccuccagaaaagugugacacucuacuaugugacauuggugaaucaucaccuaauccgacgauugaagaagguagaacuuuaaggguccugaaaaugguggagccaugguugagaggaaaucaauuuuguaucaaaguucuuaauccguauaugccgucaguaguugaaacgcucgaacaaaugcaaaggaaacaugggggaauguuggugagaaauccauugucacgcaacaguacgcacgaaauguauuggguuucaugugguacugggaacauaguaagugcaguaaauaugacaaguagaaugcuauuaaaucgauuuaccauggcucauagaaagccuacuuaugaacgcgacguugaucuaggagcagguacccgaaauguagcuguagaaccugaaguugcaaaccuagacauaauaggacagaggauugaaaacaucaaaaaugaacacaaguccacauggcauuaugacgaagauaacccauauaagacgugggcauaucauggaucauaugaaguaaaaccaagcgguagugcgucgucaaugguuaacggagugguacguuuguuaaccaaaccgugggacguaauccccauggugacacaaaucgccaugacagacacuacgcccuucggacaacaacgugucuuuaaagaaaaagucgacacaagaacaccuaaagcuaagaggggaacagcucagauuauggaagugaccgccagauggcucuggggguuccuuucacgaaacaagaaaccacgcaucuguacacgagaggaauuuacaaggaagguaagauccaacgcugcuaucggggcgguauuuauugaugaaaaccaauggaacucugccaaagaagcaguugaggacgaacgauucugggauuuaguacaucgagaaagggagcuacauaaacaagggaaaugugcaacuuguguauacaauaugaugggcaaacgugaaaagaaacuaggagaguucggaaaagcaaaaggcaguagagcaauaugguacaugugguuaggcgcgcgauuucuugaguucgaagcucugggauuuaugaacgaagaucacugguucagcagggaaaacagucuaucaggaguagaaggagaaggucuacacaaacucgguuauauucuacgggauauaaguaaaauccccggcgggaacauguacgcugaugauacugcuggaugggauaccagaauuacugaagaugaucuacaaaacgaagcaaaaaucaccgauauaauggaacccgaacaugcacuucuagccacgaguauauucaaauugacuuaucaaaacaaaguugugcgaguccagagaccagcgaaaaauggcacaguaauggauguaauaaguagacgggaucagaggggaagcgggcaggucggaacuuacggacuaaacaccuuuacaaacauggaagcacaacuaauacgucaaauggagagugaggggauauuccuuccuucggagcuagagacucccaaucuugcugaaaggguauuagauugguuagaaaaacauggaauugaaagacuaaaacggauggcuaucaguggagacgacuguguagucaagccgauagaugauagguucgcgacggcuuuaacggcccuaaaugauauggggaagguaagaaaagauaucccccaaugggagcccucaaaaggcuggaacgauuggcaacaaguacccuuuugcucacaucauuuucaucaguuaauuaugaaagacggucgagaaaucguaguaccuugcagaaaccaagacgaauuaguuggucgagcacggguaucgcagggagcuggguggucauuaagagagacagcaugucuaggcaaaucuuaugcccaaauguggcaacuuauguacuuucacagaagagaccugaggcuugcagcgaaugcaaucugcagugcaguuccugucgacuggguacccacaagucgaacaacuuggucaauucacgcucaucaccaauggaugacaacggaagacaugcuaagcguauggaauagaguuuggaucgaggagaaccccuggauggaagauaaaacacauguuagcucgugggaagauguaccauaccucggcaaaagagaagaucaauggugcggcagccuaauaggauugacugccagagcaacaugggcaacaaacauucaagucgcaauaaaccagguaagaaggcugauuggcaacgaaaauuaccuagauuauaugaccucaaugaaacguuuuaaaaacgaaaacgauccggaaggugcauuaugguga

SEQ ID NO: 21348 - RNA, 9879 nt, Artificial Sequence
  derived and/or modified CDS sequence (opt6) from DENV-1__KF921911__SS-prME
ucuguaacaauguuacugaugcuacuaccaacggcacuagcuuuucaccuuacgacacgugggggugaaccgcauaugauaguaaguaaacaagagcggggaaaauccuuacuuuuuaaaacaucaguaggaaucaacaugugcacacuaauagcaauggaccuaggugaacuaugugaagauacuaugacauauaaauguccgcgaauuacagaggccgagccagaugacguagacugcugguguaaugcaacagacaccuggguaacauacggaacauguagccaaacaggagaacacagaagagacaaaagaucuguugcauuagccccucacgucggacuaggacucgaaacaaggacugaaaccuggaugaguucggagggggcuuggaaacagauucaaaaagucgaaacaugggcacuacgccacccgggauuuacaguaacugcacuguuuuuggcucaugcuauugguacuucgauuacacaaaaaggaauaaucuuuauauuguuaaugcugguaacaccaucaauggcuaugcggugcguaggaaucgggaaucgcgauuuuguugaaggguuaucaggcgccacuugggucgauguaguccuugaacacggaagcuguguaaccaccauggcaaaagacaaaccaacacuagauauagaacuccuuaaaacagaaguaacuaauccugcgguguuaagaaaauuaugcauagaagcuaaaauaucaaauacaacuacggauagccguugccccacucaaggugaggcaacccugguagaagaacaagacucuaauuucguuugcagaagaacauuuguagacagaggauggggaaacgguuguggacuuuuuggaaaaggaaguuuauugacaugugcaaaauuuaaauguguuacaaaacuagagggaaaaauaguccaguaugagaaucuuaaauauucagugauugugacagugcauacaggagaucaacaccaaguaggaaaugaaaccacggaacacgguaccaucgcuacaauuacuccccaagcaccgacgucggaaauccaacuuacugacuauggagcguuaacacuggacuguucgccuagaacuggcuuagauuuuaaugagaugguacuuuuaacaaugaaagagaaauccugguuaguacacaagcaaugguuccucgaucucccacuaccauggacaucaggagcaucuacuucucaggaaacauggaaucgacaggaucuacuuguaacguucaaaacagcucacgcaaagaaacaagaaguuguaguguuaggcucacaagaaggugcuaugcauacagcucuuaccggagccacugagauucagacaaguggaaccacuaccauauuugcaggacaucuaaagugcagauuaaagauggacaaacuaacauuaaaggguaugucuuauguuauguguaccggauccuucaaacuggagaaagaaguugccgagacucaacaugguaccguccuaguccaaguuaaguaugaggggaccgacgcaccgugcaaaauuccauuuucagcacaagaugaaaagggaguaacacaaaacggccgauuaauaacagcaaaccccauaguuacagauaaagaaaaaccaguuaacauugaaacagaaccuccauuuggugagucuuacauuguaaucggggcaggggagaaggcuuuaaaacuaucaugguuuaaaaaggggucaucaauuggaaagauguuugaagccacagcaagaggagcacggagaauggcgauucuuggugacacugcuugggauuuuggcuccauagggggaguauucacuucagucggcaaauuaguucaucaaguuuucggugcugccuacggaguacuuuuuaguggcguaucuuggacuaugaaaauugguauagggauuuuauuaacuuggcuuggauuaaauucgagaucaacuagccucuccaugacauguauugcuguuggcaugguuacuuuguauuuagguguuaugguacaagcagauagcggauguguuauuaauuggaagggaagagaauuaaaaugcggcaguggaauauuugugacgaacgagguucacaccuggacugagcaauauaaauuccaagcugauuccccaaaaagguugagcgcagcgauugggaaagcaugggaggaaggugucuguggaauaaggagcgcuacaagauuagaaaauauuauguggaagcaaauauccaaugaacuaaaucauauauuacucgagaacgacaugaaauucacuguaguuguaggagacgcuaauggcauacuagcucaaggcaagaaaaugauacgcccccagccaauggagcacagguacucuuggaagucauggggaaaagcaaaaaucauaggugcugacauacaaaacacaacuuuuauaauagacggaccugauacucccgaaugucccgaugaccagcgugcauggaauauaugggaaguugaagacuauggguucgggauauucacaacgaauauauggcuuaaguuacgggauaguuacacgcaaaugugugaucaucgccugaugagugcagcaaucaaagauucgaaggcuguacaugcugauauggguuacuggaucgagucagagaaaaacgagaccuggaaguuagcuagagcuucguuuauagaaguaaaaacuuguauuuggccaaaaagucacacauuguggaguaauggaguuuuggagagugaaaugauaaucccaaaaaucuauggggguccaauaagucaacacaacuacagaccaggcuacuuuacgcaaacagcgggucccuggcacuuaggcaaacuagaauuagauuuugaccugugcgaggguacuacuguuguaguagaugagcauugcgggaacagaggaccaucgcuuaggacaacuacagucacaggaaaaauaauucacgaauggugcugucgauccugcacacuaccaccccuacguuuuagaggagaagacggaugcugguacgguauggaaauucggccaguuaaggaaaaggaagaaaaucuggugagguccaugguuucggcggggucaggagaagucgauagcuuuaguuuagggauucuaugcgucagcauaaugauugaggaagugaugcguucuagguggaauagaaaaauguuaaugacggggacuuuagcuguguuccuacuucugaucaugggucagcucaccuggaacgaccuaaucaggcuguguauuaugguaggugcaaaugcaagugaucgaaugggaaugggcacaacguacuuagcguuaauggcuaccuuuaagaugagaccgauguuugcgguugggcuuuuauucaggcgcuugacaucuagagaaguccuccuacuaacgauaggccugucacugguugccucuguagaacuaccaaacuccuuggaggaacuuggggauggauuagcuaugggaaucaugauguugaagcuccugacagaauuucagccacaucaauuguggacuacacuguuaucccugacuuucauuaaaaccaccuuaucacuagacuaugccuggaggacaauggcaaugguauugucaauuguaucucuauuuccccuguguuuaucaacaacaucucagaagacgacuuggcuuccuguguuacugggcucuuuugguugcaaaccuuuaacuauguucuuaauaacggaaaauaaaaucuggggaagaaagucuuggccucuaaacgaagggauaauggcgauugggauagugucuauuuuauuaagcagcuugcucaaaaaugacgucccuuuggcagggccucuuauagcugguggaauguuaauagccuguuauguaauaucugggaguagcgccgaccucucacuagaaaaagcagccgaaguuuccugggaagaagaagcagaacauaguggaaccucucauaauauccuaguggagguacaagaugaugggacaaugaaaaucaaggaugaagaaagagacgauacuuuaacuauacuacuaaaagcgacucuuuuagccguuucaggcguauauccaaugagcauaccagcuaccuuauucguaugguacuuuuggcagaagaaaaagcaaagaagcggcguacuaugggauacgccaagcccuccagagguggaaagagcuguguuagaugacggcauuuauaggauucuacaacgaggucuucugggcagaucccagguuggcguugguguauuccaagauggagucuuucacacuauguggcacguuacaagaggagcaguacuuauguaucagggaaagagacuagaacccaguugggccucugucaagaaagaucuuaucucauacggaggaggguggagguuucaggguaguuggaauacuggggaagaaguucaagucaucgcaguagaaccaggcaaaaaucccaaaaacguacagaccacgccuggaacuuuuaaaacuccggaaggagaaguaggugcuauugcccuagauuuuaaaccugggacuucaggaagcccgauuguaaauagggaagguaaaauagucagcuuauacgggaacggcguuguuacgacgagcggaaccuauguaagugcuauagcgcaggcaaaaacaagucaagaaggaccacuccccgaaauugaggaugagguauucaagaaaagaaauuuaacgaucauggauuugcauccaggaucagguaaaacccgaagauauuugccagcgauaguacgagaagccaucaaaagaaaauugcgcacgcucauauuggcaccgacaagaguaguagcaucggaaauggcugaagcacuuaaagguaugccaauaagauaucaaacaacagcgguuaaaucugaacauacuggcagagagauaguugauuuaaugugucacgcaacauucacaaugaggcugcuuucaccagugcguguuccaaacuacaacaugauaauaauggaugaggcacacuucacugacccugcgaguauagcggcaagagguuauauaucaacacgaguuggcaugggugaagccgcagcuauuuuuaugacugcaacucccccuggauccguggaggcauucccgcaaucaaaugcggucauacaagaugaggaaagagacauaccagagcgguccuggaauaguggguaugacuggauaacugauuuuccaggaaagacuguuugguuuguaccaaguaucaagaguggaaacgacauagcuaacugucuuaggaaaaacggaaaaaggguaauacaacuuucacguaaaaccuucgacacugaauaccaaaagacuaaaaacaacgacugggauuacgugguuacgacagacauuuccgaaaugggggcuaacuucagggccgauagagucauagacccccggagaugccuaaaaccaguaauucuaaaagauggacccgaaagagugauauuggcaggaccuaugccaguaacgguagccucggcugcacagagacgugggcgaauugggagaaaccaaaauaaagagggugaucaauacguuuauaugggucaaccccuaaauaaugacgaagaccacgcacauuggacugaagcuaaaaugcuacucgacaacauuaacacucccgaaggaauaauuccugcacuguuugaaccagagagagaaaaaucugcagccauagauggagaauaucgacuucgaggugaggcgcgcaaaaccuuuguugaauugaugagacgaggcgaccuaccuguguggcuuuccuauaagguggccucugaaggcuuccaauacagugauagaagaugguguuucgauggcgaaagaaauaaccagguucuugaagaaaacauggauguagaaauauggacaaaggaaggcgagagaaagaaacugcgaccgcgcugguuagacgcuagaacuuauucggauccccuagccuuacgagaauuuaaagaguucgcugcaggaagaagaucuguauccggugauuugauucuagaaauugggaaacuaccucaacaccucacguuaagggcacaaaaugcgcuagacaaccugguaauguuacauaauucagaacaaggugguaaagcguacagacaugcaauggaagaacuuccagauacaaucgaaacuuuaaugcuguuggcacugaucgcgguacugacgggcggggucacacuauucuuuuuauccggaaaaggauugggaaagacaucaauagguuuacucugcguaauggcuucaagcgcacuucuuuggauggcaaauguugaaccucauuggauagcagcaaguauaauucuggaauuuuucuuaaugguacuacugauuccagaaccggacagacaaagaacaccacaagauaaucaauuagcauauguaguuauaggucuacuuuuuaugauuuuaacaguagcugcuaaugaaaugggucuguuagaaacgaccaagaaagacuuaggcauaggacauguugcagcagaaaaucaacaccaugcgacaaugcucgacguagauuuaagacccgcaucugcguggacucucuacgcaguggcaacgacaguaauaacgccaaugaugagacauacaauugaaaauacaacagccaacauuagcuuaacagcuauugcaaaucaggcggcaauucuaaugggguuggauaaaggcuggcccauaaguaaaauggauauaggcguaccauuacucgccuuaggcugcuacagccaaguuaauccucucacccuaacugccgcaguucuuauguuaguagcacauuacgcuauaauugguccaggacuccaagcuaaagcuacgagagaagcacagaaaaggacggcugcaggaaucaugaaaaauccgacaguugacgguaucguagcuauugacuuagacccgguaguguaugaugcaaaauuugagaagcaauuaggacaaauuaugcuacuaauucuaugcaccagucaaauccuauuaaugagaacaacaugggcacucugugaaaguaucacauuagcuacugggccacuaaccacucuaugggaagguucaccaggaaaauucuggaacacgacuauugccgugaguauggccaauauauuucgagguucauaucuagccggugcaggccuagcguuuucacucaugaaaagucuuggaggaggacggagagggacaggagcgcaaggcgaaacucuuggggaaaaguggaaaagacaguugaaucaacugagcaaaucagaauuuaauaccuauaaacgcucugguaucauggagguugauagaagcgaggcuaaagagggccuuaaaaggggugagacaacaaaacaugcuguaucacgggggaccgcuaaacuacgaugguuuguagaaagaaauuuaguaaaaccugagggaaaaguaauagauuuagguuguggaagaggaggguggaguuacuauugcgcgggauugaagaaaguaaccgagguaaaggguuacacuaaaggaggaccgggacacgaagaaccaauaccuauggccaccuacggauggaacuuaguaaaguuguauagugguaaagacguguucuuuaccccuccugagaaaugugauacauuguugugugauauaggggaaagcucaccgaauccaacgaucgaggaaggcagaacacuaaggguacucaagauggucgagccaugguuacgggguaaucaauucuguaucaaaauauugaaucccuauaugccauccguaguagaaacacuggagcaaaugcaaagaaagcauggaggcaugcuuguucgaaaucccuugaguagaaauucaacacaugaaauguauugggugucguguggaacuggaaacauuguuucugcuguuaacaugacaucccguaugcuguuaaaucgauucacuauggcacaucgaaaaccaacguacgaacgagacguggaccuuggggcgggcacuagacauguugcugucgagccugaaguugcuaaucuagauauaaucgggcaaagaauugaaaacauuaagaaugaacacaaaucaaccuggcauuacgaugaagauaacccauauaaaacgugggcauaucacgggagcuacgaagucaaacccucagguuccgcaucgucuaugguuaaugguguaguccguuuacuaacaaagccuugggacguuauaccuaugguaacccagauugcuaugacagauacgacuccauuuggucaacagagaguauuuaaagaaaagguugauacucgaacaccacgcgcgaagcguggaaccgcacaaauaauggaagucacugcaaaauggcucuggggauuuuuaagucgaaauaagaaacccaggauauguacaagggaagaauuuacacguaaaguacgaagcaacgcagccauuggagccguguuuguugacgaaaaccaguggaacagugcaaaagaagcaguggaagacgagagguuuugggaccuagucuauagagaacgugaauuacacaaacaaggaaaaugugcaacgugcguauacaauaugaugggaaaaagggagaagaaacuuggagaauuuggaaaagcuaaagguaguagagcaauuugguacaugugguuaggugcgagguuucuagaauuugaagcacuaggauucaugaaugaagaccauugguuuagcagagaaaacucauuuucaggaguugaaggggaaggccuucacaaacuaggguauauacuaagggacaucaguaaaaucccaggugggaauauguacgcagacgacacagcagggugggacacaagaauaacagaagacgaccuacagaacgaagcaaaaauuacugauauuauggaacccgaacaugcuuuacuugccacgagcauuuuuaagcugacuuaucaaaacaaaguaguacgaguacagaggccagcaaagaaugggacaguuauggacguaauaagcagaagggaccaaagaggaaguggccaagucggcacauacggucuuaacacuuuuacuaacauggaaguccaguuaauuaggcagauggaaagugaaggcauuuuccuaccaagcgagcuagaaaccccuaacuuagcggaacguguacuggauugguuagagaaacaugguaccgaacgcuugaaaagaauggccauuuccggagacgacugcguggucaaacccguagaugaucgauuugcuaccgcuuuaauagcguuaaaugauaugggcaagguaagaaaagauaucccacaaugggaaccguccaaagguuggaaugauuggcaacaagugccauuuugcucccaucacuuucaucaacugauaaugaaagacgggcgagagauaguaguuccauguagaaaucaagaugagcuuguaggucgagccaggguaucucaaggagcaggauggucacugagagagacugcuugcuuaggcaaguccuacgcacaaauguggcaacuaauguacuuccaucgcagagaucucagacucgcagcgaacgcgaucugcagugcaguaccgguagauuggguucccaccucgagaacuacauggaguauucaugcacaccaccaguggaugaccacagaagauaugcucucaguuuggaaucguguguggauugaagaaaauccauggauggaagacaagacacauguaagcagcugggaggaaguaccauauuuagguaaaagggaggaucagugguguggcagucuuauugggcuaacagcacgugcgaccugggcuacgaauauacagguugccaucaaucaaguacgaagauuaauagguaaugaaaauuaucuagauuauaugacauccaugaagagauucaaaaaugaaucugacccugaaggagcacugugguag

SEQ ID NO: 21349 - RNA, 9879 nt, Artificial Sequence
  derived and/or modified CDS sequence (opt6) from DENV-1__KJ189350__SS-prME
ucaguaacaauguuguuaaugcuccugccgacggcguuagcguuucacuugaccacaagagguggagaaccucacaugauaguaagcaaacaagaacgaggaaagagcuuauuguuuaaaacgucugcuggggucaauaugugcacucuaauagcaauggacuuaggugaacugugugaggauacaaugacuuauaaaugcccgcggauaacugaggcagaaccggacgauguggauugcugguguaaugccacagauacauggguaacguaugggacauguucccaaaacggagaacaccggcgagagaaaagaaguguagcacuagcuccccauguuggacuuggcuuggaaaccagaacugaaacauggaugucaucugaaggagcuuggaaacaaauacaacguguagagacaugggcguuaaggcauccggguuuuacaguuauugcauuuuuccuagcacaugcuauuggcacaaguauaacacaaaaaggaauaauauucauucuacuaaugcuuguaacaccaaguauggccaugcgaugcgugggaauuggaaauagagauuucguugaaggguuaagcggcgcgacauggguugacgugguacucgaacacgguucaugcgucacuacaauggcuaaaaacaaaccuacucucgauaucgaacuauugaaaaccgaaguuacaaauccugcaguauuaagaaaauuauguauugaagcuaaaauaucaaauacuacaacagauagccgcugcccaacacaaggugaagcaaccuuaguagaagaacaagacgcuaauuuuguaugccgucgaacauucguagauagagguugggggaacggcugcggacucuucggaaaaggaaguuuacuuaccugugcaaaauucaagugugucacuaaauuggagggcaaaaucguucaauaugagaacuuaaaauauagcguaaucguaacagugcauacuggugaccaacaucaagucggaaaugaaacaacggaacaugggacuaucgcuacgauuaccccucaagccccaacuucugaaauacaauugacagacuauggcgcacuuacacuggauuguucaccuaggacaggacuugauuuuaaugaaaugguacuacuaacuaugaaagagaaaaguugguuaguacauaaacagugguuucuagaccuacccuuaccauggaccaguggggccucuacaucucaggaaacauggaauagacaagacuuauugguaacguucaaaacagcacaugcgaagaaacaagagguaguaguacuagguagucaagaaggagcaaugcauacugcuuuaacaggugcuacggaaauacaaacaucuggaacuacuacaaucuuugcuggacacuuaaaaugcaggcuuaaaauggauaaauugacguuaaaaggaaugagcuaugugaugugcacagguucuuuuaaacuugagaaagaaguagcugagacucaacaugggacuguucuuguucaagugaaauacgaaggaacggaugcaccuugcaaaauaccguucaguacgcaagacgaaaaaggaguaacgcaaaacggaagauuaaucacugccaaucccauuguuacugacaaagagaaaccagucaacaucgaaacugaaccgcccuucggugaaucuuauaucguuguaggagccggcgaaaaggcuuugaaguugaguugguuuaaacggggcucaucaauagggaaaauguuugaagcuacugcaagaggagcacggagaauggcaauuuuaggugauacagcaugggacuucggaaguauagggggaguuuucacaucgguuggaaagcucguucaccaaauauuuggaacugcauaugggguucuuuuuagcggcgugucguggacaaugaaaauaggaauaggaauauuacuaacaugguuaggccucaauucaagaucgacaucucuaagcaugaccugcauagcgguaggcaugguaacacuuuaucucggcguaaugguacaggcugacagcggauguguuauaaauuggaaaggccgagaacugaagugcggauccgguauauucguuacaaaugagguacauaccuggacagaacaauauaaauuucaagccgauucucccaaacgguugucggcagcaaucgggaaagcaugggaagagggagugugcgguauaaggucugccacucgucuugaaaauauaauguggaaacaaaucucaaacgaacuuaaccauauauugcuagaaaaugacaugaaauuuacaguuguaguuggcgaugcgaacgggauacuugcucaaggaaagaaaaugauccgaccacaaccaauggaacauaaauacucguggaaaucuugggguaaggcgaaaauaauaggagcggauauacaaaauacgacauucauaauagacggcccagauacaccugaguguccagacggccaaagagccuggaauaucugggaaguagaagacuauggcuuuggaguguuuacuaccaauauauggcuaaaguugcgggauucuuauacacaaaugugugaccacagacuaaugucggcggcuauaaaagacagcaaagcaguccacgcagauauggguuauuggaucgaaucggaaaagaacgagacuuggaaauuagcgagggcaaguuuuaucgaagugaaaacuugcacauggcccaaaucucauacacuauggucuaacggggugcuagagucagagaugaucauaccgaaaaucuaugguggcccaauaucucaacauaauuaucguccagguuauuucacacaaacugcggggcccuggcauuuggggaaauuggaacuggacuucgaccuuugcgaaggcacaacgguuguaguugaugagcauugugggaauaggggcccuucucuucguacaacuacuguaacagggaagauaauacaugaaugguguugcagaucauguacccugcccccguugagauuucgcggugaagauggauguugguauggaauggagauaagaccgguuaaagagaaagaggagaacuuagucagaaguaugguaucagcagguaguggagaaguugacucuuuuagcuuaggcauccuauguguaucuauaaugauagaagaaguuaugagaagcagauggagucgaaaaauguuaaugacugguacauuagcgguuuuucuucuguugauaaugggccaacugacauggaacgaucucauacgauugugcauaauggucggagccaaugcuucagaccgaaugggcaugggaacgacuuaucuagcauuaauggcaacauuuaagaugcgaccaauguuugcaguagggcuguuauuccggcguuuaacuucacgugaaguucuuuuauuaacuaucggccuaucacuuguagcuagcguugaguugccaaauucgcuagaagaauugggagauggguuagcuaugggaauaaugaugcuaaaacucuugacggaauuucagccucaucaauuguggacgacccuuuugucccuaaccuuuguuaagacuacguugagccuggauuacgcuuggaaaacuaccgcuauggcacuaucuauaguuagucuguuuccucucugucuaucuacaacaucucaaaagacuacguggcuaccaguacuacucgguuccuuuggaugcaaaccccuaacaauguuucugauaaccgaaaacaaaauuuggggacggaaaucuuggccucugaaugaaggaauaauggccauagguauaguuuccaucuuauuaucaaguuuguugaagaaugacguaccccuagcaggaccucuuauagcuggaggaaugcuuauagcuugcuacguuauuagcggaaguagcgcagauuugaguuuagaaaaagcagcagaagugaguugggagcaggaggcagaacauucuggugcaucacauaguaucuugguagagguacaggacgacggaaccaugaagauaaaggacgaagagagggaugauaccuuaaccauacugcuaaaggcaacauuacuagccguuucagguguauacccuaugucaauucccgccacguuauuuguuugguacuuuuggcaaaagaagaaacaacguuccggaguuuugugggauacuccuucucccccagaaguagagagagcgguauuagacaacggaauuuaccgcauauuacaaagaggacuauugggucgaagucaagucggcguuggagucuuccaggauggaguauuucauacaauguggcacguuacaagaggagcuguacugauguaccaaggaaaacgccuagaaccuucaugggcaagcgucaaaaaggacuuaauuucguauggcggggguuggcguuuucagggcuccuggaauacaggugaggaaguucaaguuauagcaguugaaccugguaaaaaucccaaaaaugugcaaacgacaccaggaacuuucaaaacaccugaaggagaaguuggcgcaauagcacuggacuuuaaacccggaacaagcgguucaccgaucgucaaucgugagggcaagauugucgguuuguaugguaacggaguaguaacgacaucagggacuuauguuucggcaauugcacaagcuaaagccucucaagaaggacccuuacccgaaauugaagaugaaguuuucaagaaaagaaaucucacaauaauggaucuacauccuggcaguggcaagacgcgcagauaucuuccagcuauaguuagagaagcgauuaaacggaaauuaagaacgcucauucucgcaccaacaagagugguagcuucagagauggcggaagcacuuaagggcaugccuaucagauaccaaacaacagccguuaaaucagaacacacuggccgagaaauaguagaucucaugugucaugcuaccuuuacuaugagauugcuaucaccgguucgggucccaaauuauaauaugauaaucauggacgaagcgcacuuuaccgauccugcaucuauagcugcgagaggcuauaucucuacacgagucgguaugggagaagcugcagcaaucuuuaugacagcaacucccccgggaucuguugaggcuuuuccacaaucgaaugcggugauccaggacgaagaaagggauauaccugaaaggucuuggaauaguggcuacgacuggaucaccgauuucccagggaagaccgugugguuuguuccaucgauaaaauccgguaaugacauugcaaauuguuugaggaaaaaugggaagcgaguaauacaguugucucggaagacuuucgacaccgaguaucagaaaacgaaaaacaacgauugggauuacguuguuacaaccgacauuagcgaaaugggcgcuaauuucagggcagacaggguaaucgauccgcguagauguuuaaaaccagugauucuuaaagauggaccagaaagagugauucucgccggccccaugccggucaccgcugccuccgcugcacagagacgggguagaauaggaagaaaccaaaauaaagaaggagaccaauacguguauaugggucaaccgcuuaacaaugacgaggaccacgcacacuggaccgaggcuaagauguuauuagauaauauaaauacacccgaagguaucaucccggcucuguucgagccggaacgggagaaauccgcagcgauagacggagaauaucgucuuaggggagaagcacgcaaaacguuuguggaauuaaugagaagaggagaucuuccaguaugguugagcuauaaaguagcuucagagggcuuucaauauucugauagaagaugguguuuugacggcgagcguaacaaucaaguucuugaagagaauauggauguagaaaucuggacuaaagaaggagaacguaagaaacugagaccucgauggcuagacgcacgcaccuacucagauccgcuugcucuuagagaauuuaaagaauuugccgcgggucgaagaagugugucaggcgaucuaauacuugaaauagggaagcuaccacagcaccuaacucuacgggcucaaaacgcucuagauaacuuaguaaugcuacauaauucagaacaaggagguaaggcauacagacaugccauggaggaauuaccagacacaauagaaacgcugaugcugcuagcucugauugcgguauugaccggcgguguaacauuguuuuuccucagcgguaagggccuuggaaagaccucaauuggauuguuaugcguaacggcuucuucugcgcuucuuuggauggcuucgguggagccucacuggaucgcggcuucgauaauacuagaguucuuccucaugguacuguuaauucccgaaccagacagacaacgcaccccucaggacaaucaacuugccuacguaguuaucggcuuacucuucaugauccugacggucgcggcaaacgaaaugggacuguuggaaacgacuaagaaagaucuugggauagguuauguugcggcugaaaaccaucaacacgcaacuauguuggauguggacuuacaucccgcuagcgcauggacucuuuaugccguagcaaccacagugauuacaccgaugaugcgccacacuaucgaaaauaccacagccaacauaucucucacagcaauagcuaaccaagcugcaauccucaugggucuagauaaaggauggccgauuagcaagauggacauuggcguaccguuacuugcacuggguuguuauucacaagucaauccacuaacucuaacagcugccguccugaugcucguugcccauuaugcaauaauaggaccuggacuacaagcgaaagcaacgcgagaagcgcagaaaaggacagcagcaggcaucaugaaaaaucccacaguagacggaauaguagccauugaucuagaucccgucguauaugacgcaaaauuugaaaagcaacugggacagauuaugcuacuuauacuauguacuucucaaauccuccuaaugcggacaaccugggcacuaugugaaucgauaacccuagcgacgggaccuuugacuacuuuaugggaagguucaccagggaaauuuuggaauacuacuauagcaguuagcauggcaaauauauuucgaggaaguuaucuugcgggagcgggacuugcguuuucuuuaaugaaauccuuagguggugguaggcgaggaacuggugcacagggggaaacgcugggggaaaaauggaaaagacagcuuaaucaauuaucaaaaucggaguucaauacauacaaaagauccggaaucauggagguagauagaucagaagcaaaagaaggacuuaaacgaggggagacaacuaagcaugcuguuuccagaggcacagccaaauuaagaugguucguagaaagaaaucucgugaaaccagaaggcaaagucauagaccucggcugcggacgaggaggauggucauauuauugugcuggacuaaagaaaguaacggaaguaaaaggguacacaaagggaggaccugggcaugaagaaccgauaccaauggccacuuaugguuggaauuugguuaagcuacauagcggaaaggaugucuucuucaugccaccagaaaaaugugauacauuacuuugugacauuggagaaagcaguccgaauccaacgaucgaagaagguagaacucuuaggguccuuaagauggucgaaccuuggcuuagaggcaaccaauuuugcauuaaaauucuaaauccuuauaugccgagcgugguggaaaccuuagagagaaugcaaagaaaacauggaggaaugcuggugaggaacccauugagccgcaacagcacacacgaaauguacugggucucuugugggacaggaaacaucguaagugcuguaaacaugacaucaaggauguuauugaauagguuuacgauggcucauagaaaaccaacuuacgagagagauguagacuugggggcugggaccagacacguugcuguagagccagaagucgcaaauuuagauauuauugggcaaagaauagaaaauaucaaaaaugaacacaagucgacauggcacuaugacgaagauaacccauacaaaacaugggcguaucaugguaguuaugaaguaaaaccgagcggaagugccucuucgauggucaauggagugguaagacuacuuacaaaaccaugggacguuauaccuauggucacacaaauagcaaugacugacacuacaccauucggccaacaaagaguauucaaagagaaagucgauacacggacgccacgggcaaaaagagguaccacccaaauaauggagguuacagcuaaaugguuauggggauucuuauccagaaauaaaaagccaagaauaugcacacgagaagaguucacacggaaaguaagaagcaacgcagcgauuggugcgguuuuuguagacgaaaaccaauggaauagcgcaaaagaagcagucgaagaugagagauucugggaccugguacaccgagagagagaacuucauaaacaagguaaaugcgcaacgugcguauauaacaugauggguaaacgcgagaagaaacugggagaauuugggaaagcaaaagguagucgagcuauuugguauaugugguuaggugcaagauucuuggaguuugaggcccuagguuucaugaaugaagaucacugguuuucacgagaaaauaguuuaaguggaguagaaggggaaggacuucauaaacuagguuauauuuugagagauauaagcaagauaccaggaggaaauauguaugcagacgauaccgcaggaugggauacaagagucacugaagaugauuuacaaaacgaagccaagauaacugauauaauggaaccugaacacgcuuugcuugccacaaguauuuucaaacuuaccuaccagaauaaggucgugagagugcaacgcccagccaaaaaugguacuguaauggauguuauaucucgacgugaucaacgugguucaggacaaguuggcacauaugguuuaaauacauucaccaauauggaaguucaacucauacgucaaauggaaucggaaggcaucuuuuugccaagugaauuagaaacgccaaauuuagcagaacgagcgcuugauugguuagaaaaacacggugcagagagauuaaaacggauggcuauaucuggcgacgacugcgucgucaaaccaaucgaugauagauuugccacugcauuaacggcauuaaaugacaugggcaaagucagaaaggacauaccucagugggaaccaaguaaaggauggaaugacuggcaacaaguaccauucuguagccaccauuuccaucaauuaauaaugaaggauggacgugaaauaguaguucccugcagaaaucaagaugaauuaguagguagagcccguguaagucagggugcugguuggagcuuaagggagacggccugccuaggaaaaagcuaugcacaaauguggcaacuuauguacuuucauagacgagaucuuagauuggcagcuaacgcuauaugcagcgcuguuccgguugauuggguuccaaccucucgcacaacauggaguauacacgcucaccaccaauggaugacaacagaagauaugcuguccguuuggaaucgagucuggauagaagaaaauccauggauggaaaauaaaacucauguaucaucaugggaagaggugccauauuuaggaaaaagggaagaucaguggugcgguucccucauuggucuaacggcuagagcaacaugggcuacuaacauacaaguugccauaaaucaggugcgaagauugauuggaaaugaaaacuauuuagacuauaugacaaguaugaagagguuuaaaaacgaaagcgacucggaaggugcguugugguag

SEQ ID NO: 21350 - RNA, 9879 nt, Artificial Sequence
  derived and/or modified CDS sequence (opt6) from DENV-1__KJ189351__SS-prME
agugucacuaugcuauuaaugcuucuuccuacaguacuagcguuucacuugaccacuagggguggggaaccucacaugauuguaucuaaacaagaaagagguaaaucuuuauuauuuaaaacuucagcgggaguuaauauguguacacuaaucgcaauggacuuaggagaauuaugcgaagacacaaugacuuacaaaugucccaggaucacugaagccgaaccggacgauguagauugcuggugcaacgcgacggacacauggguaacuuacggaacaugcagucaaacgggagaacauaggagggagaaaaggucagucgcucuagcaccacauguagguuugggccuugaaacaagaacugaaacauggaugucuucggaaggggcguggaaacaaauccaacgaguagaaacaugggcacuucgacacccuggguuuacaguaauugcauuuuuccuagcacaugccauuggaacaagcauuacacaaaaaggaauuauauuuauucuacucaugcuaguaacuccuucuauggcuaugcggugcguagggauaggaaauagagacuuuguagaaggccuuaguggugcaacauggguagacgugguacuugaacacgguucaugcgugacaacuauggcuaaaaauaaaccaacacuggauauagaacuacuaaaaacggaaguaaccaauccagcgguauuacggaaauuauguauagaagcuaaaauuagcaauacaacuacugacagcagauguccaacucaaggggaagcaacucuugucgaagaacaagaugcaaauuuuguuuguagacguaccuucguagauagagguuggggcaaugguuguggacucuucgggaagggaucacucuuaaccugugcgaaauucaaguguguaaccaaauuagaaggaaaaauaguacaguaugagaaccuaaaauauagcguuauaguuacgguacauacgggcgaccaacaucaaguaggcaacgaaacaacagaacauggaaccaucgcaacaauaacuccccaagcaccuacgucggaaauacaauuaacagauuauggugcucuaacgcuagacuguucuccgagaacaggauuagacuucaaugagaugguguuacuaacaaugaaagagaaauccuggcuaguacauaaacaaugguucuuagaucuaccgcuucccuggacaccgggcgcgucaacaagccaagaaacauggaauaggcaagaccuguugguuacauuuaaaaccgcucaugcuaagaagcaagagguuguagucuugggcagucaagaaggcgccaugcauacagcauuaaccggagcaacagaaauacaaacuucagguaccacaacaauuuucgcagggcauuuaaaaugcagacuuaaaauggacaagcucacguuaaaaggaaugucauacgucaugugcacgggaucauuuaaguuagaaaaagaaguagcugaaacacaacacggaacaguguuaguccaagugaaauacgagggaaccgaugccccguguaaaaucccauuuagcacgcaagacgaaaaaggagucacgcaaaacggccgauuaauaacagcuaauccaauugucacagacaaagaaaagcccguaaacauugaaacggaaccacccuuuggugaguccuauauaguaguaggugcgggggagaaagcauuaaaauuaagcugguucaaacguggauccuccaucggaaaaauguuugaagcaacagcaagaggcgcuagacgaauggcuauuuugggcgauacggcaugggauuuuggaucaauugguggaguguuuacaucaguggggaaguugguacaccaaguauuuggaacugcauacgguguacuauuuagcggaguauccuggacaaugaaaauagggauaggaauacugcuuacguggcuaggacucaauagcagaucuaccucacucuccaugacuuguauugcuguagguaugguaacacuuuaucugggaguaaugguccaagccgauagugggugugucauuaauuggaaaggaagggagcuaaaauguggaagcggcauuuucguuacuaaugaaguacauaccuggacagaacaauauaaauuucaggcugacucaccuaaacgcuuaagcgccgcuauaggcaaggcaugggaagaaggcguauguggcauaagaagugcaacaagacuagaaaacauaauguggaaacaaauuucuaacgaauuaaaucauauauuguuagaaaaugacaugaaauuuacaguuguaguaggcgaugcuaacgguauacucgcacaggguaaaaagaugauaaggccccaaccaauggaacauaaauauucguggaaaaguuggggcaaggccaaaauaauaggagcugauauccaaaacacuaccuucauaauagacgggccagauacacccgaguguccugacggacaacgugcuuggaacauaugggaaguggaagacuauggauuuggaguauucacaacaaauauuugguuaaaacugcgagauucauauacccaaaugugugaccacaggcuuaugucugcugcaaucaaggauagcaaagcuguucaugccgauauggguuauuggauagaaucagagaaaaaugaaacauggaaauuggcccgagccucauuuauagaagucaaaacaugcacuuggccuaaaucccauacucuuuggucuaaugggguauuagaaagugaaaugauuauaccaaaaaucuacggugggccgauaucgcaacacaauuacagacccggcuacuuuacacagacagcaggcccauggcaucucggaaaguuagaacuagacuucgaucuaugugagggaacaacgguggucguagaugaacauugcgguaauagggggccauccuugcguacuaccacuguuacaggcaaaaucauccaugaguggugcugccggaguugcacgcuaccaccguuaagauuuaggggcgaagacgguuguugguacggaauggaaauaagaccagugaaggagaaggaagaaaaccugguacggagcauggucucagcagguaguggugaagucgauucguucucgcuaggcauccuauguguauccauaaugauagaagaaguaaugcggucacguuggucaaggaagauguugaugaccggaacacuugcuguauuucuacuuuuaauuauggggcaauugaccuggaacgaucucacacgacugugcaucaugguaggugcuaaugcgucugaucgaaugggaaugggaacuacauaucuugcuuuaauggcgacuuucaaaaugcggccaauguucgcgguaggacuacuauuccgacgauuaaccaguagagaggugcuucucuuaaccauugguuugucucuaguugccucaguagaacugcccaauagccucgaagaacuaggugauggacucgcaaugggaauuaugauguugaaguuguugacggaguuucaaccucaccaauuauggacuacauuacuuaguuuaacguuuguuaagacaacguuaucguuagauuaugcauggaaaacuacagcuauggcacuaagcauugugucucuauuccccuuaugcuuaucaacaaccagucagaaaaccacaugguuaccgguucuacucggcaguuuuggguguaagccuuuaacgauguuccugauugcggagaacaggauauggggccgaaaaucguggccucuuaaugaagguauaauggccauugguauaguaaguauccucuuaaguucuuugcucaaaaaugauguuccacuagcugggccucuaauagcuggugggauguuaauugcuuguuaugugauaucugguucuucagcagaccugagccuagaaaaggccgcagaggugucuugggaacaggaagcagaacauucuggugcaucacacuccauauugguugaaguacaggacgacgggacaaugaaaauuaaagaugaagaaagagacgacacguugacaauuuuauugaaagcgacacugcucgcugugucaggaguguacccaaugaguauucccgccacacucuuuguaugguacuuuuggcagaagaagaaacagagauccggcguucucugggauacgccaaguccaccagaaguggaacgcgcagugcucgacaauggaauauauagaaucuuacagaggggccuuuugggacgaucccaaguaggcgucggcguauuucaggauggaguguuucauacuauguggcauguaacuagaggugcaguuuuaauguaucaaggaaaaagauuagaacccucgugggcuagugugaagaaagauuuaauuaguuacgguggcggauggcgcuuucaaggaucuuggaauacaggugaggaaguucaagucauagcugucgagccggggaaaaaccccaaaaacguucaaacuacaccgggcacauucaaaacgccugaaggggaggucggagcgauugcgcucgauuucaaaccuggaacuucuggaagcccaauugucaacagggaaggaaaaauuguugguuuauacgggaacggggugguaacgacgucaggaacuuacguuucagccauugcccaggcgaaggcuucgcaagaaggaccauuaccagagauagaagaugaaguauuuaagaaacguaauuuaaccauuauggaucugcacccagggagcgggaaaacuagacguuacuuaccagcuauuguuagagaagcuauuaagagaaaacuuagaacacuaauacuagcuccaacccgagucguugccucagaaauggccgaggcucuuaaaggaaugccgauucgguaucaaacaacugccguaaagucagaacauacuggccgugaaauaguggaucuaaugugucaugcaacuuuuacaaugagacugcuaaguccuguccgcguaccaaauuacaauaugauaauaauggaugaagcccauuucaccgacccugcuucaauugcagcuaggggauacauaaguacgagaguaggaaugggagaagcagccgcuauauucaugacggcaaccccuccuggaucgguagaagcauuuccccaaaguaaugcugugauucaggaugaagaacgagacauaccugagcggagcuggaacucggguuacgacuggauaacagauuucccggguaaaacaguaugguucguaccaucgauaaaaagugguaacgauauagcuaacugucuuaggaaaaacgggaaacgagucauacaauuaagucggaagacguucgauacagaguaucagaaaacgaaaaauaacgauugggauuacguuguaacuacugacauauccgaaaugggagcaaauuuucgcgcggauagagucauagauccaagacgcugucuaaaaccuguaauucuaaaagauggccccgaaagagugauccuagcaggaccgaugccaguuacaguagcuucugccgcacaaaggaggggacgaaucggcaggaaucagaauaaagagggugaucaguacguauauaugggacaaccacugaauaaugacgaggaccacgcacauuggacagaggcaaaaaugcuacuugauaacauaaacacaccagaagguauuauaccagcacuauuugagccugaacgcgaaaaaucugcagcaauagacggcgaguacagauuaaggggugaagcgcgcaagaccuuuguugaauuaaugcgaagaggcgaccucccgguaugguuaucuuauaagguagccagugagggauuccaauacucugaucgaagaugguguuuugacggagagcguaacaaucaaguacuugaggaaaacauggacguggaaaucuggacaaaagaaggagaaagaaagaagcugagaccaagauggcuugacgcgagaacuuacagcgauccauuagcacuacgggaguuuaaagaauuugccgcugggaggagaagugugagcggagacuuaauauuggagauagggaaauuaccacaacaccucacauuaagagcacaaaaugcacucgacaauuugguuauguugcauaauuccgaacagggugguaaagcguacaggcaugcgauggaggaacuucccgacacaauagagacauuaauguuacuugcguuaauagcaguacuuacaggaggcguaacacucuucuuucuaucgggaaaagggcucgguaagacgucaauaggguugcuaugcguaacagcgucaagugcacugcuauggauggcauccguagaaccccacuggauagcugcaagcauaauucuggaguucuucuugaugguacuacuaauacccgaaccggaccgacaaagaacaccacaagauaaucaauuagcauaugucguaaucggcuuauuauucaugauuuugacagucgccgcaaaugaaaugggacuucuagagacgacaaagaaagauuuaggcauaggcuaugucgcugcugaaaaucaucagcacgcuacuauguuagauguagaucugcacccagcaucagcauggacccuauaugcgguagcuacgacaguuauaacaccuaugaugcgacauaccauagaaaauaccacugcgaauaucagccucacggcaauagcuaaucaagcagcgaucuuaaugggcuuggacaaagguuggccaauaucaaaaauggacauaggaguaccauuauuggcuuugggaugcuauucccaaguaaacccguugacucuaacggccgcuguccuaauguuaguagcacacuaugccauaauagguccaggauuacaagcaaaagcaacacgagaagcucaaaagaggacagcggcaggaauuaugaaaaaucccacgguugacggcauuguagccauugauuuggaucccguaguauaugaugcuaaauuugaaaagcaacuaggucaaauuauguuauugauacucugcacaagucaaauucuccucaugagaacuacuugggcauuaugugaaagcauaacauuggcuacaggaccacugacgacacuuugggagggaucacccgggaaauuuuggaacacaaccauagcaguuucaauggcgaacaucuuuagaggcagcuaucuagcuggugccggacuagccuuuagcuuaaugaagucauugggagggggcagaaggggaacaggagcacaaggcgagacucugggagaaaaauggaagaggcaacuaaaccaacuaucaaaaagugaauuuaacauauacaaaagaucuggaauuauggaaguugacagaucagaggcgaaagaaggucugaaaagaggagaaacaacaaaacaugcaguuagccgaggaacagcaaaauuacgaugguuuguagaaagaaauuuaguaaaaccagagggaaagguuauagaccuaggauguggcagggguggauggucauacuacugugcggggcuaaagaaaguaacggagguaaaagguuacaccaaagggggaccagggcaugaggaaccuauaccaauggcgacuuaugguuggaaucucguaaaacugcauucgggcaaggacguauuuuucaugccaccggaaaaaugcgauacacuauuaugcgauaucggcgaaucaaguccaaauccaacaaucgaagaagggagaacauuacgaguucuaaaaaugguugaaccaugguuaaggggaaaccaauuuuguguuaaaauacuuaaucccuauaugccuucugucguagagacgcuagagaggaugcaacggaaacacggaggcaugcuuguacgcaauccgcucucccgaaauuccacacaugagauguauuggguaucgugugguaccggaaauauaguguccgccguaaacaugaccucuagaaugcuccugaauagauuuacaauggcucacagaaaaccuaccuaugagagagaugucgaucuuggagcuggaacccgacacgucgcaguugaaccggaaguugcaaaccuagauaucauaggucaaagaauagaaaacauuaaaaaugaacacaaaagcacguggcacuacgaugaggacaacccuuauaagaccugggccuaccauggaucuuaugaaguaaaaucaagugguucggcaagcuccaugguuaauggaguagugagguuguuaacaaagccaugggauguuauaccgaugguaacucaaauugcuaugacggacacaacaccauucggucaacaaagaguauucaaagaaaagguagacacuaggacuccuagggccaaaagagguacgacccaaauuauggaagucacugcaaaaugguuauggggguuuuugucucguaacaagaaaccccggauuuguacacgagaagaauuuacucguaaagucaggagcaaugcugccauaggagcaguauuugucgaugagaaccaguggaacucagcaaaagaagcagucgaagaugaaagguuuugggauuuagugcauagggaacgagagcuccacaaacaaggaaagugugcuaccuguguguauaauaugaugggaaagcgugagaagaaauugggagaauuuggaaaagcuaagggaaguagggccauaugguacauguggcuaggugcaagauuuuuagaauuugaggcuuugggcuucaugaaugaagaccacugguuuucaagggaaaacagcuuaagcggaguagagggugaaggacugcacaaacugggauauaucuuaagagauauuaguaagauuccaggagggaacauguaugcagacgauacggccggcugggauacucggauuacagaagaugauuugcaaaaugaggcuaagauaacggacauaauggaaccagaacaugccuuacuagcaacaucaaucuuuaaauugacauaucaaaacaaaguggugcgcguccaaaggccugcuaagaacgguacugucauggaugucauuucaaggagagaccaaagaggauccggacaaguuggaacguacggauugaauaccuuuacuaauauggaagugcaguuaauaaggcaaauggaaucggaaggaauauuuuugccguccgagcuagagaccccuaauuuagcagaaagagcguuagacugguuagagaaacacggggcugaacgccuaaaaagaauggcaauaaguggugaugauugcgucguaaagccgaucgaugacagauucgcaacagcauugacagcucugaaugacaugggcaaaguuagaaaagauauaccacaaugggagccgaguaagggauggaacgacuggcaacaaguaccauucugcagucaucacuuucaccaauuaaucaugaaggauggaagggaaaucguaguuccauguagaaaucaagaugaauuaguaggcagagcuagaguaucacagggugcuggcuggagccuccgagaaacagcauguuuagguaaaucauaugcucaaauguggcaauuaauguauuuccauagacgugaucuacguuuagcggcaaacgcgauauguagugcugugcccguugacuggguucccacgucucggaccacauggucgauucacgcacaccaccaauggaugaccacugaggauaugcuaucgguuuggaaucgaguauggauagaggaaaacccuuggauggaggacaagacacacgucucuaguugggaggagguaccauauuuagggaagagagaagaucaauggugcggcucauuaauaggauugacugcacgggcgacgugggcaaccaauauucaagucgcaauaaaccagguacgaagguuaauuggaaaugaaaacuaucucgauuauaugacaaguaugaaacgauuuaagaacgaaucagauucagaaggggcccuaugguaa

SEQ ID NO: 21351 - RNA, 9879 nt, Artificial Sequence
  derived and/or modified CDS sequence (opt6) from DENV-1__KJ189352__SS-prME
aguguaacaaugcuguuaaugcuacuaccuaccgcguuggcuuuucaccucaccacccgaggaggugaaccccacaugauugucucuaaacaggaacggggaaaaucauuacucuucaaaaccagcgcgggcgugaauauguguacucuuauagcgauggacuuaggggaauuaugcgaagauacaaugacauacaaaugcccacgcauaacagaagcagaaccggacgacguagacuguugguguaacgcaaccgacacaugggucaccuauggaacguguagccaaaccggcgaacaccgaagagaaaaacgaucaguugcacuagcgccucaugugggacuugguuuagaaacgcguaccgaaaccuggaugaguucagaaggugccuggaagcaaauacaaagagucgaaacaugggcucuuagacacccaggauuuacuguaaucgccuucuuucuugcacaugcaauugggacauccauuacgcaaaagggaauuaucuuuauauuacucaugcuuguaacaccuagcauggccaugagguguguagguauagggaaucgagauuucgucgaaggauuaucgggugcuacuuggguagacguaguuuuagaacauggaagcugcguaacaacaauggcuaaaaacaaacccacucucgauauugaacuacuaaaaaccgaagucaccaacccagcaguauugagaaaauuguguauugaagccaaaaucaguaauacaacuacggauagucguuguccuacacaaggagaagcaacuuuaguugaagaacaagacgcgaauuucguuuguagaaggacguuuguggaucgagguuggggcaaugguugcggacuguuugguaaaggaagucuguugaccugugcgaaauucaagugcguaacaaaauuagaaggaaagauuguacaauacgaaaaucuuaaauacuccgucauagucacaguccauaccggcgaucaacaucaaguuggcaacgaaaccacagaacauggcacgauugcaacaauaacuccacaagccccaacaagugaaauccaacuaacggauuacggagcauugacuuuggacugcaguccgagaacuggacuggauuuuaacgaaauggugcuacuaacuaugaaagagaaaagcuggcuuguccacaaacaaugguuccuagacuuaccauuaccauggacaaguggcgcgagcacaucacaagaaacguggaauagacaagaucuguuggugaccuuuaaaaccgcucaugccaagaaacaggaaguagucguauuaggaucacaggaaggcgcgaugcacaccgcacucacgggggcaacggagauacagacaagcggaacaacaacaauauuugcagggcaucuaaaauguagauugaaaauggacaagcuaacccuaaagggaaugucuuauguaaugugcacuggcagcuuuaaauuagagaaagaaguggcagaaacucagcauggaacagucuuaguacagguaaaguaugaaggaacugacgcaccguguaagauaccauucucaacucaagaugaaaaaggagugacacaaaacgggcguuugauaacugcaaaucccauuguaacagauaaagaaaagccagucaauaucgaaacagaaccacccuuuggggaaagcuacauagucguuggagcaggcgaaaaggcuuuaaaauuaucaugguuuaaaagagguaguagcauagggaaaauguuugaagcaacagcucgaggcgcuagacgcauggcuauauuaggugauacagcuugggacuuuggcucuauagggggcguuuuuacaucugugggaaaauuaguccaucaaauuuuuggcaccgcauacgggguccuauuuuccggaguuucauggacaaugaaaauagggauaggaauacuccuaacguggcuaggauuaaauuccagaucuaccaguuuguccaugacuuguauagcagucggaauggugacauuauaucuuggugucaugguucaggcggacucaggauguguuaucaauuggaaaggacgagaauuaaaaugcggcucggguauuuucguuacaaaugaagugcacaccuggacagaacaguauaaguuucaagcagacagucccaaacgcuuguccgcagcaauuggaaaggccugggaagaaggagucugcgguauacgaucggcgacucgccuagaaaacauuauguggcgucaaauaucgaaugagcuuaaucauauauuacuagagaacgauaugaaguucacuguaguuguaggugaugcuaacggaauuuuagcacaagguaagaaaaugauaagaccgcaaccgauggaacauaaauauaguuggaaaaguuggggaaaagcuaagguaauaggcgcagauauacagaauaccacauuuauaauagaugguccggauaccccagaguguccugauggucagagagcauggaacauaugggaaguagaagauuauggguuuggcgucuucacgacgaauauaugguugaaguuacgugacaguuauacucaaaugugugaccaucgucuaauguccgcagcaauuaaagacucgaaagcuguucacgcggauaugggauauuggauugagucagagaaaaaugaaacguggaaauuagcgagagcauccuucauagaaguuaaaacaugcacuuggccaaaaucacauacacuauggucaaauggaguauuagagucagaaaugauuauuccaaagauuuacggcggcccuauuucacaacauaacuaccgaccaggguauuuuacacagacggcagguccguggcaccuuggaaaacuggaauuagauuuugaucuuugugaaggcacuacggucguaguagacgaacauugcgguaaucguggaccaucauugagaacaacgacaguuacuggaaagauaauacacgaaugguguugcagauccuguacacucccuccauuacgguuccgaggagaggacggcugcugguauggaauggagauaagaccagugaaagaaaaagaagaaaacuuaguaagaaguaugguuucagcaggguccggcgaaguagacucauucucuuuggguauauuaugcguuucuauaaugauugaagaaguaaugaggucaagguggagucgaaagauguugaugaccgggacacuagcaguauucuugcuauuaauuaugggucaauugacauggaaugaucugauacgguuaugcaucaugguuggugcaaacgcuucggauagaaugggcaugggaacuaccuacuuagcgcuuauggcaacuuucaaaaugcgaccaauguuugccguaggucuucuauuuagaaggcugacaagucgugaaguacugcuacugacgaucggauuaagucucguugccagcguugaauugccaaacagccuugaagaguuaggagauggauuagcaaugggcaucaugauguugaaacuucuaacagaguuccaaccacaucaauuauggacaacucuacuuagccuaacauucgugaaaaccacuuuaagucuggauuaugcauggaaaaccacggcaauggcauuaagcaucgucucauuauuuccccuaugccugucaacaacuucacaaaagacuacgugguuaccaguauuacuuggaucauuugguuguaaaccacuaacaauguuuuuaaucacugaaaauaaaauaugggggcgaaaauccuggccccucaaugaaggaauuauggcaauaggcauaguaucuauauuacuuucuucauugcuuaagaaugauguuccgcuagcgggaccauugauugcuggagguaugcuaauagcguguuauguaauaucuggaagcagcgcugacuuauccuuagagaaagcagccgaaguuuccugggagcaggaggcagagcauaguggcgcgagucauucaauucuaguagaaguucaagacgauggcaccaugaaaaucaaagacgaagaacgugacgauacacuaacuauacuccugaaggcuacucuucuugccgucucggguguauauccuaugaguauuccggcaacauuauucgugugguacuuuuggcagaagaagaaacagaggagcgggguauugugggacacgcccucgccacccgaaguagaacgagcggugcuggacaacggaauuuacagaauuuuacaacguggccugcucggacggucacaaguuggagugggggucuuucaagacggaguuuuucacacuauguggcaugugacgagaggggcaguauugauguaucaaggaaagagacuggaaccgaguugggcaucaguaaagaaagauuuaauuucuuauggaggaggauggagauuccaaggaucauggaauacaggcgaagaaguucaagucauugcagucgaacccgguaaaaaucccaaaaacguccaaacgacaccgggaaccuuuaaaacccccgagggcgaaguaggggcaauagcccucgauuuuaaaccagggacaaguggaaguccgauugugaacagagaaggaaagauaguugguuuguacggaaacgguguagugacaacaucaggaacauacgugagcgcaauugcgcaagcgaaagcaucgcaagaagguccccucccagaaaucgaagaugaaguauuuaagaagcgaaauuugacaauuauggauuuacacccagguucaggaaaaacucguagguaccuaccugcuauagucagagaagccauuaaaaggaaauugagaacacucauacuugcaccaacccguguaguagcgucugaaauggcagaagcguuaaagggaaugccgauuagauaucagacgacugcaguuaagucagagcacacgggucgcgaaauuguugaccuaaugugccacgcuacauuuacaaugcgucuauuaagcccaguccgaguuccaaacuacaacaugauaauaauggacgaagcacacuuuacagacccugccagcauagcugcacgaggcuacaucagcacgagagucgggaugggugaagcagcagcgauuuucaugacagcgacacccccuggaagcguagaagccuuuccucaaucaaaugccgucauacaggaugaggaaagagacauaccugagcgaaguuggaauagcggauacgacuggaucacugacuucccagguaagacugugugguuuguuccaucaauaaaaucgggcaacgauaucgcgaauuguuuaaggaaaaauggaaaaagaguuauacaauuaagccguaagacauuugauacggaauaccaaaagacuaaaaauaaugauugggauuacguuguuaccacagauaucucugagaugggagcaaauuuccgagccgauagaguuauugauccaagacgaugcuuaaaaccugucauauuaaaggauggcccugaacgagugauucuugccggaccaaugccgguaaccgcagcuuccgccgcacaaagaagagggcgaauaggacgaaaucagaacaaagaaggugaucaguacguuuauaugggacaaccacugaacaacgaugaggaucacgcccauuggacagaagccaaaauguuacuagauaauauuaacaccccagagggaauuauuccugcauuauuugaaccugaaagagaaaagucagccgcgauagauggugaguauagacuuaggggagaggcucgcaaaaccuuuguugaacucaugcgccgaggggacuugccuguauggcucucuuacaaggucgcgucagaaggauuccaauacucggauagacguugguguuucgacggugaacgcaauaaucaaguguuagaagaaaacauggaugucgaaaucuggacaaaagaaggggaacgcaaaaagcugagaccaagauggcucgaugcacggacguauagugacccacuugcucugagagaguucaaggaguucgcagcaggaagacguuccgucucaggagaccuaaucuuggagauuggaaaacuaccgcagcacuuaacuuuaagggcucaaaaugcguuagauaacuuagucaugcuccacaauagugaacaaggagguaaggccuaucgacaugccauggaggaauuaccggacacaauagagacauugaugcuccuagcauuaauagcaguacuaacagguggagucacuuuauucuucuuaagcggaaaaggauuagguaaaacaaguauaggauuacuuugcguuacagccucgucagcgcucuuguggauggcguccguugagccacauuggauugccgcaucgauaauucuagaauuuuucuuaaugguccuacuaauaccugagccagauagacaaagaacaccacaagauaaucaauuagcauauguuguaauaggacuauuauuuaugauuuugacaguugcugcaaaugaaaugggauuacuagaaacuacgaagaaagaccuaggaaucggauacguagccgcggaaaaucaccaacacgcaacgauguuagacguggauuugcaccccgcaucggccuggacacuauacgcaguggcuacaacagugauaacacccaugaugagacauacaauagaaaauacuacagccaacauuaguuugaccgccaucgccaaccaagcagccauacucaugggauuagauaagggguggccuaucucaaagauggauauaggagugccccugcuugccuuaggaugcuacucacaagugaaucccuuaacucucacugcagcaguccuuauguugguggcacauuacgcgauaauagguccaggauugcaagcuaaagcuacaagggaggcucaaaaacgaacagcggcagguauuaugaagaacccgacgguggauggaauuguggccauagauuuggacccuguggucuaugaugcaaaauucgaaaaacaacuagggcaaauaauguuauugauauuguguacaagucaaauucuuuugaugagaacaacuugggcacuaugcgagagcauaacacucgcaaccggaccucuaacuacauuaugggaagguucucccgguaaauuuuggaacacaacaauagccguaagcauggcaaauauauuuagagggucauacuuagcuggagccggacucgcauuuucguuaaugaaaagucuaggagguggcagacgagguacgggagcacaaggcgaaacucuuggagaaaaauggaaaagacaguuaaaccaauuaucgaaauccgaguucaauacauacaaacgaucggggauaauggaaguugacagaucugaagcgaaggaaggccuuaagagaggcgagacuacgaaacaugcugucucaaggggaacagcaaaauugagaugguucguugagagaaaucuugugaaaccagagggaaaaguaauagaucucggcugugggagaggaggauggagcuauuauugcgcaggucuaaagaaaguaacagaaguuaaaggauacacaaaaggaggaccuggucacgaagaaccaauacccauggcaacuuacggauggaaucucguuaaacuucauaguggaaaagacgucuucuuuaugccaccagagaaaugugauacgcuuuuaugugauauaggcgaaaguucaccaaauccaaccauugaagaaggcagaacauuaagaguauuaaagaugguagaaccauggcuuagagguaaucaauucuguaucaaaauucuaaacccauauaugccaucaguaguagaaacucuagaacguaugcagcgaaaacauggagguauguuaguaagaaauccguuaagcaggaacaguacucacgaaauguauuggguuaguugugguacaggaaacaucgugagugccgucaauaugacaagucgaaugcuguuaaauagauucacgauggcccacaggaaacccaccuaugaacgagacguggauuugggugcagguacaaggcauguagccguagaaccagaaguggcgaacuuagacauaauaggacaacgaauagaaaacaucaagaacgagcauaaaagcacauggcacuaugaugaagauaacccauauaaaacaugggcuuaucauggguccuaugaaguaaaaccaucaggcucagcuagcucaauggucaauggcguaguuagauuauugacuaaaccgugggacgucauaccuaugguaacacaaauugcaaugacugauacaacaccauucgggcaacaaagagucuuuaaagagaagguugauacgcgaacaccaagggcaaagagaggcacaacacagauuauggaaguaacagccaaauggcucuggggauuucuaucaagaaacaagaaaccacgaauuugcacucgggaagaauuuacgagaaaaguuagauccaaugcugccauaggggcaguauuugucgacgagaaccaauggaacucagcuaaagaagccguugaggaugagcgguuuugggaccucguacacagagaacgagaauugcauaaacaaggcaaaugugcaacuuguguauauaauaugauggguaaacgugagaagaaauuaggcgaguucgguaaagcuaaagguucacgcgccaucugguauauguggcuuggagcaagauucuuagaauuugaggcuuuaggauucaugaaugaagaucauugguucagcagagaaaauucauugucaggcgucgagggagaaggguuacauaaauugggguacauacucagagacauuucuaagauaccggguggaaauauguaugcugacgacaccgcagguugggauacacgaguaacagaagaugauuuacaaaacgaagcaaaaauaacagauauaauggaaccugaacacgcauuguuagccacuucgauuuucaaauugacguaccaaaauaaaguuguacggguacaacguccagcuaaaaaugguacgguaauggauguaauaucacgacgagaccaaagaggcagcgggcaaguaggaacguauggucuaaauacguuuacuaacauggagguccaacugauaagacagauggagagcgaagguauauucuugccaucugaacucgaaacuccaaaccucgcagaacgcgcauuggauugguuagagaaacauggggcagaaagacuaaaaagaauggcuaucuccggcgacgacugcguaguuaaaccgauugacgaucgguucgcgacugcacucacggcgcuaaacgacauggggaaaguuaggaaagacaucccacaaugggaaccaucuaagggauggaacgauuggcaacaaguaccuuucuguagucaccauuuucaucagcugauuaugaaagacgggagagagaucgugguacccugcagaaaccaagaugaauuggucgggagagcacgaguaagccaaggugcagguuggagucuacgugagacugcauguuuaggaaaaucauaugcucaaauguggcagcuaauguacuuucacaggagggauuuacgccuugcagccaacgcuauauguuccgcuguccccguagacuggguccccacgucacgaacuacauggaguauacaugcacaucaucaguggaugacaacagaagacaugcuuaguguauggaaccgggucuggauugaagaaaauccguggauggaaaauaaaacacauguuucaagcugggaagaaguuccauaccuuggcaaaagagaggaucaauggugcggaucccucauuggccucacagcgagagcgacaugggccacuaacauccaaguggcaauuaaccaaguucgacgacuuauaggcaacgaaaauuaucucgauuauaugacuucgaugaaacgauuuaagaaugaaucagauagugaaggagcucucugguga

SEQ ID NO: 21352 - RNA, 9879 nt, Artificial Sequence
  derived and/or modified CDS sequence (opt6) from DENV-1__KJ189353__SS-prME
aguguaacuauguuguuaaugcuguugccaacagcccucgcauuccaccuuacgacaaggggaggugaaccacacaugauaguaaguaaacaagaacgugguaaaucuuuauuauucaaaacuucagcuggagucaauaugugcacuuugauagcuauggacuuaggagaacuaugcgaagacaccaugacuuacaaaugcccacgaaucacugaagccgaaccugacgauguugauuguugguguaacgccaccgauacauggguuacauacgguacauguucucaaacaggagaacacaggcgggaaaaacgcucgguggcacuagccccacauguuggauuaggguuagaaacgagaacggaaaccuggaugaguucagaaggagcuuggaagcaaauucaaagaguggaaacaugggcguugcgacaucccggcuucacaguaauugcauuuuuccuugcacacgcaauuggcaccucaauaacucaaaaaggaauuauauucauuuuacuuaugcuuguaacuccaaguauggcaaugagguguguaggaauugguaaucgagauuuugucgaaggauuauccggagcaacgugggucgacguugugcuagaacauggaagcugcguuacuacaauggcuaaaaauaagccgacguuagauauagaacuucuaaaaacugaagucacuaaucccgccguauuacgaaaauuaugcauugaggcaaaaauuucuaacacuaccacagacagcagaugcccaacccagggagaagcaacucuaguagaagaacaagacgcuaauuuuguaugccgaagaacguuuguggaccgaggauggggcaaugguuguggauuauucggaaaaggaucguuguuaaccugugcgaaauucaaaugugucacgaaauuggaggguaagaucguccaauaugaaaauuuaaaauauagcgucauugugacuguccacacaggagaccagcaucaaguugggaacgaaacaaccgaacaugguaccauugcaacgauuacaccacaagcaccaaccucagagauacaacuuacagauuauggcgcacucacauuagauugcucaccacgaacaggucucgauuucaaugaaauggugcuucucacaaugaaagaaaagucuugguuaguccacaaacaaugguuucuggaccugcccuuacccuggacaucuggugccagcacaagccaagaaacauggaacaggcaggaccuacugguaaccuuuaaaacggcucaugcgaagaaacaggaaguugugguccuuggaucacaagaaggagcaaugcacacugcacuaacaggagcuacagaaauacagacaagcggcaccacaacgauauucgcuggacaucuaaaaugccguuuaaagauggacaaacucacacuuaaaggaaugucuuacguaauguguaccgguuccuuuaaacuggaaaaagaaguugcggaaacacaacaugguaccguucugguucaagugaaauaugaagggaccgaugcgccauguaaaauaccauucuccacacaagacgaaaaagggguaacacaaaacggacgacugauaacggcaaaucccauugugacagacaaagaaaaaccaguaaacaucgaaacugagcccccauucggagaaucuuacauuguaguaggcgcgggagagaaagcccuaaaguuaucuugguuuaaaagaggaagcaguaucgggaaaauguucgaagccaccgcuagaggggcacguaggauggccauauuaggagauacggcgugggacuucgggaguauaggcgguguuuuuacgucaguagggaaacuuguucaucaaaucuucgguacagcuuauggaguacuauucaguggugucucguggacgaugaaaauuggaauagggauacugcucacauggcuagggcucaauaguagaaguacgucauugaguaugacauguauugcggucggcaugguaaccuuauauuugggugugaugguucaggcugauagugguuguguaauuaauuggaaagggagggaguugaaauguggcucaggaauuuuuguaacuaacgaaguccacacuuggacggaacaauacaaguuccaagcagauagcccuaaaaggcuaucagcugcaauaggaaaggcuugggaagaggggguauguggaauacguagcgcgacucgucuugaaaacaucauguggaaacaaauaaguaaugagcuaaaccacauacuccuagaaaaugauaugaaauuuacaguagucguuggugacgcuaaugguaucuuagcacaaggcaagaaaaugauaagaccccagccuauggaacacaaauacaguuggaaguccuggggcaaagcgaagauaaucggagcagacauacagaauaccacguuuaucauagauggaccugauacaccagaaugccccgaugggcaacgugcauggaauaucugggaaguagaagacuacgguuuuggagucuucacaacuaauauuuggcuuaaacuuagggauucauauacucaaaugugcgaccauaggcugaugucagcggcaauaaaagauucaaaagccguacacgcagauaugggauacuggauugaaucagagaaaaaugaaacauggaaauuggcaagagcgucguuuauugaagugaaaacgugcacauggccaaaaucucacacuuuauggaguaacgguguguuggaaagugaaaugauaauacccaagauauauggcgggccaauaucacaacauaauuacagaccaggauauuucacccaaacugcgggucccuggcaucucggcaaacuugaacuugauuuugagcuuugcgaaggcacuacaguaguaguugacgaacauugcgguaauaggggaccaagucuccguacgacgacagucacugguaagauaauacaugaaugguguuguagaagcugcacauuaccuccauugagauuuaggggagaagacggauguugguacggcauggagauacgaccaguaaaagaaaaggaggaaaaucuuguaagguccauggucucagcaggaaguggagaaguugacaguuucucauugggcauucuauguguaucgauuaugaucgaagaagugaugcgcagucgauggucucggaaaauguuaaugacagggacauuagcagucuuucugcuacuaauuaugggacaacuuacauggaacgaucucauacguuuaugcauuaugguuggcgcaaaugcuucagaccgaauggggaugggcaccacuuaucuugccuuaauggcuacuuucaaaaugcgaccaauguucgccguuggccuacuauuucgacguuuaacaagucgagaaguccuacuacuuacuauuggacuaaguuuagucgcuucggucgaacugccuaacucacuagaagaauuaggcgacggguuggcuaugggcaucaugaugcugaaauuauuaacugaguuccagccacaccagcuuuggacaacguuacuuucacuuacauuuguuaagacaacuuuaucacuggauuacgcuuggaagaccaccgcaauggcccucuccauaguaucccuuuuuccacuguguuuaucaaccacaagccagaaaacuacauggcuaccaguccuacuagguaguuuugguuguaagccauuaaccauguuccuaauuaccgaaaauaagauauggggcagaaaaucauggcccuugaaugaagguauaauggcaaucgguauaguuucaauucuauuaucgucauugcuuaaaaacgaugucccauuggcagguccuuuaauagcuggagguaugcuaauagccugcuaugucauaucuggaucaagugccgacuuaucauuagaaaaagcggcugaagugucuugggaacaagaggcagaacauucaggcgcaucacacagcauauugguagaaguacaagacgauggaacaaugaaaauaaaagaugaggagcgagacgauaccuugacuauacugcuuaaagcgaccuuacuugcagugaguggugucuauccaaugucaauaccagcaacguuauucgugugguacuuuuggcaaaagaagaaacagcgaucaggagugcuaugggacacuccuaguccaccugagguugaacgagcagugcuagacaauggcauuuauaggauccugcaaagaggguuauuaggacgaucacagguaggaguaggaguauuccaagacggcguauuucauacaauguggcacguuacaaggggugcaguucuuauguaucaggguaaaagguuggagccgucgugggcgucaguuaagaaagauuuaauauccuauggggguggauggcgcuuccaagguagcuggaacacgggugaggaaguucaagugaucgcagucgagccaggcaaaaaccccaaaaauguacaaacaacgccuggaacauuuaaaaccccagaaggagagguaggagcuauugcguuggacuucaaacccgguacaucagggagucccauagucaacagggaaggaaagauagucggucuuuauggcaacggugugguaacgacuucgggaaccuauguaagcgcaauugcucaagcaaaggcuucacaggaaggacccuugcccgaaauugaagaugaaguuuucaagaaaaggaaucuaacaauaauggauuugcauccggggucaggcaaaacuagacgauauuuaccagcgauaguaagagaagcgauaaaaaggaaacucaggacacucauauuagcaccuacgagaguuguggcuucagaaauggcggaggcuuuaaaagggaugcccauacgauaccaaacaacagcaguaaaaagugaacacacaggaagggaaauagucgauuuaaugugucacgccacauucacaaugagauuauuaucuccggucagggugccgaauuauaauaugauuauaauggaugaagcucauuucacugauccggcaucuauugcagcuagagguuacauaucuacgagagucggaaugggggaagcagcagcaauauuuaugacggcuacaccuccggguucagucgaggcuuucccacaauccaacgcuguaauccaggaugaagaaagagauauucccgagaggucguggaacucaggcuaugauuggauuacggacuuuccgggaaaaaccguaugguuuguaccaucgauuaaaucagguaacgauauagccaauugcuugcggaagaacgguaagcgagucauacagcuaucaaggaaaacauucgauacggaauaucaaaagacuaaaaauaaugauugggacuauguaguuacuaccgacaucucagaaaugggggcaaauuuuagggcagaucgcguaauagauccgagacgguguuuaaaacccguaauauuaaaagacgggccggagcgaguaauuuuggcugguccgaugccggucacagcagcaucagcugcucaaagaagaggccgaauuggacgaaaucaaaauaaagaaggugaucaauaugucuacaugggucaacccuuaaacaacgacgaagaccacgcgcacuggacugaagcuaagauguuacuagauaauauuaacacuccggaaggcauuaucccggcucuguucgaaccagagcgggagaaaagugcggccauagacggcgaauauagauugagaggugaagcucggaaaacguuuguugaacuuaugagacggggagacuuaccaguuugguugaguuauaaaguugcuucagaggguuuucaauauucugauagaagaugguguuuugauggugaacgaaacaaccagguuuuggaagaaaauauggaugucgaaaucuggacgaaggaaggugaacgcaagaaacuaaggccucguuggcuugaugcgagaacuuauagugaucccuuggcucuuagagaauuuaaagaguuugcagccggaagacgcucaguaucaggagaccugauucuggagauuggaaaacuuccucaacauuugacauuaagggcacaaaacgcguuggauaaccuaguaauguuacauaacagcgaacaaggaggcaaagcguaccgacaugcuauggaggaauuaccagauacaaucgaaacgcucaugcuccuggcgcuaauagcaguacuaacgggaggggugacacuauuuuucuuaaguggaaaaggacucggcaaaacaucaauuggacuacuguguguaacagcguccagcgcacuacuuuggauggcaucuguggagccucauuggauugcagcuuccauaauauuagaguucuuccucauggucuuacucauacccgagccugauagacagagaacuccacaggauaaucaacuugcauauguggugauaggacuacuauuuaugauauugacgguugcggcuaaugaaauggguuuguuagaaacgaccaagaaagaucucgguauaggguauguagcagcagaaaaucaucaacacgcuacaaugcucgacguugauuugcauccagcuagcgcguggacgcuauacgcaguagcaacgacagugauaacucccaugaugagacacacaauagaaaacaccacagccaauaucucccuaacagcaauagcuaaucaagcagcaauauuaaugggguuagacaaaggauggcccaucuccaagauggauauugggguaccauugcucgcacucggauguuacucucaagucaauccauuaacucuaacagcagcaguguuaaugcuaguugcacauuaugcaauaaucggcccgggacuacaggccaaggcgacgcgcgaagcacagaaaaggacagccgcaggcauaaugaagaaucccacaguagauggaauaguagccauagaucuagacccuguuguguaugacgcuaaauucgaaaaacaauugggacaaauuauguuauuaauuuuauguacaucacagauccuacugaugaggacgacaugggcauugugcgaauccaucaccuuggcuacugggccguugacuacguuaugggaaggaucaccagguaaauucuggaauacgacaauagcagucagcauggccaacauauucagggggucuuaucuugcaggagcaggauuggcauucucacuuaugaagucguuaggaggaggucgcagaggaacaggggcgcaaggcgagacguugggagagaaguggaaacgucaauugaaccaauuaucgaaaucagaauuuaauacauacaagagaagcggcauaauggaaguagauaggucugaagcuaaggaaggacuuaagagaggggaaaccacuaaacacgcagucaguagaggcacagccaaguugcgaugguuugucgaaagaaacuuaguaaaaccagaagguaaaguuauugauuuagguuguggaagagguggauggucauacuauugugccgguuugaaaaagguaaccgaaguuaaaggauacacaaaaggaggcccuggucaugaagaaccaauuccaauggcaacauacgguuggaaucuaguuaaacugcauuccggaaaagaugucuucuuuaugccaccagaaaaaugugauacccuauugugugauauaggagaaagcucgccuaauccaacaauugaagaaggaaggacacuacggguacuaaagaugguggaaccuuggcuuagggguaaccaauuuugcauuaaaauacuuaauccauacaugccaucugugguagaaacuuuagagaggaugcagagaaaacauggagguaugcuagucagaaauccacucagucgaaauucaacucaugaaauguacuggguaucaugcgggacgggcaacauuguuagugcgguaaauaugacaagucguauguuacugaacagauucacuauggcacauaggaaaccuacuuacgagagagacguggaccuaggugcugguacgcgucauguagcagucgaacccgaaguggcuaauuuagauauuauaggacaaagaauugaaaauaucaaaaaugaacacaaaagcacauggcacuaugaugaagacaauccguauaaaaccugggcuuaccauggaucauaugagguuaaaccauccggaagugcuucuucuauggucaacggaguaguaagacuauugacaaaacccugggauguaauuccgaugguuacacaaauagcaaugacagacaccacgccguuuggucaacaacgagucuuuaaagaaaagguagauacaagaacuccaagagcaaaacgugggacuacacaaauuauggaaguaacagccaaaugguuauggggcuuccuaucuagaaacaagaaaccgcgcaucugcacgagggaagaguuuacucggaaaguuagaucaaacgccgccauaggagcuguauuuguggaugagaaucaauggaauagcgcuaaggaagcggucgaggacgaaagauuuugggauuuggugcaccgagaacgagaacuucauaagcaagggaaaugugcuaccugcguuuauaacaugaugggaaaaagggagaagaaacuaggugaguucggcaaagccaaaggauccagagcaauaugguauaugugguuaggagcacgauucuuagaguucgaagcccuagguuucaugaacgaagaccauugguucucaagagaaaauaguuuaucgggaguagaaggagaggggcuucauaaacucggauauauacuccgcgauauuaguaaaauccccggugguaauauguacgcggaugacacugcaggaugggauacaagagugaccgaggaugauuugcaaaaugaagcgaaaauaacagacauuauggaacccgaacaugccuugcuagcaacaucaauauuuaaacuaaccuaucagaacaaagucgucaggguacaacggcccgccaaaaacggaacagucauggauguuaucaguaggcgagaucagcggggcaguggacaggucggcacguauggccucaauacauucacgaacauggaaguucaacugauaagacagauggagucagaaggaauauuucuacccucugaauuagagacacccaacuuagcugaacgagcucuugauugguuagaaaaacacggcgcugaaagacucaaaagaauggcaauauccggugaugauugcguuguuaaaccaauugacgaucgauucgcaacugcccuaaccgcacucaacgacaugggcaagguucgaaaggacauuccccaaugggagccaucuaaagguuggaacgacuggcaacaaguaccauucuguagucaucacuuucaccaacugauuaugaaagacggacgggaaauaguggugccauguagaaaccaagaugagcuaguggggcgugcccgcguuucacaaggugcaggguggucauuacgagaaacggcaugcuuggguaagagcuaugcucagauguggcaguuaauguauuuucacagaagagacuuacgguuagcagccaaugcaauuuguucagccguaccaguggauuggguaccuacaagucgaacaacauggucgauucaugcacaccaucaguggaugacgacggaggauaugcuaucuguguggaauagggucuggauagaagagaacccauggauggaaaacaaaacccauguaaguucaugggaggagguucccuauuuagggaaacgugaagaucaaugguguggcucuuuaaucggcuuaacugcaagagcaacuugggcaacuaacauacaaguagcuauuaaucaaguaaggaggcuaauuggcaaugagaauuaccuugauuacaugacuucaaugaagagauuuaagaacgaguccgauucugaaggugcauuaugguga

SEQ ID NO: 21353 - RNA, 9879 nt, Artificial Sequence
  derived and/or modified CDS sequence (opt6) from DENV-1__KJ189354__SS-prME
ucaguuacaaugcucuuaaugcuucuaccaaccgcguuagcauuccacuuaacgacgcgaggaggugaaccucacaugauuguaagcaaacaagaaaggggaaaaucuuuacuuuucaaaacaucggcugguguaaacaugugcacacuaauagcaauggacuuaggagaauuaugcgaagauacaaugacuuauaaaugcccacgaaucacggaagcagaaccagaugacguagauugcuggugcaaugcaacugacacguggguuacuuacgggacauguagucaaaccggcgaacauaggagagaaaaacguucuguugcacuagcaccccaugucggacucggauuagaaacacguacagagaccuggaugagcucggaaggagcguggaaacaaauucagaggguugaaacgugggcucuuagacacccuggauucacugugauugcuuucuuccuagcucaugccauagggacgaguaucacgcaaaaagggauaaucuucauucugcugaugcucguaacgccgaguauggcuaugcgcuguguagguauagggaauagggauuucguugaaggacucaguggggcuaccugggucgauguaguacuagaacaugguucaugugugacgacaauggccaaaaauaaaccgacgcuagauauugaacuuuuaaaaacagaagugaccaauccagcaguacuaagaaaacuaugcauagaagcaaaaauaucaaauacuacaacugacucgaggugccccacucaaggagaagccacauugguagaagaacaagaugcgaauuuuguaugccgaagaacuuucguagauagagguuggggaaauggauguggucuauuuggcaaagguucuuuauuaacaugcgccaaauucaaaugcguaacgaaauuagaaggcaaaauuguacaauacgaaaaucuaaaauauagcguaauaguuacaguccauacaggggaccaacaccaaguaggaaacgagacaacugagcacgggacgaucgcuacaauuacuccacaagcuccaaccagugaaauacaacugacggauuacggagcacuaaccuuggacuguagcccaagaacuggacuagacuucaacgaaaugguacuucugacaaugaaagagaaaaguugguugguacauaaacaaugguucuuagacuugccacuuccuuggacuucaggagcaucaacgucacaagaaacguggaaucgacaggacuuguuagucacauuuaaaacggcucacgcuaagaaacaagaaguagugguguuaggaucccaagaaggggcaaugcauacagccuugacaggugccaccgaaauacaaacaucuggaacaacaacuauuuuugcgggucaccugaaauguagauugaaaauggauaaacuaacccuaaaaggcaugucguacguaaugugcacagggucguucaaacuugagaaagaaguggcggaaacacaacaugguacaguccuaguacaagucaaauaugagggaacugacgcucccugcaaaauaccauucaguacacaagaugagaaaggagucacacagaaugguagacuaauuaccgccaauccaauaguaacggacaaagaaaaacccguuaacauagagacagaaccacccuucggcgaaucuuauauugucgucggagcaggagaaaaagcauugaaauuaucuugguucaaacgcgguagcagcauuggaaaaauguucgaagcgacugcccguggcgcuaggcgaauggcaauucugggagauacagcuugggacuuuggaagcauaggcgggguauuuacaagcguagguaaauugguccaucaaauuuuugggacugcuuauggaguacucuucucaggggugaguuggacaaugaaaauugguauaggcauucuccuuacuuggcuaggcuuaaauuccagauccacaucacuuagcaugacguguaucgccgucgguauggugacgcuguaccuagggguaaugguccaagcugacagugggugcguuauaaauuggaaagggagagaauuaaaauguggauccgguauuuuuguaacaaaugaagugcacacuuggacagaacaauauaaauuucaggcugauucgccgaaaagacuaucggcggcaauaggcaaggcuugggaggaaggaguaugugguauaagaucagcaacuagauuagaaaauauaauguggaaacaaauaaguaaugaauuaaaucauauucuguuggaaaaugauaugaaauuuacgguaguuguaggcgacgcuaauggcauuuuagcacagggcaaaaagaugauaaggccucaaccaauggagcacaaauacucauggaaaucauggggaaaagcgaaaauuaucggggcagauauucaaaauacuacauuuauaaucgauggcccagauacuccagaauguccggacggacaacgugcauggaacauuugggaaguugaagauuacggauuugguguuuucacaacgaauauuuggcuaaaacuaagggauaguuauacucaaaugugcgaucacagacuuaugucggcugcuauaaaagauaguaaagccguacacgcagacaugggauauuggauagaaagugagaaaaacgagacauggaaauuagcgcgagcgucauuuauagaagucaaaaccugcacuuggccaaagagucauacauuguggucaaauggcguacuugagagcgaaaugauuauuccaaaaauauauggcggaccuauaucucagcacaacuaccgaccggguuacuucacgcaaacagcagguccguggcauuuaggcaaauuagaacuggauuucgaucuaugcgaagggacaacuguuguugucgaugagcauuguggaaaccgagggccaucauugagaacaacaacagucacuggaaaaaucauacaugaaugguguugcagaagcuguacacucccaccucuacgauucagaggcgaagacggcuguugguaugguauggaaauaagaccaguaaaagaaaaagaagaaaauuuagucagaucaaugguaagcgcugguucaggggagguagauagcuuuucguuaggcauccuauguguguccauaaugauagaagaagucaugcgaucacgcuggagucguaaaauguugaugacagguacguuagcaguauucuuacuacugauuaugggucaacuuacauggaaugaucucauaagauugugcauaaugguaggugcuaaugcaagcgaucgcauggguaugggaacaacauauuuagcccuaauggcuacguucaaaaugagaccuauguuugccguuggcuuauuauuuagaagacugacaaguagggaaguucuacuacugacaauagguuuaagucuuguggcuaguguagaguuaccgaacaguuuagaagaacucggggaugggcuagcuaugggaauaaugauguugaagcuauuaaccgaauuucagccacaccaacuuuggacuacucugcuaucucugacauuugucaaaacuacacucucacuagauuacgcuuggaaaacuacagcaauggcacuaucaauagucucacuauucccuuuauguuuaaguacuacgucgcagaagacuacauggcugccugucuuacuaggcucauucggcugcaagcccuugacaauguuccugauuacugaaaauaaaauaugggguagaaagucuuggccauuaaacgaggggauaauggcaauugguauagucaguauccuucucucuucuuuauuaaagaacgaugugccacucgcagguccacuaauugccgguggaauguuaauugcauguuauguaauuucagggagcagcgccgaucuaucacuagaaaaggcugcugaaguuucaugggagcaagaagcagaacauagcggggcuagucauucaauccugguggagguacaggaugauggaacuaugaaaauaaaagacgaagaacgagaugacacucugacuauccuacuuaaggccacauuacuagcuguaucuggcguauacccuaugucaauaccggccacuuuauuuguaugguacuucuggcagaagaagaaacagagaaguggugucuuaugggacacaccuaguccucccgaaguugaacgagcgguccucgacaacggaaucuauagaauuuuacaacguggccuacucgguagaagucaggugggaguuggaguuuuucaggauggagucuuccauacuauguggcacguuaccagaggagcugugcuaauguaucagggcaaaagacuugaaccuucaugggcgucagucaaaaaggaucuuaucaguuaugguggcggauggcgcuuccagggcaguuggaacacaggagaggaagugcaaguuauagcugucgaaccaggcaaaaacccgaaaaacguccagacgacgccuggcacguuuaaaacgcccgagggugaaguuggagccaucgcucuggacuuuaagcccggcacaucagguuccccaaucguaaaucgagagggcaaaauaguaggacuauauggaaauggcguggucacgaccaguggcacauauguuucagccaucgcucaagcaaaggcuucgcaagaagguccacugcccgagauagaagacgagguauuuaagaaaagaaaucuuacgauuauggacuuacaccccggaucggguaaaacuaggcgguaucuaccugcgauaguaagagaagccaucaaacgcaaacuacgaacguuaauacuagcgccaacgagaguuguagcuuccgagauggcugaagcucuaaaaggaaugccaauaagauaccaaaccacggcagugaaaucggagcauacagguagggaaauaguugaucugaugugucaugcgacauucaccaugcgucuccucucuccaguucguguaccuaauuauaauaugauaauaauggacgaggcacacuuuaccgauccagccaguauugcugccagagguuacaucaguacaagagugggaaugggugaagcugcggcaaucuucaugacugcuacaccaccagguucgguagaagcguuuccucaaucaaacgcuguaauucaggaugaagaacgagauauaccagagcgauccuggaacucgggauaugauuggauuacugacuuuccugguaagaccgugugguuuguuccuucuauuaaaucugguaacgauauagcaaacugucuucguaagaacgggaaaagaguaauucaacuaagcagaaagacauucgacacggaauaucagaaaacuaagaauaaugauugggacuacgugguaacuacagauauaucagaaaugggcgcaaauuuuagagccgauagggugauagacccucgcagaugccuaaaaccaguuauucuaaaagacgggccggagagaguuauuuuggcgggacccaugccaguaacggccgcaucagcagcacaaagaagaggaagaauaggccggaaucaaaauaaagagggagaucaauacguuuauaugggucaaccacucaacaaugacgaagaucacgcccauuggaccgaagcaaaaaugcucuuagacaacauaaauacaccagaagggauaauucccgccuuauuugagcccgagagagaaaagucagcggccauugacggagaauauagacucagaggugaggcuagaaaaacuuuuguagaacucaugcgacgaggagaucuacccguauggcuaaguuauaaagucgcuucagaagguuuucaauauucagauagacgaugguguuucgacggcgaacgaaauaaucaaguacuugaagagaauauggacguggagauuuggaccaaagaaggagaacgcaagaaauuaagaccgagaugguuagacgcacgaacguauucagauccgcucgcucuuagagaguuuaaagaauuugcggccggacgacgauccgucaguggggaucuaauucuagagauaggaaaguuaccccagcacuuaacucuacgugcacaaaaugcacuagauaacuuaguuaugcuacacaauucagaacaaggugggaaagcauaucgacaugcaauggaagaacuaccagauaccauagaaacucuuaugcuacucgcacucauagcagucuuaacaggaggagucacccuauucuuucuaucggggaagggucuuggcaaaacuucuauaggacucuuaugcguuacugcaucgucugcacuuuuauggauggcgucaguugaaccgcauuggauagcugcuucaaucauauuagaauuuuuccuaaugguccuucucauuccagaaccagaccgccaaagaacaccucaggauaaccaacucgcuuacguagugauuggacuacuauuuaugauauuaacaguugcagcuaacgaaaugggccuacuagaaacuaccaagaaagauuuggguauaggauauguagcagcugaaaaucaucaacaugcaaccauguuagacgucgauuuacacccugcaagcgcguggaccuuauaugcuguagcuacgacaguaauaacaccaaugaugaggcauacgauagagaacacaacagcuaauauuucacuaacagccaucgccaaucaggcugcaauauugauggggcucgauaaagguuggccaauauccaaaauggauauaggagugccccuccuagcacucggauguuacucacagguuaacccccuaacacucacugcggcaguauuaaugcugguagcucauuaugccauuaucggaccaggauugcaagcaaaagccacgagagaagcacagaaaaggacagcugcuggcaucaugaaaaacccaacagucgacgguauugucgcuauugauuuagauccagugguguacgaugccaaauuugaaaaacaacuaggacaaauaauguuacugauauuaugcacaucucaaaucuugcuuaugaggacgacuugggcuuugugugagaguauaaccuuagcaacagguccacuaacuacuuugugggaagguucaccggguaaauucuggaauacuacaaucgcaguaaguauggcaaauauauuuagagggucuuaucuagcuggcgcaggucuagcguucucacucaugaaaagucugggaggaggacgaaggggcaccggagcgcaaggugaaaccuugggugaaaaauggaaaagacaguuaaaucaguuaaguaaaucagaguucaacacuuauaaaagaucaggaaucauggaaguagauagaucagaagcuaaggaaggauugaagcgaggugagacgacuaaacaugccguaagcagagguaccgccaaauuacgaugguuuguggagcgaaaucuugugaagcccgaaggaaaaguaauugacuuagguugcggccgagggggauggucauacuacugugcgggguuaaagaagguuacagagguaaagggguacaccaaagguggcccaggccaugaagaaccaauaccgauggccaccuauggguggaauuuggucaaauuacacagcggcaaagacguauucuucaugccaccugaaaaaugcgauacacucuuaugugacauuggagaauccucaccuaacccaacaauagaagaggguagaacacuaagagucuuaaaaaugguagaaccauggcuucggggaaaucaauuuuguaucaaaauauuaaauccuuacaugccuagcguagucgagacucuagaacguaugcaacgcaaacauggaggaauguuaguucgcaauccauuaaguagaaauagcacacaugagauguacugggucuccugugggacagguaauauaguaucagcuguaaauaugacaucucgcaugcuuuuaaaucgauucacgauggcucauaggaaacccacauacgagagggacguggaccuaggagcugguacccgucauguagccguagaaccagaaguggcgaacuuagauauaauaggccaacgaauagagaauauuaaaaaugaacauaaaagcacauggcauuacgacgaggauaauccauacaagacaugggcuuaucaugguaguuaugaaguaaaaccuucuggaagcgcuucuucaaugguuaacgggguaguaagacuucucacaaaaccuugggauguaauaccuaugguuacacagauugccaugacugacacaacuccuuuuggacaacagagaguuuuuaaagagaagguugauacaaggacaccccgagcgaaacgaggcacuacacaaaucauggagguaacagcaaaguggcuuuggggcuuccucagucguaauaagaaaccucgaauuugcacuagagaagaauuuacuaggaaggugagaaguaacgccgcaaucggugcggucuucgucgacgaaaaucaauggaacucugcgaaggaggcggucgaagacgaaaaguuuugggaccucgugcauagagagcgcgaauugcacaaacaggguaagugugccacgugugucuacaacaugauggguaaaagagagaagaaacuaggggaauuugggaaggcaaaaggaucacgagcaauaugguauaugugguuaggagcacgauuucuugaguucgaggcucugggauucaugaaugaagaucauugguucucgagggaaaauucacuaucaggaguagaaggagaaggacuccacaaacuuggauauauucuaagggacauaucgaaaauacccggaggaaauauguaugcggaugauacggcugguugggauacaaggguaacagaagaugaucuucagaacgaagcuaagauaaccgacauaauggaaccggaacaugcauuacuagcaacaucaauauuuaaacuaacguaucaaaauaaaguaguucguguucaaagaccagcuaagaauggaaccguuauggaugugauaucaaggagagaucaaagaggauccggccaaguaggaacuuauggguuaaacacauuuacuaauauggaaguacagcuuauuagacaaauggaaucugaagguauauuucugccaucagaacuugagacuccgaaucuagcugaaagagcucuggacuggcuagaaaagcacggggcagaaagauuaaaaagaauggccaucucgggagacgauuguguugugaagccaauugaugaucgauuugccacagccuuaacagcccuaaaugauauggguaaaguuaggaaagacauaccgcaaugggagccgaguaaagguuggaaugauuggcaacaagugccauuuuguucacaucauuuccaccagcuaauaaugaaagauggacgggagauagugguuccgugucguaaccaggaugagcuuguugggcgggcgcgagugucacaaggcgcgggguggagucuccgagaaacagccuguuuaggaaaauccuaugcccagauguggcaauugauguauuuucaccgaagagacuuacggcucgcagcaaaugcaauaugcucugcuguuccgguugacuggguaccuacgaguagaacaaccuggucaauacaugcucaccaccaguggaugaccacugaagauaugcuuuccguauggaauagaguauggauagaagaaaacccuuggauggaaaacaaaacccacguuagcucgugggaagaagucccauaccuagguaaacgagaagaucaaugguguggcucucuuaucggccuaacagcgcgagccacaugggcaacuaacauucaaguggcaauaaaccaaguuagacgacuaaucggaaaugaaaacuaucuagacuauaugacuucaaugaaacgauuuaaaaacgaguccgacucugaaggugcuuuaugguaa

SEQ ID NO: 21354 - RNA, 9879 nt, Artificial Sequence
  derived and/or modified CDS sequence (opt6) from DENV-1__KJ189355__SS-prME
ucuguaacuaugcuacugaugcugcugccgacagcuuuggcauuucacuuaacgacgagaggcggagaaccccauaugauaguaucaaaacaagaacgaggcaaaaguuugcuuuuuaaaacaucugcugguguaaauauguguacauuaauagcaauggauuuaggagaauugugugaagauacaaugacuuauaaaugucccagaauuacugaagcagaacccgacgaugucgauugcugguguaaugcaacagauacuuggguuacauacggcacgugcagccaaacaggagaacauagacgugagaaaagguccguagcauuagcaccacaugugggauugggauuagaaacgcgaacggaaacguggaugaguagugaaggagcauggaaacaaauacaaagaguugaaacaugggcucugagacauccgggauuuaccguuauagcauucuuuuuagcgcaugcaauugggacaagcauaacucaaaaaggcauuaucuuuauauuauugauguugguaacaccgucgauggcaaugcggugugugggaauaggaaacagggauuucgucgaaggcuuguccggcgcaacuuggguugauguuguauuagaacacgguagcuguguuaccacuauggcuaaaaauaaaccuacccuagacauagaauugcuuaaaaccgaaguaacaaacccagcuguccuacgaaaauuaugcauagaagcaaaaauuucaaacacaacgacugauagucgcugcccuacucaaggagaagcgacucuuguggaggaacaagaugcaaauuucguuugucgaagaacuuuuguagacagaggaugggguaauggaugcgguuuauucggaaaagggagcuuauugaccugcgcaaaauuuaaauguguaacgaaacuagaaggaaaaauaguucaguaugaaaaccugaaauauagcgucauugugacaguccauacaggagaucaacaccaggucgggaacgaaacaacagaacaugguacgauagcuacaauaacuccacaagcaccuacaucagaaauacaacuuacagacuauggcgccuugacacuugacugcucucccagaacaggacuagauuucaacgaaaugguuuugcuaacaaugaaagaaaaaucuuggcuagugcacaaacaaugguuuuuagaccuuccuuugccauggaccucaggugcuaguacaucucaagaaacauggaauagacaagaccuccuaguuacauucaaaaccgcucaugcuaagaaacaagaaguagucguacuugguagucaagaaggggcaaugcauacagcccugaccggggcuacggaaauccaaacauccggcacgacgacuauauuugccggacaccucaaaugucggcuuaaaauggauaaauuaacauuaaaaggaaugucauauguaauguguacuggcucguuuaaacuugaaaaggaaguugcagaaacacagcacggaacuguccuaguucaagucaaauacgaaggcacugacgccccauguaaaaucccguuuagcacacaggaugaaaaaggaguuacacaaaaugggcgcuuaauaacagcaaacccaauuguuaucgacaaagagaagccuguaaacauagaaacugagccaccuuuuggugagucauacauagucguaggagccggcgaaaaagcacuuaaacuuucgugguucaaacgggggaguucuauaggaaaaauguucgaggccacagcuagaggugcgagaaggauggcaauacuaggcgacacagccugggauuuugguuccauuggagguguauucacaagugugggaaaguugguacaucagauuuuuggaaccgcauacgggguucuauuuagugggguauccuggacgaugaagaucgggauaggaauacuucucacgugguuaggucuaaacucaagguccaugucccuuucaaugacaugcauugcgguagguaugguuacacuauaccugggcgugauggugcaggccgauucaggcugugugaucaacuggaaaggcagggaguugaaaugugggucuggaauauucgucaccaacgaaguacacaccuggacugaacaauacaaguuucaagcugacagccccaagagauuguccgcggccauaggcaaagcgugggaggaagggguaugugguauacgcucggcuacacgucuggaaaauauaauguggaaacaaauaucuaaugaguuaaaucauaucuugcuagaaaaugacaugaaauuuacugucguuguaggggaugcaaaugggauuuuagcccaaggaaagaaaaugauaagaccacaacccauggaacacaaauauucauggaaaucuuggggaaaagcaaagauuaucggggcugacauccaaaauaccacuuucauuauagaugguccugauacgccagaauguccggacgggcaaagagcuuggaauauuugggaaguugaggauuacggauuuggaguauucaccacaaauaucuggcuaaaacucagagauagcuauacacaaaugugcgaccauagauuaaugucggccgcgaucaaagacagcaaagcagugcacgcggauaugggauacuggaucgaauccgagaaaaacgagacauggaaauuagcacgagcaucauucauugagguuaagacgugcacauggcccaagucacauacucuauggaguaacggaguccucgaaucagaaaugauuaucccaaaaaucuauggcgguccgaucagccagcacaacuaccgaccuggguauuuuacacaaacggcagggccguggcauuuggguaaacucgaauuggauuuugacuuaugugaggggacuacaguuguuguugacgagcauugcgggaaucggggccccuccuuacgcacuacgacagucacugguaagaucauacaugagugguguugucgaucaugcacacuaccgccgcuuagauucagaggugaagacgggugcugguacgggauggaaauaagaccaguaaaagaaaaagaggagaacuuaguuagaucuauggugagugcaggaaguggagaaguugacuccuucucucuaggcauauuaugcgucucaaucaugauugaggaagucaugagauccagguggucucgaaaaaugcuuaugacgggaacacuugcgguauuuuuauuauuaauaaugggucaacuaaccuggaaugauuuaauucgguuauguauuaugguaggagcaaacgccucagauagaauggguaugggaacaaccuacuuggcucugauggccacuuuuaagaugcgaccaauguucgcagugggccuacuguuccggaggcugacuucacgugaaguauuauuacugacgauaggcuuaucuuuagucgcauccguagaauuaccaaauucacuagaagaacugggagauggauuagcaaugggcauaaugauguuaaaguuacuaacagaauuucaaccacaucaauuauggacaacgcuacuaucacucacguuuguaaaaacaaccuuaucauuagacuacgcguggaaaacuacugcgauggccuuaucuauaguaucccuauuuccgcugugccuaaguacaacaagucagaaaacuacauggcucccgguauuauugggaucuuucgguuguaagccucucacuauguucuugauuacagagaauaaaauauggggccguaaaucauggccauuaaacgaagguauaauggcgauaggaaucgugucuauucuccuaagcucauuacuaaagaaugaugucccauuggcagguccuuuaauugccggagggaugcuaauagcauguuauguaauaucuggaucaucugcugacuuaagccucgaaaaggcggcugaaguaagcugggaacaagaggcagagcacucaggugccagucauucaauauuaguagaagugcaagacgauggcacaaugaaaauuaaggaugaggaacgagaugacacguuaacgauacuacuaaaggcuacccuccuagcugucucuggaguauauccuaugaguaucccggccacuuuauucguuugguauuuuuggcaaaagaagaaacaacgcucuggaguccugugggauacaccgucaccuccagagguugagcgagcaguacuagauaacgguauauaccguauucuucagagaggguuacuggggagaucucagguuggaguggguguauuucaggauggcgucuuucauacaauguggcaugucacgagaggagcgguuuugauguaucaaggaaaacggcuagaaccaaguugggcgucgguuaaaaaggauuuaauaucauauggcggaggauggagauuucaagggucauggaacacaggagaggaagugcaagucauugccguugaaccuggaaagaaccccaaaaauguccagacaaccccaggcacauuuaaaacccccgaaggagaaguaggcgcgauagcccucgacuucaaacccggaacaucagggaguccuauagucaauagggaaggcaaaauaguagguuuauauggaaauggcguaguaaccacaucagguaccuaugugucagcaauugcucaagcaaaggcuucacaagaagguccguuaccagaaauugaagaugaaguauucaagaaacgaaaccucacaauaauggaucuacaccccgggagcggaaaaaccagaagauaccuaccugcaauuguacgagaagccauuaagagaaagcuacgaacucuaauucuagccccaacacgagucguugcuucagaaauggcugaagcauugaaaggcaugccuauacguuaucaaacgacugcagucaagagugaacauacaggccgggaaauagucgaucuaaugugccaugcuacauuuacaaugaggcucuugaguccaguacgcgugccaaauuauaacaugauaauuauggacgaagcucacuuuacagauccugcuagcauugcagcgcgaggguauauaucaacccgaguugguaugggagaggcugcagccauauuuaugacugcaacaccuccagguagugucgaagcauuuccucaaaguaaugcaguaauucaggaugaggaacgugauauaccagaacgaucauggaacucuggauaugauuggaucaccgauuuuccagggaaaaccguuugguuuguuccaucuauaaaaagcgguaaugacauagcaaauugucuuaggaaaaaugguaaaagaguaauccaauuaucacgcaaaacuuucgacacggaauaucagaaaacuaaaaauaacgacugggacuauguuguaacaacugacauaucugaaaugggugccaauuuccgagcggaccgagucauagauccuagaaggugucuuaaaccgguaauuuugaaagauggacccgaaaggguuauauuagcggggccuaugccugucacugcagcaagcgcagcucaaagacgaggccgcauuggcaggaaucaaaacaaagagggagaccaguauguguacauggggcagcccuuaaacaaugaugaagaucacgcgcacuggacugaagcaaagauguuacuagacaauaucaacacacccgaagggaucaucccugcucucuucgaaccagaacgugaaaaaucugcugcgauugauggugaauaucgauuaagaggagaagcuagaaaaaccuuuguugaacucaugcggaggggagauuuaccgguuuggcugucauacaaaguagccucagaagguuuccaauauucagauagaagaugguguuuugacggggagagaaauaaucaaguguuagaggagaacauggacguggaaauuuggaccaaagaaggcgaaagaaagaaguugcgcccacgaugguuggacgcgcgaacauauucagauccacuagcauuaagggaauuuaaggaauuugcagcaggccgcagaagugugucaggagauuugauuuuggagauugggaaguuaccacagcacuuaaccuuacgagcacaaaaugcucuggauaaucuugucauguuacacaauucugagcaagggggaaaagcauauagacaugcuauggaagaguuacccgauacaauugagacauuaaugcuauuagccuugaucgcaguucuaacaggaggggugacucuauuuuucuuaucggggaaaggccuagguaaaacaaguauagggcuacuuugcgugacagcaaguagcgcguuacucuggauggcgucaguagaaccacacuggauagcagcaucaauuauuuuagaguucuucuugaugguacuauugauaccagaaccugaucgacagaggaccccgcaagauaaucaauuggcuuaugugguuauuggguuacuuuuuaugauauugacaguugcagccaacgaaaugggcuuguuggaaacgacuaaaaaggaccuugggauuggguacguagcagccgaaaaccaucaacaugcuacaaugcuagauguagauuuacauccagcuucugccuggacauuguaugcuguggccacaacggucauaacuccuaugaugcgacacacaauagagaauacuacagcaaacauuucucuaacugcaauugcuaaccaagcugcaauucuuauggggcuagacaaaggcuggccgauaaguaaaauggauauuggggugcccuuguuagccuugggguguuauagccaggugaacccauugacuuugacagccgcaguacuuauguugguggcacauuaugccauaauaggcccaggacugcaagcaaaagcgaccagagaagcacaaaaacgaacugcggcugguauuaugaaaaaucccacgguugaugguauaguggcaauagaucuagacccuguaguauaugaugcaaaauucgagaagcaauuaggucaaauaaugcugcuaauucuuuguacaagccaaauacuuuuaaugcgaacaaccugggcacuaugugagucuauaacacucgcuacagggcccuuaacgaccuugugggaagguucaccagguaaauucuggaacacaaccaucgcagucucuauggcuaauauuuuuagggguaguuauuuagcgggggcaggacucgcauuuuccuuaaugaaaucauuagguggcggacgacgugguacaggugcacagggagaaacauuaggugagaaguggaaaagacaacucaaucaacuuaguaagagugaguucaauaccuacaaaaggucggggaucauggagguagauagaucagaagcaaaagagggauuaaaacgcggcgaaacgacgaaacaugcagugagccgcggaacugcuaaauugcgaugguuuguugaacgaaacuugguaaagccagaaggaaaaguuauagaucucgguugcggucgaggugguugguccuauuauugugccggccuaaagaagguuacagagguaaaggguuacacaaaaggagguccuggacaugaagaaccuauaccaauggcuacauauggguggaacuuaguuaaauuacauagugguaaagacguauucuucaugccacccgaaaaaugcgauacguuguugugugauauuggagaaaguuccccaaaucccacaauugaagaaggaaggacccugagagucuuaaaaaugguugaaccguggcuuaggggcaaucaauucuguauuaaaauauuaaauccauacaugccuagugucguggaaacauuggaacguaugcagcggaagcauggaggaaugcucguuagaaauccauuaaguagaaacaguacgcacgaaauguauuggguuagcugcgguacaggaaacaucgucucagcaguuaauaugacgaguagaaugcuucuaaacagauucacaauggcacaccgaaaaccaacauaugagagggauguggacuuaggagcugggacacggcacguagcagucgaaccggaggucgcaaauuuagacauuaucggucaaaggauagaaaacaucaaaaacgagcacaaaagcacguggcacuaugaugaggacaacccuuauaaaacaugggcauaccauggaaguuacgaagucaaacccucaggaucugcuaguucuaugguaaauggugucguaagauuacuaacuaaacccugggauguaauacccaugguaacacaaauugcaaugacugacaccacgccauuuggacaacaaagaguauuuaaggaaaaaguggacacaagaacaccucgagcuaaaagagguacaacucagauaauggaaguaacagcaaaaugguuaugggguuuucugucacguaauaagaaacccagaauaugcacccgugaagaguucacuagaaaaguaagaucuaaugccgcaauuggagcgguauucguagaugaaaaccaauggaacagugcaaaggaagcaguagaggacgagagauucugggaucuggugcaccgcgaaagggaauuacacaaacaagguaaaugcgcuacauguguuuauaacaugauggggaagcgugagaagaaauugggggaauuuggaaaggcgaaaggaucuagagcaaucugguacauguggcuaggcgcaagauuuuuagaguucgaagcacuugguuucaugaaugaagaccacugguuuucacgagaaaauucgcugucagguguagagggcgaaggccuccacaaguuaggauauauacuuagggauauaucuaagauaccgggcggaaacauguaugcggacgacacagccggaugggacacaagaguuacggaggacgaucuccaaaacgaggcgaaaauaacagacauuauggaaccggaacaugccuugcucgcuacgagcauuuucaaguuaacauaccaaaauaaggucguaagagugcagcgaccagcuaaaaacgguacgguaauggacguaauaaguaggagagaccaaagggggagcggucaaguagguacguaugguuugaauaccuuuaccaauauggaaguacaauuaauccgacaaauggaaucagaagggauauuccucccuucagaacuagagacacccaacuuggcagaaagagcauuaggguggcuugaaaaacauggugcagaaagacuuaagcggauggcaauaagcggggaugauuguguaguaaagccaauagacgaucgcuuugcuacagccuuaacagcgcuuaaugauauggguaaaguaagaaaagacauaccgcaaugggaacccagcaaaggauggaaugauuggcaacagguuccuuuuuguagccaucauuuucaucaauugaucaugaaagauggucgagaaaucguaguuccaugcagaaaccaggaugaacuugugggacgagcccgaguaucucagggagcagguuggucucucagagagacagcaugccuaggaaagagcuacgcacagauguggcaacucauguacuuucauagacgagaccuuagacuugcagcaaaugcuauuuguucagccguuccagucgauuggguacccacuucgcguacaacuuggaguauccaugcacaucaccaauggaugacaacagaagauauguuaucuguauggaacagaguuuggaucgaagaaaauccuuggauggaaaauaaaacccaugucucgagcugggaggaagucccauaccuagguaagcgugaagaucaauggugugguagucuuaucggacuaacugccagagcaaccugggccaccaacauucaagucgcaaucaaucaaguccgaagguugaucgggaaugaaaauuacuuagauuauaugaccucuaugaaacgauucaaaaaugagagugacagcgaaggggcgcucugguga

SEQ ID NO: 21355 - RNA, 9879 nt, Artificial Sequence
  derived and/or modified CDS sequence (opt6) from DENV-1__KJ189358__SS-prME
ucagugacuaugcuucuuaugcuauugccaacuguacuggcuuuucauuugacuacacgaggaggggaaccacauaugauuguaucgaaacaagaacgaggaaaaucgcuacucuuuaaaacuucagcagggguaaauaugugcacgcuaauagcaauggacuuaggagaauuaugcgaagauacgaugacauauaaaugcccaagaauaacugaagcagaaccagacgacguggauuguugguguaaugcaacggacacguggguuacauauggaaccuguagccaaacuggggaacacagacgugaaaaacgcucaguugcucuugcuccacauguuggacuaggauuagaaacccguacggaaacuuggaugucuucugaaggagcguggaaacaaauacaacgaguugaaacaugggcacuucgccauccaggauuuacaguaauugcuuucuucuuagcacaugcuauaggaacgaguauaacgcaaaaaggaauuauauucauacuauuaaugcucgucaccccuucaauggcuaugagguguguaggaauagguaaucgagacuucguagaaggacucaguggugcaacauggguggauguaguucuagagcacggaaguugugugacaacuauggccaaaaauaaaccaacucuagauaucgaauuacucaaaacggaaguaacaaauccagcuguacuccgaaaacuuuguauagaagcuaaaauaagcaauacuacaacagauucccgaugcccgacccaaggugaggcaacccuuguugaagaacaagacgcaaauuucguuugcagacggacauucguagaucgagguugggguaauggauguggauuguuuggcaaaggcagcuuacuuacaugugccaaauuuaaaugcguaacaaagcuagaaggcaaaauaguccaauaugaaaauuuaaaauauagugugauuguaacaguccacacuggagaccaacaucaaguuggaaacgaaacaacggaacaugguacaauagccacuaucacaccgcaagccccaacaucagagauccaauuaacggauuacggagcucuuacauuagacuguuccccuagaaccggacuugauuuuaacgagaugguccuacuuacaaugaaggagaaaaguuggcuaguacauaaacaaugguucuuagacuuaccauugccguggacuucaggagcaucaacaagccaagaaaccuggaauagacaagacuuauugguaacauuuaaaacagcacacgcaaagaaacaggaaguggugguacuagggucacaggagggcgcuaugcacacugcgcuuaccggcgccacggagauacaaacuucagguacuacaacgauauucgcgggacaucuaaaaugucguuugaaaauggacaaacucacccucaaaggaaugucauauguaaugugcacagggaguuuuaaacuggaaaaagagguagcugaaacgcaacacgguacggugcuaguucaaguuaaguacgaggguacggaugcacccuguaagaucccauuuucuacacaagacgaaaaagguguaacucaaaacggaagguugaucacagcaaacccuauagugaccgacaaggaaaaaccugugaacauagagacugagcccccuuucggggaaucguauauuguagucggcgcaggagaaaaagcacuuaaauuaagcugguucaagcggggaucaucaauagguaaaauguuugaagcuaccgcaaggggcgcacgaagaauggcaauucuuggugacacugcuugggauuuuggcucaauaggagguguguuuaccucgguaggaaaauuaguacaucaaguuuuuggaacggcguaugggguccuauuuucgggaguaucguggaccaugaaaauuggaaucggaauuuuguuaacauggcucggccugaacagucgcucaaccucucuaucaaugacuuguauagcgguaggaaugguaacacucuacuugggagucauggugcaagcagacuccgguugcguuauaaacuggaaaggacgugaacucaaaugcggcuccggaaucuucguuacaaacgaggugcauaccuggacagagcaauacaaguuccaagcugauagucccaaaagacugucugcugcaaucgguaaggcuugggaagaagggguguguggaaucagauccgcgacaagguuagagaauauaauguggaaacaaauuagcaacgaacuaaaccacauacuacuagaaaaugauaugaaguuuacagucguaguaggugacgcuaauggaauauuagcacaaggcaagaaaaugauucgaccgcaaccuauggaacauaaauauagcuggaaaucuugggguaaagccaaaauaauuggcgcggauauccaaaacacaacguucauaauagauggaccugauacaccugaauguccugaugggcaaagggccuggaauauaugggaaguggaagauuauggcuucggaguuuuuacgacaaacaucuggcuuaaacuaagggauucauacacacagaugugcgaccaucguuugaugucggccgcgauaaaagacaguaaagcaguccaugcugauauggguuauuggauagaaagcgagaaaaacgaaaccuggaaguuagcaagggcuaguuuuauugaagugaaaacuuguacauggccaaaaucacauacuuuauggucaaacggaguguuagagagcgagaugauuauaccuaaaauauauggagggcccauaucgcaacauaauuauaggccgggguacuucacacaaacagccggaccuuggcauuuaggcaaacuugaacuugacuucgauuuaugugaagguacuacgguaguuguugaugaacacuguggcaaucguggcccaagccuaaggacaacuacgguaaccggcaaaauaauacaugagugguguuguaggaguugcacguuaccaccauugcgauuuagaggugaagauggaugcugguacggaauggaaauucgaccuguuaaggaaaaagaagaaaauuuaguacgaucaaugguaagcgcggggaguggagaagucgauucguucucauuagggauauuauguguuuccauuaugauugaagagguuaugcgaucccgguggucucgaaaaauguuaaugaccggaacacucgcaguauucuugcugcuuauaaugggccaacuaacuuggaaugaccuaauaaggcuauguauuauggugggagcgaacgcaucugaucgaaugggaauggguacuacacauuuagcuuuaauggcuacauuuaagaugagaccaauguuugcagucggacucuuauuucgaagacuuacaucaagagaaguucuccuauugaccauugguuugagccuaguagccucuguugaacuaccaaauucuuuagaggaacugggcgaugggcuugcaaugggcauaaugaugcuaaaacuacuuacagaauuucaaccauaccagcuguggacaaccuuacucucauuaacuuucguaaaaacaacacuaucauuggacuaugcuuggaaaacuacagccauggcgcugagcauagugucuuuauuuccccuuuguuuaucuacuacaagucagaaaacgacaugguuaccuguacuauugggcagcuuuggguguaagccucucaccauguuuuugauuaccgaaaauaagauauggggcagaaaauccuggccgcuaaaugagggaauaauggccaucgggaucguaaguauccuuuuaucgagucuacuuaaaaaugacguaccuuuagccggucccuuaauugccggaggaaugcuuaucgcauguuacgucauuagugggucuuccgcugaccuuagccuugagaaagcagcugaagucagcugggaacaagaagcugaacauucaggugccagccauaguauccuaguugaaguacaagaugauggcaccaugaaaauaaaagaugaggaaagagacgacacacucacuauauugcucaaagcaacacuucuagcugugagcgguguuuauccgaugucaauuccagcaacucuguucguaugguauuucuggcaacgcaaaaagcaaagaagcggaguucuuugggauacucccaguccuccugaaguugaacgugcaguucuagacaaugguauauauagaauuuuacagcggggccugcuuggaagaucccaaguuggcguagguguuuuccaagauggaguauuccauacgauguggcacguaacuaggggcgcuguauuaauguaucaaggaaaacgacuugaaccgucaugggcaagcgucaagaaagaccugauaagcuacggugguggauggagguuucaagggucguggaauacaggggaggaaguacaagugauagccgucgaaccuggcaaaaaucccaaaaacguacaaacuacaccagguacuuucaaaacgccagaaggcgaaguuggggcaaucgcauuagauuucaaaccuggaacaaguggcucccccauuguuaauagagaagguaaaauuguaggguuauauggaaauggaguaguuaccaccagugguacuuauguuagugcaauagcacaagcaaaagccagccaagaggguccacuaccagaaauagaagaugagguguucaagaaaagaaauuuaacaauaauggaccuccaccccgguucaggaaaaacccgaaaauacuugcccgcaauuguucgagaggcuauaaaacggaaguuaagaacguuaauacuagcaccaacacgagugguugccucugaaauggccgaggcucuuaagggaaugccuauaagauaucaaacuacagccgugaaaagugaacauacuggccgagaaauaguagaucuaaugugucaugcuacauuuacaaugagacuauuaucccccgucaggguaccgaacuauaauaugauaaucauggaugaggcgcacuuuaccgauccagcaucaauugcagcgaggggguacaucucaacuagaguaggcaugggagaagcagccgcuaucuucaugaccgcgaccccuccugggagcgucgaggcuuuuccgcaaucgaaugccgugauucaagaugaggagagggacauacccgagaggucuuggaacagugguuaugacuggauaacagauuuuccagguaaaacaguaugguuuguaccaucgauaaaaagcgguaaugauauugcgaauugcuuaaggaaaaauggaaaaagagucauacaauuaagccgaaaaaccuuugauaccgaauaucagaaaacgaagaauaacgacugggacuacgugguaacuacagacauaagugaaaugggagcaaacuuucgagccgaucgagucauugauccuagaagaugcuuaaaaccaguaauuuugaaagauggacccgaaagaguaauucuagcagguccaaugccaguaaccguugcaucagcagcucaaagaagggguaggauagguaggaaucaaaacaaagagggagaucaauacguguauaugggccagccguuaaacaacgacgaggaccaugcacauuggaccgaggcuaagauguuauuggauaacaucaacaccccagagggcauaauccccgcccuuuucgaaccagagcgugagaaaagugcagccauagacggugaauaucgguuacgaggagaggcgaggaaaacguucguagaacuuaugagacggggagaccuuccuguauggcucuccuauaaaguugcgucagagggcuuucaauacucugaucgcagauggugcuucgacggagagcgcaauaaucaggucuuagaggaaaacauggauguggaaaucuggacaaaggagggagaaaggaagaagcuaaggccaaggugguuagaugcucguacuuauucagacccuuuagcacuaagagaguucaaagaguuugcagcgggcagacgaucaguuuccggcgacuuaauauuggaaauaggcaaacuuccacaacaucucacacuacgagcucaaaacgcguuagauaauuugguaauguuacauaauagugagcaaggcggaaaggcuuacagacaugcuauggaagaguuaccagacacuauagaaacucucaugcuuuuagcccucauagccgucuuaacaggaggagugacacucuucuuucucucgggaaagggauuagguaaaacaagcauaggccuacuaugugucacagccaguuccgccuuguuguggauggcaucgguugaaccgcauuggauugcugcaaguauaauuuuggaguucuuucugaugguguuacuaauuccagaaccagauagacaaagaacuccacaagauaaucaauuagcauacguagucauaggucuacuuuuuaugauacugacaguagccgcaaacgaaauggguuuacuugaaacaaccaagaaagauuuaggcaucggauacguugcagcugaaaaucaucagcaugccacaaugcuagauguagauuuacacccggcgucagcuuggacucuauaugcgguugccacaacagugauuacucccaugaugcgccacaccaucgaaaauacuaccgcaaacaucagcuugaccgccauagcuaaccaagcagcgauuuuaaugggguuagacaaggguuggccaauaucaaaaauggacauaggaguaccacuacucgcuuuaggauguuacucgcaaguaaaucccuugacauuaacugcagcggugcuaaugcuggucgcacauuaugcaauaaucgggccgggucuucaagcuaaagccacgagggaagcccagaaaaggacagcagcaggcauaaugaaaaaucccacaguugacgguauaguagcaauagaccuugaucccguaguguaugacgcgaaguucgaaaagcaacuaggacaaauuaugcuacuaauccuauguacgucucaaauucuauuaaugcgcacaacaugggcguuaugugaaagcauaacgcuugcuacaggaccuuuaacuaccuuaugggaagguucuccagguaaauucuggaauaccacuauugccguaaguauggcaaauaucuuuagaggcucuuaccuugcuggugcaggucuggccuucagucuaaugaaaagccucggugguggacgucgcgguacaggagcacagggagaaacuuugggggaaaaauggaaaagacaauuaaaccagcuaucaaagagcgaauuuaacacguauaaaaggucugggauaauggagguagaccgaagugaggcaaaagaaggucuaaagaggggagaaacaacaaaacaugccgucaguagggguacagcaaaauuacgaugguucguagagagaaaucuuguuaaaccugaaggaaagguaauagaccugggcugcggcagaggcggguggucguacuauugcgcaggacuuaagaaagucacagaaguuaaggguuacacgaaaggagguccggggcacgaagaaccaauacccauggcuacauauggcuggaauuuagugaaacuucauagcggaaaagacgucuucuuuaugccucccgaaaaaugcgauacucugcucugugacauaggugaaaguagcccuaacccaacaauugaggaggguaggacauuacguguauugaagaugguagaaccauggcuuaggggaaaccaauucuguauuaaaaucuuaaauccguacaugccaucaguaguggagacccuagagcgaaugcaacggaaacaugguggaaugcuagugagaaacccguuaaguagaaauaguacacaugagauguacugggucagcugcgguacaggaaacauaguuucugcgguaaauaugacuucaaggaugcuacuaaauagauuuacuauggcacacaggaaaccuacuuaugaaagggauguugaccucggagcuggaacgagacacguugcuguggaaccggaggucgcuaaucuugauauaauugggcagagaauagaaaauauuaaaaaugaacauaaaaguacguggcauuaugaugaagacaauccauauaagacuugggcauaucacggcaguuaugaaguuaaaccuagcgguagcgccuccucgaugguaaauggugucguaaggcucuuaacaaaaccaugggacgucaucccaauggucacacaaauugcaaugacagauacuacaccauuuggucaacaacggguauuuaaagaaaagguugauacuagaaccccuagagcaaaaaggggaaccacacagauuauggaaguuacugcuaaauggcuauggggcuuucugagucguaauaagaaaccccguauuugcaccagggaagaguucacaagaaaaguccgaaguaacgcggcaauaggcgcagucuuuguagaugaaaaccaauggaacagugccaaggaggcgguugaagaugaaagauuuugggaucuuguacacagggaacgagagcuacauaaacagggaaagugcgcaacuuguguauauaauaugaugggaaaacgcgagaagaaacugggagaauuuggaaaggcgaaggguucgcgugcgauaugguauauguggcugggcgcacgcuuuuuagaguucgaagcccuaggauucaugaaugaggaucacugguuuucgcgcgaaaauucauuaucuggaguugaaggugaaggauugcacaaauugggauauauccuucgggauauuagcaaaauacccggagguaacauguacgcugaugauacagcaggaugggacacacgaauaacagaggaugacuuacaaaacgaagcuaaaaucacagacauaauggaaccugaacaugcacaacuagcaaccucuauuuucaagcuaacauaucaaaauaaggucguacguguucaacgaccagccaagaacggcaccgugauggacguuauaagucgacgugaucaacgugguuccggacaggugggaaccuauggcuugaacacguuuacaaacauggagguacaacuuauccggcaaauggaauccgagggcauuuuccuacccucagaacuagaaacgcccaaccuagcagagcgggcacucgauuggcuugagaaaaauggagcugaaaggcuaaaaaggauggcaaucucaggcgacgacugugucguuaaaccaaucgacgauagauuugccacagcucugacagcauuaaacgauauggguaaaguaagaaaagauauuccucagugggaaccgaguaaaggauggaacgauuggcaacagguuccuuucuguagucaucacuuucaucagcucauuaugaaagaugggcgcgaaauagucguuccgugucguaaucaagacgagcuaguuggcagagcacgcguuagucagggagcaggcuggagucucagagaaacggcuuguuuaggaaaaucauaugcacaaauguggcaguugauguacuuucacagaagggaucugagauuggcagccaacgcuauauguagugcagucccugucgauugggugccaacaagcaggaccacuuggaguauacacgcgcaccaucaguggaugacaacagaagacauguuaagugucuggaacagaguauggauugaagagaauccauggauggaggauaaaacucauguuaguucaugggaagaaguuccuuaucucggaaaaagggaggaucagugguguggaucauuaauuggauuaacagcaagagcaacaugggcaacaaauauacagguggcgauuaaucaaguacgucgucuaauagguaacgaaaauuauuuagauuauaugacaucaaugaagcgauucaagaaugaauccgauucagagggcgcauuaugguaa

SEQ ID NO: 21356 - RNA, 9879 nt, Artificial Sequence
  derived and/or modified CDS sequence (opt6) from DENV-1__KJ189359__SS-prME
ucugucacaaugcuacucaugcuauuaccgacgguccuagcuuuucauuuaacaacuaggggaggcgaaccccacaugauaguaaguaaacaagaacguggaaaaucauuauuauuuaaaaccucugcugguguuaauaugugcacauuaauugccauggauuuaggggaacuaugugaagacacaaugacuuauaaaugcccuagaauuacagaagcggaacccgaugauguagauuguugguguaaugccaccgauacguggguuacauaugguacaugcucccaaacaggcgaacacagacgugaaaaacggucuguggcacuagcaccgcauguaggacucgguuuagaaacucgcacagaaacguggaugaguagugaaggugcuuggaaacaaauacaacgaguagaaacaugggcauuacgucaucccggauucacgguuaucgcuuucuuccuagcacacgcuauugggaccaguauaacacaaaaagguauuauuuuuauccuucuuauguuagucacuccuagcauggcuaugcgauguguaggaauaggaaauagagacuuuguagagggucucucuggagcgacauggguagauguaguacuagagcacggaucauguguaacaaccauggcuaaaaauaaaccuacacuagauauagaacuccugaaaacugaaguaacaaacccugcaguacugagaaaauuauguauagaagcaaaaauuagcaauacuacaacagauucgagaugcccuacacaaggagaagcaacauuaguugaagaacaagacgcaaauuuuguuugucgcagaacauucguagaucgaggcugggggaacggcugcggccuauucgguaaaggaagucuauuaacaugcgcaaaauuuaaaugcgucacaaaacuagaaggaaaaaucguucaauaugagaaccuuaaauacucggugauaguaacaguucacaccggcgaucaacaccaaguaggaaaugaaacuacugaacacggaaccauagccacaauuaccccacaagccccaaccucugagauucaacuaacagauuauggagcgcuaacccuggauuguucuccacguacaggauuagauuuuaaugagaugguacuacuuacaaugaaagaaaaaucauggcuaguacauaaacaaugguuuuuggaucuucccuuacccuggacaucaggagcaagcacuagccaggaaaccuggaacaggcaagauuuacuggucacguuuaaaacagcgcacgcaaagaaacaagaaguugucguauuaggaagccaggagggcgcaaugcacaccgcuuuaacaggagcuaccgaaauacagacaagugggaccacuacgauauuugcugggcacuuaaaaugccgcuuaaaaauggauaaacucacuuuaaaaggcaugagcuacguaaugugcaccggaucauuuaaauuagaaaaagaaguagcugaaacacagcauggaacaguauuaguacagguaaaauaugagggaacggaugcgccgugcaaaauucccuuuucaacgcaggaugaaaaaggaguaacacaaaauggcagacuuauaacagcgaaccccauaguaacggauaaggagaaaccaguaaauauugaaacugagccgccuuucggagaaagcuauauaguuguaggugcaggagagaaagcauugaaacuaucaugguuuaagcgcggaaguagcauugguaagauguuugaagcgaccgcacguggggcgcgaagaauggcgauauuaggagauacugcuugggauuuuggcucaauaggugguguuuucaccucggucgguaagcuaguucaccaaguguuuggcacagcauaugggguucuauucucuggaguaucauggacaaugaaaaucgguauuggcauucuauuaacauggcuaggcuuaaacucucguucuacuucuuugucuaugacaugcauagcaguaggcaugguuaccuuauauuuaggcgugaugguccaggcagacucagguugcguaauuaauuggaagggucgugaguuaaaauguggaucaggcauuuuuguaacuaaugagguccauacuuggacugaacaguauaaguuccaggcggauaguccuaaacgccuaagcgcagccaucggaaaggcuugggaagaaggaguuuguggcauaagaucagcaacaagacuugaaaauauaauguggaaacaaauuuccaaugaacugaaccacauacuuuuagaaaacgacaugaaauucacuguugugguaggagacgcaaacggaauacuagcucaaggaaagaaaaugauacggccacaaccaauggagcacaaauacagcuggaaauccugggguaaagcaaagauaauaggagccgacauucaaaacacgacuuucauaauugacgggcccgauacuccagagugucccgacggucaacgagcauggaauaucugggaaguagaggacuauggguucgggguauuuacuaccaacauaugguugaagcuaagagacagcuacacucagaugugugaccauagauugaugucagcagcaauaaaggacucgaaggcgguccaugccgauauggguuauuggauagaaucugagaaaaaugaaacguggaaacuagcuagagcaucguucauagagguaaaaacuugcacauggccaaaaucucauacgcuuuggaguaacgggguacucgagagugaaaugauaauaccaaaaauauacgguggaccaauaagccagcacaauuaucgcccgggguauuuuacccaaaccgcuggcccauggcauuugggaaagcucgaacuggauuuugauuuaugugagggaacaacuguagucguugacgagcauugcggaaaccgagguccuagccugaggacaacgaccgucacaggcaaaauaauacaugaguggugcugccgcucauguacauuaccacccuuacgauuucgaggagaagaugggugcugguacggaauggagauacggccugugaaagaaaaagaagaaaauuugguaagaucaauggucuccgccggaucuggggaaguugauucauucucuuuaggaauuuuaugcgucuccauaaugauugaagaagucaugcgaucacguuggucucgcaagauguugaugacaggaacucuugcaguauuuuuacuucuaauaaugggacaauuaacauggaaugaucuaauaagacuguguauuaugguaggagcgaaugcuagcgaucgaauggggaugggcacaacauauuuagcguuaauggcgaccuucaagaugagaccgauguucgccguagggcuacuuuuuaggaggcuaacaagccgagagguacuccuuuuaacaauuggauuaucuuuagucgcuucuguugaacuuccuaacucauuagaagaauugggugacggguuagccaugggaauuaugaugcuuaaauugcuaacugaauuucaaccucaucaacuauggacuacacugcugucacuaacauuuguuaagacaacacuaucacuugauuacgcauggaaaacaacagcaauggcauuaucaauaguuaguuuauuuccuuuauguuugucaacuacaagccagaaaacaacauggcuaccaguuuuguuggguaguuucggauguaaaccccuaacgauguuucuaauaacggagaauaaaauaugggguaggaaaucauggccguuaaaugaagguauuauggcuauuggaaucguaaguauucuccuaagcagucuauugaaaaacgacgugccuuuagcaggacccuuaauugcaggagguaugcucaucgcuuguuauguuauuucaggaaguagugccgaucuuucauuggaaaaagccgcagaaguaucaugggagcaagaggcugaacauucaggggccagccauucaauauuagucgaaguucaagacgacgguacuaugaaaauuaaggaugaggaaagggacgauacacuuacaauucugcuaaaagcaacguuacucgcagucucgggaguauauccaaugagcauacccgccacgcuuuuugucugguauuucuggcagcgaaagaaacaacguaguggcgucuuaugggacacucccuccccaccugaaguagaacgcgccguucuagacaacggaaucuaucgaauccuucagagaggauuauugggucggagucaagucggcguaggaguauuucaagauggaguauuucacacaauguggcaugucacuaggggugcaguucugauguaccaaggaaaacggcuggaaccgucuugggcaucaguuaaaaaggauuuaauaucguaugggggcggcuggagauuucaagguaguuggaacacaggagaagaaguacaaguaauugcgguagaaccuggaaagaacccuaaaaauguccaaacaacuccaggaacauucaaaaccccggagggagagguuggggccauugcucuagacuuuaaaccgggcacgucagguagcccuaucguuaaccgcgaagguaagauagucggucuuuaugguaacgguguagucacaacaagcgguacuuauguuucugcuaucgcacaggccaaggcuucucaggaagguccgcuuccagaaauagaagaugaaguauuuaagaaaagaaaccuuacgauaauggaccuacauccaggguccgguaagacgcguagauaucuuccagcaaucgucagagaagcaauaaaacgcaaguuaagaacguuaauccuagcuccaacgcgagucguugccucagaaauggcagaggcucuuaaggggaugccuaucagguaccagacgacagcagucaaauccgaacacaccggcagggaaauaguagauuuaaugugucaugcuacuuuuacaaugagacuccuuaguccuguccgugucccgaacuacaacaugaucaucauggaugaggcacauuuuacagaucccgcuagcauagcagcacgaggauauauaucgacuagagucgguaugggggaggcugcagcgauuuucaugacggcaacgccucccggaagcguggaagccuuuccccagaguaaugcgguuauucaagaugaagagagagacauaccagaacguucauggaacucaggauaugauuggauaacagauuucccuggaaaaacgguaugguuugugccuagcauuaaaagugggaacgauauagcaaauugccuacggaaaaauggaaagagggugauacaacucaguaggaaaacguucgauacagaguaucagaaaacuaaaaauaaugacugggauuauguugugacgacugacauaagugagaugggagccaauuuuagggcggauagaguaauugacccccgccgaugucuaaagccuguuauuuuaaaagacggcccggagagagucauauuggcagggccgaugccgguuacaguugcaucugcggcucagagaagggggcgaauagggagaaaccaaaacaaagaaggagaccaauaugucuauaugggacaaccucugaauaacgacgaagaucacgcgcacuggaccgaagcaaagaugcuucuggauaacauaaauacccccgaagguauaaucccugccuuauuugaaccagagcgugaaaagagugcugcgaucgauggugaauauagacuacguggggaggcacgcaaaacguuuguggagcuuaugagaagaggagaucuaccaguauggcugaguuacaaaguugccucagaaggauuucaauacucagaccgaagauggugcuuugauggugaacgcaauaaucaaguauuggaggaaaacauggauguugagauauggacaaaagaaggagaacgcaagaaacuuagaccacgauggcucgacgccagaacuuauucugacccauuggcacuucgcgaguuuaaagaauuugcagcaggcagaagaagcguaaguggugauuuaauauuagaaaucgguaaacucccgcaacaccuuacgcugcgggcccagaacgcauuggacaacuuagugauguuacacaacucagaacaaggaggcaaagcauaucggcaugcuauggaggaauugccagauacaaucgaaacucuaaugcuguuggcuuugauagcaguauugacagguggugucacccuguuuuuccugucaggcaaagggcuggggaagacgagcauuggacuacucugugucacagccaguucagcgcuuuuauggauggccaguguagaaccucacuggauagcagcuucaauuauacuagaguucuuucuuaugguuuuacuuauuccagagccagaucgccaaaggacaccccaagauaaucaacuagcuuauguaguuauaggccuauuauuuaugauccuaacgguagcagcaaaugaaaugggacuucuugaaacaaccaagaaagauuuaggcauaggcuauguugcugcugagaaucaucaacauacaacuaugcuagaugucgauuugcacccggcaucagcauggacacuauaugccguagcaaccacgguaauaacucccaugaugaggcauacuauugaaaacacuacggccaacauaaguuuaacggcgauagcgaaucaagcagccauacuuaugggacuugauaaaggcuggccaauuucaaagauagauauagguguuccuuuacuagcauuaggaugcuauagucaaguaaacccgcucacuuuaaccgcugcaguucuaaugcucguugcacauuacgcuauaauuggcccggggcuacaagcaaaggcuacaagagaagcgcagaaaaggacagcagcggggauuaugaagaauccuacaguugauggaauuguggcgauugacuuagauccagucgucuacgacgcaaaauucgaaaaacagcucggucagauuaugcuccugauacuauguacaagucagauauuacugaugagaacuacuugggcuuuaugugaaucuauaacgcuagcuaccgguccgcuaacuacgcuuugggaagguaguccaggaaaauuuuggaacaccacaauugcugucucgauggcaaauauuuucagggguucauauuuagcgggagcgggcuuagccuucucgcuuaugaagaguuuaggugggggaagaagagguacgggagcucaaggcgaaacccucggagaaaaauggaaaagacaauuaaaucaauuaagcaagucagaauuuaauacuuacaagcggucgggaauuauggaaguagauaggagcgaggcaaaggaaggucuaaaaagaggcgaaacgacaaaacacgcaguaucaagagguacagcaaaacuucguugguuuguagaacguaauuuaguaaaaccagaaggaaaaguaauugacuuaggcuguggucgggguggaugguccuauuauugugcagguuuaaagaaagucacagaagugaaagguuauacaaaaggcggcccaggucaugaagaaccaauaccgauggcaacuuaugguuggaaccugguaaaauuacauucaggcaaagauguauucuuuaugccaccggaaaaaugugacacccuacuaugugauauaggugagucgaguccuaauccgacgauugaggaaggcaggaccuugcgcguauuaaaaaugguugaaccauggcuuaggggaaaucaauuuuguauuaaaauacuaaacccuuacaugccuucaguaguugagacgcuagaaagaaugcagaggaaacaugggggcaugcugguaagaaauccauuaaguagaaauucuacacaugaaauguauuggguaucgugcggcacgggcaacauagucucagcagucaauaugaccucaagaaugcuacuaaaucguuuuacuauggcgcauagaaaacccacuuaugagagagauguugaucugggggcuggaaccagacacguugcuguagagccagagguagcaaaucucgauauuauaggacagcgcaucgaaaacauaaagaaugagcacaagucuaccuggcauuaugaugaagauaauccauauaaaacuugggcauaucacgguagcuaugaaguuaagccuagugggagcgcaucaaguaugguuaacgguguaguacguuugcuuacaaaaccaugggaugugaucccuaugguuacccaaaucgccaugacugauaccacacccuuugggcaacaacgaguauuuaaagaaaagguagauaccaggacgccacgugcuaagcgaggcacuacacagauuauggaaguuacggcgaaguggcuauggggcuuuuuaucgagaaauaagaaaccaagaaucuguacucgugaggaguuuaccagaaagguaagaucuaaugcagccauuggagcaguauuugucgacgaaaaucaguggaauacggcgaaggaagcuguagaagacgagagauuuugggaucuuguacaccgagaaagggaacugcauaaacagggaaaaugcgcaacgugcguauauaacaugaugggaaaaagagagaagaaauuaggagaauuuggcaaagcuaaaggcagucgugcaaucugguauauguggcuaggagcaagauuccuugaauuugaggcuuuaggauuuaugaaugaggaucauugguuuucuagagaaaacuccuugagcggcgucgaaggagaaggauuacauaaauugggauauauauuaagagauauaaguaaaauaccuggggguaauauguaugcggaugacacugcugguugggauacacguaucacagaggaugaucuacaaaaugaggcaaaaaucacagauaucauggaaccugagcacgcauuauuggccacgucuauauucaagcuaacuuaucaaaauaagguuguccgcguucaaaggccagcgaaaaauggaacuguuauggacguaaucucgagaagagaucaaagaggaucuggucagguuggaacuuacgguuugaacacauuuaccaauauggaaguccaauugauaagacaaauggagucugaagguauuuuccugccuagcgaguuagaaacucccaauuuagcagaaagagcguuagacuggcuagagaaacacggggcggagagacuaaaaagaauggcuauaucuggggacgauugcguuguaaaaccaauugacgaucgauuugcuacagcauuaacggcacuuaacgacauggguaaaguacgaaaggauauuccacaaugggaaccuucaaaaggauggaaugacuggcaacaaguucccuucugcucacaccauuuucaccaacuaauaaugaaagacggcagggaaauugugguuccuuguagaaaucaagaugaacucgucggcagagcacgcguuucgcagggugcgggcuggaguuuaagggaaacugcgugucucggcaagucuuaugcacaaauguggcaauuaauguauuuccacagaagagaccucagauuggccgccaaugcaauauguucagcaguaccugucgauuggguaccgacaagucguacaacaugguccauucacgcacaucaucaauggaugacgacugaagacaugcucucagucuggaauagaguauggauagaagaaaacccauggauggaagauaagacccaugugagcagcugggaagaaguucccuaucucgguaaaagagaggaucaaugguguggaucguuaaucgggcuaacagcucgagcgacaugggcuacaaacauccaaguugcgauaaaucaaguucguagauugaucgggaaugaaaauuacuuagacuacaugacaucuaugaaacgauuuaagaaugaaagcgacucugaaggugcucuaugguga

SEQ ID NO: 21357 - RNA, 9879 nt, Artificial Sequence
  derived and/or modified CDS sequence (opt6) from DENV-1__KJ189360__SS-prME
ucuguuacuauguuacucaugcuucucccgacggcucuagccuuccaccugacuacaagaggaggggaaccacacaugauaguaucgaaacaagaaagagguaaaucguuguuauuuaaaacuucagcuggugugaauauguguaccuuaauugcuauggaccugggggaacuaugugaagacacaaugacguacaaauguccacgcauaacagaagcagaaccagaugauguagacugcugguguaaugccacagacaccugggucacuuauggaacuuguucccaaacaggugaacacagaagagaaaaacgaaguguagcauuagcuccacauguuggauugggguuagaaacaaggacugaaacauggaugucuucugaaggagcauggaaacaaauccaacgcgucgaaacaugggcucugagacauccaggcuuuacgguuauagcuuucuuucuagcacaugccauagggacaucaaucacacaaaaaggaauuauuuucauuuuauuaaugcuaguaacacccucuauggcaaugagauguguagggaucggaaauagggauuuuguagaaggucuaucaggggcuacuuggguagauguagugcuagaacaugggagcugcgucacuacaauggccaaaaauaaaccaacauuggacauugaauuacuaaaaacugaaguuacaaacccagcgguauuaagaaaacugugcauagaagcgaaaauuucaaacacuacuacggauagccgauguccuacgcaaggugaagcaacauuaguggaagaacaagacgcuaauuuuguguguagaagaaccuucguagaccggggguggggaaauggauguggucucuuuggcaaagguucacuucuaacuugcgcaaaauucaaaugcguaacuaaacuagaagguaaaauuguacaauacgagaaucugaaauauucugugauuguaacaguacauaccggcgaucaacaucaaguagguaaugaaaccacugaacacggcacaaucgcgacaauuacgccccaagcacccacaagugaaauacaauugacagauuauggcgcucuaacacuagauugcucccccagaacaggacuggauuuuaaugagaugguucuacuaacaaugaaagaaaaaucuugguuaguccauaaacaaugguuccuugacuugccguugccauggacaaguggggcgucuacaucucaagagacuuggaauagacaagaucuuuuagucacauucaaaacugcgcaugccaagaaacaagaggucguaguucuggguucucaagaaggagcuaugcauaccgcuuugaccggagcuacugaaauccagaccuccggaacaacuacaauuuucgcuggacauuugaaauguagauuaaaaauggauaaguuaacucuuaaaggaaugagcuaugucauguguacaggaucauuuaaauuggaaaaagagguugcagaaacacaacaugguacaguauuaguacaaguuaaauaugaagguacagaugcuccaugcaagauaccauuuuccacucaggaugagaaaggagugacucaaaauggaagacuaauuacagcuaacccgauaguuacugauaaagagaaacccgucaauauagagacugagccaccguucggagaauccuacauagugguuggugcuggugagaaagcacuaaaacugagcugguuuaagcgaggcaguucgaucgggaaaauguuugaagccacugcuagaggggcgagacgcauggcaauacuaggggacacggcgugggauuuuggcucuauaggggguguuuuuacaucuguaggaaaguuaguccaucaaauauucggaaccgcauauggaguauuauuuagcggaguuucauggacaaugaaaaucggcauugguauacuacuaacuuggcuaggauugaacucacgauccaccucuuuaucaaugaccuguauugcgguagguaugguaacguuauacuuagggguaaugguacaggcggauaguggauguguaauuaacuggaagggucgggaacuuaaaugugguucaggaauuuuuguuaccaaugaaguacauacauggaccgagcaguauaaguuucaagcagauucucccaaacgucuaucagcugccauagggaaggcuugggaggaagggguaugcggaauacgcucugccacaagacuagaaaauauuauguggaagcaaauaucgaaugaauuaaaucauauacuccuugaaaacgacaugaaauuuacagugguuguaggagaugcuaauggaauacuagcgcaaggcaagaagaugauacguccucaaccaauggaacauaaauauucauggaagucuugggggaaagcaaaaauaaucggagcugauauacagaauacaacuuucauaauagacgggccggauacacccgaguguccagauggccaaagagccuggaauauaugggaaguagaagauuacgguuucgguguguucacaacaaauauauggcuuaaauuacgugauuccuauacacaaaugugugaucacaggcuuaugucagcagcgauuaaggauucuaaagcggugcacgccgauaugggauacuggauagaaagugagaaaaaugagacauggaaacuugccagggcgaguuucauagaaguuaaaacauguacauggccaaagucacauacucuuuggucaaaugguguucuagagagugaaaugauuauacccaaaauuuauggagggcccauaucacaacacaacuauagaccaggauauuuuacacaaacugccgguccguggcauuuaggcaaacuugaacuagacuuugaucuuugcgagggaacuacuguuguagucgaugaacauuguggaaaccgaggacccucccugcguacaacgacggugacagguaagauuauccaugaaugguguugucgaucaugcacucuaccaccccucagguucaggggagaggacggaugcugguacggaauggagauucgaccuguaaaagaaaaggaagaaaaccuagugcgcaguaugguaucagccgguaguggugagguugauucauuuagucuugggauucuuuguguaucaauaaugauagaagaaguaaugagaucacgauggaguagaaaaaugcuaaugacugguacucuagccgucuuucugcuccuuaucaugggacaacuaacuuggaacgaucuuauacgacuuuguauaaugguaggugcgaacgcuucugauagaaugggcauggggacaacauaccuagcccugauggcuacuuucaaaaugagaccgauguuugcagugggauuauuauuccgacgauuaacuuccagagaagugcuucucuuaacuauagguuugagccuaguugcuagcguugaacucccaaauagucuagaagaacuaggagacggacuagcaaugggaauuaugauguuaaaauugcuaacugaauuucaaccgcaccaauuguggaccacacuacuaagccugacauuugucaaaacuacccuaagccuagauuacgcauggaagacaacugcgauggcuuuaucuaucguuucacuuuuuccacucugccuauccacuacuucgcagaaaacuaccugguuaccggugcuauuagggucauucggguguaagccacuaacaauguuccuuauaacugaaaauaaaauaugggggcguaagucauggccguuaaaugaagguaucauggcaauagguaucguaucgaucuuacuaucuucauugcuaaagaacgaugucccucuagcagguccauuaauagcaggagggaugcuaauugcgugcuaugucauaucugguucaagugcggauuuaucucuggaaaaagcggccgaagucaguugggaacaagaagcugaacacaguggcgcaagccauagcauucucguugaaguacaagacgacggcacaaugaaaauuaaagacgaagaaagagacgauacauuaacaauauuauuaaaagcaaccuuauuagcgguaagcggaguguauccuaugucuauaccugccacucuauuuguaugguacuuuuggcagaagaagaaacaaaggucuggcguauuaugggauacaccaucgccgccagaagucgaacgcgcuguuuuggacaaugggauuuaucggauauuacaacgaggauuacuuggaagaucucaagucggaguaggcguauuccaagauggcguauuucauacaauguggcauguuacuaggggagcuguguugauguaccaagguaaaagauuagaaccuaguugggcaagcguaaagaaagaucuuauaucauacggcgggggcuggagguuucagggaagcuggaauacaggagaagaaguacaaguaaucgcuguagagccaggcaaaaaucccaaaaauguacaaacaacaccuggaacauucaaaacgccggaaggggaggucggugcaaucgcccucgauuucaagccgggaacgaguggaaguccgauagugaacagggaaggcaaaaucguuggguuauauggaaauggagugguaacuacaucagguacauauguaucagcaaucgcccaagcgaaggcgucacaagaagguccacucccggaaauugaagacgaaguauuuaagaagagaaacuuaaccauaauggaccugcauccagggucgggcaaaacaagaagauaccuuccagcgauuguuagagaagcuaucaaaaggaaacugaggacacuaaucuuagcuccaacaagaguaguagccagugaaauggcggaagcauuaaaagguaugccaauaagguaccaaacaacggcaguaaaaucugaacauacugggagagagauaguggaucuaaugugucaugcuacuuuuacaaugcgauuguuauccccaguacgaguaccuaauuauaauaugauaauaauggacgaagcacauuucacagauccagcgucaaucgcggcaagggguuacauaucaacacgaguuggaaugggagaagccgcugccaucuucaugacagccaccccaccaggcagcgucgaagcguuuccacaaucaaaugcggugauacaagaugaagaacgagacauacccgaaaggucauggaacucaggauaugauuggauaacugacuuuccaggaaaaacggugugguucguuccaucaaucaaaucaggaaacgauauagcgaacuguuuacguaaaaaugguaaacgcguaauucaacuaucacgcaagaccuucgacacagaauaucagaaaaccaaaaacaacgacugggacuacguaguuacaacagacauaagcgagaugggagcgaauuuucgagccgaucgaguaauugacccaagaaggugucuaaaacccguaauauuaaaagauggccccgaaagaguaauacuggcuggaccgaugccagugacugcagcauccgcggcccagaggcggggucgcaucggucgcaaccagaauaaagagggagaccaguauguuuacaugggucaaccacuaaauaaugacgaagaccacgcgcacuggacagaagcaaagaugcuacuugauaauauaaacaccccugaaggaauuauucccgcguuauuugaaccugaaagagagaagagugcagcaauugacggugaguacagauuaaggggugaagcgagaaagaccuuuguagaacuaaugagaagaggggaccugccaguuugguuaaguuacaaagucgcguccgaggguuuucaguacucagaucgacguuggugcuucgauggagagcgaaauaaucaaguucuggaagaaaauauggaugucgagauauggacuaaagaaggggaaaggaagaaacuuaggccccguugguuggacgcacgaacguauagcgacccuuuagcauuaagagaauuuaaagaauuugcagcaggcagaagaucaguaucgggagauuuaauccuugaaauaggcaagcuaccacaacaucuaacuuuacgagcacaaaacgcucuagacaauuuaguaaugcuccacaauucggaacaaggagguaaagcauaccgacaugcaauggaggaauuaccagauacaauugagacuuuaaugcuucuagcuuugauugcgguacugacuggagguguaacacuauucuuucuaucaggcaaaggacuaggaaaaacaaguauaggucuccuauguguaacugcaucguccgcacuucuuuggauggcaucaguugaaccacauuggauugcugcaucaauaauucuggaauuuuucuuaaugguccuccuaauaccugaaccagaccggcaaagaaccccucaagauaaccaauuagccuauguagucauuggauugcuauucaugauuuuaaccguagcugcgaacgagauggggcuguuagaaacgaccaagaaagaucuaggaauagguuaugucgcagcagaaaaucaucaacaugcaacuaugcucgauguagauuuacauccugcaucugccuggacgcuauaugcuguugcgacuacaguaauuacaccaaugaugaggcacacgauagaaaauacuacggccaauauauccuuaacugcaauagcaaaucaagcagcuauauugaugggacuugauaaagguuggccaauuucaaaaauggacaucggaguacccuuacuagcucuuggauguuauucacaaguuaauccucuaacgcuaacggcggcaguauugauguugguagcacacuaugcaauaaucggucccggguuacaagcuaaagcaacacgagaagcccagaaaagaacagcagcggguauuaugaaaaacccaacagucgauggaauaguagcgaucgacuuggacccaguaguuuaugaugcaaaauucgaaaaacaacuaggacaaauaaugcuccuuauucuauguacaucgcaaauacuuuuaaugcgaacaacuugggcgcucugcgaaagcauuacgcuugcaacagguccuuuaacaacucucugggaaggcagucccgguaaauuuuggaauacaacuauugcagucaguauggcaaacaucuuuagagggucguaccuagcuggagccgguuuagcuuucagccuuaugaaaucacuaggggguggucguagagggacaggagcgcagggcgaaacacuaggugaaaaguggaagaggcaacuuaaucaauuaucuaaaucagaauuuaauacguauaaaagaucuggcaucauggaaguugaccgaucggaagccaaagagggccuaaagagaggcgaaacgacaaagcaugccgucucccggggcacagcuaagcuacggugguucguugaaaggaacuugguuaaacccgaagggaagguuauugaccucgguuguggccgagggggauggaguuacuacugcgcgggccucaaaaagguuacagaggucaaaggguacacgaaagggggaccagggcacgaagaaccgauuccaauggccacauacgguuggaauuuaguaaaacuacauucagguaaagauguauuuuucaugccgccagagaagugcgauacccuccuaugugauauaggugaaucaaguccgaacccaacuaucgaggaaggucgaacuuuaagaguauugaaaauggucgaaccaugguuaaggggaaaccaguuuuguaucaaaaucuugaauccauauaugccaaguguagucgagacguuagaacgaaugcaaagaaaacaugggggaauguuaguccgaaaucccuuaucaagaaacaguacgcaugaaauguauuggguuucgugugguacuggaaacauaguuuccgcagucaauaugacgucgaggaugcuacuaaaccguuuuacgauggcacaucggaaaccaacauaugaacgagacguagauuugggggcaggaacaagacauguugcaguggaaccggagguugcgaaucucgacaucauugggcagcguauugaaaauauuaaaaacgaacauaaaaguaccuggcauuacgaugaagacaaucccuacaaaaccugggcguaucacgguagcuaugaagugaaaccaagugggagugcuuccaguaugguuaauggagucguuaggcuucugacgaaaccgugggauguuauaccuauggucacgcagauugcaaugaccgauacaacuccguucggacaacaaaggguauuuaaagaaaagguagauaccaggacucccagggcaaaaagagguacaacgcaaauuauggaaguaacagcaaaaugguuaugggguuuccuaucccgaaauaaaaagccucguauaugcaccagggaagaauuuacaagaaagguuagaucgaacgccgcaauaggugcgguauuuguagacgagaaucaauggaacucggcgaaagaagcaguagaagaugaacgauucugggaucuagugcaucgagaaagggaauuacacaaacaaggaaagugcgcaacgugugucuacaacaugaugggcaaaagagagaagaaacuuggggaauuuggaaaagcaaaaggaagcagagcuauuugguacauguggcuaggcgcaagguuucuagaguucgaggcuuuggguuuuaugaaugaggaccauugguuuagucgagagaacucauuaagcggcgucgaaggugaaggauugcauaaauuaggguauauuuugagagauauuaguaagauaccaggcggcaauauguaugcagaugauacggccgguugggacacuagaguuacagaagaugauuuacaaaaugaagcuaaaaucacggauauaauggagccggagcacgcucuccuagccaccuccauauucaagcuaaccuaccagaauaaggugguaaggguacaaagaccugcaaagaacggcacaguaauggacgugauauccagacgagaccagcgagggucaggccagguaggcacguauggccuaaauaccuucacaaauauggaaguccaacucauacgacagauggaaagugaagguauauuucuuccaucagaacuagagacgccuaauuuggcagaacgugcauuagauuggcuugaaaaacacggggcagaaagacucaaacguauggcaauaagcggugacgauuguguaguuaaaccgauagaugaccgguuugcuacggccuugacugcguuaaacgauaugggaaaagucagaaaagauaucccacaaugggaaccaucaaaaggcuggaacgauuggcaacaaguccccuucugcucgcaccacuuccaucaauuaauuaugaaagacggucgcgaaauaguaguuccaugucgaaaucaagacgaacuuguagggagggcacggguuagucagggagcuggguggagucuaagagaaacggccugccuaggaaagucuuaugcucagauguggcaacuuauguauuuucaucggcgagaccuaagacucgcagcaaaugcaauuugcuccgcugucccaguagacuggguucccacaagcagaacgacauggucaauucaugcacaucaucaguggaugaccacagaagauauguuaucaguuuggaacagaguauggauagaagaaaaucccuggauggaaaacaaaacccauguaucaaguugggaagaagugcccuacuuagggaaacgagaggaucaauggugcggaucacuuauaggcuuaacggcucgggcuacuugggcaacaaauauacagguagcuauaaaucaaguuagaagacugauuggaaaugaaaauuauuuggacuacaugacaaguaugaaacgguuuaaaaaugaauccgauucagaaggagcguuaugguag

SEQ ID NO: 21358 - RNA, 9879 nt, Artificial Sequence
  derived and/or modified CDS sequence (opt6) from DENV-1__KJ189361__SS-prME
aguguuacgauguugcuaaugcuacuucccacggcuauggcuuuccaccuaacgacucgagggggagaaccgcauaugauagugucuaaacaagaacgugguaaauccuuacucuucaaaaccucugcagggguuaauaugugcacauuaaucgcaauggaccugggagaacuaugugaagauacuaugacauacaaauguccccgaauuacagaagcagaaccagaugauguggauugcugguguaacgcaaccgacacauggguaacauacggcaccuguucgcaaacaggagaacacagaagggaaaaacgaucaguggcgcuagcgccacacgugggccuaggacucgaaacacgaaccgaaacuuggauguccagugaaggggcuuggaaacaaauccaacggguagaaacuugggcauuaaggcauccaggauuuacgguaauugcuuucuuccucgcgcacgcuauagguacaaguauaacgcaaaaagguaucauauuuauccuacuuauguuaguaaccccaucgauggcuaugagaugcguaggaaucggaaauagagauuucguagaaggauuauccggagccacauggguugauguaguguuagaacacgguagcugcguuacaaccauggcgaaaaacaaaccuacgcuggauaucgaacuccuaaaaacagaagugacgaauccagcaguccucagaaaacugugcauagaagcaaaaaucucuaacacaacgacagacucaagaugcccuacucaaggagaagccaccuugguagaagaacaagaugcaaauuucguaugccggagaaccuucguagacagaggaugggggaacggauguggauuauuuggcaaagguucccucuuaaccugugcaaaauuuaaaugugugacuaaacuggaaggcaaaauugugcaauaugaaaaucuaaaauauucuguuauuguaacaguacacacaggagaucagcaucaaguagguaaugagaccacagaacacggcacaauagcgacuauaacuccacaagcaccgacaucugaaauacaacucacugauuacggagcguugacacuggauugcucuccaaggaccggacuugauuuuaaugaaaugguucuguugacuaugaaagaaaaauccuggcugguacacaaacagugguucuuagaccuuccauugccauggaccucgggagcuuccacgucacaagaaacauggaaccgacaagauuuguuggugacuuucaaaacugcccaugccaagaaacaagaaguuguaguacucgggucacaagaaggcgcaaugcauacagcauuaacuggcgcuaccgaaauccaaaccuccggcacuacgacuauauuugcaggacauuuaaaaugucgacugaagauggauaaauuaacccucaaaggaaugucguauguaaugugcacuggaaguuuuaaguuagaaaaagagguggcggaaacacagcauggaacaguauuaguacaaguaaaauacgaagguacagaugcaccuugcaagaucccguucuccacacaggacgaaaaaggugucacgcaaaacgguaggcuaaucacagcaaacccaaucguaacugacaaggagaaaccuguuaacauugaaaccgaaccaccguuuggcgaaucuuauaucguaguaggugcuggugagaaagcacuaaaauuaagcugguuuaaaaggggaagcucuauaggcaaaauguuugaagccacagcucgcggagcacgaaggauggcaauccugggcgacacugcgugggacuucggaaguauuggaggcguuuuuaccucagucggaaagcucguacaucaaauauuugguacugcuuaugguguacuauuuucgggagucagcuggacgaugaaaaucggcauagguauacuuuuaacauggcuuggacuaaacagucguuccaccagucugagcaugacauguauugccguagguaugguaacacucuauuuaggugugaugguccaggcugacaguggaugcguaauaaauuggaagggaagagagcuaaaauguggaagcgggaucuuuguaacuaacgaaguucauacauggaccgagcaauauaaauuucaagcugauucaccaaagcgacuaagcgcagcuauaggaaaagcaugggaagagggaguuuguggcauacguagcgcaacaagacuggagaacauuauguggaaacagaucaguaaugaauuaaaccacauucuauuagaaaaugauaugaaguuuacagugguaguaggggaugcuaacggcauucuugcacaaggcaagaaaaugaucagaccacaaccuauggaacauaaguacagcuggaaauccugggguaaggcgaaaauaaucggugcugauauacaaaacacuaccuuuaucauagauggaccggacacacccgaguguccagacggucagagagcauggaacauaugggaaguugaagauuacggcuucggaguauucaccaccaauauaugguuaaagcuacgagauucauacacucaaaugugcgaucaccgacucauguccgcagcuauuaaagauucuaaagcugugcaugcagacaugggguacuggaucgagagugagaagaaugagacauggaaauuagcaagagcuucguucaucgaaguaaaaacuugcacguggccaaaaucacauacacuauggucuaauggaguacuagaaucugagaugaucaucccuaaaauauacggagguccgaucagucaacauaauuaucggccuggcuacuuuacacaaacugcagggccauggcaucuagguaaacucgaacuugacuuugaucuuugcgaaggaacaacuguaguuguagaugagcauugcggcaauagaggaccuagucuucgaacaacaacgguaacuggaaaaauaauucaugaaugguguugccgaucuuguacgcugccuccacuaagauucagaggagaagaugguuguugguacgggauggagauuaggccaguuaaggaaaaggaagaaaauuuggugagaucaauggucuccgccgguucaggugagguugacucauucagccuuggcauucuaugugucucgauuaugauagaagaagugaugagauccagauggucacguaaaaugcuuaugacagggacauuagcaguuuuucuauuauugauaaugggucaguugacguggaaugacuugauacgauuauguauaaugguuggggccaaugccagcgacaggauggguaugggcacaacauauuuggcgcucauggccacauucaagaugagacccauguuugcaguaggucugcuuuuucggagacuaacaaguagagaaguacugcuacuaaccaucggucugucuuuagucgccucaguugaacuaccaaauucccucgaagaacucggugacgggcuggcgauggguauuaugaugcuaaaacuuuuaacagaguuccaaccacaucaacuauggacuacacuucuuagcuugaccuuugugaaaacuaccuugucuuuagacuacgcuuggaaaacaacagcaauggcccuauccauagucuccuuauucccgcuauguuuaucaacuacgagucaaaagacaacuugguuaccuguacugcuagguuccuuuggcugcaaaccauuaacaauguucuuaauaacagagaacaaaauuuggggacggaaaaguuggccauuaaaugaagguauaauggcaauuggcauagucucgauauuacuaaguagccuauugaaaaaugauguaccacuggcggguccauugaucgcaggcggcaugcuuauagccuguuacgucaucaguggaagcucagcggacuuaucuuuagaaaaagcagcugaaguaucgugggaacaagaggcggaacauucaggcgccucucacucaauuuuaguggaaguccaggaugauggaacaaugaagauaaaagaugaggaacgagacgacacacuuacaauucuucuaaaagcuacauugcuagcagugagugguguuuauccuaugucaauucccgcuacuuuauuugucugguacuuuuggcaaaagaagaaacagcgcucaggaguccugugggacacaccuuccccuccggaaguagaacgggcaguauuagauaauggaauauaucguaucuuacaaagggguuuguuaggucgaucacagguaggaguaggggucuuccaggauggaguuuuucauacuauguggcauguaacgaggggcgcgguuuuaauguaucaaggaaaaagacuagagccaagcugggcauccgucaagaaagaccuuauaaguuauggcgggggauggcgauuccaaggcagcuggaacacgggagaggaaguacaagugauugcuguggaaccggguaaaaauccuaaaaauguucaaacgacaccggggacuuucaaaacaccggaaggagaaguaggagccaucgcccuagauuuuaagccggggacuucaggaucacccauuguaaaucgcgaggguaagauagugggacuguauggcaaugguguaguaacaacaagcgguacauaugucagugcaaucgcacaagcuaaagcaucgcaagaaggacccuugccagagaucgaggaugaaguguuuaagaagagaaacuugacuauaauggaucuacaccccggcuccggaaagacccggcgauaccuaccagcaauaguaagagaggcuauaaaaagaaaguuacgaacuuuaauucuagcaccaacccgaguaguggcuucugaaauggcugaggcccucaaagguaugccaaucagguaucaaaccaccgcuguuaagucagaacacacgggacgcgaaauuguugaccuaaugugccaugcaacauuuacaaugagauuacugaguccuguuagagucccaaacuauaauaugauuauaauggaugaggcucacuuuacugaccccgcaucuauagccgcccgagguuauauaagcacaaggguaggaaugggagaggcggccgcuauauuuaugaccgcaacuccacccgggagcguugaggcuuuuccacagagcaacgccguuauucaagaugaagaaagggauauaccugagagaucauggaacucaggcuaugacuggaucacagauuuuccaggaaagacgguuugguucguaccaagcauaaaaucagggaaugauauagcuaacuguuugcgcaaaaauggaaaaagaguuauacaacuaagcagaaagaccuuugauacggaguaccagaaaacgaaaaacaaugacugggacuauguagucacaacagacauaucugaaaugggagcaaauuuccgcgccgacagagucauugacccaagacgaugucuuaaaccgguaauucucaaagacggccccgaacgcguaauucuagcuggaccaaugccagugacggcggcaucugccgcacaacgacgagguagaauagguagaaaucaaaacaaagagggggaucaauaugucuauauggggcaaccguuaaauaacgaugaagaccaugcgcauuggacugaagcaaaaauguuauuggauaacauaaacacuccagaaggcauuauaccugccuuauuugaaccagagcgagagaaaagcgcagcuauagacggugaguauagacuaagaggcgaagcgagaaaaaccuuugucgagcuuaugcgaagaggggauuuaccaguaugguuaucauauaaggucgcaucagaaggauuucaauacucagauaggcgcugguguuucgauggagaaaggaacaaucaaguacuugaagaaaacauggacguugaaauauggacaaaagaaggagaacgaaagaaacuucgaccaagauggcuugacgcuagaacuuacucggauccacuugcacuucgagaauuuaaggaguucgccgcaggucguaggagcguuucaggggaucuuauuuuagagaucggaaaacugccacaacaucuaacacuccgugcucaaaaugcgcucgauaauuuaguaauguuacauaauagcgaacaaggugggaaagcauaccgacacgcaauggaagaacuaccagacacaaucgagacucuaauguuacuugcacucaucgcaguguuaacagggggaguuacauuauucuuucuguccggcaaagguuuaggaaaaaccuccauagggcuacucugugugacagccaguucugcacuauuauggauggccucaguagaaccccauuggaucgcagccagcauuauuuuggaguucuuucuuaugguacuucucaucccggaaccagauagacaacgaacaccucaagauaaucaauuggccuauguugucauaggcuuauuauucaugauacucacaguagcagcaaaugaaaugggauuacucgaaaccacuaagaaagacuugggaauaggauacguagcagccgaaaaccaucaacaugccacuauguuagauguggaccuacaucccgcaucagcauggacauuguacgcaguugcaacaaccguaaucacgccuaugaugagacacaccauugagaacacaaccgcgaauauaucacuuaccgcaauugcaaaucaagcagcuauauugaugggauuagauaaaggauggccaauaucgaaaauggauauaggaguuccucuucuagcacuagggugcuauagucaaguaaacccauuaacuuuaaccgcagccguacuaaugcucguagcgcacuaugcaaucauugguccuggccuucaagcuaaggcuacaagagaagcgcagaaaagaacugcugcaggcauaaugaagaauccaacuguagacgguaucguagcaauagaucuggacccaguagucuaugacgcgaaauuugaaaagcaauuaggccaaauuauguuacuaauucuaugcacuagccaaauauuacuaaugcggacuaccugggcucucugugagucaauuacguuagcaacggguccacugacuaccuuaugggaaggaucccccggcaaguucuggaauacaaccauagcgguaucaauggcaaauauauuuaggggcucuuaucuagcuggcgcgggucuggccuucucacuuaugaagucauuaggggguggaagaagaggaacaggugcacagggggaaacuuuaggugaaaaauggaaaaggcaacucaaucaacugagcaaaagcgaguucaacacuuauaaaagaaguggaauaauggaagucgaucgcucugaggcaaaagaaggauuaaaacguggagaaaccacuaaacaugcagucagucguggaacggcaaaauugagaugguuuguagaaagaaaucuuguuaaaccggaggggaaaguaauugauuuggguuguggcaggggugguuggagcuacuacugugcaggccuaaagaaagucaccgaaguaaaagguuauacaaaaggagguccgggccaugaagaaccaauaccgauggccacguacggauggaaccuagugaagcuacacuccgguaaagauguauuuuucaugccaccagagaaaugcgacacacuauuaugugacauuggcgaaucuucucccaaucccacuauagaagagggaagaaccuuacggguacucaagaugguagagcccuggcuaagaggaaaccaguucuguaucaaaauacuuaacccauauaugccaucaguagucgaaacucuugaacgaaugcagcgcaaacacgggggcauguugguaagaaauccucugucccgaaauuccacucaugaaauguauuggguaaguugcgguacuggaaacauuguaucggcuguaaacaugacuagcagaauguuauuaaacagguucacaauggcucauagaaagccaacauacgaacgugauguagacuuaggcgcaggaacgagacacguagccguugaaccugaaguugcaaaucuugauauuauaggacagcguauugagaauauuaaaaacgagcauaaauccacuuggcauuacgaugaagauaacccuuacaaaacaugggcauaucauggaagcuaugaaguaaagccuuccggaucggcaaguucuaugguaaacgggguugucagacuacucacaaagcccugggauguaauaccuauggucacacaaauugccaugacagauacgacuccauuuggucaacaacgcguguucaaagaaaaagucgacaccagaacuccuagggcgaaacgcgggacaacccaaauuauggaggugacugcuaaauggcucuggggguuuuuaucgagaaauaagaaaccgcgaauaugcacacgcgaagaauuuacccgcaaagucagaaguaaugcugcaauaggcgcuguguuuguagaugaaaaucaauggaacuccgcuaaagaagcuguagaggaugaacgcuuuugggauuuaguucacagagagcgagaacuacacaagcaaggaaaaugugccacuuguguuuacaauaugauggguaaacgugagaagaaauuaggagaguucggcaaagcaaaaggaucacgagcaauuugguauaugugguugggcgcaagauuucuagaauuugaagcucuuggcuucaugaaugaagaucacugguuuagcagagaaaacucacuuuccggaguugagggugaaggguuacacaaacugggauauauacuaagagacaucagcaaaauaccagggggaaacauguacgcagaugacacugcgggaugggauacccguguuacagaagaugacuuacaaaacgaagcaaaaauaacagauauaauggaaccagaacacgcccuacuagcgacaaguauuuuuaaacucacguaucagaauaaaguaguuagaguacagagaccggcuaagaauggcacggugauggauguaauaagucgacgugaucaaagggggucggggcaagucgguacuuacgguuuaaauaccuucaccaauauggaaguucaacuaaucagacaaauggaaucggaaggaauauuucucccgucugaacuagagacgccaaaccuggccgaacgugccuuggacuggcuagaaaaacauggagcggaacgccuuaaacgcauggccauuaguggagaugacugcguuguaaagcccauagacgacagauuugcaaccgcucucacagcccuuaacgacauggggaaaguaagaaaagacauuccacaaugggagccuaguaagggauggaaugauuggcaacaaguucccuuuugcagccaucacuuccaccaacuuauaaugaaagauggucgcgagauaguaguaccaugccguaaucaagacgaguuggucggucgagcaaggguaagucaaggggcuggcuggagcuuacgugaaaccgcuugccuuggaaaaucuuacgcgcaaauguggcaacuuauguauuuucauagaagagaccugcgccucgcggcgaacgcuauuuguucugcaguaccaguggauuggguaccaacuucgcgcacaacuuggagcauacacgcgcaucaccaauggaugacaaccgaggauauguuaaguguauggaauagaguuuggauagaagaaaacccauggauggaggauaaaacccacgucucuagcugggaagaaguuccauaucuaggcaaacgggaggaucaauggugcggaucacucauaggccuaacugcgagggccacuugggcaacaaauauacaaguagccauuaaucaaguacguagacucaucggaaaugaaaacuauuuggauuauaugacaagcaugaaaagauuuaaaaaugaaucggauagugaaggagcucucugguaa

SEQ ID NO: 21359 - RNA, 9879 nt, Artificial Sequence
  derived and/or modified CDS sequence (opt6) from DENV-1__KJ189362__SS-prME
ucaguaacuaugcuacuaauguuauuaccaacugcacuagcauuucacuuaacgacucgagggggagaaccacacaugauaguuucgaaacaagaacgaggaaaaucacuacuuuuuaaaacuagcgcugguguaaauauguguacacucauagcaauggacuuaggggaauugugcgaagauacaaugaccuauaaaugcccacgaauuacugaagcagaaccagaugacgucgacugcugguguaacgcaacagacacauggguaacuuauggcacaugcagccaaacuggagaacacaggcgagaaaagagaaguguagcacuggcaccucacguaggacuaggacuugaaacacgaacagaaaccuggaugucuucggaaggcgcauggaaacaaauacaaagaguggagacuugggcauuaagacauccuggauuuacggucauugcauuuuuccuugcucacgcgaucgggacgucaauuacccaaaaagggauuauauuuauccuacuaauguuaguuacacccuccauggcaaugaggugcguggggauuggaaauagagacuucguagaaggcuuaaguggugccacauggguggaugugguacuggaacauggaucgugcguaacaacaauggccaaaaacaaaccgacgcuggauauugaacuuuugaaaacggaagucacaaacccagcuguuuuaagaaaauuguguauugaagcaaagauaucaaauacaaccacugauucccgaugcccgacccaaggagaagcuacacuuguggaggaacaagacgccaacuucgugugucgaagaacacucguggacaggggauggggaaacggaugugggcuauuuggcaaagggucauuacuaacuugugcuaaauuuaagugcgugacaaaauuagaggggaaaauuguacaauacgaaaacuuaaaguauucuguaauagucacuguucauacaggcgaucaacaucaagucgguaaugaaacaacugaacacggaaccauugcuacaauaacaccacaggcaccuacaucugaaauacaacuaacagauuauggagcucuaacauuagauuguagucccagaacaggacuggacuuuaaugaaaugguacuucucacaaugaaagagaagucaugguuaguacacaagcaaugguuucuagacuuaccacucccuuggacaaguggggcaucaacaagccaagaaacauggaaccgacaagaucugcucguuaccuucaaaacagcgcacgcuaagaaacaagaaguaguaguacuaggcucacaagaaggugcuaugcacacugcuuuaacaggagcuacagagauccaaacaaguggaacgaccacgaucuucgcaggccaccuuaaauguaggcuuaaaauggacaaauuaacuuugaaagguaugucauaugugauguguaccgguucguuuaaacucgaaaaagaaguugccgagacccaacacggaacagucuuaguucaaguaaaauaugaagguaccgaugcacccugcaaaauaccauuuucgacacaagacgagaaaggaaugacgcaaaacggaaggcuaauuacagcaaauccaaucguuacugacaaggaaaagccugucaacauagagacugaaccgccauuuggagagagcuauauagugguaggggcuggagagaaagcguuaaaacuauccugguuuaaaaggggcucaagcaucgguaaaauguuugaggcaacagcaagaggagcaagacguauggcuaucuuaggggacacggcuugggauuuuggcaguauaggcggaguuuuuacuucugugggaaaauuaguacaucaaaucuuugguacugcuuauggcguucuguucucggguguuucauggacgaugaagauagguauuggcauccuuuuaacaugguuaggccuuaauucccgaaguaccucauuaucgaugaccuguauagcuguggguauggugacauuguaucucgggguuaugguucaagcagacaguggauguguuauuaauuggaaaggaagagaauugaaaugcggaucaggaauuuuugugaccaaugaaguccauaccuggacagaacaguauaaauuucaagcagacaguccgaaaaggcucucugcggcaaucgguaaggcaugggaagaaggaguaugcggcauacgcagugcaacuagacuagagaauauuauguggaaacaaauuucgaaugaauuaaaucauauacuucuggaaaaugacaugaaauuuacaguaguaguaggagaugccaacgguauauuagcacaaggcaagaaaaugauuaggccacaaccaauggagcauaaguauuccuggaaaaguuggggaaaagcaaagauuauaggggcagauauucagaauacgacuuucauaauagauggaccugauacuccagaguguccggacggucaacgggccuggaacauuugggaaguugaggacuauggcuuuggaguuuuuacaaccaauauuugguuaaaacuuagagacuccuacacucaaaugugcgaucaccgacuaaugucagcagcgaucaaggauaguaaggcaguacacgcagauaugggcuacuggauagaaagcgagaaaaacgagacauggaaacuagcaagggcaaguuuuaucgaagugaagacuuguacguggccgaaaagucauacauuguggagcaauggcguacuggagucagagaugauaauaccaaaaaucuacggcggacccauaagccagcacaauuaucguccuggauauuuuacgcaaacagcuggaccauggcaccuuggcaaauuagaacucgauuuugaccuuugugaggguacaacuguggucguagacgaacauugcggaaaccgugggccuucacugaggacuacaacaguaacaggcaagauuauucaugagugguguugucgaaguuguacccuaccaccuuuaagauuccgcggagaagacgguuguugguaugguauggagauccgccccguaaaagagaaggaagagaauuugguacgaaguaugguaucagcaggaagcggagagguagauucuuuuucauuaggcauccuaugcguaucaauaaugauagaagaaguuaugagaucaagauggucuagaaaaaugcuaaugacugguacucuagcagucuuuuuacugcuaauaaugggacaacuaacauggaaugaccucauacgucuguguauuaugguaggagccaacgcgagugauagaaugggaauggguacaacauaccucgcucucauggcaacuuuuaaaaugaggccuauguucgcuguaggauuguuauuuagacgacuaacaucucgugagguucuauugcuaacaauuggauugagcuuaguugcuuccgucgaauuaccaaauucguuggaggaguuaggagacggauuagcuaugggaauaaugauguuaaaacuacugacagaguuccaaccucaucaacucuggacaacauuauuaucauugacguuuguacguacuacauuaagucuagauuacgccuggaagacaacggcuauggcacuaaguauaguaucacucuucccauugugccuaucgaccacaagucagaaaaccacauggcugccgguacuucugggcagcuucggcugcaaaccucuaacuauguuucugauaacagaaaacaaaauauggggaagaaagucauggccacuaaaugagggaauaauggcaaucggcauaguuucaauucuauuaucuaguuuauuaaagaaugaugugccguuagcagguccccucauugcuggcggaaugcuuaucgcuuguuacguaauuucgggaucuagugcugaucucucuuuggaaaaagcagcggaaguaucaugggagcaggaggcagagcacucgggagcuagucacucuaucuuaguugaaguacaggaugauggcacaaugaaaauuaaagaugaagaaagggacgauacucuuacgauuuuacuuaaagcuacuuuacuagcugucaguggagucuaccccaugaguauuccagcaacacuuuuugucugguacuuuuggcagaagaagaaacaacggucaggaguuuuaugggauacuccuucgccgccagaaguagaacgagcggucuuagacaacggcaucuaucgaauuuuacaaagaggauuacugggccguagccaaguaggagucggaguuuuccaagauggagucuuccacacaauguggcacgucaccaggggagcaguacuaauguaccaaggaaaaaggcuagaaccaaguugggcaagugugaagaaagacuuaaucuccuacgguggaggauggagauuucaagggagcuggaacacaggggaagaaguucaaguaauugcuguagagccagguaaaaaccccaaaaauguucaaacgacaccgggaacguuuaaaacuccagagggggaggucggggcgauugcucuggacuuuaaacccggaacgucuggaucaccuauaguuaauagggaaggaaaaaucguuggucuuuacgguaauggagucguuaccacaucaggaacuuauguauccgcaauugcccaggcgaaagcgucucaggaaggcccguuaccugaaauagaagaugagguauucaaaaagcgcaauuuaacuaucauggauuugcacccggggagugguaaaacuagaagguauuugccugcaauaguuagagaagcuauaaagagaaagcuaagaacguuaauccuagcuccuacaagaguaguugcaucggagauggcugaggcuuuaaaaggaaugccuauacguuaucaaacgacagcuguuaaaagugaacauacggguagagagauaguagaccuuaugugccaugcaaccuuuacuaugcguuuacuaagccccguuagaguaccaaacuacaacaugauuaucauggacgaggcccacuuuacagacccagcuucgauagccgcucgaggauacauaucuacacgagucggaaugggggaggcagcggcaaucuucaugacugcgacuccgcccgguucaguagaggcuuuuccccaauccaaugcaguuauacaagacgaagaacgagauauaccggagaggucauggaacucagguuacgacuggauaacagacuuccccggcaaaacaguaugguuuguucccucuauaaagaguggaaaugauaucgcgaauugucuucguaagaacgguaaaagaguuauccagcuuagucgaaaaaccuucgauaccgaauaccaaaagaccaaaaauaaugacugggauuauguaguuacuacggauauaagcgagaugggcgccaauuuucgugcggacaggguaauagauccaaggaggugccuuaaaccaguaauacuaaaagaugggccagagcguguaaucuuagcaggcccuaugccagugaccgcagcaagugcagcacaacggcgaggucggaucggcagaaaucagaacaaagaaggagaucaauauguauauaugggacagccacuuaauaacgaugaagaucacgcucacuggacggaagcaaaaaugcugcuagauaacauuaauacaccugaggguaucaucccagcauuauuugagccggaaagagagaaaagcgccgcaaucgauggggaguauagauugagaggcgaagcacggaagacauuuguggaauuaaugcguagaggagauuugccaguauggcuaucauauaagguagcaagcgaggguuuccaauauuccgaucgacguuggugcuucgacggagaacgcaauaaucaaguuuuagaagagaauauggauguagagaucuggacgaaagaaggagaaagaaagaaacuaagaccacguugguuggaugcuagaacauauucagaucccuuagcacugcgggaauuuaaagaguucgcagcagggagacguucaguuagcggugauuuaauuuuagagauagguaaacuuccucagcauuuaacccuaagagcacaaaaugcacuugauaaucuuguuaugcuucauaauucagagcaaggcgguaaagcauauagacacgcuauggaagaacuuccagauacuauugaaacuuuaauguuauuagcucuuaucgccguccucacaggcgguguuacuuuauucuucuuauccggcaaaggcuuagggaagacauccauuggauuacucuguguuacagccagcucaguuuuacuauggauggcaucuguagaaccucauuggauagcggcaagcauuaucuuggaauuuuuccuaauggucuuacuuauuccugagccugaccggcaacguacuccccaagauaaucaauuagccuauguagucauagggcuauuauuuaugauauuaaccguggcagcuaaugaaaugggcuuacuugagacaacuaagaaagacuugggaauaggcuacguggccgcagagaaccaucaacaugcgaccaugcuggacgucgauuugcacccugccucugcauggacucuauaugcaguagcaacaacaguuauuacgccgaugaugagacacacuauagagaauacuacagccaauauuucacuaacugcaauagcuaaccaggcugcaaucuuaauggguuuagacaagggauggccuauuucgaaaauggauauaggaguaccauuauuagcgcuuggaugcuacucgcaaguaaacccacuuacacugacugcugcaguucuaaugcuaguagcacauuaugcaauaauuggcccgggcuuacaagcuaaggcuacaagagaagcacaaaaacggacagcagcuggaauaaugaaaaacccgaccguagauggaauuguagcuauagaucuagauccgguggucuaugaugcaaaguuugaaaaacaacuaggccaaauuaugcucuuaauauuaugcacgagucagauauuacucaugcgaaccacaugggcgcuuugcgaaagcauaacuuuagccacugguccuuugacaacguuaugggaagguucaccuggaaaauucuggaacacaaccaucgcugugucaauggccaacauauucagaggaucauaucuugccggagcagggcucgcuuuuucgcugaugaagucauuaggugggggucggagaggcaccggagcacaaggugaaacuuuaggagaaaaauggaaaagacaacucaaccaacuaagcaaauccgaguucaacacuuauaaaaggagcgguauaauggagguugauagaucagaagcuaaagaaggauuaaaaagaggggaaaccacuaaacaugcuguaagcagaggaacugcgaaacuaagaugguucgucgaaagaaaucuuguaaaaccagaggguaaaguaauugauuuagggugcgggagagguggauggagcuacuauugugcuggucuaaagaaaguuacagaaguaaaagguuauacuaaaggaggacccggucaugaagaaccgauaccaauggcaacauacggauggaacuuagucaaacuucauucaggcaaagauguauucuuuaugccaccagaaaaaugugacacccuuuuaugugauauaggcgaaagcaguccaaauccaacuauagaagaagggagaacauugcgaguauugaaaaugguugagccaugguugagaggaaaucaauucugcauaaagauacuaaacccuuacaugccgagugucguugaaacccuagaacguaugcaaaggaaacacggaggaaugcuagugcggaauccauugucacggaauagcacucacgaaauguauuggguaucaugcgguaccgggaauauaguuucagcaguuaauaugaccaguagaaugcucuuaaaucgguuuaccauggcucauagaaaaccaaccuacgaacgagauguagacuuaggagcagguacgcggcauguagcaguagagccagaaguggcgaaucucgauaucaucgggcaaaggaucgagaauauuaaaaacgagcauaaaucgacauggcauuacgacgaagacaacccauacaaaacuugggcguaccauggaaguuaugaaguuaaaccaucgggaagugcuucaucuaugguaaacggaguaguaagauuauuaacgaaaccaugggaugucauaccaaugguaacacaaauugcaaugacagacacaacgccauuugggcaacaacguguguuuaaagaaaaaguugauacaagaaccccacgagcuaagagaggaaccacacagauaauggaaguuacagcaaaauggcuuuggggauuccuuucuagaaacaagaaaccucgaauauguacacgugaagaguuuacacgaaagguuagaucaaacgcagcaauaggcgcaguauuuguugaugagaaccaauggaacucagcgaaggaggcaguggaggacgaacguuucugggaccuuguacacagagagcgugaacuucauaaacagggcaaaugugcuacuuguguauauaauaugaugggaaagcgugagaagaaauuaggggaguucggaaaggccaaagggaguagagcgauaugguauaugugguuaggugcgagauuucuagaguuugaggccuuggguuucaugaaugaggaucauugguucagccgcgaaaauucauuaagcggaguagagggagaaggacuucacaaacuuggguauauacuucgggauaucaguaaaauaccaggaggaaauauguacgcugaugacacugcuggcugggauacaagagucacugaagaugaccuucaaaaugaagcaaaaaucacggauauaauggagcccgagcacgcauuacuggcaaccaguaucuuuaaauuaacauaucaaaauaaggucguccguguacagagaccugcuaagaauggaacaguaauggauguuauuucuaggcgcgaccaacgugguucgggucaaguagggaccuacggccucaauacuuuuaccaacauggaaguacaauuaauucgacagauggagucggaaggaaucuuucuaccuuccgaacucgaaaccccgaacuuagcagaacgggcacucgauuggcucgagaaacauggcgcggaaagacugaagcggauggcgauuucaggugacgauuguguuguaaagccuauagaugauagauucgcaaccgcccuuacugcuuugaaugauaugggcaaaguccgaaaagauauaccucaaugggagccaagcaaaggcuggaaugacuggcaacagguaccauuuuguagccaucauuuccaucaguuaaucaugaaggacgggagggagauagucguacccugccguaaccaagacgaacuuguaggacgugcaagaguaucgcaaggcgcaggguggucacugagggaaacggcuuguuuagggaaaaguuaugcacaaauguggcaacuaauguacuuucaucgaagagaucuacgccuggccgcgaacgcaaucuguagugcuguccccguagauuggguaccuacaucacgaacgacuuggaguauccacgcacaccaccaauggaugacuacugaagacaugcuuagugucuggaauagagucuggaucgaagagaacccuuggauggagaacaaaacacacguaaguaguugggaagaagucccauaccuuggcaaaagagaggaccaauggugugguucuuugauaggguuaaccgcuagagcgacgugggcaacuaauauucaaguagcgaucaaccaagugcggagacuuauagggaaugaaaauuaccuagauuauaugacuucgaugaaaagguucaaaaaugagucagacucugaaggagcccucugguag

SEQ ID NO: 21360 - RNA, 9879 nt, Artificial Sequence
  derived and/or modified CDS sequence (opt6) from DENV-1__KJ189363__SS-prME
aguguuacuaugcuauuaaugcuucuucccacggcauuagcauuucacuuaacuacgcguggcggugaaccacauaugauuguaucaaaacaggaaagaggcaaaucacuucuuuuuaaaacaagugcaggcgucaauaugugcacucuuaucgcgauggaccuuggggaauuaugugaagacacuaugacguacaaaugcccacguauaaccgaagcagaaccugaugauguugauugcugguguaaugcgacugauacaugggugacauacgguacuuguucacagacaggcgaacaucgaagggaaaaacgauccguggcucuugcaccucacguggguuuagguuuagagacacggaccgagacguggaugucuagugaaggugcuuggaaacaaauccaacgaguggaaacuugggcauuacgucauccuggauuuaugguuaucgcuuucuucuuagcacacgcuauagguacaaguauuacacaaaaaggaauaauuuuuauucuauuaauguuaguaacaccaucgauggcaaugagauguguaggaauaggaaaccgugauuuuguggaaggauugaguggagccacauggguugauguaguauuagaacauggaucaugcguuacuacaauggcgaaaaauaaaccaacauuagacauagaacuacuuaaaacagaaguaacaaauccggcgguucuuaggaaacuaugcauagaagcuaaaauaucuaacaccacuacugauagccgaugcccgacucagggagaagcgacguuggucgaagaacaggacgcgaauuuuguaugcagacgaaccuuuguugaccgggguuggggaaacggauguggauuauucggaaaagguucuuuauugacaugugcaaaauuuaaaugcguaacuaaauuagaaggaaaaauaguacaauaugaaaaccuuaaauacagcgucauaguaacagugcauacaggggaucaacaucaaguugguaacgaaacaacagaacauggaacaauugcgaccauuacaccccaggcgccaacaucagagauacaauugacugacuauggagcacuaacauuggauuguaguccacguacaggucuagacuucaacgaaaugguuuugcuuacgaugaaagagaaaagcugguuaguacauaaacagugguucuuagauuuaccguugcccuggacaaguggcgcgaguaccucacaagagacauggaacagacaagaccuguuaguuaccuuuaaaaccgcacaugcuaagaaacaggaaguuguaguacucggcucucaagagggagcaaugcauacagcacuuacuggcgcaacggagauucaaacaucgggcacgaccacaauuuuugccggucauuugaaauguagacuuaaaauggauaaguugacguuaaaaggaaugucguacgucaugugcacagggucauuuaaacuagagaaagaggucgcggaaacccaacauggcaccgucuuggugcagguuaaauaugagggaacggaugccccauguaaaaucccguuuucaacgcaagaugagaagggcguaacucagaauggucgguugauuaccgcgaauccuauagugacugacaaagaaaagccggugaacauagaaacagagccuccuuuuggagagucauacauaguagugggagcaggcgaaaaagcgcuaaaauuaucaugguucaaaagagggucaucuauugguaagauguuugaggcaacagcacgcggggccagaaggauggcaauauugggcgacacagcuugggauuucggaucuauuggcggaguguucacgucuguagggaaauuaguccaccaaauauucgggacagcauauggcguccuauucagugguguauccuggacaaugaaaauagguauuggaaucuugcuuacuugguuaggccuuaacagucgauccacaucacuuucuaugacaugcauugccguuggcaugguuacauuauacuuaggcguuaugguacaggcagacagugguugcguuauuaacuggaaagguagagaacuaaaaugugguucgggaauuuuuguuacaaacgaaguucauacauggacagaacaguauaaauuucaagcagauaguccuaaacguuuaucagcugcuauuggaaaggcaugggaagaaggaguauguggaauuagaagugccacaagacuagagaauauaauguggaaacaaauaucaaaugaacucaaucacauacuguuggagaacgauaugaaguuuacuguaguaguaggcgaugcaaacggaauacuagcgcaaggaaagaaaaugauucggccacaacccauggaacauaaguacucauggaaaaguuggggcaaagcaaaaauuauuggugcugacauacaaaauacaacuuucauaauagacgguccggauacccccgaguguccugacggacaaagagcauggaauauuugggaggucgaagauuacggguuuggaguguuuacuacaaauauaugguugaagcuacgagauucauauacucaaaugugugaucaucgacuaaugucggcagcgauuaaagauagcaaagccguacaugcagacaugggguacuggauagaaagugaaaagaaugaaacuuggaaauuggcucgugcgagcuuuauagaaguuaaaacauguacauggccuaaaagccacacauuauggagcaacggaguccuagaaucugaaaugaucauuccaaaaauuuauggagggccaaucucacaacauaauuaucggccaggcuauuuuacacaaacugcggggccguggcauuuaggaaaacuugaauuagacuuugaucuaugugaagguacaacugucgucguagacgaacauugugguaaucggggaccuagucugagaacuacgaccgucacaggaaagaucauccacgagugguguuguagaucuugcacucugccgccguuacgcuuuagaggggaggaugguuguugguaugguauggaaaucaggccuguaaaagaaaaagaagagaauuuaguacgcucgaugguaucagcagggagcggugaagucgauucauuuagucuggguauucucugcguaucuauuaugauugaagaaguaaugcgaucuagauggucuagaaaaaugcuaaugacuggaacacucgccguauuuuuacuguuaaucaugggacaauuaacauggaacgaccuaauuagacucuguaucaugguaggcgcuaaugcuagugacaggauggguaugggcacaacauauuuggcacuuauggcaacguucaagaugcggcccauguuugcgguuggacuuuuauuccguagacuaacaagcagagaggucuugcuuuugacaauuggacuuucauuagucgcaucgguagaacuuccaaacagucuagaagaauuaggggauggauuggccaugggaauaaugauguuaaaacuacucacggaguuccaaccacaucaauuguggacgacauuguuaucacugacguuugugaagacaacucucagcuuagacuaugcauggaaaacuacugcuauggcccuuucuauaguaaguuuauuuccacucugcuuaaguacaacaucucagaaaacaacuuggcuacccguguuacuaggauccuucgggugcaaaccacugacaauguuuuuaauaacugaaaacaaaauuuggggacgaaaaagcuggccuuuaaaugaaggaaucauggccauaggaauugugaguauacuuuuaagcucgcuuuuaaagaaugacgucccucuggcuggaccacugaucgcaggcgguauguuaauagcaugcuacgugauuagugguucuagcgcagaucuuagucuugagaaagcugcugaaguuucaugggagcaggaagccgaacacucgggggcaucucauucuaucuugguggagguucaggaugacgggacuaugaaaauaaaagacgaagaacgggacgauacuuugaccauauuguuaaaggccacguuauuagcggucaguggaguauaucccaugaguauaccugccacuuuauucguaugguacuuuuggcaaaagaagaaacaaaggaguggaguuuuaugggauacuccuagcccacccgaaguagagagagcagucuuggauaacgggauauauagaauauugcagcgcgguuuacuagguagaucgcaagucgguguagguguauuucaagacggagucuuucacacaauguggcacguuacacguggcgcgguguuaauguaccaagggaaaagacuagagcccaguugggcgucagucaagaaagauuuaauauccuacgguggaggguggcgauuucaaggcagcuggaauacuggcgaagaaguccaagucauagcuguagaaccagguaagaacccuaaaaauguccaaaccacaccuggaaccuuuaaaaccccagaaggagaaguaggagcaauagcucuggacuucaagcccgggacuucgggcagcccaaucguaaaucgggagggcaaaauagucggcuuauacggcaacggagugguaacaacaucagguacauacgucucagcuaucgcgcaagcuaaagcaagccaggaggguccccucccugaaauagaggacgaagucuuuaagaaacgcaaucuuacuauuauggacuuacauccuggauccggaaagaccagaagauacuugccagccauagugcgcgaagccauuaaacguaaauugagaacuuugauacuagcgccaacaagaguugucgcuagugaaauggccgaagcauuaaaaggcaugccaaucagauaccagacuaccgcaguaaagucggaacauaccgguagggagauaguagauuuaaugugucaugcaaccuuuacuaugcggcuuuuaagcccuguaagagugccaaauuauaacaugauaauaauggaugaggcacauuuuacagacccugccucaauagcggccagaggauacauaucaacccgaguaggaaugggugaagcagcugcuauauuuaugacagcgaccccuccgggaucaguggaggcuuucccacaauccaacgcugucauacaagaugaagaacgggacauaccagaaagaagcuggaacucagguuacgacuggauaacggauuuuccagguaagacggucugguucguuccaaguauuaaaagugguaaugauauugcaaacugucuaaggaaaaaugguaagcgugucauucaguuaucacggaagacauuugauacagaguaccaaaagaccaaaaauaaugacugggacuacguuguuacgacagacaucucagagaugggagccaauuuucgugcagacagaguaaucgaccccaggcgaugucucaaaccuguaauauuaaaagacgggccugaaagaguaauucucgccgguccuaugccggucacagcagcgucggccgcucagagaagagggagaauaggccgaaaucaaaacaaagaaggagaucaauacguuuacaugggacagccacuuaauaacgacgaggaucaugcucauuggaccgaagcgaaaaugcuguuagauaacauuaauacuccagaaggaaucauuccugcuuuauucgagccggaaagggaaaagucggccgccauagacggugaauaucgucuacguggagaggcuaggaagacauucguggaacuaaugagaagaggugaucuaccagucuggcuaaguuauaaaguggcuucggaaggauuucaguacagugaucguagaugguguuuugauggagaaaggaauaaucaaguuuuagaagagaauauggacguagagauuuggaccaaagagggggaacguaagaaacugcgcccccggugguuagaugcacgcacauacucagauccuuuagcauuaagagaauuuaaagaguuugcagcaggacgcagaucaguuagcggagaccuuaucuuagaaaucggaaagcuaccacaacaucuaacacugcgugcucaaaacgcacuagauaacuugguaauguugcacaacuccgagcaaggugggaaagcguacagacaugcaauggaagaguugccggauacgaucgaaacucuaaugcuuuuagcguuaauagcgguucugacuggugggguaacucuguuuuuccuaagugguaaggguuuaggaaagacaucuaucggucucuuaugcgugacugcuagcagugcacuacuuuggauggccucuguugaaccucacuggauugcagcaaguauaauauuggaguuuuucuuaauggugcuacuaauaccagagccggaucgacagcgaacaccacaagauaaucaacucgccuaugucguuauaggauuacuuuucaugaucuuaacaguugcagcuaaugagaugggauuacuagaaacaacuaagaaagacuuggguauuggauacguagccgcagaaaaucaucaacaugcaacaauguuggauguggacuugcaucccgcuucggcuuggacucuguaugcaguagcaacaacugucauaaccccaaugaugcgucacacaauagaaaacacgacugccaacauaagucuuacagcgaucgccaaucaggcugcgauauuaaugggauuggacaaaggauggccgauaucaaagauggacaucgggguaccuuuacuugcacucgguuguuacagccaagugaauccguuaacacuaacugcagcggucuuaaugcuuguagcccauuaugcaauaauuggaccagggcuacaagcaaaggcuacucgagaggcccagaaacgaacagcugccgguauuaugaaaaauccuacuguagauggcauaguugcuauagaccuagauccggucgucuacgacgcuaaguuugaaaaacaauuaggccaaauaauguuacugauacuauguacaucacaaauauugcuaaugagaacuacgugggcacuaugcgaauccaucaccuuagcaacggguccauuaacaacuuugugggaaggaucuccaggaaaauuuuggaauaccacuauugccguuucaauggcaaauauauuucgaggaucuuaucuugcuggagcgggauuggccuucucccucaugaaaucacuagggggaggaagacgcggcacaggcgcccaaggggaaacauuaggugaaaaauggaagcgacaacuaaaucaacuaucaaaaucagaauuuaacacauacaaaagaaguggaauaauggagguagacagaagcgaagcuaaagaggguuugaaacgaggugaaaccacgaaacacgcgguaaguagaggaacugccaaauugcgaugguuugucgaaagaaauuuagucaagccagaagguaaaguaauugaccuaggaugcggacgcggaggcuggagcuauuauugugcuggauuaaagaaaguaacugaaguaaaaggcuacaccaaaggaggaccgggccacgaagaaccgauuccaauggcuacguauggauggaaucuaguaaaauuacauagcgguaaagauguguuuuucaugccuccugaaaaaugcgauacucuucuuugugauauaggagagucuucccccaaucccacuauagaagaaggaagaacacugagaguauuaaaaaugguagaacccugguugcgaggcaaucaauuuuguauuaaaauucuaaacccuuauaugccaucuguaguagaaacuuuagaacggaugcaacguaagcacggcggaauguuaguucgcaauccccugucacgaaauucuacgcaugagauguauuggguaaguugcggaacaggcaauauuguuuccgcaguaaauaugaccucuagaaugcugcucaauagguucaccauggcacaccggaaaccgacauacgaacgagauguugaccuaggagcuggaacuagacacguggcggucgaaccugaaguagcuaaccuggauaucauugggcaaaggaucgagaacauuaaaaaugaacauaagaguacauggcacuaugacgaggacaaucccuacaagacuugggcguaccaugguucauaugaggucaagccuucaggaucggcuucaucaaugguuaauggaguaguucgucuccucacaaaaccuugggauguaauucccaugguuacucaaauagcuaugacggauaccaccccguuuggacaacaaagaguauucaaggaaaagguagauacuagaacgccucgggcuaaacgaggaacaacucaaauaauggaaguaacggcaaaaugguuguggggguucuuaagucgaaacaagaagccuagaauuugcacuagagaggaguuuacacgaaaagucaggagcaaugcagcgauaggagccguauuugucgacgaaaaucaauggaacucugcaaaggaagcuguggaagaugaacgcuucugggacuuaguacacagagaaagagaauugcauaaacaaggcaagugcgccacuuguguuuacaauaugaugggaaagagggagaagaaacucggcgaguucggcaaagcuaaaggaucucgagcuauuugguauauguggcuaggcgccagauuuuuagaauuugaagcacuugguuucaugaacgaagaccacugguuuucucgcgaaaauuccuuaucaggagucgaaggagaagggcuacacaaacuaggauacauuuuacgagacauaucuaaaauaccaggaggaaacauguaugcagaugauacagcagguugggacacaagaguaacagaggacgacuuacaaaaugaggccaaaauuacagacauaauggaaccagagcaugcauuacuugcaacaaguauauuuaaacuaacuuaucaaaauaaaguaguacgugugcaacgaccugccaaaaacggcaccguaauggauguaauaucuagacgagaucaacgcgguucaggccaaguagggacuuacggauugaacacuuuuacuaauauggaaguacaacuuauccgacaaauggaaucagaaggaauuuuccuuccaagugaacuagagacacccaacuuagccgaaagagcucuggauugguuagaaaaacacggggcugaaagguuaaaaagaauggcaauuagcggugacgauuguguaguaaagccuaucgaugaccgauuugcaacugccuugaccgcgcuaaaugacauggguaagguuaggaaggauauaccacaaugggaaccaagcaagggguggaacgacuggcaacaaguacccuucuguagucaucauuuucaccaauuaaucaugaaagaugggagagaaaucguagucccgugcagaaaccaggaugaguugguugguagggcgcguguaagccaaggugcagguuggucuuuacgugaaacagcaugucuaggaaagucguaugcacagauguggcagcucauguauuuucaucgacgagaccuaagauuggcagcuaaugcaauuugcucagcuguaccugucgauugggugccaaccucucgaacgacuuggagcauucaugcccaucaccaguggaugacgacugaagacaugcucagcguuuggaaucguguguggauugaagaaaacccguggauggaaaauaaaacucaugucucaucaugggaagaaguaccauauuuagggaaacgugaagaucaauggugugguucucuaauaggacuuacugcaagggcgacgugggcaacaaacauacagguggcuaucaaucaagucaggcgguugaucgggaaugaaaacuacuuagauuacaugacaagcaugaaaagauucaaaaacgaaagugauucggaaggugcacugugguaa

SEQ ID NO: 21361 - RNA, 9879 nt, Artificial Sequence
  derived and/or modified CDS sequence (opt6) from DENV-1__KJ189364__SS-prME
uccgugacuauguuauuaaugcuucuaccuacugcacuggcguuucaucuaacuacaagaggcggagaaccucauaugauuguaaguaaacaagaacgugguaaaaguuuacucuuuaaaacaagugcaggcgugaauauguguacccuaaucgcaauggaccuaggagaauugugcgaagauacgaugaccuacaaauguccucguaucacagaagcagaaccagaugauguagacuguugguguaaugcgacagacacuugggucacguauggaacaugcagucaaacaggagaacauagaagagagaaaagaucuguagcguuggccccacauguagguuuaggacuugaaacucgaaccgaaacuuggaugaguagugaaggggcuuggaaacagauacaacgcgucgaaacaugggcauuaagacauccuggguucacggucauagcuuucuuucuggcgcaugcaauuggaacaaguaucacacaaaaaggaauaauuuuuauucuucuaauguuaguaacuccauccauggcaaugcggugugugggcauaggaaaccgagacuucguugaaggucuaaguggagcuacauggguagacgugguacuggaacauggaucaugcguaacaacgauggccaaaaauaaacccacacuagacauagaauuacuaaaaacagaagucacuaaccccgcugugcuaagaaaacuauguauugaagcgaaaaucucgaauaccacuacagauuccagaugcccgacacagggagaagcuacuuuagucgaagaacaagacgccaauuucgucugccgaagaacauucguagaccgaggguggggaaacgguugugguuuauucgguaaaggcuccuugcuaaccugugccaaauuuaaaugcguuaccaaacucgaaggaaaaauaguucaguaugaaaacuuaaaguauucugugauagugacaguccacacgggagaucaacaucaaguagggaacgaaacaacugaacaugggacaauugccacuauaacuccacaggcaccuacgagcgaaauacaacuuacagacuacggagcgcuaacauuagauugcucuccucguacagggcuagauuuuaacgaaaugguacuacuuaccaugaaagagaaaagcugguuaguucauaaacaaugguuuuuagauuugccuuugccauggacuucgggagcuucuacaagucaagaaacuuggaaccgccaagaucuacuuguaacauucaaaacggcccacgccaagaaacaagagguggucguacuggguucgcaggagggagcgaugcauacagcucuaacaggagccacggaaauacaaaccaguggcacaacaacgauauucgcuggccaucuaaagugucgacuaaagauggacaaacucacccuuaaaggaaugagcuauguuauguguacaggaaguuuuaaauuggagaaggaaguagcagagacgcaacacgguacuguauuaguucaggucaaauaugaaggaacagaugcccccuguaaaauuccauuuucgacccaagaugaaaagggaaugacucaaaauggacgucugaucacagccaauccaauuguuacggacaaggaaaagccaguaaauaucgaaacagagccuccauucggugaaucauauaucguuguuggcgccggggaaaaggcuuuaaaauugucuugguuuaaacgcggaagcucaauugggaagauguuugaagcaaccgcuagaggugccaggagaauggcaauucuaggagacaccgcaugggacuucggaaguauuggaggaguuuuuacaucuguagguaagcuaguacaucaaauuuuuggcacagcuuacgguguacuguuuagcgguguuagcuggacuaugaaaauaggaauagguauucuuuuaacguggcuaggacuaaauaguagaucuacaaguuuaucaaugacauguauugcaguagggaugguuacucuuuaucuaggaguaauggugcaagcugacucagguugugucauuaauuggaagggaagggagcuaaaauguggaagcgguauuuucgugacaaacgagguacauaccuggacggaacaguauaaauuccaagcagauaguccaaaaagauuaucagcagcaauaggcaaggcuugggaagaggguguuugcgguaucagaagugcgacaagacuagaaaauauuauguggaaacaaauaucgaacgagcugaaccacauucuucuagaaaaugacaugaaauucacaguaguaguuggagaugcaaauggcauauuggcacaagguaagaagaugaucagaccacaaccgauggaacauaaguauucauggaaaucaugggguaaagcuaaaauaauaggugccgauauccaaaauacgacauuuauuauugacgguccggauacaccagaaugucccgacggucaaagggcauggaauauuugggagguagaggauuacggauucggggucuuuacgacuaacauauggcugaaguugcgagauucauauacucaaaugugcgaccauagguugaugucagccgcuauuaaggacagcaaggcaguccaugcggacaugggguacuggauugagagugaaaagaaugagacauggaaacuagcuagagcuagcuuuauugaaguaaaaacguguacguggccaaaaucgcauacauuauggaguaaugguguacucgaaucugagaugauaauuccaaagauauauggcgguccgauaagccagcauaauuacaggccgggcuauuuuacacagacagcagggccuuggcacuuagggaaguuagaacuugauuuugauuuaugcgagggaacaaccguuguaguggaugagcauugugggaaccguggaccgucuuuacgaacaacuaccguuacaggcaaaauaauacaugaauggugcuguagaucuugcacacucccuccucuucgguuucguggagaagaugguuguugguacggaauggaaauaagaccaguuaaggaaaaagaagaaaaucuuguacguaguaugguaucagcagggucaggagagguugauucauuuucauugggaauauuauguguaucuaucaugauugaagagguuaugaggagcagauggagccgaaagauguuaaugaccggaacacuugccguguuucuacuguuaauaaugggucaacucacauggaacgauuuaauuagacuuugcauaaugguuggcgccaaugcgucugauaggaugggaaugggaacaacguacuuggcucuaauggcuacuuuuaaaaugagaccuauguucgcaguagguuuacuauuucgacgacuaacuucaagagaagugcucuuauuaaccauuggccuaucucuaguagccucaguagaauugccaaacucgcuugaagaguugggggacggacuggcuaugggaauaaugauguuaaaacuguugacggaauuucaaccgcaccagcuauggaccacauugcuuucauuaaccuuuguaagaacaacauuaagucuagacuacgccuggaaaaccacagcaauggcauuaucaauugugucauuauucccacuaugucuaucaacaacaagucagaaaacgacuuggcuuccaguacuacugggaucauuuggcugcaaaccacugacgauguuuuugauuacggagaacaagauuuggggacgaaaaagcuggccucuaaacgaaggaauuauggcaauagggauagugagcauucuauuaagcucccuuuugaaaaaugauguuccgcuggcgggaccccuuauagcuggaggaaugcuuaucgcguguuauguuauaagugguucaucagcggaucuaagucuagaaaaagcagcagaagugaguugggagcaagaagcugagcauucaggagcuucacacaguauuuuaguagaagugcaagaugauggaacgaugaaaauaaaagaugaagagagggaugacacucuaacaauucuuuuaaaagcuacauugcuggcuguaagcgguguuuacccgaugaguauacccgccacacuuuucguuugguacuuuuggcaaaagaagaaacagagaucagggguuuuaugggauacaccgucuccgccagaaguagaacgagcagugcuagacaauggcauuuacaggauauuacaaagaggcuugcucggaagaagucaaguagguguaggaguuuuucaggacgguguauuucauacuauguggcaugucacccggggagcaguacucauguaucaagguaaacggcuggaacccucuugggccuccgucaagaaagauuugauaucguauggaggugguuggcgauuucaaggcagcuggaauacgggagaagaaguccaaguuauagcaguugaaccagggaaaaacccgaaaaacgugcaaacgacuccugguacauuuaaaacgccggaaggggaagucggagcgauugcuuuggauuuuaagccugguaccuccggcaguccaaucguaaauagagaggguaagauugucggccuauauggcaaugggguuguuacaacaucagguacauacgucucggcgauagcccaggcgaaagccucacaagaaggaccuuugccugaaauugaagaugaagucuuuaagaaacguaauuuaacuauaauggacuugcacccgggaucugguaaaacgagaagguaucucccagcaaucguacgagaagcgauuaaacggaagcuacggacacuuauauuagcgcccacucggguuguagcuucugaaauggcagaggcauuaaagggcaugccaauuagguaucaaacaacagcaguaaaguccgaacacacaggacgcgaaaucgucgaccugaugugccaugccaccuucacuaugcgacuacugagcccaguacguguacccaacuacaauaugauaauaauggaugaagcacauuucacagacccagccucaauugcagcccggggcuauauaaguacucgaguagggaugggagaggccgcagcaauauucaugacagccacuccacccgguucuguugaggcuuucccucagagcaaugccguuauucaagaugaagagagagacauaccugaaaggagcuggaacucgggauaugacuggauaaccgauuuuccuggaaaaacagugugguucguccccagcauuaagagcgggaaugauaucgcgaauugcuuaaggaaaaaugggaaaagaguaauccaguugucaaggaaaacauuugacacugaguaccaaaagacuaaaaauaaugauugggauuaugugguaacgacagacauauccgaaaugggcgcgaacuucagagcugauaggguaauugauccccgacgauguuuaaagccaguaauauuaaaggauggaccugagagaguaauacuugcuggaccaaugccaguaacggcagccucagcugcucaaagacguggaagaauugggagaaaccaaaacaaggagggagaucaguauguuuauaugggacaaccacucaauaacgaugaagaccaugcacauuggaccgaagcgaaaaugcuccuagauaauauaaauacuccugaaggcauaauaccagcguuauuugaaccagaaagagaaaaaucugccgccauugauggugaauaucguuuacguggugaagcacgaaaaaccuucguagaauuaaugagacguggagacuugccagugugguuaucguacaaaguugcgagcgaaggguuucaauacucagaucguagauggugcuucgacggggaaagaaauaaucagguacucgaagagaacauggacguggaaauauggacgaaagaaggugaacgcaagaaacuuagaccucgaugguuagaugcgagaacguacucagauccauuagccuuacgcgaauuuaaagaguucgcagccggcagaagaucaguuucuggcgacuugauacucgaaauagguaaauuaccccaacacuuaacccuaagagcacaaaaugcauuagauaaucuagucaugcuucacaacuccgaacaaggugguaaggcuuaccgccacgccauggaggaauuaccggacacuaucgagacacuuauguuauuagcccuuauagcuguccuuaccgguggaguaacguuauucuuucuaucaggcaaaggacuagggaaaacaaguauaggacucuugugugucacagcgagcucugcguuacuguggauggcuuccguagaaccacauuggaucgccgcaucaauuauacuagaguucuuucuaaugguuuuacuuauccccgagccugacagacaaaggacaccucaagauaaccagcuugccuacgugguuaucggauuacuauucaugauucuuacuguggccgcaaaugaaaugggucuauuggaaacaacuaagaaagauuugggaauuggcuacguagccgcagaaaaucaucaacaugcgacaaugcuggauguagacuugcacccggcuucagcauggacuuuauaugcaguugcgacuacaguuauaacgccaaugaugagacauaccauugagaauacaaccgcuaauauuucacuaaccgcgauagcuaaucaggcagcaauacuaaugggucuugacaaaggauggcccauuagcaagauggacauaggcguaccucugcucgcucuggguuguuauucacaagucaauccacugacauugacagcagcugucuuaaugcuuguagcacacuaugcuaucauaggccccgggcuccaagcgaaggcaacaagggaagcacaaaagaggacagcugcagggauaaugaaaaacccaacgguugauggaauuguagcaauagacuuagacccaguaguauacgaugccaaauucgaaaaacaacuuggacagaucauguuacucauccuauguacuucccagauucuacuaaugcgaacaacuugggcuuuaugugaaagcauaacuuuggcaacgggaccguugacaacacuaugggaagggagucccggaaaauucuggaauacaacaauagcgguuagcauggcgaacauauuccgcggaucauaucuagcuggugcaggacuagcuuucaguuugaugaaauccuuagguggaggacgucgaggaacuggagcucaaggagagacguuaggggagaaauggaagcggcaauuaaaccaacuaagcaaauccgaguucaacacuuauaaacgaucuggcauuauggaaguggaccgaucggaagcuaaagaagguuugaagcggggagagacgacaaaacacgccgucucaagaggaacggcuaaacuacgaugguucguggaacggaaucuuguaaagcccgaagguaaaguaauagauuuaggauguggucggggaggcugguccuauuacugugcaggccuaaagaaaguuacagaagucaaaggauauacuaagggcggcccaggucaugaagaaccgauuccaauggcuacauauggauggaaucuugugaaauuacauuccggcaaagaugucuucuuuaugccaccugagaaaugugauacuuuguugugcgacauaggugaaagcucuccaaauccgacgauagaagagggucgaacacuuagaguucuaaagaugguugagcccuggcugcgaggcaaucaauuuuguauaaagauucucaauccuuauaugccaagugucguagaaacccuagagagaaugcagcgaaaacauggugggaugcuuguacggaauccucugucccgaaauaguacacacgaaauguacuggguaaguuguggaacaggaaauaucgugucggcagucaauaugacuagcaggauguuauuaaacagguucacuauggcgcacagaaaaccgacauacgagagagacgucgauuuaggagcggguacucgccauguagcaguugagccugaggucgcaaaucucgauauaauuggacaaagaaucgaaaacauuaaaaaugaacacaaaagcacauggcauuaugaugaagauaauccauacaaaacgugggcuuaucacggaaguuaugagguaaaaccuucaggaucagcuucaucaaugguuaacgguguuguacgacuccuaaccaaaccaugggauguuauaccaaugguaacccagaucgcaaugaccgacacuacaccuuuuggccaacagaggguauuuaaagaaaaaguggauacuagaacaccaagggcaaaaagagguacaacccaaauaauggaaguaaccgcaaaauggcuuuggucguucuuaucaagaaauaagaaaccgagaauauguacaagagaagaguucacuagaaagguaagaucaaaugccgcaauaggagcgguauuuguagaugagaaucaauggaacucugcaaaagaggcaguagaggaugaaagauucugggaucuuguacacagagagagagaacuacauaaacagggaaaaugcgcaaccuguguauacaauaugaugggaaaacgagagaaaaagcuaggugaauuuggaaaagcaaaaggaagcagagcaauaugguauaugugguuaggagcacgauuccuagaauuugaagcguuaggcuuuaugaacgaagaccauugguuuagccgcgaaaauucccucucaggaguggagggagagggauuacauaagcuaggguacauuuugagagauauaagcaagauacccggaggaaacauguaugcugacgauacugcaggaugggacacacgaguaacugaagaugaccuucagaacgaagcuaagauaacagacauuauggagccggagcaugcauuauuggcgacaaguauauuuaaauuaacuuaccaaaacaagguggucagagugcagaggccagcgaagaacggcacgguaauggaugugauaucgagacgcgaucagaggggcucuggucaagugggcaccuacggccuaaacacuuucaccaacauggaagugcaauugauacgacaaauggagagcgaggguauauuucuucccucugaacuagagacuccaaaucucgcugaacgagccuuagacuggcuagaaaaacauggagcggagagauuaaagagaauggcaaucagcggugacgauugugucguaaagccaauugaugaucgauucgcuacagccuuaacagcuuuaaaugacaugggcaagguucgaaaggauaucccucagugggagcccucaaaaggguggaacgauuggcaacaaguaccuuuuuguucgcaucauuuucaucaauugauuaugaaggauggcagagaaaucguugugccuugcagaaaucaagacgaacuuguuggacgagcacgcguaagucaaggcgcaggcuggagucuuagggaaaccgccugcuuagggaaaaguuacgcucaaauguggcaauuaauguauuuccaucggagagacuuacgauuagcugcaaaugcaauuugcucagcaguaccaguagauuggguccccacgucaagaacuacuuggagcauacaugcacaucaccaauggaugacuacggaagauaugcuauccguauggaauagaguguggauagaggaaaaccccuggauggagaauaagacccacguaagcaguugggaagaaguaccuuaccuaggaaaaagggaagaucaauggugcgggaguuuaauaggauuaaccgcacgugcaacgugggcgaccaauauacaaguggcgauuaaccaaguuaggagacuaauaggaaaugaaaacuaucuugacuacaugacaucaaugaagagauuuaaaaaugaaucugacucagaaggagcccugugguaa

SEQ ID NO: 21362 - RNA, 9879 nt, Artificial Sequence
  derived and/or modified CDS sequence (opt6) from DENV-1__KJ189365__SS-prME
agugugacuauguuguuaaugcuacuaccuacugcacuugcguuucaucuuacaacacguggaggggaaccacauaugauuguaaguaaacaagaacgagguaaaaguuuauuauuuaaaacuuccgcgggggucaauauguguacgcuuauagcaauggaucuaggagagcucugugaagacacgaugacauacaaauguccuaggauaaccgaagcagaaccagaugauguagauugcuggugcaacgcaaccgacacguggguaacauacggaacguguagccaaaccggcgaacauagacgagagaaacgaucaguugcacuagcaccacauguaggcuuagguuuggagacacguacggaaacuuggaugucgagugaaggugcauggaaacaaauccaaagaguggaaaccugggcguugcgacaucccgguuuuacagugaucgcauucuuuuuagcgcaugcaauuggaaccagcaucacgcaaaaaggaauuauuuuuauuuuauugauguuagugacuccaagcauggccaugcgaugcguugggaucggcaauagggauuucguagaagggcuuagcggagccaccuggguggacgucgucuuggaacacgguagcugugugacgacuauggcgaaaaauaaacccacacuggacauugaauuguuaaaaaccgagguuacaaauccggcugucuugcgaaaauuauguauagaagcgaaaauaagcaauacaacaaccgauucgagauguccgacccagggagaagcaaccuuaguagaagaacaagaugcgaauuuugucugucgaagaacuuuuguagacagagguugggguaauggauguggucucuuugggaaagguucucuacuuacgugugccaaauucaaaugcgucacuaaacucgaggggaaaauaguccaauaugaaaacuuaaaauauaguguuauugucacaguucauacaggcgaucaacaccaagugggcaaugaaacaacagaacauggcacaauagccaccaucacgccgcaagccccaacaagugagauccaguuaaccgauuauggagcgcuuacauuagauugcucaccacgaacuggacucgauuuuaaugaaaugguucuacuaacgaugaaagagaaaagcugguuaguacacaaacagugguuucuugauuuaccacuuccauggacuucaggagcuaguacuucccaggaaacuuggaaucgacaagauuuguugguuaccuucaaaacagcacacgccaagaaacaagaaguaguaguucucgggucacaggaaggugcuaugcauacugcucuaacaggcgcuacagaaauacaaacaaguggaacuacaaccauauucgcugggcacuugaaaugucgguuaaaaauggauaaauuaacguugaaaggcaugaguuaugugaugugcacggguaguuuuaaacuugagaaagaaguagcugaaacacaacacggaacaguacucguucagguaaaauacgaaggaacagaugcucccugcaaaauuccauucaguacucaagacgaaaaagggguaacucaaaauggacgucuuauuacugcaaauccaauagucacagauaaagaaaaaccaguaaacaucgaaaccgaaccaccguucggagaaucguauauaguagucggcgccggugaaaaagcucugaaauuaagcugguucaaaagagguaguucaaucggcaaaauguucgaagcuaccgcacgcggagcccgaagaauggcuauacuaggugacacagcaugggauuuuggaaguauagggggaguguucaccaguguugguaaauuggugcaucaaauauucgggacagccuauggaguauuauuuuccggugucucuuggacaaugaaaaucggaauugguauacuauugaccugguugggauuaaauucacgaucaaccucauugucgaugacauguauuguugucggaaugguaacgcuauaucuaggagucauggugcaagcggauucuggcugcguaauaaauuggaaaggucgugaacugaaaugugggaguggaauuuuugugacuaacgaggugcauacguggacggaacaauacaaguuccaagcagauuccccuaaaagacugagugccgccauugggaaagccugggaggagggaguuuguggcauucggucugcuacccgauuagaaaauauaauguggaagcagauuagcaacgaauuaaaucauauucuacuagaaaacgacaugaaguuuacggucguugugggcgacgcaaacgguauucuugcucaaggaaagaagaugaucagaccccaacccauggagcauaaauauucguggaaaucauggggaaaagcaaagauaauuggagcugauauacagaauacuacuuuuauaaucgauggacccgauacuccugagugcccagauggucaaagagcauggaacauaugggaaguagaagacuauggcuuugggguauuuaccacuaauauaugguuaaaacuuagagacuccuauacacaaaugugcgaucaccggcuaaugucugcagccaucaaagauuccaaagcgguacaugcugacaugggguauuggauagaaucagagaaaaacgaaacauggaaauuagcuagggccagcuuuauugagguuaagacaugcacguggcccaagucucauacacuauggucaaauggcguucuagaaucugaaaugaucauaccaaagauauacggugguccgaucucucaacauaacuauagaccuggauauuuuacucagacagcggguccuuggcaucuaggaaaauuagaauuagacuucgaccuaugugaaggaaccacaguagugguugaugaacauuguggaaacagagggccaucacugagaaccacaacggugacaggaaaaauaauacacgaaugguguuguagaaguuguacacuuccaccucuaagauucagaggagaagaugguugcugguauggaauggaaauccggcccguaaaagaaaaagaggagaauuuaguaagaaguauggucagugccgguucaggugaggucgacucguuuucuuugggcauacuuugcgucaguaucaugauugaagaagugaugcgaagcagauggucucggaagauguuaaugacggguacauuagcgguauuuuuauuguuaauaauggggcaacuaacauggaacgaucugauuagauuaugcauaauggugggugcaaaugcaucggacagaaugggaaugggcaccacguaccucgcauuaauggcgaccuuuaaaaugaggccaauguuugcgguagggcuauuauuucguagauuaacauccagagaagugcuacuauugacgauaggucucucuuuaguagcgagcguagaguuaccaaauucacuugaagaauugggugacggccucgcgaugggaauuaugaugcuaaaacuccuuaccgaguuccaaccucaucaauuguggacuacucuauugucgcuuacauuugugaaaacaaccuuaagccuagauuaugcauggaaaacaacagcuauggcccugagcaucguuucuuuauuuccguuguguuugaguacuacaucccagaaaacuacaugguugccaguguuauuaggaaguuuuggguguaaaccacuuacaauguuucucauuacagaaaacaagauuuggggaagaaaaucuuggccucucaaugaagguauaauggcaauagggauuguuuccauauuacugagcucauuauuaaagaaugaugucccuuuagcagggccccucauugccggggguaugcugauugcguguuauguuauuuccgggucaucugcugauuuauccuuagaaaaagcugcggaagugucaugggaacaagaagcagaacacucaggagccagucacaguauccuaguggagguacaagaugacggaaccaugaaaauaaaagaugaagaaagagaugauacccugacaaucuuauuaaaagcaacuuuacuagcagugucaggaguuuauccuaugucuaucccggcaacgcucuuuguaugguauuuuuggcagaagaagaaacaaagaucagguguacucugggauacccccucacccccugaaguugagagggccguguuggauaauggaaucuaucggaucuuacaacgcgggcuacucggaagaucacaaguaggaguggguguauuucaagacggagucuuucacacuauguggcaugugacaagaggagcuguauuaauguaccaaggaaagcgauuagagccaagcugggcaucagugaagaaagacuuaauaagcuauggcggagguuggagauuccaaggaucauggaauacaggagaagagguacagguaaucgcaguugaaccgggaaagaaccccaaaaauguacaaacaacuccaggaacuuuuaagaccccagagggagaaguaggcgcaauugcgcuagauuuuaagccggggacaagugguucaccaauagugaauagggaagguaaaauaguaggacuuuaugggaauggugucgugaccacaagcgguacuuauguaucggcaaucgcucaagcuaaagccagccaagagggaccacucccagagauugaggaugaaguguucaagaaaaggaacuuaacuaucauggaccuacacccaggaucaggcaaaacgcgcagauauuugcccgcaauagucagagaagcuauuaaacgaaaacucagaacccucauuuuggccccaacaagagugguagcgagcgaaauggcagaggcuuugaaggggaugcccauacgauaucaaacaacugcgguaaaaucagaacauacugggcgugaaaucguagacuuaaugugccaugcuacauuuacaaugagauuacucucuccaguacggguuccaaacuauaauaugauaauaauggaugaggcgcacuuuacagaucccgcgucaauugcagcucgggguuauauaaguacccgaguaggaaugggagaagcagcugcaauauucaugacggcaacgccaccugggagcguagaggcuuuuccucaaaguaacgccgucauacaggaugaagaacgagauauaccugaaagaaguuggaacaguggauaugauuggauaacugauuucccuggaaagacuguuugguuuguacccucgauuaagucugguaacgacauugccaauugccuaagaaagaauggaaagagagucauccaacucucaagaaaaacauuugauacggaguaccagaaaacuaaaaauaaugauugggauuaugucguuacgacugauauaucagaaaugggagccaauuuucgcgcagacaggguuauagacccgaggcgauguuuaaagccaguaauuuuaaaagacggaccagaacguguaaucuuagcagggccuaugcccguaacagcugccuccgcugcccagaggagagguagaaucggccgaaaccaaaacaaggaaggagaccaauacguauacaugggacagcccuugaauaaugaugaggaucacgcucauuggacagaagcuaaaaugcucuuagacaauauaaacacaccagaaggcaucauacccgcguuauuugaaccugaacgagaaaagucagcugcaauugacggugaguaccgucuacgcggugaagcccguaagacauuuguugaacuuaugcgacgcggagaccuaccaguauggcugucguauaagguggcaagugaaggauuucaauacagugauaggagguggugcuuugauggagagagaaacaaucaagugcuugaagaaaauauggauguggaaauuuggacaaaagaaggcgagcgcaagaaacuuagaccaagaugguuagacgcucgcaccuauucagacccauuggccuuacgugaauuuaaggaguucgcugccggucgacggaguguaucaggcgaucuaauccuagaaauugggaaacuaccccaacaucuaacucuaagagcgcaaaaugcauuggauaaccuagugauguuacacaauagugaacagggugguaaggcauauaggcaugcaauggaagaauuaccggacacaauugaaacacugaugcuccucgcauuaauagcaguacugacagguggagucacacuauuuuuccuaucaggcaaaggacuuggaaaaaccuccauaggcuugcugugcgucacugcaaguagugcccuauuauggauggcuagugucgaaccucauuggauagcagcaagcauuauauuggaauuuuuccucaugguauuacucauaccagagcccgacaggcaacggacaccccaagauaaucaauuagcauacgugguuauaggauuacuauucaugauacuaacagucgcggcaaaugagaugggauuguuggagacaacuaagaaagauuugggaaucggcuacguagcggcugaaaaccaucaacacgccacuauguuagauguugauuuacauccugcauccgcuuggacguuauacgcaguagcuacuacaguuaucacaccgaugaugcggcauacgaucgaaaauaccacggcuaauaucucauuaacugcgaucgcuaaucaggccgcuauuuuaaugggauuggacaaggguuggccaauaaguaaaauggacauuggcguaccacuacuggcacuuggguguuauucacaagucaacccacuaacucuuacggcggcuguuuuaauguuaguagcacauuacgcaauaaucggucccgguuuacaagcaaaagcaacccgugaagcacaaaaacggacugcagcgggcauuaugaagaacccuacaguugaugggauaguagccauagaucuagaucccguuguguacgaugcaaaauuugaaaagcaacucggccaaaucaugcuauugauuuuaugcacuucgcagauuuuacuaaugcgcacuacuugggcguuaugcgaaucuaucacucuagcuacuggaccacuaacuacucugugggaaggaaguccaggaaaauucuggaauaccacgauagcuguuucgauggccaauauauuuagaggaagcuaccuugcgggggcaggguuagcauucucccuaaugaaaucacuaggaggcggaagaagaggaacaggcgcccagggugaaaccuugggcgaaaaauggaaacgacaauugaaucaauuaaguaaaucagaauuuaacacguacaagcggucaggaauuauggaaguugacagauccgaagccaaagaaggucucaagcgaggagaaacuaccaagcacgcuguaucucguggaacagcuaaauuacgaugguucguggaacguaacuuagugaaaccugaaggaaaagugauagauuugggcugugguaggggcggauggucauacuacugcgcaggacuaaagaaaguuacagaagucaagggauacacuaaaggcggaccaggucaugaagaacccauuccaauggcaacuuaugguuggaaucuuguuaaacugcauuccggcaaagauguauucuuuaugccaccagaaaaaugugauacacuucuaugugauauaggugagucaucuccuaaccccacaauagaagaggguagaacuuugagaguuuuaaagaugguagaaccaugguuaagaggaaaccaauuuuguauuaaaauucugaacccauauaugccaagcgucguagaaacccuugaaagaaugcaaagaaaacauggaggcaugcuuguucgaaacccuuuaucuaggaauagcacacaugagauguauuggguaucguguggaacaggaaacaucguauccgcgguuaauaugacgucgcguaugcuacugaauagauuuacgauggcgcauagaaaacccacuuacgagagagauguugaucuuggugcuggaacucgacauguagcaguggagccugaaguagcuaauuuagauaucauaggucaaagaaucgagaacauuaaaaacgagcauaaaucaacauggcacuaugacgaagauaacccuuauaaaacaugggcauaccacgguagcuaugaaguaaaaccaagcggaagcgcaagcucuauggugaauggcguuguccgucuucuaacuaagccgugggacguaauaccaauggucacgcagauugcuaugaccgacaccacgccauucgggcaacaacgaguauucaaggaaaaaguugauacaagaacgccaagagcuaaaaggggcacgacgcaaauaauggaagugacugcuaaaugguuauggggcuuuuuaucuagaaacaagaagcccagaauuugcacaagagaagaguuuacgagaaagguacgaucgaacgccgcaauaggggcugucuucguugacgaaaaccaauggaacagugcuaaagaagcuguugaagaugagagauuuugggauuuaguacaucgagaaagagaacugcauaaacaagguaaaugugcgaccugcgucuauaauaugauggggaaaagagaaaagaaacugggugaguucggaaaagcaaaagguucgcgagcuaucugguacauguggcucggagcaagauuuuuggaauuugaagcacuuggauuuaugaacgaagaucauugguucucucgugaaaauucacuuucggguguugaaggcgaaggauugcauaaauuaggcuacauauuacgugacaucaguaaaauccccggagggaauauguaugcagaugacacugcuggaugggacacacgaguuacagaagacgacuuacagaaugaagccaaaauuacggacaucauggaaccagaacacgccuuacuagcgacaagcauauucaaauugaccuaccaaaacaagguaguccguguacaaaggccagccaaaaaugggaccguaauggacguuaucucgagaagagaucagagagguucuggucaagugggaacuuauggucuaaacaccuuuaccaacauggagguucaacuuauuagacagauggaaucggaaggaaucuuucuaccgagcgagcuugaaacuccuaauuuagcagagcgagcguuggauuggcuagagaagcacggugcugagagacuuaaaagaauggccaucagcggagaugauuguguugucaaaccuauugacgauagauuugccacagcacugacagcuuugaacgacauggggaagguaagaaaagacauuccccaaugggaacccucuaagggguggaaugauuggcagcaagucccauucugcagucaucauuuucaucaacuaauuaugaaagauggaagagagauaguugucccuugcagaaaucaggacgaauuggugggacgagcgaggguaagccaaggggcaggguggucucucagggaaaccgcaugucuaggcaaaagcuaugcacaaauguggcaauuaauguacuuucacagaagagaccugcgacuagcugccaacgcaaucuguagcgcaguuccuguagauuggguaccgaccaguagaaccaccuggucuauucaugcacaucaucaauggaugacaacugaagauauguuaucuguauggaaucggguauggauugaugagaauccauggauggaaaauaagacacauguuucauccugggaggagguaccauauuuaggaaaaagagaagaccaaugguguggaagccuaauaggcuuaacugcgagagcgacaugggcaacuaacauacaaguugcaauaaaccagguuagaagauuaauagguaaugagaauuauuuagauuauaugacuucaaugaaaagauuuaaaaaugaaucagauagugaaggggcacucugguag

SEQ ID NO: 21363 - RNA, 9879 nt, Artificial Sequence
  derived and/or modified CDS sequence (opt6) from DENV-1__KJ189366__SS-prME
agugucacuauguuguugaugcuguugcccaccgcuuuagcauuucacuuaacaacuaggggcggcgaaccccauaugaucguuuccaaacaagaaagagguaagagcuugcuauuuaaaacaagcgccggcguaaauaugugcacacuuauagccauggaccugggugaauugugcgaagauacuaugacguauaaaugcccacgcauugcagaagcugaaccagaugacguagacuguugguguaacgcaacagacacuuggguaacuuaugguaccugcagccaaacgggugagcaucgacgagaaaaacgaagugucgcuuuagcaccacacguuggguuaggucuggaaacaagaacagaaacauggaugaguucggaaggcgccuggaagcaaauacaaagaguagaaacuugggccuuacgccauccuggauucacaguaauagcauuuuuccuggcccacgcaauaggaacauccauaacacaaaaaggaauaauuuuuaucuuacucauguuaguaaccccaaguauggccaugcgauguguaggaauaggaaacagagauuuuguagaaggacuuagcggagcaacguggguugacguaguuuuagaacauggaaguugugucacuaccauggccaaaaauaaaccaacacucgauauagaacuccuuaaaacagaaguuaccaauccagccgucuuacgaaaacuuuguauugaagcaaaaauaagcaauaccacuacagacagucgauguccaacacaaggggaagcaacuuuaguagaagaacaagaugcaaacuuugucuguagaagaacauucguugaccgcggguggggcaacgguuguggauuauucggcaagggcucccugcuaacuugugccaaauucaaaugcgugacuaaauuagaagguaagauuguucaauacgaaaauuugaaauauagugugauuguaacaguacauacuggagaucaacaccaaguaggaaaugaaacgacagagcacgggacuaucgcaacaauaacaccacaagcuccaacaagugaaauccaauuaacagauuauggcgcauugacucuagacugcaguccgcgcacagggcuagacuuuaacgaaauggucuuacucacuaugaaagaaaaaucguggcuaguucacaaacagugguuucuagaucuaccacuaccauggacgaguggggcaaguacaagucaagaaacuuggaaccggcaggauuuauuaguaacguuuaaaacagcccaugcaaagaaacaggaaguugugguucuagggagccaagaaggagcaaugcauacggcucucaccggugcuacggaaauccaaacaagugguacuacaacaaucuuugcuggacacuuaaaaugucgacuuaaaauggauaaacuaacacucaagggcaugucauauguuaugugcacggguagcuuuaaacuagaaaaagaaguagcugaaacucaacacgggacgguccuaguucaaguaaaauaugaggggacagaugcuccgugcaagaucccauucucaacacaagaugaaaaaggagugacacaaaauggaaggcugauaaccgccaacccaauagugaccgacaaagaaaaaccgguaaauauagagacggagccgccauuuggcgaaucauauauuguaguaggcgccggcgaaaaggcauuaaaacuuucaugguuuaaaagaggaucaucaauagguaaaauguuugaagccacagcacgaggggcacgaaggauggcuauucucggagauacagcaugggauuucgggagcauugguggagucuuuacauccguugguaagcuaguacaccaaauauuugggaccgcguaugggguacuauucucaggaguaagcuggacgaugaaaauaggaaucgguauacucuuaacgugguuaggacuuaacaguagaagcacaagucucaguaugacuuguauagcaguugggaugguaacacuuuaccuaggcguaaugguucaggccgauuccgggugugugaucaacuggaaaggaagagaguugaaguguggaucuggaauauucguaaccaaugagguucacacauggacggagcaauauaaauuccaagcagauucucccaaacgucuauccgccgcuauagggaaagccugggaagagggugugugcgguauccgaagugcuacaagauuggaaaacauuauguggaaacaaauauccaaugaauugaaccacauuuugcuugagaacgacaugaaauucacggugguuguaggagaugcaaacggaauauuggcacagggaaagaaaaugaucaggccacaaccaauggaacauaaauacucauggaaaucauggggaaaagcaaaaaucaucggggcagauauacaaaauacaacuuuuauaauugaugguccugauacaccugaauguccggauggucaaagagcuuggaacauuugggaaguggaggauuauggauuuggagucuuuacuacgaacaucugguuaaaacuccgugauucuuauacccaaaugugcgaccacagacugaugucagcugcaauuaaagacucgaaggccguccaugcugauaugggauauuggauagaaagcgagaaaaaugaaacauggaaauuagcucgugccaguuucauagaaguaaaaacaugcacauggccuaagucucauacacuuuggaguaauggcguguuagaaucagagaugauuauaccaaagauuuacggaggcccuauaucacagcauaacuauagaccagguuacuuuacgcaaacagcggggccuuggcauuuagguaagcuagaacuugauuuugaucugugugaagggacuaccgucguggucgaugagcauugcggaaacagagguccaagucuaaggacaacaaccguuacuggaaaaaucauacacgaaugguguuguagauccuguacucuaccuccccucagauucagaggggaagaugguuguugguacggaauggaaauuagaccugucaaggaaaaagaggaaaaccuuguaagaucaaugguaucggcagguucgggugagguggacaguuucucguuggggauauugugcgucucgaucaugauagaggaagugaugaggagucgcuggucacguaagaugcuuaugacaggaacacuggcaguauuucuccuuuuaaucaugggacaacugaccuggaaugacuuaauuagacuauguauuauggugggagccaacgccucugaccgaaugggaauggggacaacauaccuugcacuuauggcaacuuuuaaaaugagacccauguucgcuguuggacuuuuauuuagaagacuaacaaguagggaaguccuucucuugacuaucggacuaagccuagucgcgucaguugaauuaccuaauagcuuggaagaauuaggagauggguuagcuauggguaucaugaugcucaaacuuuuaaccgaguuucaaccacaucaacuguggacuacauugcucagcuuaacauucgucaagacaacguuaucccuagauuaugcauggaagacaacugcgauggcacuuucaaucguuucucuauuuccauuguguuuaaguacaacuucgcagaaaacaaccugguuaccagugcuguuagggaguuuugggugcaaaccgcucacgauguucuuaauaacggagaacaaaauuugggggagaaagucuuggccauugaacgagggaauaauggcaauagguauaguaucaauauuauuaagcucuuuauugaaaaaugacgucccucuagcuggcccgcuaauagcaggaggcauguugauagcuuguuacguaauauccgggucuucugcugaucuaucguuagaaaaggcagcagagguaagcugggagcaagaagccgaacacucuggcgcuucucacaguauuuuaguugaaguacaggaugacggaacaaugaagauuaaagacgaagaacgugaugauaccuuaacaauucuguugaaagcuacuuuauuagcuguaagcggaguauauccuaugucuauuccagcaacguuauuuguuugguacuucuggcagaaaaagaaacaaagaaguggcguucugugggauacaccaucuccuccagaagucgaaagagcaguacuagacaauggcauuuaucgaauauuacaaaggggauuacugggacguagucaaguaggaguaggaguguuucaggacggagucuuucauacgauguggcaugugaccaggggagcuguguuaauguaucaggguaaaagauuagaaccgucuugggcaaguguuaaaaaggaucuaauuucauacgggggcggauggagauuucagggaucauggaauacaggugaagagguccaggugauagccguggagccagggaagaacccuaaaaauguacagacuacacccgggacauucaagacaccagaaggagaaguaggggcgauagcacuagauuuuaaacccggcacuucagguagcccaauagugaaucgggaggggaaaauuguaggauuguaugggaacggagucgugacuacaaguggaacuuauguaucagcaaucgcgcaagccaaagcaucacaggaggguccgcuuccagaaaucgaggaugaagucuucaagaaacgcaauuuaaccaucauggaucuacacccaggaucggggaaaacacguagguaucugcccgcaauaguucgagaagcgaucaaaaggaaauuaagaacauuaauucucgccccaacgagagugguggcuagugaaauggccgaggcuuugaaaggaaugccgauucgguaccagacuaccgcgguaaaaucagaacauaccggcagagaaauaguugauuugaugugucaugcuacauucacaaugagauuacuauccccgguacgcguucccaauuauaauaugaucauaauggaugaggcacacuucacugaucccgcgucaauagcggcaagaggauauauaagcacuaggguagguaugggggaagccgccgcuauuuucaugacugcaaccccuccaggaucaguugaagcauucccacaaaguaaugcagucauacaagaugaagagagagacauaccagagagauccuggaauagcggauaugacuggauaacagauuuucccggcaagacagucugguuugucccuagcauuaaaaguggcaaugauauugcuaacugucugaggaagaauggaaagagaguaauucaauuaucgagaaaaacuuuugacacagaguaccagaaaacgaagaauagcgacugggauuauguaguaacuacagauauuucugaaaugggcgccaacuuccgagcugaccgugugauagacccucgucguugcuuaaaaccugugauauuaaaagacggaccagagagaguuauucuggcuggacccaugccaguaacagcugcauccgcggcacaaaggagagggagaauaggaagaaaucaaaauaaggaaggugaucaauaugucuacauggggcagccgcuaaauaaugacgaggaccacgcacauuggacagaagcuaaaaugcuucuugauaauauaaauacgccagaaggcaucauuccugccuuauuugaaccagaaagggaaaaaucagccgcuauagauggagaauauaggcuaagaggcgaggcgcgaaaaacauucguagaguuaaugcggaggggugaucuaccggugugguuaucuuacaaaguagcaucagaaggcuuucaauacucggaucgaagauggugcuuugacggugagcguaauaaucaaguguuggaggagaauauggacguugaaauauggacaaaagagggcgaaagaaagaaacuuaggccgaggugguuagacgcuagaacuuauucagauccgcuagccuuacgagaguuuaaagaauuugcggcaggaaggcgcaguguaucgggugaccuuauuuuggaaauaggaaaauuaccucaacacuuaacauuaagagcucaaaaugcgcuagacaaccuaguaaugcuccauaacagugaacaaggggguaaggcauaucgacacgccauggaagaauuacccgauacaauagaaaccuuaauguuauuggcacuuauugcagugcucacaggcggaguaacccuauuuuucuuaucgggcaaaggcuuagguaagacauccauuggccuacucugcguaacagcaaguagcgcucucuuauggauggcaucugucgagccucauuggauagcagcgucaauuauacucgaauuuuuccuuaugguauuacugauuccugagccagacagacaacggacaccacaggauaaucaguuggcguauguaguaauaggcuuacuauucaugauauugaccguugcagccaaugaaaugggacucuuagaaacgacaaagaaagauuuggggauugguuacguugcugccgagaaucaucaacaugucacgaugcuggauguugaucuacacccagcuagugccuggacacucuaugcuguugccacgacaguuauaacuccaaugaugcgacauacaauagaaaaugcuacggcaaauaucucuuuaacagcaauagcgaaccaagcagcgauacuaauggguuuagauaaaggauggccuauaagcaaaauggacaucggcgucccccuauuagcccuuggcugcuacucucaaguuaauccguuaacauugacugcugcuguauuaauguuaguagcacauuaugcgaucauuggaccggguuuacaggcgaaggcaacaagggaagcgcagaaaaggacagcugcgggcauaaugaaaaauccuacggucgacgggauagucgcaaucgauuuagauccugucguuuacgaugcgaaguucgagaagcagcugggacaaauaaugcugcuaauauugugcacaagucagauccuuuuaaugcgaacuacuugggcacugugugaaaguauaacacuagcgaccggaccacuaacaacacuaugggaaggcaguccaggaaaauuuuggaauacaacaauagccgucucaauggccaacaucuuuagaggcaguuacuuggcuggagccgggcuugcauucucauuaaugaagucacuagguggcggucgaagaggcacuggagcacaaggagaaacacuuggggagaaguggaagcgccaauuaaaccaacuaagcaagucagaauuuaauacauauaagagaucaggaaucauggagguagauagaucugaagccaaagaggggcucaagcgaggggaaacaacaaagcaugcgguaagcagaggaacagcaaaacucagaugguucgucgagcgaaaucuagugaaaccagaaggaaaggugauugauuuggguuguggaaggggcgguuggagcuauuauugugcgggauuaaagaaaguuaccgaagucaagggcuauaccaaaggcgguccgggucaugaggaaccaaucccaauggcuacuuacggauggaacuuaguaaaacuacacaguggcaaagauguauucuuuaugccaccugaaaagugugauacauuguuaugcgauauaggcgaaucaagcccgaaccccacaguugaggaggguagaacguuaagaguguuaaagauggucgaaccaugguuacgagguaaucaguuuuguauaaaaauccugaacccauacaugccaucaguaguggagacuuuagaaagaaugcagcgaaaacauggagggauguuagugagaaacccgcuuaguagaaacagcacccacgaaauguauugggugaguugcggaacuggaaauauugucucugcugucaauaugacgucacggauguuauuaaauagauuuacaauggcacauaggaaaccaacuuaugaaagagauguagaccuuggugcaggaacacgacauguugccguagaaccugaagucgcgaaucuagauauuauuggacaacggauagaaaauaucaaaaacgaacacaaaucaaccuggcacuaugaugaggacaaucccuacaagacaugggccuaccacgguaguuacgaagugaagccaucagguagugcaaguuccauggugaauggaguagugaggcuguuaaccaaaccaugggauguaauaccuauggugacucaaauagcaaugaccgacacgacaccauucgggcagcaaagaguauuuaaagagaaaguggauacaagaacgccuagggccaaaagaggcacuacgcaaauaauggaaguuaccgccaaaugguuguggggguucuuaagucgaaauaagaaaccaagaauauguacaagggaggaauuuacacguaaaguaagaagcaaugcagccgucggagcaguuuucguugacgaaaaccaauggaacuccgcaaaagaggcaguagaggaugaacgauucugggacuugguacaccgagaaagggaacuucacaaacaagguaagugcgcuacguguguauauaauaugauggguaagagagagaagaagcugggagaguucggaaaagcuaagggaagucgagccauaugguacauguggcuaggcgcacguuuccuagaauuugaggcuuuaggguuuaugaaugaggaccacugguuuagcagggaaaacaguuuguccggcguggagggagaagguuuacauaaacuugguuauauucugagggauauaagcaaaauaccuggagggaacauguaugcagaugauacagcagguugggacaccagaguaaccgaagacgaucuacaaaaugaagcaaaaauuacugacauuauggaaccugagcaugcucuuuuagcuacuuccauauuuaaacuaacuuaucaaaauaaaguuguaagaguucaacgaccagcuaagaacggcacuguuauggacguaauaucuagaagggaucaaagaggaagcggacaaguaggaaccuauggacucaacacauuuacuaauauggaaguacagcugauccgacagauggaaucugagggaauuuucuuacccucggagcuagaaacaccaaaccuagcagaacgagcacuggauuggcuagagaaacauggagcggaaagauugaagagaauggccauaagcggagaugauuguguaguaaaaccaauagacgaucgcuucgcuaccgcacuaacggcucuuaaugacauggggaagguaagaaaagacauuccacaaugggaaccauccaaaggauggaacgauuggcaacaggugccauuuuguucucaccauuuucaucaacugauuaugaaagaugggagggagaucguuguuccuuguagaaaccaagaugaacucgucgguagagcaagaguaagucaaggagccggauggucuuuaagggaaacagcgugccugggaaagucguaugcgcaaauguggcaacuaauguacuuucacagaagggaucuuaggcuagcagcuaaugcaauuuguucggcuguaccaguugauuggguucccacgucacgaacuacguggucaauccacgcacaucaccaauggaugacgaccgaagacaugcucaguguuuggaauaggguguggauagaagaaaaccccuggauggaaaauaaaacucaugugagcucaugggaagagguuccauaucuuggcaaacgugaagaucaguggugugguucauuaauaggccuuacugcuagagcgacuugggcaacgaacauccagguugcaauuaaucagguaagacgauuaauaggaaaugaaaauuaccuagauuauaugacaaguaugaaaagauuuaaaaacgaaucagacucagagggugcauuaugguag

SEQ ID NO: 21364 - RNA, 9879 nt, Artificial Sequence
  derived and/or modified CDS sequence (opt6) from DENV-1__JN819417__SS-prME
ucugugacaaugcuucucauguuacuaccgacggcucuggcauuccauuugaccacucgaggaggggaaccucacauggugguuuccaaacaagaaagaggaaagagcuuacuuuuuaaaacuucagcugguguaaauauguguacccuuauugcaauggaccugggagaauuaugcgaagacacaaugacuuauaaauguccaagaauuacagaagcagaaccugaugauguagauugcugguguaaugcaaccgacacuuggguuacauauggaacaugcagucaaaccggagagcaccgccgugauaaacgaagcguggcgcuagcaccacaugucgguuuaggguuagaaacacgaacugaaaccuggaugaguucagaaggagcauggaaacaaauacaaaaaguagaaacuugggcuuuaagacauccugguuucaccguaauagcacuuuuucucgcgcacgcuauaggaacuucaauaacccaaaaaggcauaauauucauuuuguuaauguugguuacaccaucgauggcaaugcgaugugucgguauaggcaaccgagacuuuguagaaggccuuucgggagcaacuuggguggauguuguccuugaacauggauccugugugacaacaauggccaaaaauaaaccaacacuagauauagaauuauuaaaaacagaggugacaaaucccgcuauacuuagaaaacuuuguauugaagccaaaauaucuaauacaacgacggacucaagauguccgacacaaggagaggcuacuuuagucgaggaacaagacgcaaacuucgugugcaggagaacauuuguggacaggggauggggaaacggauguggacuguuuggaaaaggaucucuacuuaccugugcuaaauuuaaaugcgucacgaaauuagaaggaaaaauuguccaacacgaaaaccuaaaauacaguguuauuguuacuguacauacaggcgaucaacaucaagucggaaacgaaacaacggaacaugguacuauugcuacgauaacuccacaagcgccuacaagugagauucaacuuacagauuauggggccuuaacauuagauugcagcccacgaaccggauuggacuuuaacgaaauggucuugcuaaccaugaaagagaaaagcugguuagugcacaaacaaugguucuuggauuuaccacugcccuggaccagcggagcaucgaccucccaugaaacauggaaccgccaagauuuacucguuaccuuuaaaaccgcucaugccaagaaacaggaagugguuguacuuggaucccaagaaggggcgaugcacacagcccuuacgggugcaacagagauacagacuucaggaaccaccacuauauuugcggggcauuugaaaugcagguuaaaaauggauaaacuaacucuuaagggcaugaguuacgucauguguacaggaucauucaagcucgaaaaagaaguugcugaaacucaacacggcacuguauugguucaaguaaaauacgaagguacggacgcgccaugcaagauuccuuuuagcacccaagacgaaaagggggugacacagaaugguagauuaauaacagcgaauccuauaguaacugauaaagaaaaaccggugaacauagaaacugaaccacccuucggagaaucuuacauuguaguuggagccggagagaaagcucuuaagcuaagcugguucaaaaagggaucaucaauagguaaaauguucgaagcuacugcaagaggggcuagaagaauggcuauccucggggauaccgccugggauuucgguagcauugguggcguauucacaaguguaggcaaguuaguucaccaaguauucggcacagcauauggaguccuguucucaggcguuaguuggacaaugaaaauuggaauaggaauauuacuaaccuggcucggauuaaacucuagaaguaccuccuuaucuaugacauguauagcaguagggaugguaacucuuuaucuaggagucaugguacaagcagacucagguugcguuauaaacuggaagggaagagaauuaaaauguggaaguggcauauuugucaccaaugagguucacacauggacugaacaauacaaguuucaggcagauucaccuaaaagacugucugcggcuauagguaaagcgugggaagaaggcguguguggcauuagaagugcuacucgcuuagaaaauauuauguggaagcagauuagcaaugagcuuaaucauauacuccuagaaaaugauaugaaguucacaguaguuguaggagacgcuucaggaauuuuagcucaagggaagaaaaugauaagaccacaaccuauggagcacaaauacagcuggaaaucaugggggaaagcuaagaucauaggcgccgauacccaaaauacgacauuuauuauugacggucccgacacaccagaaugcccagaugaccaaagagcauggaauauaugggaaguugaagauuacgguuuuggaauauuuacaaccaacauauggcuaaaauuacgcgacaguuauacacaaaugugcgaccaccggcuaaugucagcagcaauaaaagacucgaaagcgguacacgcagacauggguuacuggauagagucagaaaagaaugaaacguggaaauuagcacgugccucuuucauagaagugaagacgugcauuuggccgaagucacacacucucuggagcaaugggguacuagagagugaaaugauaauacccaaaauuuaugguggucccauaagucaacacaauuauaggccaggguacuuuacacaaacagcaggaccauggcaucuaggcaaauuagagcuugauuuugacuuaugugaaggaacuaccguagucgucgaugaacauugugguaaccgcgggccguccuuaagaacaacgacaguaacagguaaaauaauccaugaauggugcuguagaagcuguacccugcccccauuaagauuuagaggugaagacggauguugguaugguauggagauaaggcccguaaaagaaaaagaagaaaauuugguaagaucaaugguaagugcgggauccggagagguugacuccuuuucacuggguauuuuaugugucagcaucaugauugaagaggucaugcguagccgauggaguagaaaaaugcucaugacugggacccuagcaguauuccuacuccuuauuaugggacaacuaacuuggaaugaccugauccguuuaugcauaauggucggugcaaaugcuagugaccgaaugggaaugggaacuacauacuuagcauuaaugggaaccuuuaaaaugcguccaauguuugcuguaggccuucuauuucgacguuugacuucaagggaagucuuacuacuuacuaucggauuaucacucguagcgucaguggaauuaccgaauagucuugaagaacuaggggacggguuagcuaugggaauuaugaugcuuaaauuguuaacugaguuccaaccccaccaacuauggacuacuuuauuaucuuuaaccuuuaucaaaacgacauugucacuagauuaugcuuggaaaaccauggcuaugguucuuucaauuguuagucuauuuccucugugucuuaguacgaccagucagaaaacuacaugguuaccaguccugcuaggaaguuuuggcuguaagccccugacuauguuuuuaauaaccgagaauaaaauuuggggucgcaagagcuggccccuaaacgaagggaucauggccauugguauaguuucaauacuauugaguagccuauugaaaaaugauguaccgcuagcagguccacugaucgcaggcgggaugcuuauugcauguuauguaauuaguggaaguagugcugaccugagucuagaaaaagcugcggaaauaaguugggaggaagaagcugagcauucaggaacaagucauaauauccuaguugaaguacaagacgauggaaccaugaagauaaaggaugaagaacgggacgacacacuaacuauuuuacuaaaagcuacucuacuugcuguuuccggcguauauccgaugucaauaccugcaacguuauuuguaugguauuucuggcagaaaaagaaacaaaggucaggaguacucugggauacuccgagcccgcccgaaguagaacgagcaguauuagacgacgggauauaccguauauugcagagaggccuuuuaggacguagucaagucggaguagggguauuucaagacgguguuuuucacacaauguggcaugugacuagaggagcaguccucauguaccaaggaaaaagauuagagccaucaugggcuucaguuaagaaagaucuaauuucuuacggcggaggauggcgauuccaaggaaguuggaacacgggggaggaagugcaaguaauugcaguagaaccagggaaaaaccccaaaaacguccagacgacaccagguacuuuuaagacaccagagggagaaguaggagcaauugcgcuagauuuuaaaccgggaacaucaggcucaccaaucgugaaccgagaagguaaaauaguuggccuauauggcaacggcguaguaacaaccuccggcacauauguaagugcuauagcucaggcgaaagcaucacaagaaggaccacuaccugaaaucgaagacgaagucuucaagaaacggaaucuaacaauaauggauuuacauccagguaguggaaaaacacgucguuaucuuccagcaaucgugagagaagcuauuaaaagaaaauuaagaacauuaauacuggcgccaacgagagugguggcaagugagauggcugaggcacuuaaaggaaugcccauaagauaucaaacaacggcaguaaagucagaacacacuggcagagaaauaguagacuuaaugugucacgccacguuuacaaugagauuguugucuccaguacgggucccgaauuauaacaugauuauuauggaugaagcucauuuuacagaccccgcaucuaucgcugcacgcggguauauaaguacacgggugggcaugggagaagcugcugcaaucuuuaugacugcgacaccuccagggucgguagaagcauucccucaaucgaaugccguaauacaagaugaagaacgagauauuccugaacggucauggaacucgggcuaugauuggaucaccgacuucccugguaaaaccauuugguuuguuccaagcaucaaaagcggaaacgauauagcaaacugccuuaggaaaaacgguaaaaggguaauacaacucucacgcaaaaccuucgacacagaauaucaaaagaccaaaaacaaugauugggauuauguagucacuacugauauaucugagaugggagcgaacuucagagcagauagaguuauagauccccgucggugucuuaaaccuguaauacucaaggacgguccggaaagaguuauauuagcgggaccaaugcccguaacuguagcaagugcggcgcagcgaaggggccgaauagggcguaaucaaaauaaggagggugaccaauaugucuacaugggacaaccgcucaacaacgacgaagaucaugcucacuggacggaagcgaaaauguuacucgacaauauaaacaccccggaagggauaauaccagcgcuauucgaaccugagagagaaaaaucagccgccauagacggagaauauagauugcgaggagaagcacggaaaacauuuguagaauuaaugcgcaggggagaccuccccguauggcuaucauauaaaguggcaucggaagguuuccaauacucggacagacguugguguuuugauggcgaacgaaauaaccagguccuagaagagaauauggaugucgaaaucuggacaaaggagggagaaaggaagaaacuacgcccuagauggcuagaugcaaggacauacucagauccccuagcguuacgugaauuuaaagaguuugccgcuggucgucgcuccauauccggugacuuaauucuagaaauuggaaaacugccacagcaccugacacuaagagcucagaacgcguuagacaaucuugugaugcuacauaacuccgagcaaggagggaaagccuacagacaugcgauggaagaauuacccgauacaauagaaacgcucaugcuauuagcgcucauagcuguacuuacgggaggggucacauuauucuuuuugagugggaagggguuggguaaaaccucaauagguuuauuaugcguuauggcgaguucagcgcucuuauggauggccaauguggaaccucauuggauagcugcauccauaauucuugaauuuuuccuaaugguacuauuaauaccugaaccugacaggcaacgaacuccccaagacaaucaguuagccuauguggucauuggucuccuauuuaugauauugaccguugcagcaaaugaaaugggucuguuagagaccacuaagaaagaucuugguauugggcaugucgcagcggaaaaccaucaccaugcuacgaugcucgacgucgauuuaagacccgcaagcgcauggacucucuaugcaguugcaaccacuguuauuaccccaaugaugagacacacuauagaaaauacaaccgcaaacauaagucuaacagcaauagcgaaucaagcagcuauuuugauggggcuugauaagggauggccaaucucuaaaauggauauaggaguaccgcucuuggcauuagguuguuauucucaaguaaauccguuaacgcuuacagcggcaguauuaauguuggucgcgcauuaugcuauuauaggucccggacuacaggcuaaagcaacucgagaagcgcagaaaagaacagcugcugggauaaugaagaaucccacgguagauggcauuguagcaauagauuuagauccaguaguauacgacgcgaaauuugagaaacagcuaggucagauaaugcuucuaauucuuuguacaagccaaauacuauuaaugaggaccacuugggcauugugugagucuauaacuuuggcaacugguccguugaccacacuaugggaggggaguccaggaaaauucuggaacaccacuauagcagugucaauggcuaauauauucagaggaucauaucuugcuggcgcaggauuagccuucucguuaaugaaaucgcuagguggaggcagaagaggaacaggugcgcaaggcgaaacccugggugagaaauggaaacgucagcugaaccaguuauccaaaucugaguuuaacaccuauaaacggagcggaauaauggaaguugauagaagugaagcgaaagaagguuuaaagagaggggaaacuacaaaacacgcaguaucgcgagggacagcuaaguuacgcugguuuguagaaagaaaucuuguuaaacccgagggaaaaguuauagaucucgggugcgggagaggagguuggucguauuauugugcaggcuuaaagaaggucacggaaguaaaaggauauacuaaaggaggaccgggacacgaggaaccgauuccuauggcuacuuauggauggaacuuaguaaaauuacauaguggaaaagacguguucuuuacuccacccgagaaaugugauacacucuuaugcgauauuggcgagucauccccuaauccgacaauagaagaaggucggacauuacguguacucaaaaugguugaaccauggcugcggggcaaucaguuuugcaucaaaauacucaauccuuacaugcccagugucguugaaacacuugagcagaugcaacgaaaacauggagguauguugguaaggaacccauuaaguagaaacucgacacaugaaauguauuggguaucgugcggaaccggcaauauuguaagugcagugaauaugacuucgcggaugcuacuaaaccgcuucacaauggcgcaucgaaaaccaacauacgaaaaagauguagacuuaggagcaggaacacgacauguugcaguggaaccugagguugcgaaccuagauauuauaggucaacgcauagagaauaucaaaaaugaacacaagucaacguggcauuaugaugaagauaaccccuacaaaacaugggcuuaucacggcuccuaugaaguuaaacccagcggaagcgcgaguucuaugguaaaugggguaguaagauugcuuacgaagccuugggauguaauccccaugguuacacaaauugccaugacugacacaaccccauucggacaacaacgcguuuucaaagaaaaaguagacacgcgaacaccuagggcgaaacgaggaacggcgcaaauaauggaaguuaccgcaaaaugguuguggggguuccugagcaggaauaagaaaccuagaauaugcacucgcgaagaauuuaccaagaaaguaaggaguaaugccgcaaucggugcaguguuuguagaugagaaccaauggaacucagcaaaagaggcaguugaggaugaaagauucugggaccucguucacagagaaagggaauugcauaaacaagggaaaugugcaaccugcguguauaauaugauggggaagcgugagaagaaacucggugaguucggcaaagcaaaaggaagucgagcgauaugguauauguggcuaggcgcacgauuucuagaauuugaagcguuaggauuuaugaacgaagaccauugguuuagucgcgagaacucucuaucuggaguagagggggaagggcuucauaaacuagguuacauucuucgcgacauaagcaaaauacccggaggcaacauguaugcugaugauacagcagguugggacacgcgcauaacggaagaugauuuacaaaacgaagcgaaaaucaccgacauaauggaacccgaacaugcccuuuuagcaacgucaaucuuuaaacugacuuaucaaaacaaaguuguucgaguacagcguccggcuaaaaacgggaaugucauggacgucauuucaagaagggaucagagagggagcggacaaguaggaacauauggauuaaauacuuuuaccaauauggaaguacaauugauaagacaaauggaaagcgaagguauauuuuuaccaagugaguuagaaacaccuaaucuagcagaacggguacuagauugguuggaaaaacauggagcggaacggcucaagagaauggcuauaucaggagaugacugugugguuaagccuauagaugaucgguucgcuaccgccuuaauugcauuaaaugacaugggaaagguacguaaggauaucccacaaugggaaccaaguaaaggcuggaaugauuggcagcaagugccauucuguagccaucauuuucaucaauugaucaugaaagacggucgagaaaucgucguacccuguagaaaccaagaugaauuagucggcagagcaaggguaagucaaggcgcaggguggagcuuacgagaaacagcgugucuagguaaguccuacgcacagauguggcaacuuauguauuuucaucggcgagacuugagacuagcugcgaacgccaucuguagugccguccccguggauuggguaccaacgucgcguacuacauggagcauucacgcacaucaccaauggaugacaacagaggauaugcuaucaguauggaacagaguauggaucgaggaaaacccauggauggaagauaaaacccauguaaguucaugggaagagguuccuuaccuuggcaagagggaagaccaauggugcgguagccuaauaggacuuacagcaagagccacaugggcuacaaacauucaggucgcuaucaaucaaguaagaagauugauaggcaacgaaaacuacuuagacuauaugacaaguaugaaaagauuuaaaaaugaaagugacccagaaggagcauuaugguag

SEQ ID NO: 21365 - RNA, 9879 nt, Artificial Sequence
  derived and/or modified CDS sequence (opt6) from DENV-1__FJ687426__SS-prME
ucagucacuaugcugcuaaugcuuaugccuacugcgcuagcauuucaccuaacaacacguggaggggaaccacacaugauaguaucuaaacaagaacgaggaaaaucguuguuguuuaaaacaagugcagggguaaauauguguacgcucaucgcaauggaccuaggagagcugugugaggacacgaugacauacaaaugcccgagaaucacugaagcagaaccugaugauguagacugcuggugcaacgccacggauacauggguuacuuauggaacguguagccaaacuggugaacacagacgagauaaaagauccgucgcauuggcaccacacguuggacuuggguuagaaacacguacagaaacauggaugagcucagaaggugcauggaaacaaauacaaaggguagaaacaugggcgcuuagacauccaggauuuacagucauagcacuguuucuagcccacgcaaucggaaccaguauuacacaaaaaggaauaauauuuaucuugcuuauguugguuaccccaucaauggcaaugcgcugcguaggcaucggcagucgagacuuuguggaaggauuaagcggagcaacguggguagauguaguauuagaacauggauccugcguaacaacuauggcgaaagauaaaccaacccuagauauagaauuacuuaaaacugaagucacaaaccccgcugucuuacgcaaacuuuguauugaagcuaaaauaucaaauaccacaacugauucucguugcccaacccaaggugaggccacuuuaguugaagaacaagacgcuaacuucguuuguaggagaacauucguagauagaggguggggcaacggaugugguuuguucgguaaaggcaguuuacuaacgugugcgaaauucaaaugcguuacuaaauuggagggaaaaauugugcaauaugaaaacuuaaaauacucuguaauuguuaccgugcauacaggcgaucaacaucaaguuggaaaugaauccacagaacaugggacaacggcgacuaucaccccucaggccccaacaacugaaauacaguuaaccgauuacggagcucuuaccuuggacugcaguccaaggaccggucucgacuuuaaugaaaugguauuacuaaccaugaaagagaaaucaugguugguacacaaacagugguuucuagaccucccucuaccauggacaaguggugcaucgacuucucaggaaacguggaauaggcaagaucuccuaguaacauucaaaaccgcacaugccaagaaacaagagguuguaguucuuggaucucaagaaggagcaaugcauacggcucugacuggcgccaccgaaauacaaacuagcgguacaacaaccaucuucgcgggccauuuaaaaugccgucuuaaaauggacaaauuaacgcugaaaggaaugaguuauguuauguguaccggaucauuuaaauuagagaaagagguggccgaaacgcaacauggaacuguauuaguucagauaaaauaugaagguacagaugcuccguguaaaauacccuucagcacacaagaugaaaaagguguaacccagaauggacgacuaaucacggcgaauccuauaguuacugauaaagaaaaaccuguuaacauagaagccgaaccaccuuuuggggaaucauauauaguaauaggagccggugaaaaagcauuaaaacuaucuugguucaagaaaggaaguagcauaggaaaaauguuugaagcuacggcgagaggagcccgacgaauggcgauucuuggagauacagcgugggauuuugggucaauaggcggggucuuuacuagcguaggaaagcuaguucaccagauauucgguacagcauacggcguacuauuuucaggggucucauggacuaugaaaaucggaauaggggugcuacuaacuuggcucggguuaaauaguaggaguacaagucuaaguaugacuugcauugcugucggucuagugacauuguacuuaggagucaugguucaagcggauaguggaugcgugauaaauuggaaaggaagagaauuaaaauguggaagcgggauauucguuacgaaugagguacacacauggacugagcaauauaaauuccaagcagauaguccuaagaggcucagugccgcaaucgguaaagcaugggaagaaggcguaugcggaauacgcucugcaacucgacuagagaacauuauguggaaacagaucucuaaugaacuaaaucauauacucuuagaaaaugacaugaaauucacaguaguaguuggugacgucgccggcauauuagcgcaaggaaagaaaaugauaaggccccaaccuauggaguauaaguacagcuggaaaucauggggaaaagcaaagauuaucggagcugauguacaaaauucaacguucauaauagacggaccgaauacaccugaaugccccgaugaucaaagggcguggaauauuugggagguugaagauuauggcuuuggaauuuuuacaaccaacauaugguuaaaacugcgggacagcuacacgcaaguuugugaccaccguuuaaugucggcugcaauaaaagauagcaaggcuguacaugcagauaugggauacuggauagagagugagaaaaacgaaacguggaaacuagcgggagcuucauucauagaaguuaagaccugcauauggccaaagagucauacucuauggucgaauggaguauuggaguccgaaaugauuauaccgaagauauauggcggcccaaucagucagcauaacuaccggccuggauacuuuacgcaaacagccggcccauggcauuuagguaagcucgaacuagacuucgaccucugugaggguacaacaguaguaguagaugagcauugugguaaucgugguccaucacuaagaacaacuaccguaacagguaaaauaauucaugaaugguguugcagaucauguacauugccuccacuacguuuucgcggggaggacgguuguugguauggaauggaaauaagaccaguaaaagaaaaagaagaaaauuuaguaaaauccaugguuuccgcgggaucaggggagguagauaguuuuucguuaggauuacugugcauaaguauaaugaucgaggagguuaugagaucuagguggaguagaaaaauguuaaugacagguacauuagcuguauucuuucuauuaauuaugggucaauuaacauggaaugauuuaauacgauugugcauuaugguaggagcuaaugcuuccgauagaaugggaaugggcacaacauaucucgcguugauggcaacauuuaaaaugagaccuauguuugccguagguuuauuauuucgaagauuaacaucuagagagguauugcuucucacuauaggauuaucauuagucgcaaguguugaacucccuaauucuuuggaggagcuaggcgauggucucgcaauggggauaaugauccuaaaacuauuaacugacuuccaaagccaucaguuaugggcaacauugcucucucuuacauucauaaagacuacguuaucuuugcauuacgcuuggaaaacuauggccaugguucucaguaucguuaguuuauuucccuugugucuaucuacaacaucucagaaaacuaccuggcuacccguucuuuuagguucgcucggauguaagccccuaacaauguuucuaauagcagaaaacaaaauuuggggucguaaauccuggcccuugaacgaaggcaucauggcaguaggaauuguuucaauuuuacuuucaucacuauugaaaaacgacguaccauuggcagguccauugauagcgggaggaaugcuuauugccuguuaugucauaucagggucaagugccgauuugucucuugaaaaagcagcugagguguccugggaagaggaagcggaacauaguggggccucgcauaacauucucguugaaguccaagacgauggaacaaugaaaauaaaagacgaagaacgagaugacacacuaacaauucugcucaaagcgacgcugcuugcuguaucaggaguguauccucuaucuauccccgcaacauuguuuguuugguauuucuggcagaagaagaaacagagaucuggaguacuuugggacacucccucuccuccggaaguagaaagagcuguuuuagaugacggaauuuacaggauuaugcaaagaggccuccuuggaaggagucaaguaggcguugguguguuccaggagaacguuuuccauacaauguggcauguuacacgcggggcaguguuaauguaucaaggcaaacgacucgagccuucaugggccucuguuaagaaagauuuaaucaguuauggaggcggauggcgacuacaaggaaguuggaauacaggcgaagaaguucagguuauagcuguagaacccgguaagaaccccaaaaauguucaaaccgccccagggacauuuaaaaccccagaaggagaaguuggagcgauagcauuagauuucaaaccuggaacaagugguucuccaauaguuaauagggagggaaaaauagucggcuuauauggcaaugguguaguuacaaccucagguacguauguuagugccauagcacaagcuaaagcaucgcaggaaggcccacuucccgaaauagaagacgaaguauucaggaagcgcaaucuaacuauuauggaccuucacccaggaagcggaaaaacgagacgauaucuuccugccauugugagagaagcuauaaagagaaaacuaagaacucuaauuuuggccccaacuaggguagucgcgucagagauggcagaagcucuaaaagguaugccaaucagauaucagacgacagcuguaaaaucagaacauaccggcaaggagauaguugaucuaaugugucacgcaacguucaccaugagguuacuguccccuguucgggucccaaacuauaacaugaucauaauggaugaagcacacuuuacugacccuucaaguaucgcagccagggguuauaucucaacuagaguaggaaugggugaagcggcggcaauuuucaugacugcgaccccgccaggaagcguagaggcauuuccacaaucaaaugcgguuauucaggaugaagagagagauauuccugagcguaguuggaauaguggguacgaauggauaaccgacuucccagggaaaacggugugguucgugccaucaauaaaggcaggaaacgauauagcaaauuguuuaaggaaaaacggaaaaagaguaauucaacuaagcagaaagacuuuugauaccgaauaccagaaaacuaaaaauaaugauugggauuacguugucacuacugacauaucugagaugggugcaaacuuucgugcugaucguguuauagaucccagacgaugcuuaaaacccgugauucuaaaagauggaccggaacgagucauccuagcuggaccuaugccagucacaguugcuagugcagcccaacgcagaggaagaauaggaaggaaccacaacaaagaaggagaccaguauauuuacaugggacaaccacuuaauaaugacgaagaucaugcacacuggacugaggcaaaaaugcuuuuagacaacauuaauacuccagaaggaaucauaccggcauuauuugagccugaacgagaaaaaucugcagcuaucgauggugaauacagauuaaggggugaagcgagaaaaacguuuguugaguugaugaggcggggugaccuaccgguauggcucaguuauaaaguugcuuccgagggauuccaauacagugaccguagaugguguuuugauggggagagaaacaaccaaguacuggaggaaaacauggacgucgaaauauggaccaaagaaggugaacgcaaaaagcuaagaccuagauggcuugacgcacguacauacagugauccgcuagcccuuagagaauuuaaagaguuugcagcaggaagaagaucgguuagcggcgaucugauauuggaaauugguaaauuaccgcaacaucuaacgcaacgagcucaaaacgcauuagauaaccuaguaaugcuccauaauagugagcaaggaggcagagcauauagacacgcuauggaggaacuaccagacacuauagaaacuuuaauguuauuggcacucauagcgguccuaacagggggagugacacuauuuuucuugucaggcaagggauuaggcaaaacuucuaucggacuguuaugugugauggcauccaguguucuauuauggauggcuuccguagaaccucauuggauagcagcaagcauaaucuuagaguucuuuuuaaugguacuccugaucccagagcccgaucgacaaaggacaccacaagauaaccaauuggcguauguagugauaggucuccuauuuaugauuuuaacaguugcagcaaaugaaaugggguuauuagaaacuaccaagaaagaccuuggcauaggucauguagccgucgagaaucaccaccacgcagcuaugcuggauguugacuugcaccccgcuagcgcuuggacuuuguacgcagucgcuacuacaauaauuacacccaugaugcgucacaccauagagaauacgaccgcuaacauuaguuuaacugcaauagccaaucaggccgccauauuaaugggcuuagauaaaggauggccaauaagcaaaauggauauugguguucccuugcuagcacucgguuguuacucucaaguaaacccccuaacuuugaccgccgcaguauugauguuaguagcacacuaugcgauaauugggccuggauugcaggcaaaagcaacccgugaagcacagaaaagaacagcugcuggcauaaugaaaaaccccacuaucgauggaauaguugcuauagauuuagauccgguaguguaugaugcaaaauuugaaaaacaauuaggacaaaucaugcuauuaauauuauguacaagccaaauucuucuaaugagaaccacaugggcauugugcgaaaguauaaccuuagcuacgggucccuuaaccacuuuaugggaggggucgccgggaaaguuuuggaacacuacgauugccguaaguauggcuaacauauuuaggggaucuuacuuagcgggugcaggacuggcuuuuucucuaaugaaaagucucggaggcggacggcgagggaccggggcucagggagagacucuuggggaaaaauggaaaagacagcuuaaccaacuaaguaaaagugaguucaacacuuauaaaaggucaggaauaauggaggucgaucgaagugaggcgaaagaaggauuaaagagaggugagacgacgaaacaugccguuucacgcggaacggcuaagcuaagaugguuugucgaacgaaaucuaguuaaaccagaagguaaagugauagacuuagguugugguaggggagguuggagcuacuauugugccggacuaaagaaaguaacagaaguuaagggcuauacuaaaggaggacccggccacgaggaacccauaccaauggcaacguacggauggaaccuugucaaauugcacaguggaaaagacguauucuucauacccccagagaaaugcgauacccuauugugugacauaggugaaagcucucccaacccgacaauugaagagggaagaaccuuaagaguucuaaagaugguggaaccguggcugcgaggaaaccaguucugcauaaagauuuuaaacccuuacaugcccagugugguugagacacuugaacagaugcaaagaaagcacggggguaugcuaguaagaaacccguuaagcagaaauaguacacaugaaauguacugggucaguugcgggacagguaauauaguaucagcgguuaacaugacaagcagaaugcucuuaaauagauucacaauggcucaucgaaagccuaccuacgaaagagauguagacuuaggugcgggcacccgacacguggcaguugaaccagaaguggcuaaccucgacauuauuggccagagaauagaaaauauuaagcaugagcauaagaguaccuggcauuacgaugaggauaaccccuauaagacuugggccuaucaugguucguacgaagugaagcccagugguagcgcaucaucaauggucaacggaguuguaaaguugcuuacuaaaccaugggacgugauccccaugguaacucaaauugcaaugacagauaccacuccauuuggacagcaaagaguuuuuaaagaaaaaguagauacucgaacgcccaaggcuaaaaggggaacugcacaaauuauggaaguaacagcaaaaugguuguggggguuccuaagcagaaauaagaaaccuagaauuugcacacgggaagaauuuacgcgaaagguacggaguaaugccgcaauuggagccguguuuguugaugaaaaucaguggaacagugcgaaagaggcuguagaagaugaucgcuuuugggaccucguacacagagaacgagagcuacauaaacaagguaaaugcgcuaccuguguauacaauaugauggguaaacgcgagaagaaacugggagaauuuggaaaagcaaaagguagucgagcaauuugguacauguggcuuggugcaagauuucuugaguuugaggcacuuggguucaugaaugaagaucauugguuuucacgcgagaacagucugucaggaguugaaggcgaagguuuacacaaacuaggcuacaucuuacgagacauaaguaaaauaccugggggaaauauguaugccgacgauacugcagggugggacaccagaaucacagaagacgauuuacagaacgaagccaagaucacagauaucauggaaccagagcacgcgcuucuggcaaaaaguaucuucaaauugacauaucagaauaaagugguacgcguucaaaggccugccaaaaauggaaccguaauggauguaauaaguagacgagaucaaagggguucagggcaaguggggacauacggacuaaacaccuucacaaacauggaggcccaacuuaucaggcaaauggaaucagaaggaauauuuagcccuaaugaacuagagacucccaaccuagcagaacgugucuuggacugguuagaaaaguauggggucgagagacucaaacggauggccauuaguggggacgacuguguaguaaaaccuauugacgaucgauuugcuacugcguuaacagcgcuuaaugacaugggaaaagugcgcaaagacauaccgcagugggagcccucaaaaggcuggaaugacuggcaacaaguaccauuuugcucccaccacuuucaucagcuaauuaugaaagacggucgugaaauagugguaccuugccgaaaccaggaugagcuaguuggacgugcccgaguaucgcaaggugcggggugguccuuaagggaaacggccuguuuggguaagucuuaugcacagauguggcaacuuauguauuuucaucgacgagaccuaagacuugcagcaaacgcuaucugcucggcagugccuguagauuggguuccaacaaguagaacuacaugguccauccaugcacaccaucaauggaugacuacagaggacaugcuaucaguauggaaucgcguauggauugaggaaaacccauggauggaagacaaaacccgaauaagcucuugggaggacguuccauaccuaggaaagagggaagaccaauggugcggcagucuuaucggacugaccgcgagagcuacuugggcuacuaacauacaggucgcuauaaaucagguaagaagauugauaggaaaugaaaacuauagcgauuauaugaccagcaugaaaagauuuaaaaacgaaucggaaccagaaggagcucuaugguaa

SEQ ID NO: 21366 - RNA, 9879 nt, Artificial Sequence
  derived and/or modified CDS sequence (opt6) from DENV-1__FJ687428__SS-prME
agugugacgaugcuauugaugcuuaugccuacugcauuagcguuucaucucacaacacguggcggggaaccacauaugauaguauccaaacaagagagagguaagagcuuauuauuuaaaacaagugccggugugaauaugugcacgcuaauagcaauggaucugggagaacuaugcgaagauacaaugacuuauaaauguccucgaauaaccgaagcggaacccgacgacguggacuguugguguaaugcuaccgauacuuggguuacuuaugggacauguucccaaacaggugaacauagaagggauaaaagaucaguagcacuggcuccgcauguagggcuaggccucgaaacucguacugagacuuggaugagcuccgaaggagcauggaaacaaauccaaagaguagagacuugggcauuacgacauccuggauuuacuguuauagcauuguuucuugcucaugcaauaggaaccucaauaacacaaaaagguauaauauuuauuuuacuuauguuagucacaccaaguauggcaaugcgaugcguaggcauaggaucaagagauuucguugaaggguuaaguggcgcaacguggguagauguaguuuuagaacauggaucaugcgucacaacuauggcaaaagauaaaccuacuuuagauaucgagcuauugaaaacagaaguaacaaacccugcagugcuaagaaaacuaugcauugaagcgaaaauaagcaacacaaccacugauucucggugcccgacccaaggugaagccacguuaguugaggaacaggacgccaauuuugugugucgaagaaccuucguggauagaggauggggaaacgguugcggauuguucggaaaaggcucccuauuaacuugcgcaaaguucaaguguguaacaaaauuggaaggaaaaauaguacaguaugagaaucugaaauacucaguaauaguaaccguucacacuggugaucaacaccagguggggaaugaaagcacagagcauggcacuacagcaacaauaacaccucaagcaccuacgaccgaaauacaauugacagauuauggagcacuuacucuugacuguagucccagaacaggccuagacuucaacgaaauggucuuauuaacuaugaaggaaaagucuuggcuaguacacaaacaaugguucuuagaucuucccuuaccauggacaagcggggcgagcacuucgcaagaaaccuggaauaggcaggacuugcuaguaacuuuuaaaaccgcacacgccaagaaacaagaagucguaguacucgguagucaagagggggcaaugcauacugcccuuacuggagccaccgagauucaaacauccgggacaacaacuauauuugcaggacaccugaaauguagacuaaaaauggauaaauuaacguugaaaggaauguccuacguaauguguacggggucuuucaaauuagaaaaggaaguagcagaaacgcagcacgggacaguuuuaguacagauaaaguacgaagguaccgacgcucccuguaaaauaccuuucagcacucaagacgaaaagggcguuacgcaaaaugggagacuaauaacagcuaauccgauaguaacugauaaagagaaaccuguaaauauagaggcggaaccaccauucggagaaucguacauuguaaucggcgcgggugaaaaagcacuaaaguuauccugguuuaagaaagggucuucaaucggaaaaauguuugaagcaacagcuaggggcgcacgaaggauggcuauauuaggggauaccgcuugggacuuuggaagcauaggcggaguuuuuacauccguaggaaaauuaguccaucaaauauuuggaacagcauacggaguccuguucaguggagucucuuggacaaugaagauaggaauuggcguguugcuuacauggcuaggucuaaacagccguuccacuagccuguccaugaccuguauugcaguugguuuaguaacacuguauuuaggagugauggugcaagccgauucuggaugcgugaucaauuggaagggacgagaauuaaaauguggcucaggaauauucgugaccaacgaaguccauaccuggacugaacaauauaaauuccaagcggacucaccaaaaagauuaucugccgccauugggaaagcgugggaagaggggguuugcggcauacguucugcuacgagguuagaaaauauuauguggaaacaaauauccaacgaauuaaaucauaucuuauuagaaaacgacaugaaauucacaguggugguaggagacguagccggaauacuagcccaaggaaagaaaaugauucguccacagccaauggaauauaaauauagcuggaagaguugggguaaagccaaaauaaucggugcugauguacaaaauaguacauuuauaauagauggaccuaauacaccggaauguccagaugaucaacgagcauggaacauaugggaagucgaagauuacggauucgguaucuuuaccacaaauaucugguuaaaacuacgagacucguacacccaagucugcgaucacagauugauguccgcagcaauuaaagauucuaaagcaguucaugcagauaugggauacuggauagaaucggagaaaaaugaaacuuggaaauuagccggugcaaguuucauagaaguaaaaacuuguauuuggccaaaaucacacacacucuggucgaaugggguacuugaaagcgaaaugaucauuccgaaaaucuauggugguccaauaagucaacacaauuauagaccgggcuauuucacacaaacagcuggcccauggcaccugggcaagcuagaauuggacuuugauuuaugcgaaggcaccaccguugucguagacgaacacugcgguaaccgagggccuucauuacgcacuaccacaguuacaggaaaaauuauacaugaauggugcuguagaucauguacuuuaccuccacugcgguuccgaggagaagauggaugcugguaugggauggaaauacgucccguaaaggaaaaagaagagaaccucgucaagaguaugguuuccgcggguucgggcgaaguugacaguuucagucuugggcuucuguguaucucuaucaugauagaagaggucaugagaucaagauggucacguaaaaugcugaugacagguacgcuugcuguauucuuuuuacugauuaugggucaacuuacuuggaaugacuugauacgauuaugcauuauggucggugcuaaugcaagcgacaggaugggaauggguacaacuuaccuugcacucauggcaacguucaaaaugcgcccaauguucgcagucggguuacuuuuucgaaggcuaacgagcagagaaguccuccuucuaacaauaggccucucauugguagcaaguguagaacuaccuaauucauuggaagaacuuggagauggucuugcaauggguauaaugauauuaaaauuauuaacagacuuucaaagccaucaacuaugggcuacgcuuuugagcuuaacauucaucaaaacgacauugagccuccacuaugcauggaaaacaauggcgaugguucuuucgauaguguccuuguucccauuauguuuaagcacuacaucucagaaaacuacauggcucccuguuuuauuagguaguuugggcuguaaaccacucaccauguuuuuaauagcagaaaauaaaauauggggaagaaaaucauggcccuuaaaugaggguauaauggcgguugggauagugucaauuuuacuuucuucacuacucaaaaaugauguaccucuggccgggccacugauagcgggugguauguuaauagcauguuacgugauuucagguucaagcgcugaccuaagucuugaaaaagcugcagaaguuuccugggaggaggaagcggaacacucuggagcaagucacaacauuuugguugagguacaagaugauggaacuaugaagauuaaagaugaagaaagagacgauacuuuaacaaucuugcuaaaagcgacguuacuagcugugucuggaguauauccgcuaucaauaccagcaacacuauucguaugguauuucuggcagaagaagaaacaaagaaguggagugcuaugggauacuccaaguccuccagaaguagaaagagcuguacuagaugacggaauuuaccggauaaugcagcgaggacuauuaggaagaucacaaguaggugucgguguauuucaagaaaacguuuuucauacaauguggcacguaacacgcggagccguauuaauguaccaagguaaaagauuagaaccgucgugggcaucugucaaaaaggaccuaauaucauaugguggcggauggagauuacaaggcucauggaauacuggagaggaaguacaaguaauagcagucgaaccugggaaaaaucccaaaaauguucaaacggccccgggaacauucaaaaccccagaaggagaaguuggagcuauagcacuagauuuuaaaccuggaacuucugguucuccaauagucaaucgcgaaggaaagaucguaggacuuuaugguaacggcguagugaccacaagcggaacuuacguaucagcaauagcucaagcaaaggcgagccaagaagggccguugccugagaucgaagaugaaguuuuucggaaaaggaaccuuaccaucauggacuuacauccggguucgggaaaaacuagacgauaccucccugcaauugucagagaagcgauaaaaagaaaauugcguacuuugauacuagcuccuacacgcgugguagccucagagauggccgaggcacucaagggcaugccuaucagguaucaaaccaccgcuguuaaaucagaacacacugggaaggaaauagucgacuuaaugugucacgcuacuuuuacgaugcgucuccuuagcccuguaagaguuccuaacuauaacaugaucauaauggacgaggcacacuuuacagauccaaguaguaucgcagcccgaggauauauaucuacucgcguaggaaugggugaagccgcagcaaucuuuaugacagcaacuccgccgggcucaguagaggccuuuccacaaaguaaugcuguaauccaggaugaagaacgagauauuccagaaagaaguuggaacucaggauacgaauggauaacagacuucccagggaaaacgguaugguuuguacccucgaucaaagcagguaacgauaucgcaaauuguuuaaggaagaacggaaagcgcgucauacaauugagcagaaaaaccuuugacacugaauaccagaaaaccaaaaauaacgacugggacuaugugguaacuacggauauaucugaaaugggagcuaacuuccgagcagauagagucaucgauccaagaagguguuuaaagccgguuauauuaaaagauggaccagaacgaguaauauuagcugguccgaugccggucacgguagcaagugcagcacagagaagaggucgaauaggacguaaucacaauaaagaaggagaccaauacauauauaugggucaaccguuaaacaaugaugaagaucacgcacauuggaccgaggccaaaauguuguuagauaauauaaacaccccggaaggcauuauaccugcuuuguuugagccggagagagagaaaagcgcggccaucgauggugaauacagguuaagaggagaagcgcgaaaaaccuucguagaacuaaugagaaggggugacuuaccggucugguuaaguuacaaaguugccagugagggcuuccaauauuccgacagacgauggugcuuugacggggaaaggaauaaccagguauuggaagaaaauauggaugucgaaauauggacaaaagaaggagaacgcaagaaacuaagaccucguugguuagaugccaggacuuauagcgauccacucgcccuucgugaauuuaaagaauuugcggcgggaagaagaaguguaaguggugauuuaauuuuagaaauuggcaaauuaccgcaacaucuuacccaaagagcgcaaaaugcauuggacaauuugguaaugcuacauaauagugaacagggugguagagccuauagacacgcaauggaggaguugccugacacaauugaaacucuaauguuacucgcauuaauugcgguucugacugggggaguaacccuauucuuucugucuggaaagggacucgguaagacgagcauuggcuuauuauguguuauggcaucaucgguuuugcuauggauggcuagcguagagccucauuggauagcggccucgauaauacuagaauuuuuccuaaugguuuuacugauaccagaaccugaccgucagagaacuccacaggauaaucaacuagcguauguugucaucggcuugcuauuuaugauacuaaccguggccgcaaaugaaaugggucucuuagaaacuaccaagaaagaccuuggaauuggacaugucgcgguagaaaaucaucaucaugcugcaaugcuugauguagauuuacauccagcuucagccuggacacucuaugcaguggccacaacuauaauuacgccaaugaugcggcacacaauagaaaauacgacggcaaauauaagucugacugcuauugcgaaucaagcagccauacugauggggcuagacaaagguuggccuauuucaaagauggacaucggcguuccuuuacucgcacuaggauguuacucccaaguaaauccucuaaccuuaaccgcugccguacuuaugcuaguugcccauuaugccauuauugguccgggauuacaagcuaaagccaccagggaagcucagaagcgaacggcagcgggaaucaugaaaaauccaaccauagauggaauuguagcaaucgaucuggauccgguaguuuacgacgcuaaauuugaaaaacaauuaggucaaauaaugcucuuaauacucuguacaucacaaaucuugcucaugagaacuacuugggcgcugugcgaauccauuacucuagcgacuggaccauugacaacucuaugggaaggauccccaggcaaauuuuggaauaccacaaucgcaguaucaauggcgaauauauucagaggaaguuauuuagccggugcugggcuagcauuuucccugaugaaaucauuaggaggugguaggagagguacaggagcacagggagaaacccuuggagaaaaguggaaaaggcaacuaaaccaguugagcaagagugaguuuaauacauacaaaagaagugguauaauggaaguugaccgauccgaggcuaaagaaggauuaaaacggggcgaaacaacgaaacacgcaguuucgagggggacugccaaauuaagaugguucguugaacgcaauuuaguuaaacccgaagguaaggucauagaucugggcugcggaagagguggguggucauacuauugcgcaggacuaaagaaaguaacugaagucaaaggauacacaaaaggaggaccuggacaugaagaaccuauuccgauggccacauaugguuggaaucuagugaaguuacacucaggaaaagaugucuucuucauuccaccugaaaaaugugauacucuccuuugcgacauuggagaaagcucgccuaauccuacaaucgaagaaggccgaacauuaagaguauuaaaaauggucgaaccaugguuaaggggaaaccaguucuguauaaaaauccucaauccauauaugccaagcgucgucgaaacucucgagcaaaugcaacggaagcacggagguauguuggucaggaacccauuaagccgaaacaguacacacgagauguauuggguaaguugcgggacgggaaauauaguauccgcggucaauaugacaagucgcauguuauuaaacagauuuacuauggcucacagaaagccaacuuaugaacgagauguagauuugggagccggcacacgccaugucgccguggagcccgaaguagccaauuuagauaucauaggacaacgcaucgaaagcauaaagcacgaacacaaaucaacauggcacuaugacgaagacaacccauacaaaacgugggcuuaucauggcucuuacgaaguuaagccuucagggucugcaagcucaaugguaaauggaguagucaaacuucuuacuaagccaugggaugugauuccaaugguaacacaaauagcaaugaccgacacuacuccuuuuggacaacaaaggguauucaaggagaaaguugauacaaggaccccgaaggcaaaaaggggcaccgcacaaauaauggaagugacugcuaaaugguuauggggauuuuuaagccguaauaagaagccaagaauauguacuagagaagaguucacaaggaagguacgcucaaacgcagcuauaggagcaguauucguagaugagaaccaauggaacucagcuaaagaggcagucgaagaugaccgcuuuugggaccuaguccauagggaaagagaauugcacaagcaagggaaaugcgccacuugcguauauaauaugauggggaaaagggagaagaaauuaggugaguuuggaaaggccaaggggucaagagccauaugguacauguggcuaggcgcacgauuuuuagaguuugaagcucucggauucaugaacgaagaucauugguuuucacgggaaaauagucucagugggguagaaggcgaaggauugcacaaauuaggauacauucuacgugacauaagcaagauaccagguggaaacauguacgcugacgauacugcgggaugggauaccaggauuaccgaagaugauuuacaaaaugaggccaaaauaacagauauaauggaaccugaacacgcucuccuagcaaaaucgauauuuaagcuaacuuaucaaaauaaaguaguuagaguccaaaggccugcgaaaaauggaaccgugauggauguaauaagcagaagagaccaaagaggcucaggucagguaggaacauacggccucaauacauuuaccaauauggaagcacaacuuauaaggcaaauggaaagcgaaggaauauucucaccgaaugaauuagaaacaccaaacuuggccgaaagaguucuagacuggcuagagaaauauggaguugaaagacugaagagaauggccauaaguggagacgacugcguagucaaaccuauagaugaucgauuugcuacugcacuuacagcacuaaacgacaugggaaagguucguaaagauauaccacaaugggaacccucuaaaggguggaaugauuggcagcaaguaccauuuuguucgcaucauuuucaucaacucauuaugaaggacggaagagaaaucguggugcccugucgaaaucaagacgagcuagucgguagagcaagaguaagucagggggcgggauggagccuucgcgaaacagcaugucucgguaagaguuaugcacaaauguggcaauuaauguacuuucaccgcagggaccucagauuagcagcgaacgcgauaugcucagcaguaccgguagauugggucccuacgucgcgaacgaccuggagcauucaugcacaccaccaauggaugacaacugaagacauguuaaguguuuggaauaggguauggauagaagaaaauccuuggauggaagacaaaacacgcauuucuaguugggaagaugucccguaucucggcaagcgagaggaucaguggugcgguagucugauuggacuaacagcuagagcaacgugggcaaccaauauacaaguggccauuaaucaaguacguagacuaauuggaaacgaaaauuacucagauuacaugacaucaaugaaaagguuuaaaaaugaaagugaaccagaaggagcauugugguaa

SEQ ID NO: 21367 - RNA, 9879 nt, Artificial Sequence
  derived and/or modified CDS sequence (opt6) from DENV-1__FJ687429__SS-prME
ucgguaacaaugcucuuaaugcucaugccuacagcacucgcauuucacuuaacaacgagagguggugaaccacauaugauuguuaguaaacaagaacgugggaaaucgcuucuguuuaaaacuagcgcuggaguuaacaugugcacauuaauugcaauggaucuaggagaacuuugugaagauacaaugacuuacaaauguccacgaauaacagaagcagaacccgaugauguugacugcugguguaaugcaacggauacaugggugacauauggaacaugcagucaaaccggugaacauagaagagauaaaagaaguguagcacucgcaccucaugucggcuugggccuggaaaccagaacugagacauggauguccucagaaggcgcguggaaacagauacagcgcguugaaacaugggcauuaaggcauccuggauuuacaguuaucgcacuuuuucuagcacaugcgauugggacuucaaucacacaaaaagguauaaucuucauacuacuaaugcucguuacccccucaauggcaaugagauguguaggaauaggcucuagggauuucguagaaggacucucaggugcgacauggauagaugugguccucgaacacggaucaugcauaacaacaauggcuaaagacaaaccaacccuggauauugaacugcugaaaacagagguaacaaacccugcaguuuuacggaaacuaugcaucgaagccaaaauaucgaauacgacgacugacuccaggugucccacacaaggagaagcgacacugguugaagaacaggaugcuaacuuuguauguaggagaacauuuguagaccguggaugggggaauggauguggauuauucggaaaaggcaguuuacuaacgugcgcgaaauuuaaaugcguaacuaaacuagaggguaaaauugugcaguacgaaaauuuaaaauacucuguuauugucacuguacacacaggagaccagcaucaaguaggaaacgaaaguacugaacauggaacgacugcuaccauaacgccacaagcacccacuacagaaauccaauuaacagacuacggugcauuaacuuuagauuguucuccccgaacaggucuugacuuuaacgaaaugguuuuacucacuaugaaagaaaaaucauggcugguacacaaacagugguuccuggauuugccucuuccauggacgaguggagcaucaacaagucaagagacauggaaucgucaagaccuauuggugacuuuuaaaacugcucacgcuaagaaacaggaaguaguaguuuuaggaucgcaagaaggcgcaaugcauaccgcgcuuacuggcgcaacggagauccagaccagcggaacuaccaccauuuucgcaggacauuuaaaaugucgguuaaaaauggacaaacuaacauuaaaagguaugucguaugugaugugcaccgguucauuuaaacuugaaaaagaaguagcggaaacacaacacggaacgguacugguacaaaucaaauaugaaggcacugaugcgccuugcaaaauuccguuuucuacccaagacgagaaaggaguaacacaaaaugguaggcugauaacggccaacccaaucguaacugacaaggaaaagccaguuaacauugaagccgaaccaccauuuggugagaguuacauaguaauuggcgccggagagaaggcauuaaaacucucuugguuuaagaaaggauccucuauugggaaaauguuugaggcuacagcacguggagcgaggcguauggcgaucuuaggggauaccgcgugggauuuuggcucaauagguggcgucuucacaucuguuggaaaauugguucaccagauauucggaacagccuaugguguucuauuuucaggcguuaguuggacgaugaaaauuggaaucggaguauuauuaacguggcugggauuaaacagccguucgaccucauuaaguaugacuugcauagcagucgggcuaguaacauuauaucucggcguaaugguacaagcugauucaggaugcguaauuaacuggaaaggacgagaguuaaaaugcgggucaggaauauucgucacuaaugaaguacacacuuggacugagcaauacaaauuucaagcagauucaccgaaacggcugagugcagcaauuggaaaggcuugggaggaagguguguguggaauuagaucggccacacgucucgaaaacauaauguggaaacaaauuucaaaugaacuuaaccacauauugcucgaaaacgauaugaaguuuacuguagucguaggugauguagcagggauacuagcacaaggcaagaaaaugauacgaccgcagccuauggaguauaaguacaguuggaagucaugggggaaggcuaaaauaauaggagcagacguccaaaauucuacauuuauaauagauggaccaaacacuccugaaugucccgaugaucaaagggcauggaacauaugggaaguagaagacuacggauuuggaauuuuuaccacgaacauauggcuaaaauuaagagacuccuauacacaagucugugaccauagacuuaugucggcagcgauaaaggacaguaaagcggugcaugccgauauggguuacuggauugagucggaaaagaacgaaaccuggaaacuagcgagagcaaguuucaucgaaguuaagacauguauauggccaaagucgcauacucucuggagcaacggaguacuugaaucagaaaugauuauaccaaagauauaugggggaccaaucagucagcacaauuacaggccugguuauuuuacccaaacugccggaccguggcacuuggguaaauuagaauuggauuuugaccuuugugaaggaacgacgguuguuguagacgaacauugcgguaaccgugguccuagucuucguacuacaacaguaacaggaaaaaucauacaugaauggugcugucgcucauguacccuaccgccacugagauuuagaggagaagauggauguugguacgggauggaaauuagaccagucaaagagaaagaggaaaaccuagucaaaagcaugguuagcgcugguucgggagaagucgacucauucucccuagguuuacuuuguauaucaauuaugauagaagaggucaugagaucuagauggaguagaaaaauguuaaugacaggcacacuugcaguuuucuucuugcugauuauggggcaacucacauggaacgaccuaauacgccuauguaucaugguaggagcuaaugcaagugauaggaugggaaugggaacaacauaucucgcacucauggcaacguuuaaaaugagacccauguuugcugugggucuacuguucagaagauuaacaucaagggagguuuuauuauuaacuauagggcugucucuuguagcgucagucgaauugcccaauaguuuagaagaacuaggagacggacuagccauggguaucaugauauuaaaauuacuaaccgauuuucaaagucaccaguuaugggcuacauuacugagcuuaacauucauaaaaacuacuuucagccuucacuaugcauggaaaacgauggcaaugguuuuaucaauuguaucacuguucccacuguguuugaguacuacuagccaaaagacuaccuggcuuccaguccuacuuggaaguuuaggguguaagccucuaacaauguuuuuaauagcagaaaacaaaauaugggggaggaaaagcuggcccuuaaaugaaggcauaauggcaguuggaauagucucaauucuuuugagcagcuuacuaaagaaugauguaccuuuagcugguccguuaauugccggugggaugcucauugcaugcuacgugauuucugggaguucagcugacuuaucacucgaaaaagcugcugaagucagcugggaggaagaagcagaacacuccggggcuagucauaauauacugguagaaguacaagaugaugguacaaugaaaauaaaagaugaagaacgugaugauacccuaacaauacuucuaaaagcgacuuuauuggcuguuucgggugucuacccucuuucaauaccggcuacccuauuugucugguacuucuggcaaaagaaaaagcagagaagugguguuuuaugggacacaccaagcccacccgaaguggaacgagcuguacuugaugauggaaucuacaggauuaugcaaagaggauuguuagggcggagccaaguagggguuggcguauuccaagagaacguuuuucauacgauguggcauguuacucgaggcgcuguacugauguaucaaggaaaacgauuggaaccuucaugggcaagcgugaaaaaggaccugaucagcuauggagguggguggagacuacaaggaucuuggaacacuggugaagaaguccaagugauugcuguugaaccugguaaaaaucccaaaaacguccaaacggcgccgggaacguucaagacaccugaaggagagguaggugcuaucgcccuagauuuuaaaccggggacgagugguaguccaaucguuaacagagaagggaagauuguaggcuuauaugguaaugguguuguuaccacgucgggaacuuauguaagugcaaucgcacaggccaaggcuucacaagagggcccacuuccugaaauagaggaugaaguuuuccguaagagaaauuugacaauuauggaucuccaccccgguagcggcaaaacacgacgauauuuaccagccaucgucagagaagcgauaaaaagaaaauuacgaacguuaauauuggcuccaacaagaguaguagcgagugaaauggccgaagcacugaaaggaaugccuauuagguaccaaaccacagcaguaaaaagcgaacauacagggaaagaaauuguagaucugaugugccacgccacauucacaaugaggcuucuaucacccguacguguucccaacuauaauaugaucaucauggacgaagcacacuucaccgacccgucauccauugcugcaagagguuauauuagcacuagaguggggaugggagaggcagccgcaauauucaugacagccacuccuccuggaagcgucgaagcauucccgcaaaguaaugcugucauucaagaugaagaaagggauauaccagaaaggagcuggaauagcggcuaugaauggauaacugacuuccccggcaaaacgguuugguuugugccuuccauaaaagcagggaaugacauugcuaauugcuuacguaaaaacggaaaaagagugauacaguuaaguagaaaaaccuuugauacugaguaccaaaagaccaagaauaaugacugggauuacgucguaacaacagauauuagugaaaugggagcuaacuuccgugcagaucgagucaucgaccccaggcgcugccucaaaccuguuaucuugaaagacggaccggagcgaguaauuuuagcagguccgaugccagucaccguagcuucggccgcacaaaggcgaggaaggaucggacgcaaccacaauaaggaaggagaucaauacaucuacaugggacaaccccuaaauaaugacgaagaucaugcccauuggacagaagcaaaaaugcuauuggauaacaucaacacccccgaggggauaauucccgcccucuuugaaccugagcgugaaaaaucugcagcgauugacggagaauauagguuaagaggagaagcgcgaaaaacauuuguagaacuaaugcgaagaggcgaccuaccaguauggcucuccuauaaaguugcaucggaagguuuccaauauagcgacagaagaugguguuuugacggugagcguaauaaccagguacuagaagaaaacauggacguagaaaucuggaccaaagaaggggaacgaaagaaauuacgcccacguuggcuagaugcaagaacauacucagauccucuugcguuacgagaauuuaaagaguuugcugcugguaggcgaaguguuagcggugaucugauacuagaaauagggaagcugccucaacaucuuacacagcgagcucagaaugcgcuagauaaucuaguaauguuacauaacagugaacaaggagggagagcuuauagacacgcuauggaggaguuaccagauacaauagaaaccuuaaugcuauuagcccuaauagccguacuuacaggaggggugacauuauuuuucuuaucaggaaaagggcuugguaaaacauccauaggacuauuaugcguaauggcaucaucgguacuauuauggauggcuucaguggaaccucauuggauugccgcaagcauuauccuugaauuuuucuuaauggucuuauuaauucccgaaccagauaggcagagaacuccacaagauaaucaacuagcuuauguagucauaggucuacuauuuaugauacugaccguagcggcaaaugaaaugggacugcuagaaacaacuaaaaaggaccuuggaaucggacacguagcgguugaaaaccaccaucaugcagcgauguuagacguagauuugcacccugcgucagccuggacucuauacgcggucgccacaacaauaaucacacccaugaugagacauacuauagaaaauacuacggcgaacauaucgcuaacggcgauagcaaaucaagcagcaauccugaugggacucgauaaagguuggcccauaucgaagauggacauaggggucccguuacucgcccucggauguuacucgcagguuaauccauugacucuuacagcugcaguucuaauguuaguugcacacuaugccauuauaggacccggguuacaagcaaaagccacaagggaagcacaaaagcggacagccgcaggaauaaugaagaacccuacuauugauggaaucguugcuauugacuuagacccaguggucuacgaugcaaaauucgagaaacagcuuggucaaaucaugcuauugauacuaugcacgucacaaauccugcuaaugagaacaacaugggcacugugugaaucuaucacacuagcuacagguccuuuaacgacccucugggaagguucaccggguaaauuuuggaauacaacaauagcuguaucaauggcuaauauuuuccguggaucguaccucgccggagcuggacuggccuuuucgcugaugaagucuuugggaggaggacgaagaggaacuggugcacaaggugaaacgcuuggcgaaaaauggaagcgccaacuaaaucaacuaagcaaaagugaguucaauacauauaagcggucaggcauaauggaaguagaucggucugaagcaaaagaaggauuaaaaaggggcgagacgaccaaacacgcagucucgagaggaacagcuaaauugagaugguuugucgagcguaaccucgucaaaccagaaggcaaaguuauagaccugggauguggaagagggggcuggucauauuauugugcgggucucaagaaagucacggaaguaaagggauacacaaaaggugguccgggccacgaagaaccaaucccaauggcuacauauggauggaacuuaguaaaguuacacagugguaaagacguauucuucauacccccagaaaaaugugauacacuccuaugugauauuggcgagucaagcccaaauccaaccauagaagagggccggaccuuaagagucuuaaagaugguugagccauggcucagaggaaaucaauuuugcauaaaaauacuaaaccccuauaugccaucaguaguagaaacgcuugaacaaaugcaaagaaaacauggcggaaugcucguccggaauccauugucgcgaaacagcacucacgaaauguacuggguaucuugugguaccggaaacauaguuagugcgguuaacaugacaagccgcauguuauuaaaccgcuuuacgauggcucaccgaaaaccgacauaugaacgagauguugauuuaggggccggcacuagacacguugccgucgaaccggaaguggcaaaccuagacauaauugggcaacgaauagaaaacauuaagcacgagcauaaaucuacauggcauuaugacgaggauaacccuuauaagacaugggcauaucacggaaguuaugagguuaaaccaagugguagugccagcucuauggucaacggaguaguaaaacuuuuaacgaagcccugggacguuauacccauggugacacaaauugcgaugacugauaccacuccguucggacaacagcgaguauucaaagaaaaagucgacacccgaacaccuaaggcuaaaagaggaacagcucaaaucauggagguuacagcacgauggcuauggggcuuuuuaucuaggaauaagaaaccuagaauuugcacuagagaagaauuuacuaggaaaguacgcagcaaugccgccaucggggccguuuucgucgaugaaaaccaauggaauagugcaaaggaagcuguggaagaugauagauuuugggauuuaguccacagagaacgagaguugcauaagcagggaaagugugcuacauguguguauaacaugaugggaaaacgugagaagaaacuaggagaauuuggaaaagcaaaaggcucaagagcaauuugguauauguggcucggugcgcguuuucuagaguucgaagccuuagguuuuaugaacgaagaccauugguucucgagagaaaacucacugagcggcguugagggggaagggcuacacaaacuggguuauauucuucgcgauauaagcaagauaccaggagguaacauguacgcugaugauacugcugguugggacacuagaauuaccgaagacgauuuacaaaacgaagcaaaaauuacagacaucauggagcccgaacacgcguuacuagcaaaaucgaucuucaaacuaacguaucagaacaaaguuguccggguucaacgaccagccaaaaacggaacagugauggaugugauuagcagacgugaccagcguggaagcggccaagucggcacuuacggccucaauacauuuacuaauauggaagcacaacugauaagacagauggaaucagaaggcauauucuccccgaaugaguuagaaacgccaaacuuagcagaaagaguacucgauugguuggaaaaauaugguguugaaagacuaaaaagaauggcaauuagcggggaugacugcguagugaagccgauugacgaccguuuugcaacugccuuaacggcguuaaaugauaugggcaaaguacguaaagauaucccucaaugggaaccuucgaaaggauggaacgauuggcaacaaguaccauuuugcucgcaucauuuucaucaacuaauaaugaaggaugguagagagauaguaguacccuguagaaaucaggaugaguuagucggacgugcacgcguuucacaaggugcugguuggucccuacgagaaacggcgugucuagguaagaguuacgcacaaauguggcaguugauguauuuccauagaagagaucuucgauuagcugcuaacgcuauaugcucugcaguaccgguagauuggguaccgacgagcagaacuaccuggaguauccacgcacaccaccaauggaugacaacugaagacauguuaucggucuggaacagaguauggauugaagaaaauccuuggauggaagauaaaacgagaauaucuucgugggaagauguaccguacuuagggaaaagggaggaccaauggugugggucgcuaauaggcuuaacagcacgggcaacaugggcaacuaacauucaaguugcaauaaaccaaguucgacggcuaaucggaaacgaaaauuauucagacuacaugacuuccaugaaaagauuuaagaaugaaucagagccagaaggagcacugugguaa

SEQ ID NO: 21368 - RNA, 9879 nt, Artificial Sequence
  derived and/or modified CDS sequence (opt6) from DENV-1__FJ850068__SS-prME
ucagugacgaugcuccuaaugcugaugccgacugcguuagcuuuucauuugacaacacgcggaggggaaccccacaugauagugagcaaacaagaaagaggcaaaucccuauuauuuaaaacuucggcuggagucaauauguguacucuuauugcuauggauuuaggagaauugugugaagacacaaugacguauaaauguccaagaauuacagaggcugaaccugacgacguggacugcugguguaacgcaacagauaccugggucaccuacggaacgugcagccaaacaggugaacaccggagggacaaaagaucuguggcgcucgccccucauguagggcucggauuagaaacaagaacagaaaccuggaugagcagugaaggugcauggaaacaaauacagcgugucgaaacaugggcacucagacacccagguuucacaguuauugcccucuuccucgcacaugcaauugggacgagcauaacacaaaaaggcauaauuuuuauauugcuaaugcuagugacaccuaguauggccaugcggugcguagggauuggaucgagagauuuuguagaagguuuaucaggcgcaacguggguggaugucguguuagagcacgguaguuguguuacaacuauggcuaaagacaaaccuacucuugacaucgaacuacugaaaacagagguuacaaaucccgccguauugcguaaacuauguauugaagccaaaaucucuaacaccacuacagauucgcggugucccacacagggagaggcaacccuaguugaggaacaagacgccaauuucgucuguagaagaacuuuuguagaucgagguuggggaaaugguugugggcuuuuuggaaaagguagccuguuaacaugugcuaaauuuaaauguguaacaaaacuagaagguaaaauaguacaauaugagaaccuaaaauauagugugauaguuacugugcacacaggagaucagcaccagguugggaacgagaguaccgaacacgguaccacugcaaccauuacaccccaagcaccaacgacagaaauacaacuaacagacuacggugcucuaacauuagacuguucaccacguacgggucucgauuuuaaugaaaugguuuugcuuacuaugaaagaaaaaucaugguuaguucauaaacaaugguucuuagauuugccauuaccauggacaaguggugcuaguacgagucaagagacauggaauaggcaggauuuauuaguuaccuucaaaaccgcccacgccaagaaacaagagguaguuguucucggaucgcaggagggagcuaugcauacugcacuaacgggcgcgacugaaauacaaacauccggaacgacaacaauuuuugcaggacauuuaaaaugucgacuaaaaauggacaaacuaacuuugaaggguaugagcuauguaaugugcaccgggucauuuaagcuagaaaaagagguugcugagacacaacauggaacugugcuuguucagauuaaauaugaaggcacagaugccccuuguaagauuccguuuuccacacaagacgaaaaaggaguuacacagaauggcagauuaaucacugcaaaucccauagugacugacaaggaaaaaccaguaaauauagaggcugaaccaccuuuuggugaaucauauaucguaauaggagcgggagagaaagccuugaaacucagcugguuuaagaaagguuccuccauaggaaaaauguuugaggcgacagcucggggugcaagaagaauggcuauuuuaggugacacagcaugggauuucggaucaauuggcggaguauuuacaucaguaggaaaauuaguacaccaaaucuuuggcacugcuuacggcgugcucuuuucuggagugagcuggaccaugaaaauuggaauaggcguguuguugacauggcucgggcuaaauucgagaucaacgaguuugucaaugacuuguaucgcgguugguuuaguuacguuauauuuaggcgugaugguacaagcagauucuggcugcguuauuaauuggaaaggucgugaauuaaaaugcggaucggggaucuucguaacaaaugaaguccauacauggaccgaacaauacaaguuucaagcagacuccccgaaaagacugucggcggcaauaggaaaggccugggaagaaggcguuugcggaauacgaucagcuaccagacuagaaaacauaauguggaaacaaauaagcaaugaguugaaucauauauuauuagaaaaugacaugaaauuuacagugguugugggugacguugcaggaauauuggcgcaggggaagaaaaugauacgcccacaaccuauggaguauaaauacuccuggaaaucaugggguaaagcaaaaaucauaggagcugacguacaaaacagcacguucauuauugaugguccuaacacaccggaaugcccggaugaccaaagggcuuggaauauaugggagguagaagauuacgguuuuggaauauuuacaaccaauauuugguuaaaguugcgagacucuuacacucaaguaugcgaucaucgauuaauguccgcugcaauaaaagauagcaaagcaguacacgcagacaugggguacuggauagaaucagagaaaaaugaaacuuggaaacuugcuggagccagcuucauagaagucaaaacuuguauuuggcccaaaagccauacguuauggucaaaugguguauuagaaucggaaaugauaauaccgaaaauuuacggcgggccuauuagucaacauaauuaccguccugguuauuuuacucaaacagcagguccauggcaucuaggaaaacuugaacuugacuuugaucuaugugaaggaacuacggugguaguagaugagcacugugguaacaggggcccaucguuaaggacaacuacaguuacaggaaaaauuauacacgagugguguugucguaguuguacucuaccacccuuaagauuuagaggagaagacggcuguugguauggaauggagauuagaccaguuaaagaaaaggaagagaaucucgugaaaucaaugguaucagcaggaaguggcgaaguagauucauuuaguuuaggauuguuaugcauaucuaucaugauagaagaagucaugaggagucgauggucuagaaaaauguuaaugacaggaacauuagcuguauucuuucuucuuaucaugggucagcuaacuuggaaugacuuaauaagacucuguauaauggugggagcgaaugcuucugaucgaaugggaaugggcaccacauaucuugcucugauggccacauucaaaaugcgaccuauguuugcuguaggauuacucuucagaagauuaacaaguagagagguacuguuguuaacuauugggcugucucucguugccucuguugaacuccccaacucauuagaagaacuuggagacggccuagcgaugggcaucaugauacuuaaacuacucacggauuuucaaucgcaccaauugugggcgaccuuauugucucuaacuuucaucaaaaccacauucucguuacauuaugccuggaaaaccauggcaaugguuuuaucaauaguaagccuauucccucuaugcuugucaacuacgagucagaaaacgacguggcuacccguucuuuuaggcucauuaggcuguaagccucuaacgauguuuuuaauugcggaaaacaaaauauggggucgaaaauccuggccguuaaaugaagguauaauggccguaggcauuguuucaauacuauugucaucauuauuaaagaacgacguucccuuagccgggccacuuauugcgggaggcauguuaauagcauguuacguuauaagugggaguucggcggacuuaaguuuagaaaaagcagccgagguuucaugggaagaagaagcugagcauucaggggcuucccacaacauccuaguggaaguacaagaugauggaacuaugaagauaaaagacgaagagagagacgacacucuaacuauucuacugaaagcaacacuauuagcuguuagugguguuuauccucuaaguauucccgccacacucuuuguaugguacuuuuggcagaagaagaaacagagauccgggguucuaugggauacaccuucuccuccagagguagaaagagcaguauuggaugacgggauauaucguaucaugcaacgaggucuauuaggccgcucacaagugggcgucggaguauuccaagaaaauguuuuucauacaauguggcaugugacucgcggagcaguacucauguaccaaggcaaacgacuggaaccaucgugggcgagugugaagaaagaccugaucaguuauggagggggauggagacuacaggggucauggaauaccggggaagaaguccagguaauugccguugaaccaggaaagaaccccaaaaauguacaaaccgcacccggaacguucaaaaccccagaaggcgaagucggagcuaucgcacucgauuuuaaacccgggaccucaggaucuccuauagucaaucgggaagguaaaauagugggauuauacgguaauggaguaguaaccaccagugguacauaugugucggcuauagcacaagcuaaggccagucaggaaggaccguugccagaaauagaagacgaaguuuuucguaaaagaaaucuuacgauuauggacuuacacccaggaucuggaaaaacucguagguaccugccugcaauaguccgugaagcaauuaaaagaaaacuaaggacgcuaauacuugcaccgacuagagucguggcaucagagauggcggaagcgcugaaaggaaugccgauccgcuaucaaacuacagcggugaaaagugagcauacuggaaaagagauuguagauuuaaugugucaugcaacauucacaaugcggcuauuaucuccuguaagaguuccaaauuauaauaugauaauuauggaugaggcucacuucacagauccuaguuccauugcugcuagaggcuacauaaguacacguguggggaugggagaagcugcugcgauauucaugacugcgaccccgccagguucugucgaagcguuuccucaauccaaugccguaauacaggacgaagagagggacauacccgaaaggucuuggaacucggguuaugaauggauuacugacuuuccugguaaaacaguuugguuugugccgucuauuaaggcugggaaugauauugccaauugucugcguaagaauggaaaacgaguuauucaacuuucaagaaaaacuuucgauaccgaguaccagaaaacuaagaauaacgauugggacuaugugguaacuacagauauaagugagaugggagccaauuuccgagcagacagagugauugauccccguagauguuugaagccagugauauugaaagaugggccagagcgaguaauacuagcugggccuaugccgguaacgguagccucagcggcacaacgacgaggucgaauaggacgaaaccauaauaaagaaggagaccaauacauauauaugggacaacccuuaaauaacgaugaggaccaugcgcacuggacggaagccaaaauguuauuagauaacauaaacacaccggagggaauaauaccugcacuauucgaaccagaacgugagaaaagcgccgcaauagauggugaguaucguuuaagaggagaagcuagaaaaacuuuuguagaacugaugaggagaggagaucuuccagucugguuaagcuacaaaguugccagcgagggcuuccaauacagcgauagaaggugguguuuugacggagaacggaauaaccagguauuagaagaaaacauggauguagaaauauggacgaaagaaggcgagagaaagaaacuacgaccucgauggcuugaugcucggacauacuccgauccauuggcacuucgugaguuuaaggaauuugcagcagggaggcgcucagugucuggcgaccuaauacuugagauuggcaaauuaccgcaacaccuaacacaaagagcgcaaaacgcucucgauaaccuuguuauguugcauaauucggaacagggcgggcgggcauauagacaugccauggaggagcucccagacacaauagaaacguuaaugcuacuugcccuuauagcuguucuaaccgguggaguaacacuauucuucuugucaggcaaaggucuagggaaaacaucgauaggguuauuauguguaauggccucuaguguuuuauuguggauggccaguguagaaccacacuggauagccgcuaguauaauauuagaguucuuuuuaaugguauugcuuauaccagaaccagacagacaacgaacaccucaggauaaucaauuagcuuacguaguaauaggacuccuguucaugauacuaacuguugcggcgaaugaaaugggguuacuagaaacaaccaagaaagauuuaggaauuggucacguagcaguagaaaaucaucaccacgcggccaugcuagauguagauuugcauccagcaucggcauggacucucuacgcaguagcaacuacuauuauaacuccuaugaugaggcauaccaucgaaaauacaacggcaaauauaucacugacagcgaucgccaaucaagcagccauuuugaugggauuggacaaaggauggccuaucucgaaaauggacauagggguaccauuacuugcgcuaggcuguuacucacaagugaauccguuaacauugacggccgccgucuugauguuggucgcacacuaugcaauuaucggcccagggcuacaggcgaaagcaacuagggaagcacaaaaacgaacagcagcggguauaaugaaaaauccaacaaucgacgggauaguagccauagaccuagacccaguaguuuaugaugcaaaauucgaaaaacaauuaggucaaauuauguuauuaauccuaugcacuucgcagauacuucuuaugcggacgacgugggcauugugugaaucuauuacacuagcaacaggaccguugacaacacugugggaaggaucgccaggaaaauuuuggaacacaacuauugcuguuucaauggcuaacauuuuucggggaucguacuuagcuggugccggacuagcauucagccucaugaagucccuaggaggagguagacgugggacuggagcccaaggagaaacuuugggggaaaaauggaaaagacaguugaaccaguuaucuaagagcgaauuuaacacauacaaaagaaguggaauaauggaaguugaucgcagugaagcaaaggaaggcuuaaagcguggugaaacuacaaaacaugcugugucgagggguacagcaaaauuaaggugguucgucgaaagaaaucucguaaagccggagggaaaaguaauagaccuaggauguggucguggcggguggucauauuauugugcgggucuuaagaaagugacugaagucaaaggguacacaaagggaggaccggggcaugaggaacccauuccuauggccacguacggcuggaaccuuguuaaacuacauagcgggaaggauguuuucuuuauaccaccagagaaaugcgacacacuauuaugugauauuggugaaucuaguccaaauccaacuauagaagaagguagaaccuugcgcguacuaaaaaugguagaaccaugguuaagaggcaaucaguuuuguauuaaaauucucaauccauauaugccuucuguuguugagacccucgaacaaaugcaacgaaaacauggaggaauguugguucguaauccacuuaguagaaauagcacacacgaaauguacuggguaucaugcggaaccggcaacaucgucucagccguaaauaugacuucucguaugcuauuaaauagauuuacaauggcacaucgaaagccuacauaugaacgugauguggaucucggagcggguacuaggcacguagcuguagaaccggaaguugcuaauuuagauaucauaggacagagaauagaaaauauaaaacaugaacauaaaagcacauggcauuacgaugaagacaaucccuauaaaacuugggcauaucacgguucuuaugaggucaaaccuagugguucugcuagcucuaugguuaacggaguagugaaauuacucacaaagccaugggaugugaucccuauggugacacaaauagcaaugacggacacaaccccuuuuggucaacagcguguauucaaagaaaagguagauacaaggacgccaaaagcaaagagagguaccgcucaaauaauggagguaacagcacgcuggcuauggggcuuccuaagucguaacaagaaaccaagaauauguacuagagaagaauuuacaagaaaaguccguucuaaugcagccauuggagcggucuuuguggacgaaaaucaauggaacucugccaaagaagcgguagaagaugaucgauuuugggauuuagugcauagagagcgcgaauuacacaaacaaggcaagugugcaacguguguguauaauaugauggggaagagagagaagaaauuaggagaauuuggaaaggcaaaaggaucgcgugcaauaugguauaugugguuaggcgcaagguuuuuggaauuugaggcccuugguuuuaugaaugaagaccauugguuuuccagggagaacagcuuaucuggugucgagggugaaggacuucacaaacuaggguauauccuuagagacaucucaaaaaucccagggggaaauauguaugcggaugauacugcuggcugggacacuagaauaacggaagacgaucuacaaaaugaagcuaaaauuacagacauaauggaaccagaacaugcacuauuagcaaaaagcauauuuaaacuuacuuaccaaaauaaaguaguacgaguacaaagaccagcgaaaaauggcacaguuauggauguaauuucaagaagagaucaaaggggaaguggucaagucggaacauacgggcuaaacacuuucacaaacauggaggcgcagcuaauaagacagauggaaucagaggguauauucagcccaaaugaacuugaaacaccuaaucuugcagaacguguacucgauuggcuugaaaaauacgguguugaacgauuaaagagaauggcuauuaguggugaugauugcguaguaaaaccgauugaugaucgauuugcuacggcucucaccgcccucaaugauauggggaaaguucggaaagacaucccucaaugggagcccaguaaaggauggaaugauuggcaacagguaccauucugcucgcaucacuuccaucaauuaaucaugaaggacggaagagaaauagugguuccuugcagaaaccaagaugaguuaguuggaagggcccguguaagccagggcgcgggguggucuuugcgcgaaacggcuugucuagguaaaucuuaugcacagauguggcaauugauguauuuccauagacgugauuuaaggcuagcagcaaaugcuauaugcucagcaguacccguagacuggguacccacaucacggacaacuuggaguauccaugcacaucaucaauggaugacuacagaagauauguuaagcguuuggaacagaguuuggaucgaagaaaacccauggauggaggacaaaacucgaauuuccucaugggaagauguuccguaccuagguaagcgugaagaucaauggugugguucccuuauaggauuaacagccagagcaacaugggcuacaaacauccaaguggcaauaaaucaaguaagaaggcuuauuggaaaugaaaauuacagcgauuauaugacaaguaugaaacgguucaaaaaugaaagugaaccugagggugcauuaugguaa

SEQ ID NO: 21369 - RNA, 9879 nt, Artificial Sequence
  derived and/or modified CDS sequence (opt6) from DENV-1__FJ687430__SS-prME
agcguuacaaugcuauuaaugcuaaugccgacagcacuagcuuuccauuuaacaacuaggggcggcgaaccacauaugauaguaucuaaacaagaaagagggaaaucauuacuauucaaaacaagcacgggcguaaacauguguacauugauagcgauggaucuuggagaauugugcgaagacacaaugacauauaaauguccuagaauuacugaagcagaaccggaugauguagauugcuggugcaaugcgacagauacuuggguaacuuauggaacauguucacaaacaggcgaacaucgcagagauaaaagaucuguugcauuagcuccucauguaggguuaggguuagaaacaaggaccgaaacuuggaugucaagugaaggagcauggaaacaaauacagaaaguggaaacaugggcacuuagacacccuggauucacaguaauagcucuuuuucuugcucaugccauagggacaaguauaacgcaaaaagguauuauauucauuuuacuaaugcuaguaacgcccucuauggcgaugagaugcguaggaauaggcaguagggacuucguagaaggacuaucuggagcuacauggguugauguugugcuagaacauggcuccugcgugacgacaauggcgaaagacaaaccaacauuagauauagaauuauuaaagacagaagucacaaacccagcuguacugcguaaauuauguauagaagcuaaaauuaguaacacgacaacagauaguagauguccgacucaaggcgaagcaacccuaguagaagaacaagacgcuaacuuuguauguagacgaacguuuguggaccgggguuggggcaaugguuguggacuauucgguaaaggcucacuaauuacgugcgcaaaauucaaauguguuacaaaacuugaaggcaaaauaguacaauaugaaaaucuaaaauacucuguaaucguaacgguccacacuggggaucaacaucaaguagggaacgagucuaccgaacaugguacaacugcaaccaucacuccacaagcgccuacaacagaaauucaacuaacggauuauggcgcccuuacacuggacugcucaccaagaacuggacuugacuuuaacgaaaugguucuucuaaccaugaaagaaaaaucauggcucguacauaaacagugguuuuuagaccuuccacugccguggacaaguggagcuucuacaagccaagagacauggaauagacaagaucuccuaguaacauuuaagaccgcacaugcaaagaaacaagagguuguggucuuagguucucaagaaggggccaugcauacugcacuuacuggugcgacagaaauucaaacgucggggacaacuaccauauuugcagggcaccuuaaaugucgacuaaaaauggacaaauuaacgcuuaaaggaaugucauacguaaugugcacagguaguuucaaauuggaaaaagaaguggcagaaacacagcauggaaccauucuggugcaaauaaaguacgaaggcacggaugcuccauguaagauaccuuucucuacccaggaugagaaaggagugacucaaaauggacguuuaauaacagcgaaucccauagucaccgauaaggagaaacccguaaauauagaggcagaaccgccuuucggcgaaucguauauuguaauaggggccggagaaaaagcgcuaaaauugagcugguucaagaaagguuccucaaucggaaaaauguucgaggcgacggcaagaggggcaaggaggauggcuauauuaggggauacagccugggacuuugguucuauuggaggaguauuuacuucagucgggaagcuaguacaccaaauauucggcacggcauauggcguacuguucucagggguuuccuggacaaugaaaauaggcauuggagugcucuugacuuggcugggucuaaacucaaggucaacaaguuugucaaugaccuguauugccguaggccuaguuacgcuauauuuaggugucauggugcaggcagacucuggguguguaauuaauuggaagggcagagaauuaaaguguggcagugguauauuugucacaaaugaaguccacacauggacugaacaauauaaguuccaagcagauuccccaaaaagacucucugcugcuauuggcaaagcgugggaagaagguguuugcggcauuaggucagcuaccaggcuggaaaauauuauguggaaacaaauaaguaaugaauuaaaucacauacuacuagaaaaugauaugaaauuuacaguaguugugggagaugucgcuggaauacuugcacaaggcaagaaaaugauuagaccacaaccgauggaauacaaguacaguuggaaaucuuggggaaaagcgaaaauaaucggugcugacgugcaaaacgcgacuuucaucauagacggccccaauaccccugaaugcccagaugaucaaagagcuuggaauauuugggaaguugaggauuauggguucgggauauucacgacgaacaucugguuaaagcuccgagauucguauacacaaguuugugaccaucgucuaaugagcgcagcaauuaaggauuccaaagccguccacgccgauaugggauacuggauagagagugagaaaaaugaaacguggaaauuggcgcgugcauccuuuauugaagugaaaacuuguauauggccaaaaucucacacacuauggagcaaugguguacuagaaucagaaaugauuaucccaaaaauauauggcggcccgauuucacaacauaauuauagaccggguuacuuuacgcaaacagcaggaccauggcaucuaggaaaauuagagcuagauuucgaucuaugcgaaggcacuaccgucguaguagacgaacauugugguaaucgaggaccuuccuugcgaacaacgacugugacagguaaaauuauacacgagugguguugccguucuuguacucuuccgccgcucagauuucgaggggaggacggauguugguacggaauggagauucgaccgguaaaagaaaaagaggaaaaccuagugaaguccaugguaucugcuggaucaggagaaguugacucguucagucuaggccuauuguguaucaguauaaugauagaagaaguaaugaggaguagaugguccagaaaaaugcuaaugacagguacccuagcagucuucuuucucuuaauaaugggacaauuaacauggaaugacuuaauucgauuauguauaauggucggagcaaaugcaucugauaaaaugggaauggguacuacuuauuuagcuuuaauggcuacauuuaagaugcggccaauguuugcagugggcuuacuauucagaaggcugacuagcagagaaguauuguuguuaacgaucggguuaucccuagucgcuucaguagaacuaccaaauucucuggaagaacuaggggacgggcucgcuauggguauaaugaucuugaaguuacuaacagacuuccaaagccaucaacuaugggccacauuauuaucguugacguuuauuaaaacuacauucaguuuacacuaugcuuggaaaacaauggcgaugguccuaagcauaguauccuuauucccacugugccuaucgacaaccucacagaaaacuacauggcucccaguucuucuagggaguuuagguugcaaaccuuugaccauguucuugauugcggaaaauaaaaucuggggcagaaaaagcuggccauugaacgaagggauaauggcuguggggauuguuaguauacuacuuaguagcuugcuuaagaaugacgugcccuuagcaggaccauuaauugccggagguauguuaauugcauguuauguuaucagugggagcuccgcagauuuaucauuggaaaaagcagcagaggucucaugggaagaggaagcggaacauucaggggcaucccauaauauauuaguugaagugcaggaugauggaacaaugaaaaucaaagaugaagaacgugaugauacauuaacgauauuauuaaaggcgacuuugcuagccguuaguggaguuuauccuuugagcauccccgcuacguuguuuguaugguauuuuuggcagaagaagaaacaaagaagcggaguacuuugggacacuccaucgccgccugaaguugaacgagcgguucuagacgauggcauuuaccgaauaaugcagcgaggacuguuaggucgcucacaagucggaguggguguauuucaggaaaauguauuccacacuauguggcacguuaccagaggggccguacucauguaucaagggaaaagauuagaaccaucaugggcaagcgucaagaaagaucugauaaguuaugguggaggguggcgcuuacaagggucuuggaacacaggugaagaaguucagguuaucgcaguugaaccugggaaaaauccaaagaacguacaaacagccccuggcacuuuuaagacaccagaaggagaagucggugcaaucgcacuugauuuuaaaccugguacaucugggucaccuauuguuaauagggaaggaaaaauagugggauuauacgggaauggaguaguaaccacuucagguacauauguaucugcaauagcacaagccaaagcaucucaggaagguccacuaccugaaauagaagaugagguauucagaaaaaggaaccugacuauuauggaccuucacccuggaagugggaaaacacgucguuaucuuccagcuauaguaagggaagcuauuaaaagaaaacuuaggacguuaauucuugcuccuacgcgcgugguggccucggaaauggcugaagcccuuaaggggaugccaauuagauaccagacaacggcuguuaaaagcgagcacaccggcaaagaaauaguggaccuuaugugucaugcaacguucacuaugcgcuugcuuucaccaguucgagugccuaauuauaacaugauuauuauggacgaggcccauuuuacugauccaagcagcauagcugcaagggguuacaucuccacaaggguuggaaugggugaagccgcugccauuuucaugacugcuacucccccuggaucaguagaagcauuuccgcaaucaaaugcagucauacaagacgaagaaagggacauuccagagagaucauggaacuccggauacgaguggauuaccgauuuccccgguaaaacagucugguuugugccguccaucaaaaguggaaaugauaucgccaauugccucaggaaaaaugguaaaagagucauucaauuauccagaaaaacguucgauacugaauaucaaaagacgaaaaauaaugacugggacuauguaguaacaacugacauaucagaaaugggagcaaacuuuagagcugacaggguuauugauccgcguagaugucuaaagcccgugauacuuaaagacgguccggagcgaguaauacucgcgggcccuaugccaguuacaguggcaucugcagcucagagaaggggacgaaucggacggaaucauaacaaagagggagaccaauauauauauaugggacaaccauugaauaaugacgaagaccaugcucacuggacggaggcgaaaaugcuguuagauaacauaaacacgccagagggcaucauaccugcccuguucgaaccagaacgcgagaaaucggcggcgaucgauggagaauauagacuacguggagaagcucgaaaaacuuucguugagcuaaugcguaggggugaccugccuguaugguuaagcuauaaagucgcaucagagggauuucaauauucugaccgacgaugguguuuugacggggaaaggaacaaccaagugcucgaagaaaacauggacguggagauauggacuaaagaaggagagagaaagaaacuacggccacgauggcucgaugcaagaacauacagugacccccuugcucuuagagaguucaaagaauuugcagcuggaagaaggaguguuucaggagauuuaauacuugaaauugguaaauuaccucaacacuuaacucaaagggcgcaaaacgcuuuagacaaucugguaauguugcauaacagcgaacaaggggguagggcguauagacacgcucuugaggaguuaccggauacaauagagacuuuaauguuauuagcguuaauagcgguucuaacuggaggcguuacacuguucuuuuuaucgggucggggucuugguaagacaaguauuggacuguugugcgugauggcaagcagcguacuauuauggauggccucaguugagccccauuggauagccgcuagcauaauauuggaauuuuuccuaaugguacuucuaauaccugaaccugacagacaacguacaccucaagauaaucaacuagcuuacguaguaauaggacuauuguuuaugauccucacaguugcagcuaacgaaaugggguuacuagaaacgacgaagaaagauuuggguauaggccauguagcaguagaaaaucaucaccaugcaaguaugcuugacguagauuuacauccggcgucggccuggaccuuguacgcaguagcuacaacuauaaucacaccaaugaugcgacauacaauagaaaauacuacagccaauauuucucuaacagccaucgcuaaccaagcagccauacucauggggcuggacaaaggauggccaaucucaaagauggauauugggguaccauuacuugccuuaggcuguuauucucaaguuaacccccucacuuuaacagcugcuguuuugaugcuuguagcucacuaugcuauaauagggccuggacugcaggccaaagcgacgagagaagcucaaaaacgaacugcagcagggaucaugaaaaauccgacaguagauggaaucguugcuauagaccuugauccuguuguauacgaugcaaaauuugaaaaacaacucggacaaauaaugcuuuuaauauuaugcacaucacaaauauuguuaaugcgaacaacgugggcauuaugugaaucgauuacccuagcgacggguccucuaacaacauuaugggaaggaagcccuggaaaauucuggaacacaacgauugcagugucaauggcaaauauauuccggggcuccuacuuagccggagcuggacuugcguuuuccuuaaugaaaucauuaggagggggaagacgaggaacaggcgcacaaggagaaacgcucggagaaaaauggaaaaggcaacuuaaccaguuaucgaaaagugaguuuaauacguacaaaagaaguggcauuauggaaguagauaggucggaagcgaaagaaggacuaaagcggggugaaaccacuaaacacgcgguuagccgggguaccgcaaaauuacguugguucguugaaagaaaccuuguaaaaccugaaggaaaaguuauagaccuggguugcgggcgcggaggcuggucuuauuacugugcaggucugaagaagguuacagagguuaaagguuauaccaaagggggacccggacacgaagaaccaaucccuauggcuacuuauggauggaaucuuguuaagcuacacucuggaaaagaugucuucuuuauuccaccggaaaagugcgauacauugcucugcgauauaggagaaucaucccccaauccuacuauagaagaaggaagaacucucagaguccuaaagaugguagaaccuuggcuuaggggaaaucaguuuuguauaaaaauacuuaauccuuacaugccuucaguaguagagacacucgaacaaaugcaaagaaaacauggcggaauguugguucggaauccgcugagucgaaacaguacccacgaaauguacuggguaucaugugguacaggaaauauuguaucggccguaaauaugacuuccagaaugcuucucaaccgguuuacaauggcccacagaaaaccaaccuaugaacgggauguagauuuaggugcaggcacaaggcauguagcaguagagcccgaaguagcaaaccuagauauaauuggccaacgaauagaaaauauaaaacaugaacauaaauccacauggcauuacgaugaagauaaccccuauaaaacaugggcauaccacgguucauacgaggucaaaccuagugggagcgccucaagcauggucaauggagugguaaaacuuuuaacgaaaccaugggacgugauuccaaugguuacgcaaacagcuaugacagacacuaccccguuuggacagcaaaggguuuuuaaagaaaaaguagauaccagaaccccuaaagcuaaacgaggcacagcgcaaauuauggaaguaacugcacgauggcuauggggauuccuaagcagaaauaagaaaccuaggauaugcacgcgggaagaguuuacuaggaaagucagaucaaaugccgcgauuggagcaguuuuuguagacgagaaucaauggaacuccgcuaaagaagcgguggaagacgaaagauucugggaccugguacauagagaacgugaauuacacaaacaaggcaaaugcgcaacaugcguauauaacaugauggggaaacgcgagaagaaacuaggugaguucggaaaagcaaaaggaucuagagcuaucugguauaugugguuaggggcaagauuuuuggaauuugaagccuugggauuuaugaaugaagaccacugguuuagcagagaaaauucgcuaucagguguagagggagaaggucuucauaaauuaggauauauauuaagagacauuucuaaaauccccggagguaauauguacgcagaugauacggcggguugggacacccgaauaacugaagaugauuugcaaaaugaagcuaaaauuacagauauaauggaaccugagcacgcgcuauuagcuaaaucuauauuuaaacugacuuaccaaaacaaaguuguaagaguacagcgacccgcaaagaauggaacaguuauggacguaauuucucggcgggaccagaggggauccggacaaguuggaaccuauggcuuaaauacguucaccaacauggaagcccaauuaauacgacaaauggaaucagaaggaaucuucucacccagcgaauuagaaacucccaaucucgcagaacgaguuuuagauugguuagagaaguauggaguagaaaggcuuaaaaggauggcaauaucaggcgacgauugcguuguaaagcccauagaugaccgauuugccacagcacuuaccgcacuuaacgauauggguaagguaagaaaagacauaccgcaaugggaaccaaguaagggcuggaaugacuggcaacaagugccauucuguucacaucauuuucaucaauuaaucaugaaagaugguagagaaauuguuguaccauguagaaaucaagaugaguuagucggaagggcuaggguaucucagggggccggguggucguuaagagagaccgcuugccuaggaaaguccuacgcgcaaauguggcaacucauguacuuccauaggagggaucugcggcuggcagccaaugcuauauguagugcaguaccgguagacuggguuccgacuucuagaacuaccuggaguauacaugcgcaccaccaauggaugaccacggaggauauguuaucaguuuggaaccgugucuggauugaagagaauccguggauggaagauaaaacacauauaaguucaugggaagauguccccuauuuaggaaaacgagaagaucaauggugcggaagccucauuggucucacggcaagagcuacaugggcuaccaauauucaaguagcaauuaaucaagugagacguuuaauuggaaacgaaaauuauuuagacuacaugacaaguaugaaaagguuuaaaaacgagucggacccugaaggagcguuaugguaa

SEQ ID NO: 21370 - RNA, 9879 nt, Artificial Sequence
  derived and/or modified CDS sequence (opt6) from DENV-1__FJ687432__SS-prME
agugucacuauguuacuaauguugaugccaacggcauuagcuuuccacuugacgacucgagguggagaaccccacaugauugugagcaaacaagaacguggaaaaaguuuauuauuuaaaaccagcacugguguaaauauguguacauuaauagcuauggauuugggagaacuaugcgaagacacaaugacguauaaauguccccgcauuacagaagcagaaccagaugacgucgauugcuggugcaaugcaacugacaccuggguaacuuaugguacaugcucucaaaccggagaacacagaagagauaaacggagcguugccuuggcaccgcauguugguuuaggucuagaaacgaggaccgaaaccuggaugaguagcgaaggugcguggaaacaaauccaaaaaguugaaacaugggcacuacgacaccccggauucacaguaauugcucuauuuuuggcacaugcaauagguaccuccaucacucaaaaaggaauaaucuucauacucuugauguuaguaacucccucaauggcgaugcgcugcgucgggauaggaagucgcgacuucgucgagggacuuuccggugcaacuuggguugaugugguccuagagcauggaagcugugucacaacaauggcuaaagacaaaccuacccuagauauagaacuuuugaaaaccgaaguuacaaacccagcuguccugcgaaaacucuguauugaagccaaaauaucuaauacaacgacagacuccagaugcccuacucagggggaagcaacauuaguugaagaacaggacgccaacuucguauguaggcgcaccuuuguugauaggggaugggggaacggaugugguuuauuuggcaaagggucucucauaaccugugcgaaauuuaaauguguaaccaaacuugaaggcaaaauaguacaauacgaaaacuuaaaauauucgguuauaguuacaguacacacaggggaucaacaucaaguagguaacgaaagcacagaacauggcacuacagccacgaucacuccacaagcaccaacgacagaaauacaauugacagacuauggugcccuaacgcucgacugcaguccccgaacuggauuagauuuuaacgagaugguauugcucacgaugaaagagaaaucguggcuggugcauaaacaaugguuuuuagauuuaccacuaccauggaccucuggcgcuaguaccagucaagaaaccuggaauaggcaggaucuucucguaacauuuaaaacagcucacgcgaagaaacaagaaguugucgucuuaggaagucaagaaggagcuaugcauaccgcucuaacuggugcgaccgaaauacaaacaaguggaacaacuaccauuuucgccggacaccuaaaauguagguugaagauggauaaguugacgcucaaaggcauguccuacguaaugugcaccggcagcuuuaaacuggagaaagaaguugcagagacccaacacgguacgauccuaguacaaauaaaauacgaagguaccgaugcaccaugcaagauacccuuuucgacccaagacgaaaaaggaguuacucaaaacggacguuuaauaacagcaaaucccaucgucacugacaaagagaaacccguaaauaucgaagcagaaccgccguuuggugaaucuuacaucguaauuggggcaggagaaaaagcacuuaaacuaucgugguucaagaaaggaucgucuauuggaaaaauguuugaagcaacagcacggggagcacgucgaauggcgauuuuaggagacacagcuugggauuuugguucuauagguggaguuuucacauccguugggaaauuggugcaucaaauuuucgguacugcauaugguguacuauucucaggggucucauggacgaugaaaaucgguauaggcguacucuuaacuuggcuaggacuuaauuccagaucaacaagucuaagcaugacuuguauagcagucggguuaguaaccuuauacuuaggaguaaugguucaagcugauaguggaugcgugauaaauuggaaagggagagaacugaagugugguucugggauuuuuguuacaaaugaaguacacacguggaccgaacaauacaaguuccaagcagauucaccgaagcgacuuucggccgcuaucgggaaagcaugggaagaaggagucuguggcauucgaucagcaaccagacuugaaaauauaauguggaaacaaaucaguaacgaauugaaccacauauugcuagaaaaugauaugaaguuuacuguaguaguaggagauguagcggguauacuagcgcaaggcaagaaaaugauacguccccaaccaauggaauacaaauauagcuggaaaagcuggggcaaagcuaaaauaauaggagcggacgugcaaaacgcgacauucauaauagauggaccuaauacaccugaaugucccgacgaucagcgugcauggaauauaugggaaguagaggauuaugguuuuggcauauuuaccacaaauauaugguuaaaacuuagagauucauacacacaggucugugaucaccgucuuaugucggcugcuaucaaagacuccaaagcaguucaugccgauauggguuauuggaucgaaagugagaaaaacgaaacguggaaacuagcgagggccagcuuuauagaaguaaaaacguguauauggcccaaaucccauacauuguggucuaaugguguacuugaaagcgaaaugaucauccccaaaaucuacgguggaccaaucagccaacauaauuaccgaccaggauacuuuacacaaacagcagggccuuggcaccucggaaaguuggaacuggacuuugacuugugcgaaggaacaacggugguagucgaugagcauugcggaaauagggguccuucguuaagaacaacaacaguuaccggcaaaauaauacaugagugguguugucgcucuugcacccuaccuccacuaagauuucgaggagaggaugguuguugguacggcauggagauucgacccguaaaagaaaaagaagagaacuuaguuaaaucaaugguaagugcagguagcggggaaguggacucauuuucauuagguuuacuaugcauuuccauuaugauugaggagguuaugcggagccgauggucccggaagaugcucaugacaggcacucuagcggucuuuuucuuguuaauuaugggucaacucacuuggaacgauuuaauucggcuuuguauaaugguaggugcaaacgcaucggaccguauggguauggguacaacuuaucucgcccuaauggcaacguuuaaaaugcgcccaauguucgcaguaggcuuauuauucaggagauuaacuucgcgugaagucuuacuuuuaaccaucggcuuaagccuaguggcaucagucgaauuacccaauuccuuagaagaacuaggcgauggcuuagcaaugggcauaaugauacuaaaacuauuaacagacuuucaaucccaucaauuaugggccacacugcuuagucuuacguuuauuaagacgacguuuagccuacauuaugcauggaagacuauggcgaugguucuaucaauaguuucuuuauucccucuaugucucucgacaacuucucaaaagacuacguggcugccuguacuucuuggcagccugggauguaaaccguuaacuauguuccuaauagcugaaaauaaaauauggggaagaaaaaguuggccccuuaaugaagggauaauggcuguugguauuguaucaauuuuguuaucgucucucuugaaaaaugaugucccuuuagccgguccacuuauagcaggcgguaugcuuauugcuugcuaugucaucaguggcagcagcgcugaucucuccuuagaaaaagcugcugaaguaucgugggaagaagaagcggaacauagcggagcaucucauaacauuuuaguagagguacaagaugaugguacuaugaagaucaaagacgaggaacgggacgauacucuaacaauacuuuuaaaagcaacacuacuagcaguuagcggcguuuauccacuuucaauaccagcaacacuuuucguaugguacuuuuggcaaaagaagaaacaaaggucuggugucuuaugggauacgcccucgccuccugaagucgaaagagcugucuuagacgacggaauauacagaauuaugcaaagaggccuacuagguagaagucaaguaggcguuggcguuuuucaagaaaacguguuccacacaauguggcacgugacuagaggagcuguuuuaauguaccaaggaaaaagacuagagccauccugggcaagcgucaagaaagaucucauaucguauggagguggauggagauuacaaggcagcuggaacacuggggaagaaguacaaguuauagccguugaaccagguaaaaacccaaagaauguacaaaccgcacccggaaccuuuaaaacaccagaaggugagguuggagcaauugcacuagauuuuaaaccagguacaucgggaucaccaaucguuaaccgcgaagggaaaauaguggggcuauacgguaauggaguuguaacuacuagcgguacauauguguccgcuaucgcacaagcuaaagccucucaggaaggcccuuuaccagagauagaagaugaaguguuucguaaaagaaaucuuacaaucauggauuuacauccugguucaggcaaaaccagacgcuauuuacccgcgauuguucgagaagcuauuaaaagaaaguuaagaaccuuaaucuuagcgcccaccagagucguagcaagugagauggcagaggcacuuaaagguaugccaauucgguaccaaacgacagccgucaaaucagagcauacuggcaaagagaucguagaucuaaugugccaugcaacuuucacuaugagauuacuuuccccaguuagagugcccaauuacaacaugauaaucauggacgaagcucauuuuacugauccgaguucuauagcagcacgaggauauauuucuacgcgugucggaaugggagaagcagcugcaaucuucaugacugcgacuccuccagggucaguggaggcguucccgcagucuaaugcagucauccaagaugaggaacgggauauaccagagcguucauggaacucugguuaugaauggauuaccgacuucccaggcaaaaccguaugguucguaccuucaauaaaaucuggaaacgauauugcaaacugucuaaggaaaaacggcaaaagagugauacaacucucaagaaagaccuuugauacugaauaccaaaagacuaagaauaacgauugggauuacguagugaccaccgacaucagugaaaugggcgcuaauuuuagagccgacagaguaauagacccaaggcguugcuuaaaaccugugauacuaaaagauggaccugagagagugauauuagcagggcccaugccuguaacaguagcgagugccgcgcaaagacgcggcagaauaggaagaaaucacaacaaagagggggaccaauauauauacaugggacaaccuuuaaauaaugaugaagaucaugcgcauuggacggaggcaaaaaugcuacuagauaacauaaauacgccggaaggcauaaucccagcauuauuugagccggagcgugaaaaaucugcagccauagacggggaauauagauuaagaggcgaggcuaggaaaacauuugucgaauuaaugaggaggggugauuuaccgguuugguuaagcuacaaaguagcaagugaagguuuccaauauucugauaggagauggugcuuugacggagaacguaacaaucagguucuagaggagaauauggacguagaaauuuggacaaaagaaggcgaacguaagaaauuaaggccaaggugguuagaugcucgcacuuacagugacccacucgcucuacgagaguuuaaagaauuugcugcagguagaagaagcguaagcggagauuuaauauuggaaauaggcaaauuaccucagcaccuaacacagagagcacagaaugcgcuggauaauuugguaauguuacauaauucugaacaaggagguagggcauacaggcaugcacucgaggaguuaccagauacaauagagacgcuaauguuauuagcauuaauagcgguguuaaccgguggcguaacuuuguucuuucuaucugggcguggauuaggaaaaacaaguauaggccuguugugugucauggcuaguucaguauugcuuuggauggcuagcguagagccccauuggauagccgccaguauaauacuugaguucuuccucaugguacuguugauuccugaaccugacagacagcguacaccccaggauaaucaacuagcauacguagugauaggguuauuguucaugauauuaacaguugcugcuaaugaaauggggcuacuggaaacuacgaagaaagaccuggggaucggucauguugcaguugaaaaucaucaccacgcuaguaugcuggauguggauuuacauccugcuuccgcuuggacguuguaugcaguagcgacaacaauaauaacacccaugaugcgacacacgaucgaaaauacuaccgcaaauauaucauuaacagcgauugcgaaccaagccgccauacuuaugggacucgacaaaggauggccaauuagcaagauggacaucggaguaccauuguuagcacucggauguuauucccaagucaauccauuaacucuuacagcagcaguauugauguuaguagcgcacuaugcaauaauaggaccgggcuuacaagcaaaagcaacucgcgaagcucagaaaagaacugccgcagggauaaugaagaacccaacaguagauggaauuguggcaauagaccuagauccuguaguauaugacgcaaaauucgagaaacaauuaggucaaauaauguuacuaauuuuguguacuucucagauauugcuaaugagaacaacuugggcucuaugcgaaagcaucacgcuugcaacaggaccauugacgacguuaugggaaggaucgccgggaaaauuuuggaacacaacuauugcaguaucuauggcaaauaucuuucgcggaucauaccuggcaggcgcuggauuagcguuuucguuaaugaaaagccuuggaggaggcagaagggggaccggagcacaaggggagacccuaggagaaaaauggaaacgucaacuaaaucagcuaucaaaaucugaguuuaacacuuauaaaaggucagggauaauggaaguagaccgcagugaagcgaaagaaggccuaaaaagaggugaaacgacuaaacacgcugugagcagagggacagcuaagcugcgcugguuugucgagcgaaaucuuguaaagccagaaggaaaggucauagaccuaggguguggaagagguggaugguccuauuauugugcggggcucaagaaaguaacggaagugaaaggauauacgaaagguggcccaggucaugaagaacccaucccuauggcuacguaugguuggaaccuugucaaacugcacuccgggaaagauguguucuuuauaccuccagagaaaugcgacacgcuucugugcgauaucggagaaucaucaccgaauccgacaauagaagaaggccggaccuuacguguguuaaaaaugguagagccaugguuacguggaaaccaguuuuguauaaagaucuuaaauccauacaugccgucugugguagaaacuuuagaacaaaugcagagaaaacacggagguauguugguaaggaauccauuaucaaggaauaguacacacgagauguacuggguaucaugcgggacagggaacauugucagugcuguaaacaugacaucaaggaugcuccuaaacagauuuacuauggcccacaggaaaccaacuuaugaaagagacgucgauuuaggagcagggacacgacauguagcagucgaaccugaaguugcaaaccuggauauaauuggccagcguaucgagaauaucaagcacgaacauaaaucuacauggcacuacgaugaagauaauccguauaaaacuugggcauaucauggaaguuaugaaguaaagccaagugguucagcuucaagcaugguaaacggagugguuaagcuacugacuaaaccaugggacgugauacccaugguaacacaaacagcgaugacagauacaacuccguucggucagcaaagagucuuuaaggaaaaaguugacacacgcacuccuaaagccaaacgcgguacggcacaaauaauggaaguaacagcgagguggcuaugggguuuccuaagcagaaacaaaaagccccgaauauguacucgugaggaguucacaagaaaaguaagaucuaaugcggcgauuggagcaguuuucguagacgaaaaccaauggaacagcgccaaagaagcagucgaagacgaacgauuuugggaccuggugcaucgagaacgagaacuucauaagcaaggaaaaugugcaacuuguguauauaauaugaugggaaaaagagagaagaaauugggcgaguucggaaaagccaaggggucaagagcgaucugguacaugugguuaggagcuagauuucuugaguucgaagcucugggcuuuaugaacgaggaucauugguuuucacgcgaaaauucccuuucgggaguagaaggcgaagggcuccacaaauuaggguacauucucagagauauaaguaagauccccggugguaacauguacgcagacgacacagcaggaugggauacuagaauuacagaagacgauuuacagaacgaagcgaaaauuacggauauaauggaaccagaacacgccuuacuagcuaaaaguauauucaagcugacauaucaaaacaaagugguccgagugcaacggccagccaaaaacggaacggucauggacguaauuucacggagagaccaacgaggaaguggacaaguagguacguacggccugaacacuuuuacaaauauggaagcacaauuaauucgacaaauggaaagugaaggaaucuuuucaccaagugaacucgaaacaccgaauuuagcagaaagaguacuagauuggcuagaaaaauacggcguagagagacucaaacguauggcuaucucuggugacgacuguguaguuaaaccaauagaugaccgauucgcaacagcauuaacugccuuaaacgauaugggcaaaguucgaaaagacauuccacaaugggagccgucaaagggauggaaugacuggcaacagguuccauuuugcucucaccauuuccaucagcuaauaaugaaagacggacgugaaauugucgucccauguagaaaccaagaugagcuaguagggcgagcuagagugucccaaggagcugguuggucacuacgagaaacagcaugcuuagguaaguccuaugcacaaauguggcaguuaauguauuuccacagaagggaucugagacuagcagcuaacgcaauauguagcgcuguaccaguagacugggucccuacuagccggacgacauggagcauacaugcacaucaccaauggaugacaaccgaagacauguuaucaguuuggaacagaguauggauagaggaaaauccauggauggaggauaagacacauauuagcucgugggaggacguaccuuauuuagggaaaagggaagaucaauggugugguucacuaaucggccugacugcaagagcgaccugggccacaaacauacagguugccauaaaucagguucggcggcugauuggcaaugagaacuaucuugauuauaugacaucaaugaaaagauuuaaaaacgaaagugauccugaaggcgcacucugguaa

SEQ ID NO: 21371 - RNA, 9879 nt, Artificial Sequence
  derived and/or modified CDS sequence (opt6) from DENV-1__JQ922547__SS-prME
uccguuacgaugcuguuaaugcuacuccccacagcauuggcguuucaucucacaacgagagguggagaaccgcauaugauagucucuaaacaagaaagagguaaaagucuauuauucaaaacaagugcaggaguuaacauguguacccuuauagcuauggaccuuggagaacuuugugaagauaccaugacuuauaaaugcccuaggauaacagaagcagaacccgaugacguagauugcuggugcaaugcgacagacacguggguuacauauggaaccugcagucaaacgggagaacacaggcgagauaaacgcucgguagcguuagcaccacacgucggccucggacuugaaacaagagcggaaacauggaugaguagugaaggagcauggaaacaaauacaaaaaguagaaacgugggcgcuucgacauccggguuucacuguuauagcacuauuuuuagcgcaugcaauuggaacuucgauuacacaaaaagggauuauauuuauacuauuaaugcuaguaacaccaucuauggcuaugagauguguagggauaggaaacagagacuucguagaaggauugucuggugccccguggguagacguaguauuggaacauggaaguuguguaacuacgauggcuaaaaacaaaccuacucuggacaucgaacuuuuaaaaacagaaguaacgaacccugcaguucuacgaaaauuaugcauugaagcaaaaauaucgaauacaacaacugacaguagaugcccuacacaaggagaagcaacguuaguggaagaacaagacgccaacugcgugugucguaggacauuuguggaucgggguuggggaaauggguguggauuguuugggaaggggucacuuauaacuugugcgaaguucaagugugucacuaaacuagaaggaaagauaguacaauacgaaaauuugaaauauagcguuauuguuacuguccacacgggcgaucaacaucaagucgggaaugaaacuacuacacauggaacaacagcaacaauuacaccacaagcaccaacuucugaaauacagcuaacggauuacggggcacuuacucuggacuguucaccuaggaccggauuagacuuuaaugaaauggugcuauuaacaaugaaagaaaaauccugguuagugcacaagcaaugguuuuuggauuuaccguuaccauggaccucuggcgcaucgacaucucaggaaacuuggaacagacaggauuuauugguaaccuuuaagacagcucacgccaagaaacaggaaguaguugucuuggggucccaagaaggggccaugcacaccgcauuaaccggggcaaccgaaauacaaacaagcggaacuacuacaauauuugcaggacacuuaaaaugcagguugaaaauggacaaacuaacauuaaaagguaugaguuaugugaugugcacaggcagcuuuaaguuagaaaaagaaguugcggagacucagcacggaaccguguugguacaagucaaauacgaggguaccgaugcaccuuguaagauacccuuuucaacacaggaugagaagggagcgacacaaaauggcagguuaauaacagcaaauccuauaguaaccgacaaagaaaaaccgguuaacauagaggcagagccaccuuuuggugagaguuacauaguaguaggcgccggagagaaagccuuaaaacuauccugguuuaagaaagguaguucuauaggaaagauguuggaggcgacugcaagaggagcaagaaggauggcaauccuaggagacaccgcuugggacuucgguuccauugguggaguauuuacaucaaugggaaaacuuguccaccaaguuuucggcaccgcuuaugguguccuauuuucggggguaaguuggacuaugaaaaucgguauagggauucuccuaaccugguuaggauuaaauucacgaaacaccucccuaaguaugauguguauagccguaggaaugguaacauuauaccuaggagugaugguucaggcggacagugguugugugauaaauuggaagggaagagaauuacuauguggcacaggcauauuuguaacuaacgaggugcauacuuggacagacccguauaaauuucaagccgauccaagcaaucggcuaucaccaauaaucgguaaggcaugcgugauccgaguaugcggaauaagaucugcaacaaggcuagagaauauuauguggaaacaaauaaguaaugaacugaaccacauauuacuugagaaugacaugaaauuuacagucgucguaggugauguuuccgggauucuagcacagggagagaaaaugauuagaccacaacccauggagcauaaauauaguuggaaaagcuggggaaaagcgaaaauaauaggagcagaugugcaaaauaccacauucauaaucgacggaccgaauacuccagaauguccugacaaccaacgagcauggaauauaugggaaguugaggauuacggauucgguauauuuacaacgaauaucugguugaaauuacgggauagcuauacucaaguaugugaucauagauuaaugagugcagcaaucaaagauucuaaagccgugcaugcugauaugggcuacuggauagagagugagaaaaacgaaacuuggaaacuggcacgugcgagcuucaucgaagucaaaacauguacauggcccaaaagucacacccuguggaguaauggaguucuagagucggaaaugaucauaccuaaaauauauggugggccgauaucacaacauaauuaccgaccaggguauuuuacccagacagcgggcccauggcauuuaggaaaauuagaguuggauuucgacuuuugugaaggcaccacggucguuguagaugaacacugcgggaauaggggaccaucccuacgcacgacaacgguaaccgguaaaaucauacacgaauggugcugccgcaguuguacuuuaccaccacuacgcuucaaaggugaagauggaugcugguacggaauggaaaucagaccuguuaaagauaaagaggaaaaccuaguaaaaucgaugguaagugcugguaguggugaggucgauucauucagccuaggacuacuauguauuagcaucaugauagaagaaguaaugaggucacgauggucaaagaaaaugcuuaugguuggaacuuuagcaguuuuucugcuauuaaucaugggacaacugaccuggagcgauuugauuagacuuugcauaauggucggggcaaaugcaagugacagaauggguaugggaacgacuuaucuugcacuuauggcaacauuuaaaaugagacccauguuugcgguaggguugcuauucccaaaauuaacaagccgagaaguacuauugcucaccauaggauugucucuaguugcgucuguagaauugccuucuagucuagaagaacuuggagauggacuagccaaaggaauuaugaugcuaaaguuacuaacagauuuucagucacaucaacuaugggccacccuauuaagucucacauucauaaagacgacuuuuaguuugcauuaugcguggaaaacaauggcaaugguacucaguauaguuagucucuuuccacuuugucucaguaccacgucccagaaaacuacguggcuccccguguugcuagguucacuagggugcaagccauuaccaauguuucuaauuacggaaaauaaaauuuggggucgaaaaaguuggccauuaaacgaaggaauaauggcaguuggaauuguaagcauacuucuaucuagcuuauugaaaaaugacguaccacucgcagggccgcugauagcaggaggcaugcuaguagcgugcuauguuauaucuggaagcagcgcagacuuaagucuagaaaaagcugcagaaguuucaugggaggaagaagcagaacacagcggagcaucccauaacauauuaguggaaguucaagaugaugguacaagaaaaauaaaagacgaagaacgugaugauacacugaccauacuccuaaaagcgacuuuacuagcagugucaggugucuacccaauguccauuccagcgacauuauuuguuugguauuuuuggcagaagaaaaaucaacguaguggaguaggacucauuacuccuucuccgcccgaaguagaacgugcaguuuuagaugacggaaucuauagaauacuacagaggggccuauuagguaggucccaaguuggcgucgguguauuccaagaagguguauuucacacgauguggcauguuacgagaggagcuguacuaauguaccaaggaaaaaggcuugaaccaaguugggcaagugugaagaaagaucuaauuaguuauggaggggguuggagguuccagggaagcuggaacacaggugaagaagugcaagucaucgcuguugaaccggggcgcaauccuaagaauguccaaacggcccccgguacuuuuaaaacgccagaaggagaaguuggagcaauuccauuagacuucaaaccaggaacuagcgguagcccgauaguuaaccgugaaggaaagauagucggacuauacgguaauggggucguaacuacaucgggaacauauguauccgccauagcgagagcaaaagccucccaggaggguccgcugccggaaauagaagacgaagucuuucgaaaaagaaaccucacuaucauggaucuucauccuggauccggaaaaaccagacgauauuuaccugcgauaguuagggaagcuauaaaaaggaaauuaagaacgcuaauccuagcaccaacaagagugguggccagugaaauggcagaggcuuuaaaagguguuccuauaagauaucaaacuaccgcuguaaaaagcgagcacacuggaaaagagaucguugaucucaugugucacgccacguucacgaugcggcucuuaucaccaguaagaguuccuaauuacaauaugauaaucauggaugaagcucacuuuacugacccugcuucuauagccgccaggggauacauaucuacgagaguagguaugggugaagcagccgcaaucuuuaugacggcaacgcccacagggucaguggaagcauuuccccaaucgaacgcgauaauccaagacgaggaacgcgauauuccagagagaaguuggaauagcggguaugacuggauaacugacuuucccgguaagacagucugguuuguaccaucgauaaaauccggaaacgauauugcaaacugcuuaaagaaaaacgggaagagaguuauacagcuaucgaggaagacuuuugauacugaauaccagaaaacuaaaaauaaugacugggacuauguaguaacuacagauauaucagagaugggagcaaauuuccgagcagauagaguaauagauccacgaagaugccuaaagccagucauuuuaaaagacgggccugaaagaguuauacuagccgguccaaugccaguuacaguagcgagugcagcucaaagacgaggucguauaggaaggaaucaaaauaaggagggagaucaguacauuuauauggggcaacccucgaauaacgaugaagaucaugcgcacuggacagaggcgaaaauguugcuugauaauauuaauacaccagagggaaucauaccggcacuguucgagccggaaagggaaaagucugcugcaaucgauggagaauauagauugagaggagaggcucgaaaaacuuuuguagaauuaaugagacgcggagaccuaccuguuuggcuuagcuacaaagucgcguccgaaggauuucaauauuccgauagaagauggugcuuugacggugaaagaaacaaucaaguacuagaagaaaacaaggaugucgaaauuuggacgaaagagggagaaagaaagaaguugaggacuugcugguuagaugcgagaacauacagugauccuuuagccuuaagagaauuuaaggaguuugcagcuggaaggcgcucaguaaguggagaucugauacucgaaauuggaaaacucccacaacaucuaacacaaaaggcccaaaaagcacuugacaacuuaguuaugcuacauaacucggaacaagguggaaaggcauauaggcaugccauggaagaacucccagauacuauugaaacguuaauguuguuggcgcuuauagccgugcuaaccggugggguuacuuuguuuuucuuguccggcaggggucuagguaaaacgucaaucgguuuacucuguguaauggccuccucuguucucuuauggauggcaucaguugaaccgcauuggaucgccgccucgaucauucuugaguucuuccuaaugguacuucugaucccagaaccggacagacaacgcacaccacaagauaaccaauuagcauacguuguaauaggucugcuauucaugauauuaacgguagcagccaacgagaugggacuauuagaaacuaccaagaaagaccuagguauuggacauguagcagccgagaaucaucaucacgccacgaugcuugauguggauuuacguccggcuagugcuuggacacuguaugcaguggcaacaacaaucauaaccccaaugaugcgacauacaauagaaaauaccaccgcaaacaucagucugacggcaaucgccaaucaagcagcaaucuuaaugggucuagauaaaggcuggccaauaucuaaaauggauauaggggugccuuuauuagcuuuggguuguuacucucaaguuaauccgcuuacauuaacagcugcaguauuaauguuaguagcacacuaugccauuaucgggccuggccuacaagcuaaggcaacgagggaggcccagaaacgaacugcagcuggaauuaugaagaacccaaccguggauggaauaguagcaauagauuuagauccgguaguuuacgaugccaaguucgaaaaacaacuugggcaaauuauguuauuaauauuauguacaagucaaauacuacuaaugaggaccacaugggcgcuaugugaaucuauaacauuagcgacgggaccacuaacaacacuaugggaaggcaguccuggacguuuuuggaauacgacaauugcagugucgauggccaauauauuucggggaagcuauuuagcuggagcaggccuagcguuuagucugaugaagucauuaggcggaggacguagagggacgggagcacagggagaaacuuuaggugagaaauggaaaagacaacucaaucaauugucuaaaagcgaauuuaacacguacaaacgcucaggaauaauggaaguugacagaagugaggcuaaggaaggacugaaaagaggcgaaacaaccaaacacgcaguaagucguggaacugcaaaauuacguugguuuguugaacgaaauuuaguaaaaccagaaggaaaaguuauagaucuagguugugggagaggaggauggucuuacuauugcgcaggccucaagaaagugacggagguaaagggcuauacaaagggaggaccugggcacgaagaaccaauuccuauggcaacauauggauggaaucucguaaaacugcacagcggcaaagauguauucuuuauuccuccugaaaaaugugacacucuauuaugugacauaggugaaaguuccccaaaucccacaaucgaagagggcagaacucugcgugugcuaaaaaugguugaacccuggcuuagggggaaccaguuuugcaucaaaauucugaauccauauaugccuaguguaguagaaacccucgagcaaaugcaaagaaaacacggugguaugcuggugcggaauccgcugaguaggaacaguacgcacgagauguauuggguaucaugugguacagggaauauuguuucagcuguuaauaugacuucacguaugcuacuaaaucguuucacgauggcacaucgaaaaccaacauaugaacgggacguagauuuaggggcaggaacgagacacguugcgguagaaccugaaguugcaaauuuggauauaaucggacaaagaauugaaaacauuaagaaugaacacaagaguacguggcacuacgacgaagacaauccauacaaaacgugggcguaucauggaaguuacgaaguuaaacccuccgguucagcauccucgauggugaaugguguaguuagauuacucacuaaaccaugggacguaauuccaauggugacccagauugcaaugaccgauacgacaccauuuggccaacagcgaguauucaaagagaaaguagauacacgaacaccaaaggcgaaaagaggaaccgcucaaauaauggaaguuacagcaagaugguuauggggauuucugucacgaaauaaaaagccgaggauaugcacgagggaagaauuuacacgaaaaguaagaaguaacgcggcuauuggugcaguauucguggacgagaaucaguggaauagugcuaaagaagcaguagaggacgagagguucugggaccuaguacacagagagcgugaauugcauaaacaaggaaaaugcgcuacuugcguuuacaauaaaaugggaaagagagagaagaaguuaggagaguucggcaaagcaaagggaucaagagcuauaugguacaugugguuaggagcacgguuucuggaguucgaagcccuugguuuuaugaacgaagaucauugguucaguagagaaaauucccucucuggugucgagggagaaggacuacauaaauugggguauauccuacgggauauuagccgcauuccaggagggaacauguaugcugaugauacagcaggcugggacacaagaauuacagaagaugacuugcaaaacgaagcaaagauaaccgacauaauggaaccggaacaugcccuucuugcuacgucaauauucaaacuuacuuaccagaauaaggucguaagaguacaaagaccagccaaaaacggcacgguaauggaugcaaucagcagaagagaucagagaggauccggacaggugggaacguaugguuugaacacguuccuucauaaagaggcucaauuaauuagacaaauggaguucgaaggcaucuucuuacccucugaacuagaaaccccuaaccuggcaggacgugugcucgauugguuggaacaauacggaguggaaagguugaaaagaauggcuauaaguggugaugauugugucguuaagccaauagaugauagauuugccaccgccuuaaccgcauuaaaugauauggguaaggugcggaaagacauuccacaaugggaaccaaguaaaggauggggagauuggcaacaagugccuuucugcucucaccacuuucaccaauugauaaugaaagaugugagggaaauaguaguuccuuguaggaaucaggacgagcuuguaggcagagcacgaguaucucagggagcuggguggaguuugcgggaaacagcaugucuuggcaaaaguuaugcacagauguggcagcucauguauuuccaccgucgagacuuacgacuggcggccaaugcuauuuguucugcuguuccagucgauugggugccgacuucgagaacuacauggaguauacacgcccaucaucaauggaugacgacggaagauauguugaguguguggaauagaguauggauugaagaaaauccauggauggaagauaaaacacacguaucgaguugggaggacguaccuuauuuagguaaacgagaggaucaaugguguggaucuuuaauaggucugacggccagggcaacaugggcuacuaauauacaaguagccauaaaccaaguaagaagacuaauaggaaaugaaaacuacuuggacuauaugacauccaugaaaagauuuaaaaacgaaagugacccugaaggcgcauugugguag

SEQ ID NO: 21372 - RNA, 9879 nt, Artificial Sequence
  derived and/or modified CDS sequence (opt6) from DENV-1__EU482567__SS-prME
ucaguuacaauguuauuaauguuauugccuacagccuuggcauuucaucuaaccacccgaggaggcgaaccacauaugauuguaaguaaacaagaaagagggaaaucuuuauuauucaagacaucggcaggaauaaauauguguacucuaauugcuauggauuuaggugaguuaugugaagacacuaugacauacaaauguccucgcauaacagaagcugaaccugaugauguugauuguugguguaaugcaacagauacuuggguaacuuauggcacguguucacagacuggugagcauagacgcgauaaaagauccguggcauuagcaccucacgugggguuaggccuugaaacuagaacagaaaccuggaugucaucggaaggggcauggaagcaaauucagaaaguagaaacaugggcucugagacacccaggauuuacaguuacugcuuuguuucuggcucacgcaauugguacuucgauaacucaaaaagggauaaucuucauauuacuuauauuagucacaccuucgauggcaaugcguuguguagguaucggaaaucgggacuuuguugaaggguuaaguggggcaacauggguagacgucguacuagaacauggaaguugcguuaccacaauggcuaaagauaagccaacguuggacauagaauuacuaaagacagaagugacaaaucccgcaguccuuagaaaacucuguauagaagcuaaaauauccaauacaacuacugacucaaggugcccaacccaaggugaagccaccuuaguggaggaacaagacucgaauuucgucugcaggagaaccuuuguugauagaggaugggggaacggaugcggauuauucgggaagggcucgcuguugaccugugcaaaauuuaaguguguuacuaagcuagaaggcaaaauaguacaauacgagaaucuaaaauacucaguaaucguaacuguucacacaggagaccaacaccaaguagguaacgagacaacugaacauggaacgauugcaacgauuaccccacaggcgccaacgagcgagauacaauuaacugacuacggagcgcuuacccuagacuguucuccucgcacaggccucgacuuuaaugaaaugguucucuuaacuaugaaagagaaaagcuggcuuguacacaaacagugguuccuggacuugccuuuaccuuggacaaguggcgcgagcacuucacaagagacguggaacagacaagaucuguuagugacauuuaagacagcucacgcuaaaaaacaggaaguaguuguauuaggaucgcaggaaggcgcgaugcacacagcuuuaaccggagcaacggaaauucagacaucuggaacaacuaccaucuuugcaggucaucucaaauguagguuaaaaauggauaaauuaacacucaaagguaugaguuacguuauguguacuggcucauucaaguuggaaaaagaaguggcagaaacacaacauggaacgguauuggugcaggugaaauacgagggaacagacgcaccuugcaaaauuccauucagugcgcaagaugaaaaaggaguuacccaaaacgggcgcuugauuaccgcgaauccuauaguaacagauaaggaaaaaccagucaauauagagacggaacccccuuucggcgaaucguauauaguugucggagccggcgagaaggcauuaaaauugucgugguuuaaaaagggaucaucgaucggaaaaauguuugaagcaaccgcccgaggagcgcgucgaauggcaauacugggagauaccgcaugggauuuuggauccauaggcggcguuuuuacaucagcggguaaauugguucaccaagucuuuggagcagccuacgguguccucuuuucaggagucagcuggacaaugaaaauaggaauugguauccuuuuaacaugguuagguuugaauucacgcucuacuucacuaucaaugaccuguauugcgguagguaugguaacacuauaucuuggagugguggugcaagcugauuccggaugcguaauuaauuggaaagggagagaacuaaaauguggaucaggcauauuuguuacgaaugaggugcauaccuggacagaacaauacaaguuucaggcagacucuccuaaaaggcuuucugcggcaaucgguaaagcaugggaagagggaguuuguggaaucagaagugcaacaagauuggaaaacauaauguggaaacaaauaucaaacgaacuuaaccacauucuacuggagaaugauaugaaauucaccguaguaguuggugaugcaaaugggauuuuggcgcaaggaaaaaaaaugauuaggccgcaaccaauggagcauagauacuccuggaaauccuggggaaaagcaaaaauaauuggggcagauauucaaaaugcgaccuuuaucauagauggcccggauacaccagaaugcccagacgaucaaagggcauggaacauuugggaagucgaagacuauggauuuggcauuuucacaacuaauauauggcuuaaauugcgagauuccuauacacaaaugugcgaccaccgauugaugagugcugcaauaaaagauagcaaagcaguacaugcagauaugggauauuggauagaaucagagaaaaaugagaccuggaagcuggcaagagcaaguuuuauugaaguaaaaacauguauauggccuaaaagccauacccucuggucuaauggaguguuagaauccgaaaugauaauaccuaaaauauauggaggaccaauuagccagcauaauuaucguccagguuauuucacucaaacugcagggcccuggcaucuugggaaauuggaacucgauuuugacuuaugcgaagggacuacaguaguugucgaugaacacuguggaaaucgaggcccaucgcuuaggacuacgaccgucacagguaagauaauucaugaaugguguuguagaucaugcacauuaccgccucuaagauuccguggugaggauggauguugguaugguauggaaauaagaccugucaaagaaaaagaagagaauuugguuagaagcaugguaagugcgggaaguggagaaguagauaguuuuagucuuggaauacucuguguaucaaucaugauagaggaagugaugcggucgagauggagucgaaaaaugcucaugacuggaacucuagcagucuuucugcuuuuaauuaugggccagcuaacuuggaaggaucuaauucgacuuugcauaaugguaggagcuaacgcaucggauagaaugggcaugggaacaacuuacuuagcauuaauggcaacauuuaaaaugagaccgauguucgcaguaggucuucuuuuucgcagacuaacaucaagggagguauuacuguugacuauaggcuugucacuaguggcuucaguagaauugccaaauucgcuggaagaauugggcgaugguuuggcaaugggaaucaugauguuaaaauuauuaaccgaguuccaaccacaccaacucuggacgacucuucugucacucacauuuauaaauacaacacuaagcuuagacuaugcguggagaacaauggcuauggucuuaaguauaaucagucuuuucccacuaugucuuucaacaaccagccaaaaaacuacaugguuacccguauuacuugguaguuuugguuguaaaccauuaacuauguucuuaaucacagagaauaaaauuugggggcggaaaagcuggccacugaaugaagguauaauggcgauaggcauagugucaaucuuguugucuucucugcuaaaaaaugauguaccauuggcaggaccguuaauagcaggagggaugcuuauagcaugcuauguaauuucuggcucuagugcagauuugucauuagaaaaggcagcggaagucuccugggaagaagaagcagaacacagcggaacuagucauaauauucucguagaaguacaagacgacggaacgaugaaaauuaaagacgaagaacgugaugauacgcugacuauucuauuaaaagcaacgcuccuagcuguaucggggguauauccaauguccaucccagcaaccuuguuuguaugguacuucuggcagaaaaaaaaacaaagaagugguguucuuugggauacaccuucaccuccggaggucgaaagagcuguacuagaugacggaaucuaucgcauuuuacagagaggacuacuagggaggucacaaguuggagucggaguguuucaagacggaguauuucauacuauguggcaugugacgcgaggugccgugcuaauguaccaaggaaaaagacuagaacccucaugggcgucagucaaaaaggaucuaauaucuuauggaggugguuggcgauuucaagguagcuggaauacaggagaggagguucaagugauagcuguugaaccugguaaaaauccaaaaaauguacaaacaacuccagguacguuuaagacucccgaaggugagguaggagcaauugccuuggauuucaaaccgggaacgucagggucccccauagucaauagagaagggaaaaucgugggcuuauauggaaauggagugguaacuacaagugguaccuauguuagugcgauagcgcaagcuaaaacuagccaagagggaccucugccagagauagaggaugaaguuuuuaaaaaacgcaaucucacaauaauggaccuacacccgggcucaggaaaaacgagacgauauuugccagcaauuguaagagaagcuauuaaaagaaaguugagaacacugauuuuagcaccaacccgagucguugcgucagagauggcagaagcguuaaaggguaugccgauuagauaucaaacaacggcugugaaaagcgaacauacaggccgagaaaucguagauuugaugugucaugcaacuuuuacuaugagacuucuuaguccaguaagagucccgaacuacaauaugauuauaauggacgaggcucacuuuacagauccugcaucgauagcggcaagaggcuauaucucuaccagaguagguaugggcgaggcugcggcgauauucaugacugcaacgccuccugguucgguagaagcauuuccacaaagcaaugcaguaauacaagacgaagagcgagauauaccagaaagaucuuggaauucagguuaugacuggauaacagauuuucccggaaagacaguuugguucguuccgaguauuaaaagcggaaaugauauagcaaacugcuugcguaagaauggaaagagagucauccaauuaucucguaagacuuucgacacugaauaccaaaaaacgaaaaauaaugauugggacuauguaguuaccacagauauaagugaaaugggcgccaauuuucgagcagaucgcguaaucgauccuagaagaugucuaaaacccgugauucuaaaagauggcccagagagagugauucuggccgguccgaugcccguaacaguagcauccgcagcccaacgaaggggucguauaggucggaaucaaaauaaggaaggcgaucaauauguauauauggggcaacccuuaaauaaugaugaagaccacgcacacuggacagaagcaaaaauguuacuggacaauauuaacacaccagaaggcauaauuccggcgcuauucgaaccagaacgugaaaaaucugcugcaauugacggcgaauacagacuaaggggggaggcgcgaaagacauuuguggaauuaaugaggagaggagauuuaccagucuggcugucuuauaaggucgcuagcgaaggguuucaauacucugaccgaaggugguguuucgauggcgaaagaaacaaucaaguacuggaagaaaacauggauguugaaauauggacuaaggaaggcgagcggaaaaaauuaaggccaagauggcuggaugcucgaacauacagugauccuuuagcuuugcgagaauuuaaggaauuugcagcuggcagaagaucaguaaguggagaucuuauccuugagauagguaaacucccacagcacuuaacucugagagcucaaaacgcauuagauaaccuuguaauguuacauaauagcgaacaaggugguaaggcguaucgacaugccauggaagaguuaccagacacaauagaaacccuaauguuacuagcauuaaucgcaguguugaccggugggguaacucuguucuuuuugucagggaagggacuaggaaagacgucaauaggacuucuaugcguaauggcuucgagcgcucuacuuuggauggcaaauguagaaccacacuggaucgcugcgucaauuauucuggaauuuuucuuaaugguuuuguuaaucccagaaccggauagacaaaggacaccgcaagauaaccaacuagcauauguaguaauaggccuauuauuuaugauucucaccguggccgcuaaugaaaugggccuauuagaaaccaccaaaaaagaucuggguauuggacauguagccgccgaaaaucaccaucaugcgacgauguuggacguggaccuuaggcccgccagcgcauggacacuguaugcuguagcuacuacuguuaucacgccaaugaugagacauaccauugaaaauacaacugcaaacauuuccuugacagcaauagccaaucaagcagcaauuuuaaugggcuuagauaaagguuggccuauuucuaaaauggacauagguguaccacuacuugcccuuggauguuacucgcaaguaaauccacucacguuaacugcggcgguccucauguuaguggcccauuaugcaauaauaggucccgggcugcaagcaaaggcuacaagagaagcucaaaaaagaacggccgcggggauuaugaaaaauccuacgguagacgguauuguagcaauagaccuugauccuguaguauaugaugcaaaauuugaaaaacaacuagggcaaauaaugcuguuaauauuaugcacgagucagauucuacuaaugcggaccacuugggcuuuaugcgaaagcauaaccuuggcuacuggcccucuaacgacacuaugggaagguucccccgguaaguucuggaacacgacgauugcgguauccauggccaacauuuuuagggguaguuaccuggcaggagcgggccuugcguuuucacugaugaaaucccucgggggaggcagacgaggcacgggcgcgcaaggagaaaccuugggggaaaaauggaaaagacaauuaaaccaauuauccaagucagaauuuaauacauauaaacguaguggcauaauggaaguugacagaucugaagcaagagagggcuuaaagaggggcgaaacgacaaagcacgccgugagccgaggcacugcgaaauuaagaugguuugucgagcguaaccuaguaaagccugaggguaaaguuauugauuuaggaugugggcggggggguuggucauauuauugugcugggcuuaaaaaaguaacugagguuaaagguuauaccaaggggggaccaggccaugaagaaccgauuccaauggccacuuacggcuggaacuuagugaaacuauacucggggaaggacguguuuuuuauacccccagaaaagugcgacacauugcuaugcgauauaggggagucaaguccaaaccccacgauagaagagggcaggacauuaagaguccugaaaaugguugaacccuggcugagagguaaucaauucuguauuaaaauacuuaauccguauaugccuuccgucguugaaacgcuagaacaaaugcaacguaaacacggagguaugcuaguaagaaaucccuuaucgcgcaacucaacacaugaaauguacugggucaguuguggcacuggaaauauugugucugcagucaacaugacaaguagaaugcuuuuaaauagauuuacgauggcccauaggaaaccuacguacgaacgcgacguugauuugggggcgggaacacggcauguggcuguggaaccagaaguagcaaacuuggacauaauaggacagcggauugagaacauuaagaaugaacauaaaaguacguggcacuacgaugaggauaacccauacaaaacgugggcauaccacgggucguacgaaguaaaaccgucuggaagugcaaguucaaugguuaacggugugguaagacuucugacaaaaccuugggaugucaucccuaugguuacacagauagcuaugacugauacgacaccguuuggucaacagcgugucuuuaaagaaaaaguagauacacguacgccuagagcuaaacgcgguacggcacaaauuauggagguaaccgcuaaauggcuauggggauuuuugagccgaaauaagaagccaagaauuuguacacgugaggaauucacucggaaagucagauccaacgcugcaauaggugcaguguuugucgacgaaaaucaauggaauagugcgaaggaggcuguagaagacgaaagauuuuggaaucuuguacauagagaaagagaacuucacaaacaaggaaagugcgccacgugugucuauaauaugauggguaaacgugagaaaaagcucggagaauuuggaaaagcuaaagggucacgugcaauaugguacauguggcugggagcuagauuucuggaauucgaggcgcuaggauuuaugaacgaagaccacugguuuucaagagagaauucuuucucuggaguagagggagaagguuugcacaaacuagguuauaucuuacgugacauauccaagauuccagguggaaauauguacgcugacgauacugcgggaugggauacacgaaucacugaggaugauuugcagaacgaagcaaaaaucaccgauauuauggagccugaacacgcucuacuggcaaccucgauauuuaaacuuacauaucagaacaaaguuguacguguacagagaccagcaaaaaauggaacagugauggauguaauuagccgucgugaucagcgaggaaguggacaagucggaaccuauggacuaaacacauuuacuaauauggaaguucaauuaaucaggcaaauggaaucugaagguauauuucuuccgagugagcuggaaacuccaaauuuagcggaacggguguuagauugguuagaaaaacacggaacugaaagacucaaaaggauggcgauaagcggcgaugauugcguaguaaaaccgguggacgagcguuucgcaacagcccugauugcacuuaaugauauggggaaaguuagaaaagauaucccucagugggaaccuuccaaaggauggaaugacuggcaacaggucccauucugcagucaccauuuucaucaacucauaaugaaggauggacgugaaauagucguaccguguagaaaccaggaugaacuuguugguagagcacgugucagucaaggcgcaggauggagucuaagggaaacagcaugcuuagguaaaaguuaugcccagauguggcagcuaauguauuuucaucguagggaucuuagauuggcagcuaacgcaaucuguucggcaguaccaguugauuggguaccaacgucacguacuacauggucgauccacgcucaucaucaauggaugacaacagaggacaugcuaucuguuuggaaccggguuuggauugaagaaaacccauggauggaagacaaaacacauguaucaaguugggaggaaguaccuuauuuaggaaaacgagaagaucaguggugugguucuuuaauuggguuaacagccagggccacaugggcgaccaauauccaaguagcaauaaaucaaguacgcaggcucauuggaaaugaaaauuaucuagauuauaugacaagcaugaaaagguucaagaaugaaucagacccagagggagcguugugguaa

SEQ ID NO: 21373 - RNA, 9879 nt, Artificial Sequence
  derived and/or modified CDS sequence (opt6) from DENV-1__FJ390378__SS-prME
ucagugacaauguuacucauguugcuacccacugcacuagcuuuccaucucacaacaagaggaggagaaccucacaugaucguauccaaacaagaaagggguaaaucucuacuauucaaaacaucagcaggaaucaauauguguacuuuaauagcaauggaucuaggugaacugugugaagacacuaugacauauaaauguccaagaauaaccgaagccgaaccagaugauguugacugcugguguaaugcuacugauacguggguaacauauggcacguguucacagacaggcgaacaucgacgugacaaacguucuguugcauuagcaccgcauguuggacuagguuuggaaacgagaacagaaacguggaugucuucugaaggagcauggaaacaaauccaaaaaguugaaaccugggcauuaagacauccuggauuuaccguaacagcacuauuuuuagcgcaugccauuggcacaucaauaacccagaaaggcauaauauuuauacuauugaugcuaguuacaccgaguauggcaaugaggugcguaggaaucgggaauagagauuuuguggaaggacuaucaggcgcaacauggguagacguaguauuggaacaugguucauguguuacuacaauggcgaaagacaaacccacgcuagauaucgaauuacucaaaacagaagucacgaacccugcaguccugaggaaacuguguauugaagccaaaauauccaauaccaccaccgauucacgaugcccaacgcaaggagaagccacuuuaguagaagaacaagauucuaauuuuguguguaggagaacauucguugaccgcgguuggggaaacggaugcggguuauuuggaaaagggucacuguuaacgugugcuaaauuuaaauguguaacaaaauuagaagguaaaauaguccaauacgaaaacuugaaauauucuguuauuguaacaguucauacuggugaccagcaucaaguaggcaacgaaacuacagaacauggaacaauagcaaccauuacgccucaagcucccacuucugaaauacaacucacagauuauggggcauuaacauuggauuguucuccacguaccggauuagauuucaacgaaaugguauugcuuaccaugaaagaaaaauccugguuaguccacaaacaaugguuccucgaucucccauuacccuggaccucgggagcaaguacaucacaagaaacauggaacagacaggaucuacucguaacauucaaaacugcucacgcaaagaaacaagagguaguaguacuagguucgcaggagggcgcaaugcauacagcauuaacaggugcuacugaaauucaaacgucuggcacgacuaccauauucgcaggacaccuuaaauguagauuaaaaauggacaaacuaacgcuaaaaggaaugucauaugucaugugcacaggcucauuuaaacuggaaaaagaaguagcagaaacccaacacggcacaguuuuaguucagguaaaguaugaaggcacugaugcaccaugcaaaauaccuuucucggcucaagaugaaaaaggaguaacacagaauggaagacuuauaaccgcaaauccaauaguuaccgacaaggaaaaaccugugaacauugagacggaaccaccuuuuggagaaucauacauuguuguaggagcgggagagaaggcuuugaaauugaguugguuuaaaaaggguagcucaauuggcaaaauguuugaagcaacugcgaggggagcuaggaggauggcgauacuuggagacacagcuugggacuuuggcucaauagguggcguguuuacgaguguagguaaguuggugcaucaaguauuuggggcagccuacggaguacuauuuagugguguuucauggacaaugaagauaggaauaggcaucuuacuaacuuggcuugggcucaacagucgaucuaccucccucucaaugacauguauugcuguggguaugguuaccuuauaccugggagucaugguccaagcagacucaggguguguaaucaauuggaaagguagggagcucaaaugugguaguggcauuuucgugaccaacgaggugcacaccuggacugagcaauacaaauuucaagccgacucgccuaaaagauuaucagccgcuauaggaaaggcuugggaagaggguguauguggaauaagaucagcgacccgcuuagaaaacauuauguggaaacaaauaucgaaugagcuaaaccauauccuauuagaaaaugacaugaaauucacaguaguaguaggagaugcaaacggaaucuuagcgcaagggaagaaaaugauuaggccacaacccauggaacaucgauauaguuggaaauccuggggaaaagcgaagauuauaggugcggauauacagaauaguacuuuuauaaucgaugggccagauacacccgaauguccggaugaccaacgugcauggaauauaugggaaguagaagauuauggcuuugguauuuuuacaacgaacaucugguugaaacuaagagacucauacacccaaaugugugaucaucgauuaaugucugccgcgauuaaagacaguaaggcaguacacgcggacaugggguacuggauagagagcgagaagaacgaaacuuggaaacucgcgagagcaucauuuaucgaaguaaaaacguguaucuggccaaaaagucacacccuauggucuaaugggguauuggaaucagaaaugauuaucccaaaaauuuauggagggcccauaagccagcacaauuaucgaccaggguauuuuacgcaaacggcaggaccauggcaucuaggaaaauuagagcucgacuuugaccucugugaagguaccacaguuguagucgaugaacacuguggcaacaggggaccgucucugcgcaccacgacgguuacuggaaagaucauacaugaaugguguuguagauccugcacucuaccaccucuacgcuuuagaggugaagaugguuguugguauggaauggagauacggccagucaaagaaaaggaagagaacuuaguccguucuaugguaagcgcagguucuggcgagguagauucguucagcuuagguauacucugugucucgauaaugauugaagaaguuaugaggucacgcuggagcagaaagauguuaaugacuggaaccuuggcuguuuucuuauuacuaauaaugggacaacuaaccuggaaugaucugauaaggcuuugcauaaugguaggugcuaaugcaagcgaucggaugggcaugggcacgacauaucuggcauugauggcaacauuuaaaaugcgaccaauguuugcaguuggucuccuauucagaagauuaaccucacgagaaguauuauuacuuaccaucggauuaagccuaguagcuucaguagaauuaccuaauagccuugaagaacuaggagaugguuuggccauggguauaaugauguuaaaauugcugaccgaguuccagccucaccaauuguggacuacauuauuaucccuuacauucauuaaaacaacacugucacuugauuaugcauggaggacaauggcuaugguccuaucaauaguuucacuguucccguuauguuuaaguacgacaucucaaaagaccacaugguugccaguuuuauuaggaucauucggaugcaagccauuaacgauguuuuuaauaacagaaaacaagauauggggaaggaaaaguuggccacuuaaugaaggaauuauggcgauugguauuguaucuauccuacuaaguucacuucucaaaaacgacgucccauuagccggaccacucauagcgggcggcaugcucauagcuuguuaugugauaucggggaguucagcugaccuaaguuuagaaaaagcggcugaaguaucuugggaagaggaagcggaacauaguggaacaucgcauaacauuuuaguugagguacaagaugacgggacuaugaaaauaaaggaugaggaacgggaugauacccuuacuauacugcugaaagcuacucucuuagccguaagcggaguauauccaaugucaauaccagcaacacuuuuuguaugguacuuuuggcagaagaagaaacaacgaucaggaguucuaugggauaccccgucuccgccugaaguugagcgcgcaguauuggacgauggcauauaccggauacuucaaagaggauuacuaggucgaagucaaguuggaguuggaguauuucaagauggaguauuucacacuauguggcacguaacuagaggagccguucuuauguaucaggguaaaagacuagaaccaagcugggcgagcgucaagaaagauuuaauuucguauggaggugguuggagguuccaagggaguuggaacacaggggaagaaguucaaguuaucgcaguagaacccgggaaaaaucccaagaauguacaaacuacacccggcaccuuuaagacuccagaaggagaagucggagcuauagccuuagauuucaaaccugguacgucggggucuccgauuguaaaucgagagggaaaaauugugggacuauacgggaacggaguagugacuacaagugguacauauguaagcgccauugcgcaggccaagacuucccaagaaggaccccuaccagaaauugaagaagaagucuucaagaaaagaaaucuaacgauaauggacuuacauccaggaagugguaagacacggagauaccuaccagcaauuguaagagaggccaucaaacguaaacuccguacccuaaucuuagcaccaacucggguaguugcuucugagauggcagaagcccuuaagggaaugccaauucgcuaccaaacgacugccguuaaaagcgagcauaccgggcgagaaaucguagacuuaaugugccaugccacauuuaccaugagguuauuaucaccuguacgugugccgaauuauaacaugauaauuauggaugaggcacacuuuaccgauccagcgagcaucgcagcucguggguauauuucuacacgcgucggcaugggagaagcagcugccauauuuaugacugccacaccuccgggcagcguagaggcuuuuccucaauccaacgcuguuauacaagaugaagaaagagacauuccugagagaaguuggaacaguggauacgauuggaucacugacuuuccagggaagacaguaugguuuguaccuucaauaaaaaguggaaaugauauagccaauugccuucguaagaacgggaagcgcguuauccaacuaucucggaaaacuuucgacacagaguaccagaaaacuagaaauaaugacugggacuauguaguuacaacagauaucucugaaaugggugccaauuuucgagcagacagagugaucgauccccguagaugucuaaaaccaguaauucucaaggauggccccgaacggguuauccuagcaggaccuaugccuguuacgguggccucggcagcacaaagaagagggagaauaggaagaaaccaaaacaaagaaggcgaccaauacguauauauggggcaaccgcugaacaacgacgaagaucacgcccacuggacagaggcaaaaaugcucuuagacaauauuaauacuccggaaggaauaaucccagcucuuuucgagccagagcgcgaaaaaucagcagcaauagauggcgaguacagacuucgaggugaggcgcguaaaacuuuuguugaauuaaugagaagaggugaccuaccaguguggcuuaguuauaagguugcuucagaaggauuucaauauucggacaggagauggugcuuugauggugagcgaaauaaccaaguacuugaagaaaauauggauguugagaucuggacuaaagagggugaacguaagaaacugagaccaaggugguuagaugcaagaaccuacucagacccacuagcacuuagggaguucaaggaauuugcagcagggcgaagaaguguuucgggagauuuaauucuagaaauugggaaauuaccgcaacaccucacacuuagagcucaaaaugcuuuagauaaucuaguuauguuacacaauagugaacaagguggaaaagcauacagacaugcaauggaggaacugcccgauacgaucgagaccuuaauguuacuugcgcuaauagccgugcugacagguggaguaacccuguucuucuuaucaggaaaaggucuagguaaaaccaguauugguuuacuaugugucauggcuucuucagcgcucuuguggauggcaaacguggaaccgcauuggauugccgcgucaaucauucuugaguucuuucuaauggugcuacuaauaccugagccagauagacaaagaacgccacaagacaaccaacuagcuuacguggugaucggacuauuguuuaugauucuaacgguagcagcaaaugaaaugggacuacuagaaacaacaaagaaagaccuaggaauugguuauguugcugcagaaaaccaacaccaugcuacaauguuggauguggacuugagaccugcaagugcauggacccucuacgccguugcuacaacggugaucacaccuaugaugaggcacacaauagaaaauacuacggcaaacauaagccugacagccauagccaaucaagcugccauacugaugggguuagauaaaggauggccuauuagcaaaauggauauugguguuccucuacuugcucugggauguuacucucaaguaaauccucuaacuuugacugcagcuguauuaauguuaguagcccauuaugcuauaauugggccugguuuacaagccaaagcgacaagagaggcgcagaaacggacugcugccggaaucaugaagaaccccacagucgaugggauagucgcgauugauuuggauccaguaguuuacgacgcuaaauuugaaaagcaauuaggucaaauuaugcuucuaauccuuuguaccagucaaauuuuacucaugagaacgacaugggcacuuugcgaaaguaucacacucgcuacugggcccuuaaccacauugugggaaggaucuccagggaaauuuuggaauacaacuauugcaguaucaauggcuaacauuuucagagguagcuacuuagcuggagcaggguuagcuuucagucuuaugaaaagccuagguggaggcagacgagguaccggugcucaaggagaaaccuugggagagaaauggaaacgucaauuaaaccaacuuuccaagucggaguuuaauaccuauaaacguaguggaauaauggaagucgaucguagugaagccaaagagggcuugaaacgaggcgaaacgaccaaacacgccguuucacggggaacggcuaaauugcggugguucguagaaagaaauuuagugaaaccagaaggaaaagugauagaccuuggauguggcagaggagguuggaguuauuauugugcgggacuaaagaaaguuacagaaguuaaaggguacacuaaaggagggccuggucaugaagaaccgauuccaauggcaacauauggauggaauuuagugaaauuauacucugguaaagacguuuucuuuacaccaccagagaaaugugacacacuauuaugcgauaucggagagucaagcccaaacccaacaauugaagaagguagaacucuucgaguauuaaagaugguagaaccauggcuuagaggaaaccaauucugcaucaaaauauugaaucccuauaugccuagcguugucgaaacucuagaacaaaugcaaagaaaacacgguggaauguuagugcgaaauccccuuucccguaauucaacucacgaaauguauugggucaguuguggaacaggaaauaucguaagugccguaaacaugaccucccguaugcuccuaaauagguucacgaugacgcaccgaaagccgacauaugagcgugacguagauuuaggggcaggaacaagacauguagcaguggagccagaagucgcaaaucuagauauaauugggcaacgaauugaaaauauuaaaaaugaacauaaaucgacauggcauuaugaugaagauaauccauacaaaacuugggcuuaucaugguagcuaugaaguuaaaccaagcggaucugcuucaucgaugguaaaugguguaguucgacuacuaacaaaaccuugggauguaauaccgaugguaacgcaaauagcaaugacagauacuacacccuuuggccaacagagggucuucaaagagaagguagacacucgaacuccgcgugcgaaacgugguacugcacaaaucauggaaguaacagcaaaaugguuauggggcuuucucuccagaaauaagaaaccacgcaucugcacuagagaggaguucacuagaaaaguaaggucaaacgcugcgauaggugcgguuuuuguagaugaaaaucaauggaacucagcaaaggaagcgguugaagaugaaagauucugggauuuaguacauagagaaagagaguuacacaaacaaggaaaaugugcaacauguguguacaacaugauggggaaacgagaaaagaaacuuggagaguuugguaaggcaaagggaucaagagcgauaugguacauguggcucggugcaagauucuuagaguucgaagccuugggauuuaugaaugaagaccacugguucucacgagagaacaguuuuagcggugucgagggagaaggucuucacaaacuuggguacauacugcgagauauuucuaaaauuccagguggcaauauguaugcagaugauaccgcaggaugggacacacguauuacugaggaugacuuacaaaaugaagcaaaaauaacagauauaauggaaccggaacacgcucuauuagcaacuucaauauuuaaacucacauaucaaaauaaaguuguccgaguacaaagacccgcuaaaaaugguacaguaauggauguaauuucgaggagagaccaacgcggaaguggucaaguaggaacuuacggauuaaacaccuuuacgaauauggaaguucaacuuauacgacagauggagucugaaggaaucuuucuaccaucagaauuagaaacacccaaucuugcagaaagaguuuuaaacuggcucgagaagcaugggaccgaacgguuaaaacgcauggcaauaagcggggaugauugcgugguuaaacccguagaugacagauuugcuacugcauugauagcguuaaaugauaugggaaaagucagaaaggauauuccacaaugggaacccagcaagggauggaaugauuggcaacaaguuccauuuugcucgcaucauuuccaucaauuaaucaugaaagacggucgggaaauaguagucccauguagaaaucaagaugagcuuguuggacgagcacgaguaagucaaggcgccggcugguccuugagggaaacagcuugucuugguaaaucguaugcgcaaauguggcaacuuauguacuuucaucgaagggauuugcgauuggcagcuaaugcgauuuguucggcagucccgguugauuggguaccuacgucuagaacaacauggucaauacacgcacaccaccaauggaugacaacugaagacauguuaucgguguggaaccguguuuggauagaagaaaacccguggauggaagacaaaacgcacguaagcucgugggaagagguaccauaucuaggcaaacgcgaagaucaaugguguggcucucugauaggacuuacugcccgcgcuaccugggcaacgaauauacaaguugcaaucaaucaggugcgacggcuaauagguaaugaaaauuaccuagauuauaugacgucaaugaaacgauuuaagaaugaaucagauccagaaggagcucucugguaa

SEQ ID NO: 21374 - RNA, 9879 nt, Artificial Sequence
  derived and/or modified CDS sequence (opt6) from DENV-1__FJ205872__SS-prME
agugugacuaugcuacuaaugcuacuuccuacugcuuuagcguuucacuugacaacaagagguggagaaccccacaugauugucucuaaacaagaaagaggaaagagcuuauuauuuaaaacgagcgcgggaauuaauauguguacucuaauagcaauggaucuaggugaacugugugaagacacuaugacauauaaauguccaaggaucacagaagcagagccggacgacgucgacugcugguguaacgcuacggauacauggguaacguauggaacuugcucgcagacuggugaacauagacgagauaaaagaucgguagcucuugcuccccauguuggacuaggauuagagacuagaacagagaccuggaugucgucagaaggagcauggaaacaaauucaaaaagucgaaaccugggcacuccgacauccuggcuuuacugucacugcuuucuuucuugcucaugcaauaggaacuucgauaacacaaaaaggaauaauuuucauucugcucauguuaguaacacccagcauggcgaugagaugugugggcauagguaauagagacuuuguugaaggguuaucgggagcgacauggguagacguaguucuagagcaugguaguuguguaacuacaauggcaaaagacaaacccaccuuagacauugaacuacugaaaacggaaguaacuaauccagcaguauuacguaaauuaugcauagaagcgaaaauaucaaauacuacaacagacagccgaugcccaacacaaggagaggcaacucuuguugaggaacaagacaguaacuuuguauguaggcgcacuuucguagaucgcgggugggguaauggaugcggauuauuugguaaagguucuuuacucacaugcgcaaaauucaaaugugugacaaaacuagaggguaaaaucguucaauaugaaaacuuaaaauacucgguaauugugacaguccauacuggugaccaacaucaaguaggaaaugaaacuacagagcacggaacuauugcaacaauaaccccgcaagcacccacuucugaaauacaacugacugauuauggcgcucugacacuggauugcucgccacgaacgggcuuagauuuuaaugaaaugguguuacuaacaaugaaagaaaaaucauggcucguacauaaacaaugguuucuugaucuaccgcuuccuuggacuuccggugcuucuacuucacaggagacauggaaucgucaagaccuacuuguuacuuucaaaacagcacacgcgaagaaacaagaagucguugugcuugguucgcaagaaggagcaaugcauacagcauuaacuggugcaacggaaauccaaaccucagguacaaccacaauauuugcuggccacuuaaaaugcagguuaaaaauggauaaacuaacucucaaagguauguccuacgucauguguacgggaucauuuaaacuugagaaagaaguugccgaaacacaacacggaacaguauuaguucagguaaaauacgagggaacugacgccccuuguaaaaucccuuucucugcucaagaugaaaaaggagugacccaaaaugguagacuaaucacggcaaacccuauaguuaccgacaaagaaaaaccagucaacauugagacugaacccccauuuggggaauccuacauagucguaggcgcaggggaaaaagcgcuaaaauuaucaugguuuaagaaaggaucaucuaucggcaaaauguuugaggcaacggcgaggggugcuaggagaauggcgauacucggagacacggcaugggacuuugguaguauaggagggguauuuaccucaguagggaaacucguacaucagguauuuggugcggcuuauggcgugcuauuuagcgggguuucuuggacuaugaaaauuggaauuggaauuuuauugacauggcuuggacugaauagccgcucgaccagucuaaguaugaccuguauugcagucgguaugguuacucuauaucucggagugaugguacaggccgauaguggcuguguaauaaauuggaaaggaagggaacugaaauguggcucaggaaucuucgucacgaacgaaguacacacuuggacagaacaauacaaauuucaagcagauucgccaaaacguuuauccgcagccaucgguaaagcaugggaagagggggugugcggaauacgcucagcuacaaggcuugaaaacauaauguggaaacaaauaucuaacgaauugaaucauauauuauuggaaaacgauaugaaauucacaguuguagucggggaugcaaacgguauucuggcccaaggaaagaagaugauacgaccucaaccaauggaacacagauacucauggaaaucguggggaaaagcgaaaauaaucggggcagacauucaaaauucaaccuucaucauagacggcccagacacaccugaauguccagacgaccaacgggcguggaauauaugggaaguagaagacuauggauucgggauuuucaccacgaacauuuggcugaaacugcgagauucauacacucaaaugugcgaucacaggcugaugagugccgcaauaaaagacucuaaagcuguccaugccgauaugggauacuggauagaaagcgagaaaaaugagacguggaaacuggcaagagcgucguuuauugaggugaaaacauguauauggccaaaaagucacacauuauggagcaacggaguuuuagaaagugagaugaucauaccgaagauauauggcgguccaauaucucagcauaauuacagaccgggauauuuuacacaaacugcuggaccauggcacuugggaaagcuagaacuagacuucgaccuaugcgaagguaccacaguaguuguugaugaacacugcgguaaccgaggaccaucucuacgaacaacuacggucacuggaaagauuauucaugagugguguugccggaguugcaccuugccgccauuacgguuuagaggugaggacgguugcugguauggaauggaaauacgaccagucaaagagaaggaggaaaauuuaguacguucaaugguuucagcaggaucgggagaaguggauucguucucacuagggauccuaugugugagcauaaugauagaagaaguaaugaggucgagguggucccggaaaaugcuaaugacuggcacucuagcuguuuucuuauuacuaaucaugggucaacuuacuuggaacgauuuaauaagauuauguauuauggugggugcuaaugcaucagaucggauggggaugggcacaacuuauuuagcucuuauggcuacauuuaagaugagaccaauguucgccguaggccuuuuauucaggcguuuaacaaguagggaggugcuauuacuaacuauuggcuugagucuugucgcgaguguugagcuuccaaauagccuugaggaacuaggagauggucuugccaugggaauuaugauguuaaaauuguuaaccgaguuccaaccacaccagcuuuggaccacauuacuaucauugaccuuuaucaaaacaacacuuagucuugauuacgcauggaggacaauggcuaugguucuaucaauagugucauuguucccauuaugucuuaguacuacgucgcagaaaacuacuuggcucccgguucugcuuggaucauucgggugcaaaccgcugacuauguucuugaucacugaaaauaagauauggggaagaaaaaguuggccauuaaacgaagguauaauggcaaucggaauagucucaaucuuacuuaguucgcuacucaaaaacgauguuccuuuagcggguccuuuaauagcaggggguauguuaaucgcaugcuacgugaucucugggagcucggcugaucuuuccuuggagaaagcagcugaagugaguugggaagaagaggcagaacauucugggacaucacacaauauucuaguggagguucaagacgauggaaccaugaaaauaaaagaugaagaacgggaugauacccuaacgauucuacuuaaggcaacacuauuagcaguaagcggcguauauccaaugucgauacccgccaccuuguuugugugguacuuuuggcaaaagaagaaacagagaucaggggugcuaugggauacuccuagcccuccugaaguugaacgagcuguccuagacgauggcauuuacagaauuuuacagcgaggacuccuugggagaucacagguugggguuggagucuuucaggacgguguguuccauacuauguggcacguuacgagaggggcuguccuuauguaccaaggcaagagauuagagcccaguugggcgucugucaagaaagaccuaauaaguuacggaggagguuggagauuucaaggaagcuggaauacaggagaagaaguccaaguaauugcgguggaaccuggcaaaaaucccaagaauguucaaacuacaccuggaacauucaagacacccgagggagaagucggggcaauagccuuagacuuuaaaccagguacaagugguucacccauagugaaccgagaaggcaaaauuguaggauuauacggcaauggaguugucacuacuagcggaaccuauguauccgcaauagcacaagcaaagacaagucaggaagggccguuacccgagauagaggaggaaguuuucaagaagcgaaacuuaaccauaauggauuuacauccggguagugguaaaacucgaagguacuuaccugccauagucagggaagcgauuaaaaggaaguugcguacccuaauccuugcaccaaccagaguaguagcuucggaaauggcggaagcucuuaaaggaaugccgauucgauaucagacuacagcaguaaaaucugaacacacugggcgcgaaaucguugaucuaaugugucaugccacauuuacuaugagguugcuauccccgguucgagucccaaauuauaacaugauaauuauggaugaagcccauuuuacggaccccgcaaguauugcggcucguggguauauuaguacaagagucggaaugggggaagcagcagcaauauucaugacagcuacaccaccagggucuguugaagcauucccucaaaguaacgcuguaauacaagacgaggaacgagacauaccggaacgcucuuggaacagcggauaugacuggauaacagauuucccagggaaaacaguuugguuugucccaaguauaaaaucggggaaugauauagccaauugucuacgcaagaaugggaaacgcguuauacagcuaucacgaaagacauuugauacagaauaucagaaaacgaggaauaaugauugggauuacgugguuacaaccgacauaagcgaaaugggagccaacuuuagggcagauagagucauagauccaaggcgaugucuuaaaccuguaauccucaaggauggaccugaacgaguaauacuggcaggucccaugccuguaaccguagccucugccgcacaacgcagaggucguauaggcagaaaccaaaacaaggaaggagaucaauacgucuacaugggacagccacuuaacaaugacgaagaucaugcucauuggacagaagcaaaaaugcuacuagauaacauuaauacgccugaaggaauaaucccugcguuauuugaacccgaaagagaaaagucugcugcaauugacggggaauauagacuaagaggugaagcacgaaagacauuuguagaacucaugcgucgaggugacuuacccguauggcuuaguuauaaaguugcuagugagggcuuccaauauuccgacagacgcugguguuuugauggagaaagaaauaaucaaguccuagaggaaaacauggacguugaaauuuggacuaaagaaggagaacguaagaaauuaagacccaggugguuagaugcaaggaccuauucagauccucuagcuuuaagagaauuuaaggaguucgcagccggaagaagaucaguuucaggcgaccucauacuagaaauagguaaguugccucagcaccuuacauuacgggcucagaaugcccuagauaacuuagucauguugcacaauucagaacaagguggaaaggcauacagacacgccauggaagaauuaccugauacaaucgaaacauugaugcuucuagcgcucauagcagcuuugaccggcggcgugacacuguuuuucuugaguggaaagggacugggaaaaaccucaauuggauugcucuguguaauggcuucaucagcguuauuauggauggcuaauguugagccucacuggauugcagcgucaauuauauuagaguucuuuuuaaugguacuuuuaauaccggaaccagacagacagaggaccccacaagacaaccaauuggcuuauguaguuauaggccuucucuucaugauuuuaacgguugcggcgaacgaaaugggacuacuugagacgacuaagaaagaucucggcauaggauacguagcggcggaaaaucagcaccacgccaccaugcuugauguagauuugaggccggcaucagccuggacguuauaugcuguggcuacaacaguaauaacuccgaugaugcgccacacaauagaaaacacaaccgcaaacauaucguuaacagcgauagcuaaccaggcagcuauacuuauggguuuagacaaagguuggcccauuagcaaaauggauauagggguuccauuacuagcauuagggugcuauagccaaguaaacccauuaacacuaaccgcagccguguuaauguugguugcacauuacgcuauuauuggaccggguuuacaagcaaaagcgacucgagaagcacaaaagcguacagcagcugguauaaugaaaaacccuacagucgauggaauuguggcaauugaucuagauccuguagucuacgacgcaaaguuugagaagcaauuaggucaaauaaugcuauuaauacugugcacuucucaaaucuugcuaaugagaacuacgugggcgcuaugcgaaagcauaaccuuagccacugggccuuuaacuacacugugggaaggauccccggggaaauuuuggaacacaacuaucgcaguaucuauggcgaacauauuuagaggaucuuaccuggccggugcgggacuggccuucucgcugaugaaaaguuuaggaggugggagaagagguacaggagcccaaggugaaacacugggggaaaaauggaaaagacagcugaaucaacuaagcaaaucugaauuuaacacuuauaaaagaagugggauaauggaaguggauagguccgaagcaaaagaaggacugaagcggggagaaacaacaaagcacgcagugucacgagggacagcgaaguuacguugguuuguagaaaggaauuuaguuaaaccugaaggaaaggugauagauuuaggaugugguagaggaggauggaguuauuauugugcuggccucaagaaaguaaccgaaguaaaaggguauacaaagggagguccgggucacgaagaaccaauaccaauggcgacauacggguggaaucucguuaaacucuacucuggcaaagaugucuucuuuacaccaccagagaagugugauacuuugcuaugcgacauuggagaaaguucaccaaauccaacaaucgaagaagggcguacucugagaguacugaaaauggucgaaccgugguuacgagggaaccaguuuugcaucaaaauucugaauccauacaugccgaguguaguagaaacgcuugagcaaaugcagcgaaaacacggaggaauguuagugagaaauccuuuguccagaaauaguacacaugaaauguauugggugaguugcgguacugguaacauuguuagugcugugaacaugacaaguaggauguuacuuaaucgauucacaaugacccaccgcaaacccacuuaugagagagaugucgaucuaggcgcgggaacaagacacguagcaguagagccagaaguagcgaaccucgauaucauaggacaaagaauagagaauauaaagaacgaacauaaaucuacauggcacuaugacgaggauaauccauauaaaacgugggccuaucauggaucauacgaaguaaagccgucaggaagugcaaguaguaugguuaacggaguuguccggcuccuuaccaaaccaugggaugucauuccuaugguaacacagauagcaaugacggauacaacaccguucggacaacaaagaguguuuaaggagaagguagacacacggacuccaagagccaaacgcggaacagcgcaaauaauggaaguaacugcaaaaugguugugggguuuucuuucaaggaacaagaaaccacgaauaugcacccgggaggaauuuacacgcaaagucaggaguaaugcagcuauaggagcaguauucguagacgagaaccaauggaauagcgcuaaagaagcaguagaagaugaaagauucugggacuuagugcaccgagaacgagaauuacacaaacaaggaaaaugugccacuuguguguacaauaugauggguaagagagagaagaaacuuggagaauuugguaaagcgaagggaucgagagcaaucugguauaugugguuaggggcuagguuccucgaauuugaagcgcuaggauuuaugaaugaagaucacugguuuagucgugaaaauucuuuuucaggagucgagggagaagggcugcacaaauuaggguauauuuuacgcgauauaucaaaaauuccugggggcaacauguaugccgaugauacagcuggaugggauacccguauaacugaggacgaucuucaaaaugaagcaaaaauaacagauauaauggaaccagaacaugcauugcuagcaacgaguauauuuaaguugacauaccaaaauaaagugguccgggugcaacggccagcuaagaacggcacagucauggacgugauuaguagaagagaucaaaggggaaguggacaagucgggacguauggccucaacacguuuacaaacauggaagugcaauugauaagacaaauggaaucagaaggaaucuucuuaccauccgaauuagagaccccaaaucuugcagaacgaguguugaacuggcucgagaaacacggaaccgaaagauuaaaacgaauggcaauuagcggcgaugauuguguuguaaaaccaguagacgauagguuugcaacagcguugauugccuuaaacgauauggguaagguaaggaaagacauaccgcagugggaaccgaguaaaggauggaaugauuggcaacaaguaccuuucugcucacaccauuuccaucaauuaauaaugaaggauggacgcgagauaguaguuccuuguagaaaucaagacgaauuaguuggcagagcuagggucagucaaggggccggauggucgcuuagggaaacggcguguuuaggaaagaguuaugcgcaaauguggcaauugauguacuuucauaggagggaucuaagauuagcagcuaacgcaauauguucagcagucccaguagauugggucccgaccucaaggacgacguggaguauucaugcacaccaccaauggaugaccacugaagauauguuaagcguauggaacagaguuuggaucgaagaaaacccguggauggaagacaaaacacaugucaguagcugggaggaaguaccauauuugggaaaacgcgaggaucaguggugcggcaguuuaauuggacuuacagcaagagcuacgugggcaacgaauauccaaguugccauaaaccaaguaaggagguuaauaggcaaugagaauuaccuagauuauaugacaaguaugaagagauucaaaaaugaaucagauccagaaggcgcucuuugguag

SEQ ID NO: 21375 - RNA, 9879 nt, Artificial Sequence
  derived and/or modified CDS sequence (opt6) from DENV-1__FJ205873__SS-prME
ucgguuacuaugcuucuuauguugcucccaacagcauuagcauuccaucucacaacucgaggcggggaaccgcauaugauuguaaguaaacaagagcgagggaaaucgcuauuguuuaaaacgucggcugggauaaauauguguacacucaucgcgauggauuuaggugaauugugcgaagauacaaugacauacaaauguccacgaauaacugaagcggagccugaugauguagauugcugguguaaugcaacagauacuugggugacauaugggacauguagccaaacgggggagcauagacgugauaaaagaaguguagcgcuggcuccucauguaggacuuggauuggaaacgagaacagaaaccuggaugucaagugaaggagcauggaaacaaauacaaaaaguggagacgugggcuuuaagacacccaggauuuacaguaacagcacuauucuuggcgcaugccauuggcaccaguauuacccaaaaagguaucauauucauuuuguuaaugcuggugacuccuagcauggcaaugcgaugcgucggcauaggcaaucgagauuuuguugaagggcuaaguggugccacauggguugauguaguucuagaacacggaucuugcgucacaacgauggcaaaagacaaaccaacucucgauauagaacuacugaaaacugaggucacgaauccugcuguauuaagaaaacucugcaucgaagcgaaaauaucuaacacaacaacagauaguaggugccccacacaaggcgaggcaacacucgucgaggaacaggacaguaacuuugugugucgaaggacuuucguagauaggggcuggggcaacggaugcgggcuuuuuggaaaaggaucgcuccuaacuugugcaaaauuuaaaugcguaacaaaauuagaaggcaaaaucguucaauaugaaaaucuuaaauauagcguuauaguuacaguccacacuggggaccaacaccagguagggaaugaaaccacggagcauggaaccauagcaaccauaaccccacaagcaccuacauccgaaauacaguuaacugauuacggugcacucacacuagauuguucgccaagaacaggccuugacuuuaaugagaugguauuacuaacgaugaaagagaaaaguugguuagugcacaaacaaugguuccuugaucuaccauuaccauggacaucaggcgcguccacgucacaagaaaccuggaacagacaagauuuauuaguuacuuuuaaaaccgcgcacgccaagaaacaagagguaguagucuuaggcagucaggaaggggcaaugcauacagcacuaacaggugcaaccgagauucagacgucagggacuacaacaauauucgccggacaucuaaaaugccguuugaaaauggacaaacugacacuaaaaggcaugucuuauguaaugugcacagggagcuucaaacuagaaaaagagguagcagaaacucagcaugggacggucuuaguacaagucaaauacgaagggacagaugcuccaugcaaaauuccauucucagcgcaagacgaaaaaggaguuacucaaaacggucgacuaauuacggcuaacccuaucguuaccgauaaagaaaaaccagugaauauagaaacagaaccaccuuuuggggagaguuauauagucguaggggccggugaaaaagcgcugaaauugucgugguucaagaaggguucauccauagguaaaauguuugaagcaacagcuagaggcgcaagacguauggcaauacuaggggacacagcaugggauuuuggaagcauugggggaguguucaccucaguaggaaaacuugugcaucaagucuuuggggcugcauaugguguuuuauuuucaggggugucuuggacgaugaaaauuggaauaggaauacuucucacauggcugggacuaaauuccaggaguacaucauuaucaaugacauguauugccguaggaaugguaacgcuauacuuaggugucaugguccaagcagacucagguugcguuauaaauuggaaagguagagaauuaaaaugcggaucaggcauauuuguaacaaaugaaguucauacuuggacagagcaauacaaauuucaagcagauucgccaaaacggcuaagugcagcuaucggcaaggcaugggaggaaggaguaugcggaauacgaagugcuacacgauuagagaacauaauguggaagcaaauaagcaaugaacuaaaucacauccuuuuagaaaaugauaugaaauuuacagugguuguaggugacgcaaauggaauauuagcacaagguaagaaaaugauuaggccccaaccuauggagcacagguacucauggaaaaguugggggaaggcuaaaauuauuggugccgacauccaaaauucaaccuucauaauugacgguccagauaccccagaaugucccgacgaucagagagcauggaauaucugggaagucgaagacuauggauucggaauauuuacuacaaacauuuggcuaaaguuacgcgacucuuauacucaaaugugugaccaucgacugaugagugcugcgauaaaagacucaaaggcaguccaugcagacaugggauauuggauagaaucugagaaaaaugaaacauggaaacuugccagagcuucauuuauugaaguaaagacuuguauauggccaaaaagccauacucuauggucaaauggaguauuggaauccgagaugaucauaccaaaaaucuacggaggaccuauaagucagcauaacuacagacccggauauuuuacacagaccgcggguccuuggcaccugggaaaauuggaguuagauuucgaucuaugugaaggcaccacaguugugguagacgaacacuguggcaauagaggccccucucuacggacgacaacugucacagguaaaauuauacaugaauggugcuguagaaguuguacuuuaccgccguugcgguuccguggcgaggauggauguugguacggaauggaaauacgccccgucaaagaaaaagaggagaacuuaguuagauccaugguaucagcaggaucgggagaaguagauucuuucagucuagguauauugugugucaguauuaugauagaagaaguuaugagaagccguuggucccgaaaaauguugaugacuggaacuuuagcaguuuuucucuuauuaauuauggggcagcuaacuuggaaugauuuaauucgccucuguaucaugguaggagcaaaugccagugauagaauggggaugggaacaacauacuuagcacucauggcaacuuucaaaaugaggccaauguuugcuguaggucugcuauuuaggaaacuaacgucuagagaaguucucuuacuaacaauaggguugucucuaguagcuagcguugaguuaccaaauucccuagaagaacugggagauggacuugcaauggguauuaugaugcugaaguuauugacggaauuucaaccucaucaacuauggacaacacuacuuucccuaacauucauaaaaacuacuuugucguuggacuaugcauggcgcacaauggcaaugguacucucaauaguuagccuauucccacuuuguuuaucaacaacaucucagaaaacuacgugguugccuguuuuguuaggaucuuuuggauguaaaccucuuaccauguuuuugaucacagaaaacaaaaucuggggaaggaaaucguggccccuuaaugaggguauuauggcuaucgguauuguuuccauuuuacuuuccagccuacuuaaaaaugauguaccacuggcaggaccauuaauugccggaggaaugcugauagcuugcuacgucauuucuggaucaagcgcugaucuaaguuuggaaaaagccgcugaagugucaugggaagaagaagcugaacacucaggaacaucucauaauauauugguugaggugcaggacgauggaacuaugaaaaucaaagaugaggaacgagaugacacauuaacuauauuacugaaggcaacacuauuagcgguuagcggaguuuacccaaugucuauccccgccacucucuuuguaugguauuuuuggcagaagaagaaacaacgguccgguguccuuugggauaccccaucuccuccugaaguggaaagagcaguacuggaugaugguauauauaggauauugcaacggggacuauuaggucgcucacaaguuggaguaggaguauuucaagacgggguuuuucacacaauguggcaugucacacgaggagcgguguuaauguaucagggaaaacgacuggaaccgucaugggcaucugugaagaaagauuuaaucaguuaugguggaggauggagguuucaggguagcuggaauacaggugaagagguacaaguuauagcgguagaaccagguaaaaaucccaaaaauguucagacaacgccuggcacuuuuaaaacaccagaaggggaaguuggagcgauagcacucgauuuuaaaccuggaacaaguggaaguccaauaguaaaccgggagggaaaaguaguuggacuguacgguaaugguguagugacaacuagcgguaccuacguuagugcuauagcucaggccaagacaucccaagaaggcccgcugcccgaaauagaagaagaagucuuuaagaaacguaauuuaacuauaauggaucuucacccuggaaguggcaagacucgcagauaucuuccagcuaucguuagggaagcaauaaagcgcaagcugaggacuuuaauacuugcaccaacaaggguuguagcgucagagauggccgaggcucuuaaggguaugccaauacgauaucaaaccacugcaguuaaaagugaacacacuggaagagaaauuguagaccucaugugccaugcuacauucacaaugaggcuauuaaguccaguacguguaccaaacuacaacaugaucauaauggacgaagcucauuuuacagauccagcaaguauugcugcuagagguuacaucucaaccagaguaggcaugggagaagcugcagcaauauuuaugacugcaacacccccuggaucuguugaagcauucccacaaagcaaugcugugauucaggacgaggaacgggacauaccugaaagaaguuggaacucaggguaugacuggauaacagauuucccaggcaaaacaguaugguuugugccaucgaucaaaucggggaacgacauagcgaacugccuaaggaaaaaugguaaaagagugauacagcugagucgcaaaacguucgauacagaauaccagaaaacaaggaacaacgauugggauuacguaguaaccacagauaucuccgaaaugggugcgaacuuccgcgcagauagaguaauugacccuagaagaugucuaaagccaguaauacucaaagauggucccgaacgaguuaucuuagcaggcccgaugcccguuaccguggcuucugcagcucaacgccgaggccgaaucggaagaaaccaaaauaaagaaggggaccaauacguuuauaugggucaaccauugaauaaugacgaggaucaugcacauuggacugaagcgaagaugcuccuugauaauauaaauacaccagaggguauaauaccagcccuuuuugaaccugagcgagaaaaauccgccgcgauugauggagaguacagacuaagaggggaagcacgaaaaaccuuuguagagcucaugcgucggggugauuugccuguaugguugagcuauaaggucgcuucggaaggauuccaauauagugauagaagaugguguuuugacggagaacggaacaaccaaguccuagaagaaaauauggauguagagaucuggacuaaagagggggaaagaaagaaacucaggccgagauggcuugaugcucgaacauauuccgacccacuagcgcugcgagaguucaaagaguuugcggcaggacgacgcucaguauccggcgacuugauuuuagaaauaggcaaauugccucaacauuuaacccuccgagcccaaaaugcuuuggacaaucuggucaugcuacauaacucagaacaaggugguaaagcguauagacaugcgauggaagaauugccggacacgauagagaccuuaauguuacucgcuuuaaucgccguacuuacaggcggagucacguuauucuucuuguccgguaaaggucuaggaaaaacaaguauaggcuuauuauguguaauggcuucgucggcauuacuuuggauggcaaacguagaaccccacuggauagcugcgaguaucauccuugaauuuuuccuuauggucuugcuaauaccugaaccugauagacaacgcacaccgcaagauaaucagcuugcuuauguaguaauuggacuacuauuuaugauacugacaguugcggcaaaugaaaugggccuucuagaaacaacuaagaaagauuugggaauaggacauguggcggcagaaaaucagcaccacgcgacaauguuggauguggauuuacgucccgcuagugcauggacacuuuaugcgguugcuacaacugugauuacacccaugaugcgacauacgauugaaaacacaacugcaaacauaucgcugaccgcaauagcgaaucaagcggcaauauugaugggacuggauaaaggcuggccaauuucuaagauggauauaggcguuccacuauuagcucuaggauguuauagucaaguuaacccauuaacacuuacagcagcaguucuuaugcucguagcacacuaugcaauuauugggccagguuuacaagcgaaagcuacuagagaggcgcaaaaacgaacagccgcaggcaucaugaaaaaucccacgguggauggcauuguagcaauagacuuggauccaguugucuaugacgcgaaauuugaaaaacaacucggacaaauaaugcuccuuauacugugcacaagccaaauucuguuaaugagaacgacuugggcguugugugaaucaauaacguuagcgacagggccauuaacgaccuuaugggagggcagccccgguaaauuuuggaauacgacaauagcgguauccauggcaaauauauuucgcgguaguuauuuagccggagcaggauuggcauuuucauuaaugaaaaguuuagguggagggagaagaggcacgggagcacaaggugaaacguugggagaaaaauggaaacgacagcugaaccaauuauccaagucagaguuuaauacauacaaacguagugguauaauggaggucgacagauccgaagcgaaggaaggccuaaaaagaggagaaaccacaaaacacgccgucucgaggggaacugcuaagcugagaugguuuguagagcguaacuuaguuaagccugagggaaaagucauugaucuagggugugggaggggaggauggucauacuacugugcuggacuaaagaaaguuacggaaguuaaaggauauacaaaaggaggaccggggcaugaggaaccgaucccaauggccacauacggauggaaccuaguuaaauuguauaguggcaaggauguguucuuuacuccgcccgaaaaaugugauacguuacuaugugauaucggagaaucaucuccaaauccgacaaucgaagaagguagaacauuaaggguuuuaaaaaugguggagccuuggcucagaggcaaucaauucuguauuaaaauacuuaacccauauaugcccucugucguggaaacguuagaacaaaugcagagaaaacacggagguauguuaguuagaaaucccuugucuagaaauucuacgcaugaaauguauuggguuucaugcgggacagguaauauaguuuccgcuguaaauaugacgaguagaauguuacugaaucgauuuacuaugacucacagaaagccaaccuacgagcgugauguagaccuuggugcggguacacggcauguagcuguagaaccagaaguagcaaauuuagauauaaucggucaacguauagaaaauaucaaaaaugaacacaaaucaacauggcacuaugacgaagacaacccuuacaaaaccugggcuuaccaugggucguaugaaguaaaaccuagcggauccgccagcuccaugguaaacggaguaguacgucugcuuacgaaacccugggaugugauuccuauggucacucaaauagcuaugacugacaccacgccauuuggucaacaaagaguauuuaaagaaaaaguagacacaagaacuccuagagccaaacgagguacagcacaaauuauggagguaacugcaaaauggcuguggggauucuuaucuagaaauaagaaaccaagaauauguacuagagaagaauuuacucggaaaguacgauccaacgcugccauaggcgcaguuuucguagaugaaaaccaguggaacucagcaaaggaagccguagaagacgagagguucugggaccuaguucauagagagcgagagcuacacaaacaagguaaaugcgcgacauguguuuauaauaugauggguaaaagagagaagaaacucggagaauuugguaaggcaaaaggaucacgugcuauaugguacaugugguugggggcacgauuucuggaauuugaagcucuagguuuuaugaaugaggaucacugguuuucuagagaaaacucguuuaguggcguugaaggugaaggucuucauaaacugggguacaucuuacgugauauuucgaaaauuccaggaggcaauauguaugcagaugauacagccgguugggauacaagaauaacggaagacgauuugcaaaaugaagcuaaaauaacagauauaauggagccagaacaugcguuauuagcuacaaguauauuuaaguuaacauaccagaacaaaguggugcgcguacagcgccccgccaaaaaugguacgguaauggacguaauauccagaagagaucaaagggguucaggacaaguagguacauacggccuuaacacauuuacuaacauggaagugcaacuuauaagacaaauggaaucugaaggaauauuucugccaucggagcuagaaacaccuaauuuagcagagcgcguuuuaaauuggcucgaaaaacacgggaccgagagacuuaaaagaauggccauaaguggagacgacuguguaguaaaaccagucgacgacagguucgcgaccgcuuuaauagcucuaaacgacaugggaaaagugcgaaaggauauaccacagugggaaccuagcaaaggauggaacgacuggcaacaaguacccuuuuguucucaucacuuucaucaacuaauaaugaaagacggaagggaaauugucguaccaugccgcaaucaagaugaauugguagggcgugcaagaguaucacaaggcgccggauggucauuaagagagacagcaugccugggaaaaucauacgcacaaauguggcaacugauguacuuccaccgucgugaucuaaggcuggcagcgaacgccauaugcucugcugugccuguggauuggguuccaacuagccguacaacuuggaguauacacgcucaccaucaauggaugaccacagaagacaugcuaucagucuggaauagaguuuggauagaggaaaauccuuggauggaagauaaaacacauguuucuucaugggaggaaguaccauauuuaggcaaaagggaggaucaauggugcggaaguuuaaucggucugacugcucgcgcuacuugggcaacaaauauccaaguagcaauaaaucaaguacgaagauuaauaggaaacgaaaauuaucuagacuauaugaccagcaugaaaagguuuaaaaaugagucugaucccgaaggagcacuaugguaa

SEQ ID NO: 21376 - RNA, 9879 nt, Artificial Sequence
  derived and/or modified CDS sequence (opt6) from DENV-1__FJ390379__SS-prME
ucaguaacuaugcuauuaaugcuacucccuacggcacuggcauuucacuuaacuacuagagguggcgaaccucacaugauuguaaguaaacaagaacgaggaaaaucguuacuauucaaaacuucagcaggaauuaacauguguacucuuauugcaauggauuuaggcgaacuaugcgaagauacuaugacauauaaauguccacguauaacagaagcagaaccggaugacguugauugcugguguaaugcuacagacacuugggucacauaugguacauguagucaaacgggugaacauagaagagauaaaagaaguguagcucuagcaccucaugucggacuaggccucgaaacucgcacggaaacauggaugucaucugaaggggcauggaaacaaauacagaaaguagaaacgugggcuuuaagacauccaggguuuacgguaaccgcgcuauuccuagcgcaugcuauuggaacgaguauuacacaaaaagguauuauauuuauuuuauuaauguugguaacaccuaguauggccaugcgauguguugggauaggaaacagagauuucguugaaggucuaucgggagcaacauggguugaugucguuuuagaacaugguaguugcguaacgacgauggcgaaagacaaaccgacacuagauauagaacuauuaaaaacagaaguaacaaaucccgcagucuugcgcaaacuaugcauagaagcaaaaauauccaauacaacaacagacucuagaugcccgacgcaaggcgaagccacccugguagaagaacaagauaguaauuucguuugcagacgaacuuucguagacaggggauggggcaacgggugcggacuuuuuggaaaaggaaguuuauuaacuugugcaaaauuuaaaugcguuacuaaacuagaagguaaaauuguacaauaugaaaaucuaaaauauaguguuauugugacuguucacacuggagaccagcaccaggugggcaaugaaaccacagaacauggaaccauagcuacaauaacaccacaagcccccacgagugagauucaauuaaccgauuacggugcuuugacacuugacugcaguccucgaacaggucuagauuuuaacgaaaugguacuuuugacuaugaaggagaaaucuuggcugguucauaaacagugguuccuggaucucccuuuaccauggacaaguggagcguccacuucgcaagagaccuggaaucgccaagauuugcuugugacguuuaagaccgcacacgccaagaaacaagagguugucguucuaggcagucaggaaggggccaugcacacugcucugacgggagcgacggaaauacagacauccgguacaaccacaauauuugcaggacacuuaaagugucgacugaaaauggauaaguuaacauuaaaaggcaugagcuauguaaugugcacggggucauuuaagcuggaaaaggaagucgcagaaacucagcacggcacuguacucguacagguaaaguaugaagggacagaugcaccuuguaagauaccuuucucugcucaagaugaaaaaggagugacacaaaaugguagauugaucacagccaauccuauuguaaccgacaaagaaaaacccguaaauauagagacagaaccacccuuuggugagucauauauaguagugggagcaggagagaaagcacuaaaauugaguugguuuaagaaaggaagcaguauugguaaaauguucgaggcaacagcuagaggagcaaggaggauggcgauacuaggagacacagccugggacuuuggcagcauaggagggguuuucacaaguguaggcaaauugguacaccaaguuuuuggggccgcauauggcguucuauuuagcggaguauccuggacuaugaaaauuggaauagguaucuuauuaacgugguuaggucuaaauucuagaucaacgucacugucgaugacaugcauugcgguugggaugguuacucuauacuuaggaguaaugguacaggcugauagcggauguguuauuaauuggaaagggcgcgaauuaaagugugguucagguaucuuuguuacuaacgaaguucauacuuggaccgaacaguauaaguuucaagccgauucaccaaaacgucuuucggcggcaauaggaaaagcaugggaagaggguguauguggcauucgaagugcaacaaggcuagaaaacaucauguggaaacaaauuuccaacgaacuaaaccauauacuucuugaaaaugacaugaaguucacugugguuguuggagaugcuaacgguauucuagcacaaggucgaaaaaugauacguccucaacccauggaacaucgauacaguuggaaaaguuggggaaaagcuaaaaucauuggagcagauauacaaaauucaacauucauaauagauggaccagauacacccgaauguccggaugaucaacgugccuggaauaucugggaaguagaggauuacggauuuggcauauuuacuacuaauaucuggcuaaaauuacgcgacucuuauacucaaaugugugaucacagauuaaugagcgccgcaauaaaggauaguaaagcaguacaugcagacauggguuauuggaucgagagugagaaaaaugagaccuggaaauuagcacgugcaucuuuuauugaagugaaaacguguauuuggccaaaaagucauacauuauggucgaaugguguucuagagucugaaaugauaauacccaaaauauacggaggaccaauuucccagcauaacuaucgcccaggauauuuuacucagacggcugguccauggcaucuagguaaacuagaacuagauuuugacuuaugcgagggaacaacaguagucguagaugaacauugcggaaaccgaggaccaucccuacgaacaaccacaguaacggggaaaaucauccacgaaugguguugccguagcuguacauuaccaccguugcgguuccgaggugaagacggauguugguacgguauggagauuaggccagugaaagaaaaagaagaaaacuugguaagguccaugguuucagccggcucaggugaaguagacaguuucucccucggcauauuguguguuaguauuaugaucgaagaagugaugaggucccgcuggucacgcaaaaugcuaaugacaggaacuuuagcuguguuucugcuccuaauaaugggccaacuaacauggaacgaucugauacgcuuaugcauaaugguuggugccaacgccagcgauagaaugggaaugggcacuacuuaucuggcuuuaauggcgacauuuaaaaugagaccgauguucgcugucggacuauuauucagaagauuaacaucacgcgaaguacuucuauuaacgauaggacuuucauuaguugccucugucgaguuacccaacagucuagaagaacuaggagauggcuuagcgaugggaauaaugaugcuaaaacuccucacggaauuucaaccacaucaauuauggacaacacugcucagucuaacguucauaaagacgacauuaucguuagauuaugcauggagaacaauggcaaugguuuuaagcauagugucuuuguuuccacucugucuaaguaccacaucacagaaaacuacauggcuuccgguacuucuuggcucguuuggauguaaaccguuaacaauguuucugauuacugaaaacaagauuuggggacguaagucuuggcccuuaaacgaagguauaauggccauagggauuguuucgauuuugcuaucaucucuacugaaaaacgauguaccgcuugcugguccauuaauugccggcggaaugcugauagcuugcuaugucauuucaggaucaucggccgauuuaucacuugagaaggcagcagaaguaucuugggaagaagaagcagagcauucagguacuucacauaacauauuaguagaagugcaggaugauggaacgaugaaaauuaaagaugaggaacgcgaugauaccuugacaauccuacuaaaagccacauugcuagcuaucagugguguauacccuaugucgauaccagccacauuauuuguaugguacuucuggcaaaagaaaaagcagagaucuggaguacuuugggauacaccaucuccuccugaggucgagagagcuguacuagaugacggaauauacaggauccuacaacguggucuauuaggucgcagucaagucggagugggaguauuccaggauggaguuuuucacaccauguggcacgugacaagaggcgcgguacuuauguaucaagggaaaagacuugaaccgucaugggcaagugucaagaaagaucuaauaaguuacggaggaggguggcgauuucaaggaaguuggaauacuggagaagaaguacagguaauugcuguugaaccugguaagaauccgaaaaauguacaaacuacucccgggacguuuaagacccccgaaggggaaguaggggcaauugcucuggauuuuaaacccggaacaucagggucuccuauaguaaaucgugaagguaaaauaguggguuuauauggaaacggggugguaacaaccuccggaaccuaugugagugccauugcacaggcaaaaacgagucaggaagguccguuaccggaaauugaagaagaaguguuuaaaaagaggaaucuaaccaucauggaucuacacccaggcuccgggaagaccagaagauacuuaccggcaauagugcgcgaagcaauaaaacgaaaacugaggaccuuaauauuagcgccaacaaggguuguggccucggaaauggcagaagcacugaaagguaugccuauacgcuaccagacaacagcagucaaaucagagcauacaggucgagagaucgucgaccucaugugucaugcuacauucacaaugagacucuuaaguccaguaagaguccccaauuauaauaugaucauaauggacgaagcucacuucacagauccagcgagcauugcagcaagaggcuauauaucaacuagaguugggaugggagaagcagcagcgauauucaugacagcuacacccccuggcucaguagaggcauuuccacagucuaaugcugugauccaggaugaagaacgagacauaccugaaaggucuuggaauagcggcuaugauuggauaaccgacuuuccugguaaaacgguaugguucguaccauccaucaaaagugguaaugauauagcaaauugccuaaggaaaaacggaaaacgaguuauucaauuaaguagaaaaacuuucgauacggaauaccaaaagacaaggaauaacgauugggacuauguagucacaacagauauaagugagaugggggcaaacuuuagagcggaccgcgucauugaccccaggcgaugucugaaacccguaaucuugaaggaugggcccgagcgagucauacuggcuggcccuaugccagugacgguagcaucagcagcgcaaagaagagguaggauuggacgcaaucaaaauaaagagggcgaucaauauguauauaugggccaaccauugaacaaugaugaagaucaugcucacuggacugaagcuaaaaugcuacuagauaauauuaacacaccugaagguauuauacccgcacuuuuugaacccgaacgcgaaaagucagccgcuaucgacggcgaauaucguuugcgaggagaagcaaggaagaccuucguggaauugaugcgaagaggagaucuaccaguauggcucaguuacaaaguagcguccgaagguuuccaauauucggauagaagaugguguuuugauggugaaagaaauaaccagguauuagaagaaaacauggaugucgaaauauggacaaaagaaggugaacgcaaaaaguuacggccucguuggcucgaugcgagaacuuauucagauccgcucgcauugagagaauuuaaagaguuugcggcaggacggaggucuguauccggagacuugauuuuagaaauagggaaacuuccacaacaucuuacucuuagggcucagaaugcuuuggauaaccugguaaugcuucacaacagcgaacaaggugguaaggcuuacagacacgcaauggaagaguugccggauacgaucgaaacauuaaugcuacuugcauugaucgcgguccuuacuggaggaguaaccuuauuuuucuuaaguggcaaaggcuuagggaaaacuucuauaggacuauuauguguaauggcuuccucggcgcuuuuauggauggcuaacguagaaccacacuggauugcagccuccauuauucucgaguucuuucuuaugguauuacuaaucccggaaccagaucgucaaaggacaccccaggauaaccaauuagcauaugucguuaucggacuacuauuuaugauacuaacaguagcagcgaaugagaugggccuuuuagaaacaacuaagaaagauuuagguauuggacacguugccgccgaaaaccaacaucaugccacaaugcuugacgucgauuuacgaccugcuagugcguggacacuauaugcaguagcaacgaccgugauaacgcccaugaugagacacacgauagagaauaccacugcgaauauaagucuuacagcgauagccaaccaggcagcaauucuuaugggauuagauaaaggauggcccauaaguaaaauggauauagguguuccacucuuggcucuuggaugcuacucacaaguaaauccgcuaacacuaacugcagcaguauugaugcuaguagcacacuaugcgauuaucggacccggauuacaagcgaaagccaccagagaagcucaaaaacguacugcugccggaauuaugaaaaauccaacaguagauggcaucgucgcuauagacuuagauccuguuguauacgaugcaaaauuugaaaaacaacucgggcaaauaauguugcugauacucuguacaucucaaauacuccuuaugcguacaacaugggcacuaugugagucuaucacuuuggcuacggggcccuugacaacucuaugggagggauccccuggcaaauuuuggaauacaacaauagcggucaguauggcgaauauauuuagagguagcuauuuagcaggagcaggacuugcauuuagccuaaugaaaagucuagggggcggucgacgugggacaggugcacaaggcgaaacguuaggagaaaaauggaagcgacagcucaaccaauuaagcaaaucagaauuuaauacauauaaacggucuggaaucauggaaguagaucgaucugaagcuaaagagggucugaaaagaggagaaacaaccaaacaugcuguaagucgcgguacugccaaauuacguugguuuguggaacgaaaucucgugaaaccagaaggaaagguuauagauuuagggugugggcgaggaggcuggaguuauuauugcgcagggcucaagaaagugacugaagugaaaggguauacaaaaggcgggccgggucacgaagaaccggugccuauggcaacuuacgguuggaaccuggucaagcucuacucugguaaagacguauucuuuaccccaccagagaagugugacacguuauuaugugacauuggugaaagcaguccaaauccaacgauugaggagggacggacgcuucgaguauugaaaauggucgaaccguggcuaagagguaaucaauucuguauaaagauauugaaccccuauaugccaaguguuguagaaacacuugaacaaaugcaaagaaagcacggagguauguuaguucgaaauccucuaagcagaaauucuacacaugagauguauuggguaucauguggaacaggcaacauuguaagcgcagugaauaugacuagcagaaugcuacucaaucgauuuacgaugacucacagaaagccuaccuaugaacgugacguggauuuaggugcuggcacacgacauguggcaguagaaccagaaguagcuaacuuagauaucauaggccaaagaauugaaaacaucaaaaacgagcauaagucuacauggcacuacgaugaagauaaucccuacaaaacuugggcauaucaugggucauacgaggugaaaccauccgguucugcuucaucuaugguaaacggaguaguccgucuacucacaaagccuugggacguuaucccuaugguaacacaaauagcaaugacugauacgacuccauuugggcaacaacgagucuucaaagaaaagguagauacuagaacaccgcgggccaaaagagggacagcucaaauaauggaagugacagcgaaaugguuguggggauucuuaucucggaauaagaaaccccggauaugcaccagagaggaguucaccaggaaagugagaucuaaugcagcaauuggcgccguauucguagacgagaaccaauggaacagugcaaaagaagcaguggaagaugaaagguucugggaccucguacaucgcgaacgagaacuccacaaacagggaaaaugugcaacuuguguauauaacaugaugggaaaaagagagaagaaacuaggggaguucggcaaggcaaaaggaucacgugcaauaugguauauguggcuaggagcccgguuccuagaguucgaggcacuagguuuuaugaacgaagaucauugguucucaagagaaaacucauuuaguggaguagaaggggaagguuuacauaaacuagguuauauucucagggacaucagcaaaauacccggcggcaauauguaugcagacgauaccgcagggugggauacucgcaucacugaggacgaucuacaaaacgaggcaaagaucaccgauaucauggagccggaacacgcauuauuagccacauccauauuuaagcuaacuuaucagaacaaaguggucagagugcaaagaccagccaaaaacgggacaguaauggaugugauaucacgucgagaucagcgcggcucuggacaaguuggcaccuaugggcucaauacguucaccaauauggagguacaacuuauaagacaaauggaaucagagggaauauucuuaccuucugaacuugaaacuccuaacuuagccgaacgcguccuugacugguuagagaaacacgguacagaacgauuaaaacgaauggcuauaaguggcgacgacugcguuguuaaaccaguagaugauagauuugccacagcccuaauagcacuaaaugacaugggaaaagugagaaaagacauuccucaaugggaaccuagcaaaggcuggaaugauuggcaacaagucccauuuuguagccaccauuuucaucaacuuauaaugaaggaugguagagaaauagugguaccgugccguaaucaggacgagcuaguagggagagcacgugucucucagggagcuggcuggucguugcgcgaaacagcuugucuggguaaauccuacgcucaaauguggcaauuaauguacuuccaucgaagagaccucagguuggcugcuaacgcuauuuguucagcaguaccaguggacuggguacccaccucacgaacaaccuggagcauucacgcacaucaucaauggaugacaacagaagacauguugucaguauggaacagaguauggaucgaggaaaacccuuggauggaagacaagacucacguaucuucaugggaagaagucccauaucuaggaaaaagagaagaucaguggugcggaucguuaauaggacugacagcuagagcaacaugggcaacuaauauucagguagcgaucaaccaaguccgucgauuaauagguaaugagaacuaucuagauuauaugacaucaaugaagcguuuuaagaacgaaagugauccggaaggagcucuuugguaa

SEQ ID NO: 21377 - RNA, 9879 nt, Artificial Sequence
  derived and/or modified CDS sequence (opt6) from DENV-1__FJ390380__SS-prME
ucaguaacaauguuacugauguuauuaccuacugcucuagcauuccaucuaacaacaagagguggagagccucauaugaucguaaguaaacaagaaagagguaaaucacuuuuauucaaaacgucggcagguauaaauaugugcacauugaucgcuauggaccuuggggaauuaugcgaagacacaaugacuuauaaauguccuagaauuacugaggcugaaccugaugacguugauugcugguguaaugcaacugauacauggguuacauauggaacaugcagucagaccggugaacauagacgagauaaaagaucgguagcauuggcaccccacguaggacuugguuuagagacuaggacagagacuuggaugaguagugagggcgcauggaaacaaauccagaaaguagagacaugggcauuaagacacccaggauucacgguuacagcacuauucuuagcucaugcaauuggcacgagcauaacucaaaaaggaauaauuuuuauccuccugaugcugguuacaccaaguauggcaaugcgauguguugguauuggcaaccgagauuucguugaaggauuaucgggcgcaacuuggguagaugugguauuggaacacggauccugugugacuacuauggcuaaagacaaaccgacacuugauauugaauuacuuaaaacagaggugaccaacccugccguccuaagaaaacuuuguaucgaagcuaaaauuagcaauacaacaacugauucacguugcccuacucaaggugaagcuacguuaguugaagaacaagauagcaauuucgucuguagaagaacauuuguagaucgaggaugggguaauggauguggacuuuucggaaaagguucauuguugacaugcgcaaaauuuaaaugcguuacaaaauuagaggguaaaauagugcaauacgaaaauuuaaaauacucaguaauuguaaccguacauaccggugaucaacaccaggucggcaaugaaacaacugagcauggcacgauagcaaccauuacaccgcaggcaccgacuucugaaauacaauugacagauuauggugcucuaacucuugauuguuccccaagaacaggguuagauuucaaugaaaugguucuauuaacgaugaaggagaaaagcuggcugguucacaaacaaugguuucuggacuuaccacuucccuggacgucgggagcuucaacaagucaagaaacauggaaccgacaagaucucuuaguaacuuuuaaaacugcgcaugccaagaaacaagaaguuguuguguuaggaucgcaagagggggcgaugcacacagcucugacuggagcaacugagauucaaacuagcggcacaacuaccauauucgcgggacauuugaaauguagauuaaaaauggauaaauugacccugaaagggaugucauauguuauguguacggguaguuuuaaacucgagaaagaaguagcagaaacucaacacggaacaguauuaguccaggucaaauaugaagguacagacgccccgugcaaaauuccuuucagcgcacaagaugagaaaggagucacacagaaugggcgacuaaucaccgcuaacccaauagucacagauaaggaaaaaccgguaaauaucgaaaccgaaccgccguuuggugagaguuauauuguaguaggugcuggagagaaagcucuaaaguuaaguugguuuaagaaaggaaguaguauaggaaagauguuugaagccaccgcucggggugccaggcgaauggcaauacucggcgauacagcgugggacuucggauccaucggcggcguauuuaccucgguaggaaaacugguucaucaagucuuuggcgccgcauacggaguuuuauucagugggguuuccuggacuaugaagaucggcauugguauuuugcuaacguggcuuggacuaaauucgagaucaacuagcuuaaguaugaccugcauagccguaggaaugguaaccuuauaucugggagugaugguacaggcggauucaggauguguaaucaauuggaaaggucgcgaguuaaaaugugguagugguauuuucguaacaaacgaaguacacaccuggacggagcaauauaaauuucaggcagauaguccaaaaagguuaucugccgcaauagguaaagccugggaggagggaguaugugguauacgcucugcaacaagacuugaaaacauaauguggaaacaaauaaguaacgaacuaaaucauauuuuacuggaaaaugauaugaaauuuacaguaguaguaggagacgcaaacggcauacuggcacaggguaagaaaaugauaagaccccagccaauggaacauagauauucauggaaaucuugggguaaggcaaaaaucauuggugcagauauucagaauagcacauuuauaauagacggcccagacacaccagaaugucccgacgaccaacgugccuggaauaucugggagguggaagacuacggauuugggauuuuuacaacuaacauauggcuaaaacugcgagauagcuauacucaaaugugugaccaccgcuugauguccgcugcuauaaaagauaguaaagcaguacaugccgauaugggauauuggaucgagucugagaaaaaugagacauggaaacuagcaagggcuaguuucauugagguaaagacguguauauggccaaaaucacacacccucuggaguaaugguguauuagaauccgaaaugauaauacccaaaauuuacggagguccaauaucccaacauaacuaucguccaggguauuuuacccaaacagccgggcccuggcacuuagggaaacuagaacuagacuucgaguuaugugaaggcacuacuguaguuguugaugagcacugugguaauaggggaccgucacugcgcacgacaacuguuacaggaaaaauaauacaugaaugguguuguaggucuuguacauuaccaccguuacgauuccggggagaggacggauguugguaugguauggaaauuaggccaguaaaggaaaaggaagaaaauuugguuagaucaaugguaucugcagggucgggagaaguggacucuuuuucccuagggauacugugugucaguauuaugauagaggaagugaugaggaguagauggagucgaaagaugcuaaugacuggaacuuuaguaguauucuuccuacuaauaaugggacaacuaaccuggaaugauuuaauacgacucuguauuaugguuggugcaaaugcgagugauagaaugggaaugggaacgacuuauuuggcgcucauggcaacguuuaaaaugagaccaauguuugcgguuggcuuguuauuucggcgauuaacaucuagggaaguauugcuucuaacaaucggguuaagucucguggccucaguagaacuaccaaacucauuagaggagcuaggggacgguuuggcgaugggaaucaugaugcuaaaauuauugacagaauuucaaccucaccaacuauggacaacgcuccuaucccuaacguuuauaaaaaccacgcucagcuuagauuaugcguggcgaacuauggccauggucuuaagcauaguauccuuauucccgcugugcuuaucuacgaccucacagaagacuacguggcuaccaguccugcuagguucauuugguugcaaaccccuaacaauguuuuuaauuaccgaaaacaagauaugggggcgcaagucauggccuuuaaacgaagggaucauggccaucgguauuguaaguauucuucuaucuagucuguuaaagaacgacgugccguuagcaggaccuuuaaucgcaggagguaugcuaauagcaugcuauguuaucuccggcucgucggcagauuugaguuuagagaaggcagcagagguaagcugggaagaagaagcugaacauucagguacuucucauaauaucuugguggaaguccaagaugauggaacgaugaaaauaaaagacgaagaacgcgaugauacgcucacaauacuacuaaaagcgacguuacuugcagugaguggaguuuaucccaugucaauaccagcgacauucuucgugugguacuuuuggcagaaaaagaaacaacgaucgggaguucuuugggauacuccgucgccacccgaagucgaacgugcagugcuugaugauggaauuuaucguauauuacaacgaggacuauuggguagaucacaagucgggguuggaguauuccaggacgggguuuuucauacaauguggcauguuacaagaggagccguuuuaauguaccaggguaaaagauuagaaccaagcugggcaucuguaaagaaagaccuuauaaguuauggaggaggguggcgguuucaagggagcuggaacaccggcgaagaagugcaaguaauagcaguagagccuggcaaaaauccuaaaaacgugcaaacaaccccaggaaccuucaagacacccgaaggagaagugggagcaaucgcacuagauuucaaaccagguacuuccgggagcccaauaguaaauagggaaggaaaaauagucggacuguaugggaacggcguaguaaccacauccggcaccuacguuucugcgauugcacaagcaaaaacgucccaggagggaccacuaccggaaauugaagaagagguguuuaagaaaaggaauuugacaauuauggaccuacacccuggaucugggaaaacuaggcgauaccuccccgcuauaguuagggaagcaauuaaacgcaaacuaagaacccuaaucuuagcuccuacgagaguaguagcgagcgagauggccgaagcacugaaaggaaugccgauuagguaccagacgaccgcaguaaagucagagcauacagguagagagauaguagaccuuaugugccaugccacauuuacgaugagacuacucaguccaguaagaguacccaauuauaauaugauuauaauggacgaagcccacuuuacagauccggcgucuauagcugcgaggggcuauauaucaacaaggguaggaaugggagaagcagcggcaauuuucaugacagcuacacccccuggcagcguagaagcauuuccucaaaguaaugcagugauucaagacgaagaacgagauauuccugaaagaucuuggaacuccggcuaugacuggaucacagacuucccaggaaaaacugucugguuuguaccaagcauuaaaagugggaaugauauugcgaauuguuuacgcaaaaaugguaaaagagucauucaacucucucggaagacguuugauacugaauaccaaaagacccggaauaacgacugggacuauguaguaacuacagauauuagcgaaaugggugcaaauuuccgcgcugauagggugauagauccuaggcgaugccuaaaaccggucauucucaaagacggaccugagagagucaucuuagcugguccuaugccagugaccguagcauccgcagcccaaaggagaggcagaauaggcagaaaucaaaauaaagaaggagaucaguacgucuauaugggccaaccauuaaauaaugaugaggaccacgcgcacuggaccgaggccaaaaugcuacucgauaauauuaacaccccagaaggaauaauuccugcauuauucgaaccggagcgagaaaaauccgcagcaauugacggugaguaucgauuacgaggggaagcaaggaaaacauuuguagagcuaaugagaaggggcgaucuaccuguuuggcuaucauauaaaguagccucagaaggauuccaauauucagauagaagauggugcuuugauggugagaggaauaaucaaguauuggaagaaaauauggauguugaaauauggacaaaagaaggagaaagaaagaaguugcgacccagauggcuagacgcuagaacauauagugauccccuagcuuuacgugaguucaaggaauuugcagcugggagaaggucuguaucaggugaucucauauuagaaauaggcaaguuaccacaacauuuaacgcuccgagcgcaaaacgcacuagauaauuuaguaauguuacacaacagugaacaagggggcaaggcuuauaggcaugcgauggaagaguuaccagacacgaucgaaaccuuaauguuguuagcuuuaauagccguacugacgggaggaguaacucuauucuuucuuucagguaaagguuuagggaagacaucuauaggauugcuauguguuauggccagcagugccuugcuauggauggcaaauguugaaccucacuggauagcugcaaguauaauacucgaauuuuucuuaaugguccuauuaauaccggaaccagaccgacaacgcacuccccaagauaaccaauuggccuacguaguaaucggguuauuguuuaugauuuuaacgguagcagcgaaugaaaugggacuacuagaaacuaccaagaaagauuuagggauagggcacguagccgcugaaaaccaacaucaugcgaccaugcuagaugucgacuuaaggccugccagugccuggacucuuuaugcaguagcuaccaccgucaucaccccuaugaugcgacauaccauagagaauacaacugcuaacauaaguuugacagcaauagcuaaccaggccgcuauacuuaugggucucgauaaaggauggccaauaagcaagauggacauuggcgucccauugcucgcacuaggaugcuauucucaaguaaauccucugacacuuaccgccgcuguacuaaugcuaguagcgcacuaugcaauaaucggacccggauuacaggcuaaagcuacgcgugaagcccaaaagcgaacagcagcaggaauaaugaaaaauccgacaguggauggaauugucgcgaucgacuuagacccaguuguauaugacgcaaaauuugaaaaacaacucggacaaaucauguugcuuauuuugugcacaucccaaauacuauuaaugagaacuacaugggcauuaugugaaaguauaacguuagcuacuggcccauuaacaacauuaugggaagggagcccaggaaaauucuggaacacaacaauagcugugaguauggcuaauauauuccgcgguucuuaucucgccggugcuggacuagcauucaguuuaaugaagucauuaggaggaggacgaagagggacgggggcucagggcgaaacccuuggagaaaaauggaaaaggcagcuaaaucaguuguccaaaucugaauuuaauacauacaaacgcucugguauuauggaaguugaucgaucugaggcuaaggaagguuuaaagagaggugaaacaacuaagcaugcggucagucgugggacagcaaaauugaggugguucguagaacgcaaucuggugaaaccagaagggaaggugauagaccuuggcuguggcagaggaggauggucguacuauugugcuggauugaagaaaguaacugaaguuaaaggcuauacaaaaggugggccgggacacgaagaacccauacccauggcaacuuacgguuggaacuuaguaaaauuauauagugguaaagauguuuucuuuacacccccugaaaaaugugauacauuacugugugauauuggagagucuucacccaacccaacuauugaggaaggaagaacccuuagaguauugaaaaugguggagcccugguuacggggcaaucaauuuugcauaaagauuuugaacccauauaugccaaguguuguugaaacacuagagcaaaugcaaagaaaacacgggggcaugcuaguucgcaacccucuaucuagaaacucaacgcaugaaauguacugggucaguuguggaacggguaauauugucucagcagugaauaugaccaguagaaugcucuuaaacagguucacuaugacccaucguaaaccaaccuaugaaagggauguugaucuuggagcuggcacucgacacguugcaguagagccugaaguagcaaacuuagacaucauuggucaaaggaucgagaauauuaaaaaugagcacaaaaguacuuggcauuacgaugaagauaauccuuacaaaacaugggccuaucauggcagcuaugagguaaaaccaucgggauccgcaucaucaauggucaacggaguaguucgauuacugacaaaaccgugggacguaauaccgaugguaacccaaauagcuaugacggacacuacaccauuugggcagcaacgaguauucaaagagaaaguagacacucggacaccaagagcuaaacgaggaacagcgcagauaauggagguuacagcaaaaugguuauggggauuucuaagucguaauaagaagccaagaauuuguacucgugaagaguucacaagaaaaguccggagcaaugcugccaucggagcagucuuugucgaugagaaucaauggaacucagcaaaggaagcuguggaggaugaacgcuucugggaccuaguccaccgugagagagaacugcauaagcaaggcaaaugcgcuacguguguauacaauaugaugggcaaacgagaaaagaaacuaggcgaauuuggcaaagcaaaaggcagucgagcgauaugguauaugugguuaggggcaagguuucuagaauuugaagcguugggauuuaugaacgaagaccauugguucucucgugagaacaguuucagcgguguugaaggagaaggauuacacaaauugggauacauauuacgagacauaagcaaaauaccgggcggaaacauguaugcugacgauacugccggaugggauacacgaauuacugaagaugacuuacaaaaugaagcaaaaauaacugauaucauggagccugaacacgcauugcucgcgacuucaauauuuaaauuaacuuaucaaaauaagguaguaagaguucaacgaccugccaaaaaugguacagugauggacguuauuucacgaagagaccagaggggguccggucagguuggaacguauggucucaacacauuuacaaauauggaaguccaauugauuagacagauggaaucagaagguauauuuuuacccucugaacucgagacaccuaaccuagcggaaagagucuugaacuggcuagagaagcauggaacggaaagacuaaaaagaauggcaauuagcggggaugauuguguaguaaaaccaguggaugauagauucgcaacugccuuaauugcccucaacgauauggguaaagugcgaaaggauauaccacaaugggagcccaguaaagguuggaaugacuggcaacaaguaccuuucugcagucaucauuuccaucaacucauaaugaaagacgggagggagauugucguaccgugucgaaaccaggaugaauuggucgguagggccagaguaucacaaggcgcaggauggucauugagagaaacggcuuguuuagggaaauccuaugcacaaauguggcaguuaauguauuuccacaggcgugaucuacgucuggccgcuaaugcuauauguagugcuguaccgguagauuggguaccaaccucuaggacgacguggucaauucaugcacaucaccaguggaugaccacagaagauauguugagcguguggaaccguguuuggauugaagaaaacccuuggauggaagacaaaacacaugucucguccugggaagaaguccccuaucuaggcaaacgcgaggaucagugguguggaucccuuauagggcuaaccgcuagggcaacuugggcaacgaauauccaagucgcgaucaaccaagucagacgacuaaucgguaaugaaaauuacuuggacuacaugacaaguaugaaacgguuuaaaaaugaaucugacccagaaggcgcacuaugguga

SEQ ID NO: 21378 - RNA, 9879 nt, Artificial Sequence
  derived and/or modified CDS sequence (opt6) from DENV-1__FJ205874__SS-prME
aguguaacaauguuguuaauguuauuaccaacgguauuggcauuucaucuuacaacacgagggggagaaccgcacaugauuguugggaaacaagaaaggggaaaaagucuucuauuuaaaacaucugcaggaguuaauaugugcacauuaauagcgauggaucucggagaacugugugaagauacaaugacuuacaaauguccucgaauuacagaagcugaaccugacgauguggauugcugguguaacgcaacggauacauggguuacuuacgguacauguagucaaacaggggaacaucgucgagacaaaaggaguguagcauuagcuccucacguaggacucggucuagaaacacguacagaaacauggaugagcagugaaggagcuuggaaacaaauucaaaaaguagaaacgugggcacuucggcaucccgguuuuaccgucauagcguucuuucuagcccacgccauuggaacgucuaucacucaaaaaggaauuauauucauucuacugauguuaguaacuccgaguauggcaaugagaugcgucggcauaggaaauagggauuucguugaaggauugucaggggccacauggguagauguuguauuggagcaugggucaugcgugacaacaauggcuaaaaauaaaccaacuuuagauauagaauuguuaaaaacagaagugacgaauccggcaguauugcgcaaacucugcauagaagcuaaaaucucuaacacaacaacugauagucguugcccaacacaaggugaggcaacuuuagucgaagaacaagaugcaaacuuuguuugccguaggacauuuguagauagaggcugggguaacgggugugggcuuuucggaaaagguucacugcuaacgugcgcaaaauucaaauguguuacaaaauuggaggguaaaauaguacaauaugaaaaucuaaaauauaguguaauaguaaccguccauacuggagaucaacaccaaguggguaaugaaacaacagaacacgggaccauagcgacaauaacaccacaagcaccaacgucagaaauucaacuuacagauuacggugcacugacacuagauugcucgccacggaccgguuuggacuuuaaugaaaugguguuacuuacaaugaaagagaaaaguuggcuuguccauaaacaaugguucuuggaucuaccuuugccauggacaucaggcgcuucaacaucacaagaaacauggaauaggcaagaucuuuugguuacauuuaaaaccgcacaugcgaagaaacaagaagugguagucuuaggaucgcaggaaggugcgaugcauaccgcacucacaggagcuaccgaaauccaaacuucaggaacgacgaccaucuucgcgggacaucucaaauguagauuaaaaauggauaaacugacucucaaagguaugaguuauguaaugugcaccggcaguuuuaaacucgaaaaagaagucgcagagacacagcaugguacaguguugguucaaguuaaauaugaagguacggaugcaccaugcaaaaucccuuugucaacucaagacgagaaagguguaacacaaaauggucgucucaucacugcaaacccaauaguuacggauaaagaaaaacccguuaauauugagacagaaccaccguucggggaaaguuacaucauaguaggggcuggggaaaaagccuugaaauuaucaugguuuaagaaaggcagcucaaucgggaaaauguucgaggcuacugcuaggggagcuagaagaauggcaauuuuaggugauacagcuugggacuuuggaaguaucggaggcguauucacaaguguggguaaacugguccaccagguguucggaacagcauauggaguacucuuuagcgggguauccuggacuaugaaaauaggcauaggaauacuuuuaacuuggcucggauuaaauagcagaucagcuucauuaucaaugacgugcauugcuguaggaaugguuacccucuaucuuggaguaaugguucaagccgacuccggauguguaauuaauuggaaaggcagagaacuuaaaugugggaguggaaucuucgucacaaacgaaguacacacguggacagaacaguacaaauuucaagcagauagccccaaaagacuaucugcugccauaggcaaagcaugggaagaggguguuugcgguguuagaagcgcuacaagacuugaaaauauuauguggaagcagaucaguaacgaacucaaccacauuuuauuagaaaaugauaugaaauuuacugugguagugggcgacgcuaacggcauucuggcgcaagguaagaagaugauacguccccaaccaauggaacauaaauauaguuggaaaaguugggguaaggcgaaaauaauaggagcggauauccaaaauacuacauucauaauugaugguccggauaccccagaaugcccagaugaccaaagagcauggaauauaugggagguggaagauuauggcuuuggcauauucacuacaaacauaugguuaaaauuaagagacucuuauacacagaugugcgaucaucgacuaaugucugcagcaauaaaagauucaaaagcaguccaugccgauaugggguacuggauugaaagcgagaaaaacgagacuuggcgucuugcucgagccagcuuuauagaagucaaaacauguauauggccgaaaucgcacacucucugguccaacgggguacuugaaucggaaaugaucauuccaaaaauauacggagguccaaucucacaacacaauuacagacccggcuacuuuacucagacagcaggaccguggcaucuaggcaaacuugaacuugauuucgaccucugcgaggguaccacaguagugguagaugaacauuguggcaaucggggaccuucacuuaggacaacaacugugaccggaaaaaucauucacgaaugguguuguagaucuuguacucuaccuccuuuaagauucagaggcgaagauggaugcugguauggcauggaaauuagaccaguaaaagaaaaggaagagaaucuagugcguuccaugguguccgcagguucuggggaaguagacucauucucacuagggauacuauguuuaucuauaaugaucgaggaagucaugcguucacgguggagccgaaaaaugcuuaugacagggacacuugcuguauuucuguugcuaauuaugggucaacuaacuuggaaugaucucaucagguuauguauuauggucggcgccaaugccucugaucgcaugggcaugggcacgacauacuuagcauuaauggcaaccuuuaaaaugaggccuauguucgcagugggguugcucuuuaggcgauuaacaagucgagaaguauuguuacuaacaaucggccuaucacuggucgccuccgucgaauuacccaauuccuuggaagaguuaggggauggccucgcaauggguauuaugaugcugaaauuacuaacggaauuucaaccacaucaacuauggacuacuuuauugagucucacuuuuauuaaaacaacucuuucacuagauuaugcauggaagacgauggcgaugguauuaucaauugucucauuauuuccauugugcuuauccacaacaucccagaaaaccaccugguuacccgugcugcuagguagcuuuggauguaaaccgcugacgauguuucuaauuacggagaauaaaauauggggcaggaaaaguuggccgcuaaaugaagggauaauggcaauugggauuguaucuauccugcucucgucgcuauugaagaaugauguaccucuagcggggccuuuaauagcaggggguaugcucauagcuuguuacgucauuucagguucaagugcagacuuaagucuagaaaaagcugcugaaguuaguugggaagaagaagcugagcacucggggacgucgcacaacauccuuguagaaguucaagacgauggaacuaugaaaauaaaagaugaagaacgagaugacacacucacuauauuauuaaaagcgacacuccuagcuguaucugguguguacccgauguccauaccagcuacacuauuuguaugguauuucuggcagaagaagaaacaacgcuccggcguacucugggauaccccuucaccuccugagguagaaagagcaguucuggaugacgggauuuaccguauucuucaaagaggacuguugggacgcagucaagucggaguaggagucuuucaggacggaguauuucacacuauguggcacguaacaagaggggcuguuuuaauguaccaagguaaaagauuagaaccuucaugggcuaguguuaagaaagauuugauaagcuaugguggaggauggagauuucaaggaucuuggaauacgggcgaagaaguacaagugauagcaguugaacccggcaaaaauccuaaaaacguucagaccacucccgguacauuuaaaacaccagagggcgaaguaggggcugucgcuuuagauuuuaaaccaggaacaagcgggucuccaauaguaaauagagaaggaaaaauaguaggucucuacggcaacggaguaguaacaacuuccgggacuuauguaagugcgauagcucaagcaaaagccucacaggaggguccccuaccagagauagaagacgaagucuuuaagaaacguaaccuuacaauaauggacuuacauccagggucagggaaaacacgaagguaucuacccgcgaucguaagggaagcaauaaaaagaaaacucagaacacucaucuuagccccuaccagaguuguugcaagugagauggcagaggcauuaaaaggaaugcccauccgauaucagaccacagccgucaaauccgaacauacaggacgugaaauugucgacuuaaugugccaugccacauucacaaugagacuacuuagcccaguccgagucccuaauuauaacaugaucauaauggaugaagcacacuucacagauccugcaucuaucgcggcccgaggauauauaagcacgcgcguuggaaugggagaggcugcggcgauuuucaugacagccacuccuccaggcucaguugaagccuuuccacaaaguaaugcgguaauacaagaugaggaacgagauauuccagagcgaucauggucgagcgguuaugacuggaucacagauuucccaggaaagacggucugguuugucccaagcauaaaauccggaaaugacaucgccaauugcuugagaaagaauggaaaacgaguaauacaacuuucgcggaaaacauuugauacugaauaccagaaaacaaagaauaacgauugggauuauguaguuacgacagacauaagugaaaugggagcuaacuuucgagcagaccgcgucauugauccaagacgaugucuuaaaccugugauccugaaagacggaccagagcgaguaauacuugcagguccaaugcccguuacuguugccagcgcugcccaaagaagaggacgaauagguagaaaucaaaauaaagagggagaccaauacgucuacaugggacaaccucugaacaaugaugaagaucaugcgcacuggacagaagcaaaaauguuauuagacaauauaaauaccccagaaggaauuauaccagcuuuauuugaaccggaacgagaaaagucggcugcaauagauggcgaguauagguuaagaggggaagcacguaagacuuucguggaauuaaugaaaagaggagacuugccagucugguuaucauauaaaguagcuagugaagguuuccaauacucugaucgacgguggugcuucgacggugaaagaaauaaucaaguauuagaggagaacauggacguagaaauuuggacaaaagagggagagagaaagaaacuuagaccuagaugguuggacgcacgcacauauucugacccauuagcgcuucgugaauuuaaagaguuugcagcaggaagacgaagugugaguggcgacuuaaucuuagaaauuggaaaauugccccaacaucugaccuugagagcacaaaaugcucuagauaaccuaguuauguuacauaacucggagcaaggagggaaagcguaucgccacgccauggaggagcucccagacacgauagaaacccuaaugcuacuagcacuuauagcuguguuaacaggagguguaaugcuguucuuccuaucagguaagggacucgguaaaacauccauaggacuauuauguguaauggcuagcagcgcucuauuauggauggcaaguguagagccccauuggaucgcagcaucuaucauauuagaauuuuucuugauggugcuauugauaccggaaccagacaggcaaagaacaccucaagauaaucaacuugccuauguggucauaggacugcuauuuaugauccuuacuguugcagcuaacgagaugggccuacuugagacuaccaagaaagauuuggggauaggucauguugcugcagaaaaucaucaucauguuacaaugcuagauguugaucuuagaccggcuuccgcuuggacguuauacgcaguugcuacuaccgucauaacaccgaugaugcgucauacuauugaaaauaccacagcaaauauuagccugacugcaauagcgaaccaagcagcaauucuuaugggccuagauaaaggcuggccuaucucuaaaauggauauuggcguuccauuauuagcgcucggauguuauucccaagucaauccgcucacucuaacagcugcaguguuaaugcuuguggcacauuaugcuauaauaggacccggccugcaagcuaaagccaccagagaggcacaaaaacgaacugcagcuggcauaaugaaaaauccaacaguagauggaauuguagcuauugauuuagauccaguaguauaugaugcaaaauucgaaaaacaacucggccaaauaaugcuguugauauuauguaccucccaaauacuccuaaugaggacaacaugggcucugugugaauccauuacccuggcgacagguccccuaacaacuuuaugggaagguaguccugguaaauuuuggaauacuacgauagcaguguccauggcaaauauuuucaggggaaguuaucuagccggggccggccucgcuuuuucucuaaugaaaagucucggagguggcagacgugguacaggugcucaaggggaaacacuaggugaaaaauggaaacggcagcuuaaccagcugucaaaaagcgaauuuaauacuuacaaacguucagguauaauggaaguugaucguuccgaagcaaaagaaggacucaaaagaggugaaacuacuaaacaugcuguaaguaggggcacggcuaaguugagaugguucguugaacgaaacuuagugaaaccagaaggaaaggugaucgaucuuggaugcggcagagggggauggaguuacuacugcgcggguuuaaagaaaguuacagagguaaaggguuacaccaaaggaggucccggacaugaagaaccaauucccauggcaacguacggauggaauuuagugaaauugcauagcggaaaggauguuuucuuuaccccaccagaaaaaugugauaccuugcuaugugauaucggcgaaucaucuccaaauccgacuauagaagaaggucgcacguuaagaguacuaaaaaugguugaaccgugguugagggguaaucaguuuuguaucaaaauacugaauccuuacaugccaucggucgucgagacucuagaacagaugcagaggagacauggaggcaugcuaguaagaaacccgcucucgagaaauucaacacaugagauguauuggguaagcuguggcacaggaaacauaguaucggccguaaauaugacuagcagaauguuacuaaauagauucacgauggcccaucggaaaccuacuuaugagcgagacgucgauuuaggcgcagggacaagacauguggccguggaaccagagguugcuaauuuaggaauuauaggacagcgaauugaaaacauuaaaaaugaacauaaaagcacguggcacuaugacgaagauaaccccuacaaaaccugggcuuaccacggauccuacgaaguaaaacccucugguucagcuagcucgaugguaaacggcguaguacgucuauuaacuaagccaugggauguaauaccaauggucacacagauagcgaugaccgauacaacaccguucgggcagcaaaggguauucaaagaaaagguagauaccagaacgccgcgagccaagcguggaaccgcacaaauuauggagguaacugcaaagugguuaugggacuuuuuaucuagaaacaagaaacccagaauaugcacaagggaagaauuuaucagaaaaguccggaguaacgccgcgaucggggccgucuuuguagacgaaaaucaguggaacucugcaaaagaagcuguagaagaugaacgauucugggaucugguacacagagagcgagaauuacacaaacaaggcaaaugugcaaccuguguuuauaauaugaugggaaaaagagagaagaaauuaggagaguucgguaaagccaaaggcaguagagcaaucugguauauguggcuaggggcaagauuucuugaguucgaagcucucggcuucaugaaugaagaucauugguucagucgcgaaaacucuuuaucaggagucgagggugagggacuacauaaguuagguuacauacucagagacauaucuaagauaccuggagguaauauguaugcagacgacacugcagguugggacacaaggauuacagaggacgacuuacaaaaugaagcuaaaauuaccgauauaauggaaccagaacaugcacuacuggccaccaguauauucaaauugacauaccagaacaagguggugagaguacaaagaccagcaaagaauggcacugucauggacguaauuucgcgaagagaucaacgaggaucaggucagguaggaacauauggauuaaacacguuuacaaauauggagguccaacucauacgucaaauggaguccgaaggaauauuucucccgagcgaauuagagacuacaaaucuggcagaacgaguacuggauuggcuugagaaacauggaguagaacgacuaaaaagaauggccauaaguggagacgacugcgugguaaaaccuauagacgauagauuugcgacugcucuuauagcucucaaugacaugggaaaaguacgcaaggacauuccucagugggaaccuaguaaaggauggaaugacuggcaacagguaccuuuuuguucucaccauuuucaccaacuuauaaugaaagauggcagagaaaucguggugccaugccggaaucaagaugagcuagugggccgggcgaggguaucacagggcgcaggguggucauuaagagaaacugccugccuggguaagucuuaugcccagauguggcagcuuauguacuuucacaggcgcgaucuacgguuagcggcuaaugcgaucugcagcgcgguccccguagauugggugccgacgagucgaacuacuuggagcauacacgcgcaucaccaauggaugacgacugaagauauguuaucaguuuggaauaggguauggauagaagaaaauccuuggauggaagacaagacacauguuucaagcugggaagaaguaccuuaucuuggaaaacgagaagaucagugguguggcucacuaauaggucugacggcacgagccacuugggccacgaacauacaaguagccauaaaccagguuaggagauuaaucggaaaugagaacuaccuagauuacaugacuucuaugaagagauucaaaaacgaaagugacccagaaggcgcgcuuugguag

SEQ ID NO: 21379 - RNA, 9879 nt, Artificial Sequence
  derived and/or modified CDS sequence (opt6) from DENV-1__FJ205875__SS-prME
aguguaacgauguugcuuaugcuacuuccgaccgcacuggcauuccaucuaacgacgagagguggugaaccacauaugauuguuucaaaacaagaacguggaaagucucuccucuuuaaaacuucggccggaauaaauaugugcacauugauagcaauggaccuaggagaacucugcgaagacacaaugacauauaagugcccgcggauuacagaagcggaaccagacgacgucgauuguuggugcaacgccacagauaccugggugacuuacggaacuuguagucaaacuggggaacauaggagagauaaacguuccgucgcacuagccccacaugugggauuaggauuggaaacucgaaccgaaacauggaugaguagcgaaggagcguggaagcaaauucaaaaaguugaaacaugggccuugcgacauccaggauucacggugauugcacuauuuuuggcgcaugcuauuggcacuagcauaacucaaaaaggaauaaucuuuauucuccucaugcuugucacaccaucaauggccaugagaugugucggaauaggaaauagagacuuuguagaaggauuaucaggagcgaccuggguggaugucguauuggaacauggaucauguguaacuacaauggcaaaagauaaaccaacauuagacauugaacuacuuaaaacugaagucacuaauccugcaauccucagaaaacuuuguauagaagcgaaaauuagcaacacaacuacagacaguagaugcccaacacaaggugaagcaacuuuaguugaggaacaagacgccaauuuugucugucguagaacuuucguagaucguggauggggaaaugguuguggauuauucggaaaagguucacuuuuaacgugugcaaaauuuaagugugucacaaagcucgaaggcaagauaguacaguaugaaaacuuaaaauauucagucauagugacaguucauacgggagaccaacaucaggugggcaaugagacuacggaacauggcacgauagccacgaucacaccucaggcgccaacuagcgagauucaacuaacggauuauggagccuugacgcuugacugcucuccccgcaccggauuagauuuuaacgaaaugguauuacuuacgaugaaagagaaaaguuggcuagugcauaaacaaugguucuuagaucuaccuuugccauggacaaguggugcuucaacuagccaagagacuuggaauagacaagacuuacucguaaccuuuaagacagcccaugcuaagaaacaggaaguagucguucuugguucucaagaaggagcaaugcacacggcccuuacuggagcaacggagauucagacaucagguacaacuaccauauuugccggacaccuaaaaugucgcuuaaaaauggauaaacuaacucuaaaaggcaugaguuacgucauguguacgggcucauuuaaacuggaaaaagaggucgcagagacccaacacggcacgguauugguccaagugaaauaugaaggaacugaugcaccuugcaaaauaccauuuucaacucaagaugaaaaggguguaacgcaaaacggacgacuaauaacugccaauccaaucguaacggauaaagaaaagccugucaauauagaaacagaaccuccuuuuggggaaucauacauaguaguaggggcuggagagaaagcucucaaauuaucaugguuuaaaaagggcucgucgauugguaaaauguuugaagcaacagcuagaggggcuagaagaauggcaauauugggugacacugcaugggacuuugguucgauugguggcguauuuacaaguguaggaaaauugguacaucaaguauucgggacggccuacggcguccuuuuuaguggaguuagcuggacuaugaaaauaggaauugggauacugcuuacaugguugggauuaaacagccgaaguacaucacucagcaugacguguauugccguaggaauggucacgcuauacuuagguguuaugguccaagcagauagcggcugcguaauaaauuggaaaggccgugaguuaaaauguggaagcggaauuuuuguaacuaaugaggugcauacuuggaccgaacaauauaaauuucaagccgacucuccaaaaagauuaagugcggcaauuggaaaggcaugggaagagggaguaugugguauuagaagugccacuagguuagaaaacauaauguggaaacaaauaagcaaugaauuaaaucacauacuacuggaaaacgauaugaaauucacgguaguuguuggggacgccaauggaauacuugcgcaaggcaagaaaaugauucgaccacaaccaauggaacacaaauauaguuggaaaagcugggguaaggcuaaaauaaucggugccgauauacaaaauacuacauuuauuauugauggcccggauacaccugaauguccagaugaucaaagagcauggaacauaugggagguagaagauuacggguuuggaauauuuacaacgaauauuuggcuaaagcuacgagacucauauacucaaaugugcgaucauaggcuaaugagugcugcaaucaaagacucuaaggcuguacaugcugauaugggguacuggauagaauccgaaaagaacgagacuuggaaauuggcucgagcaucuuuuaucgaaguaaaaacuugcauuuggccaaaaucacacaccuuauggagcaauggcguucuggaaagugagaugauaauucccaaaauuuauggcggaccgaucucccaacacaacuacagacccgguuacuuuacucaaacggcagguccauggcaccuugggaaauuggaacuagacuucgauuuaugcgaggggacgacaguaguaguagaugaacauugcggaaaucgaggaccaucgcuacguacaacuaccgucacuggcaaaauuauccacgagugguguugcagaucauguacccucccaccacuaagauuucgcggugaagacggauguugguaugguauggaaauaagaccaguaaaagaaaaagaggaaaaucugguucgauccauggugagugccgguuccggagaaguagauagcuucucguuagggauucuuugugugagcauuaugauagaagagguaaugagaucaagguggaguaagaaaaugcugaugacagguacacuugcgguuuucuuguuacuuauuaugggucagcugacauggaaugacuuaauacguuuauguauaaugguaggagcaaacgcuagugacaggaugggcaugggcaccacuuaucuagcauuaauggcuacauucaaaaugagaccuauguuugcggucggauuguuguuuagacgacuaacaucacgcgaaguacuguuauugacgauaggacuaucauuaguagccagcguugaacugccaaauagccuagaagaacucggcgauggacuagcaaugggaauaaugauguuaaaacuacugacggaauuucagccucaccaauuguggaccacuuuauuaucauuaacauucauaaaaacgacauugagucuagauuacgcauggaggacgauggcuauggugcuaucuauaguuucauuguuuccacucugcuugaguacuacuagccagaaaacaacuuggcuaccuguguuguuaggaaguuucggguguaagccucuaacaauguuucucaucacugagaauaaaauauggggaaggaaaagcuggcccuuaaaugaaggaaucauggcuauugguauuguuucaauccuuuuaucaagucuacuaaagaaugacguaccgcucgccggcccauuaauagcagggggcaugcucauugcuugcuacgucauaucaggaaguucggcugaucugagucuugaaaaagcggccgaaguuagcugggaagaagaagcagaacauagcggaacaagccauaauauccuaguugaaguucaagacgaugggaccaugaaaauaaaagacgaagaaagagacgauacccucacuauauuacuuaaggcaacccugcuugcgguaaguggagucuauccgaugucaauucccgcuaccuuauuuguuugguacuuuuggcaaaagaagaaacaaaggucgggcguguugugggauacccccagucccccagagguggagagagcgguacuugaugacggaauuuaucgaauauuacagcgaggacuacucggucgaagucaaguuggaguggggguauuucaagacggaguguuucacacuauguggcaugucaccagaggagccguucuaauguaucaagggaagagacuagaaccuucuugggcaucugugaagaaagaccugauuaguuacgguggggguuggcgguuucaaggauccugguccaccggagaagagguacaaguuauugcuguagaaccaggcaaaaaccccaaaaaugugcagacaacuccggguacuuuuaagacgcccgagggugagguaggagcaaucgcacuagacuuuaagccgggaacuucuggaagcccuauaguaaacagagaaggcaaaauaguaggacucuauggcaacggaguggugacgacgagcggaacauauguuagcgcaauagcucaagcaaaaacgagucaagagggaccauuaccggagauugaagaugaaguuuucaagaagagaaaucuaaccaucauggaccuacauccggguucaggaaaaacccgaagguaucuuccugcaauagugcgcgaggcgaucaagcgaaaauuacgaacacuaauucuugcacccacaagggugguugcgucggaaauggccgaagcauugaaagguaugccaauuagauaucagacuacagcagucaaaagugaacacacaggccgcgaaauuguagacuugaugugccacgccacuuucacuaugcgauuauuaucgccggucagaguaccaaacuacaauaugauaauaauggaugaagcucauuucacugauccagcaagcauagcggcucgugguuauauuucuacuagaguggguaugggugaagcugcggcaauauuuaugacugcaacaccaccaggaucuguggaggcguuuccucaaaguaacgcgguaauucaagaugaagagagagacauuccggaaaggagcuggaacucgggguacgacuggauaacugauuuuccuggaaagacaguuugguuuguaccgucaauaaaaucggggaacgacaucgcgaauugccugaggaaaaauggcaaaagaguaauucaacuuucaagaaaaacauuugauaccgaauaucagaaaacgaaaaacaacgauugggauuauguggugaccacggacauuucugagaugggagcuaauuucagggcggaucguguuaucgauccaagacguugcuuaaagcccguuauuuugaaagaugguccugaacgcgugauacuagcaggaccaaugcccguaacuguugcaucagcagcccaaagacgcggacguauuggcaggaaccaaaauaaagaaggugaccaauacguauauauggggcaaccacugaacaacgaugaggaccaugcacauuggaccgaggcaaaaaugcucuuagacaauauuaauaccccugagggcauuauaccagcguuauucgaacccgaacgcgaaaaaucagcugcaauugauggugaguacagacugaggggugaagcuaggaaaacuuuuguagaauugaugcgucgcggggaucugccugucuggcuaagcuauaaaguagcauccgaagguuuccaauauagcgaucggagaugguguuuugauggagagcggaauaaucaaguacuugaagaaaauauggacguagagauauggacuaaagaaggcgaacgaaagaaauugcgaccuagauggcucgacgcgaggacguacucggaucccuuggcauugagggaauuuaaagaauuugcagcggggcgacggucgguuaguggugaccuaauucuagaaauaggaaaauuaccacaacaucuaacacuacgagcccaaaaugcucucgacaacuuaguaaugcugcauaauucagaacaaggaggaaaagccuaucgacaugcaauggaagaauuaccugacacaauagaaacuuugaugcuuuuagcauugauagcgguuuuaacuggcgguguaacacucuucuuucuaucugggaaagggcucgggaaaacaaguauuggucuuuuaugcgugauggcaucaagcgcauuacuguggauggcgaacgucgagccucacuggauagcagcuucgauuauauuagaauuuuuccugauggugcuuuuaauucccgaaccugaucgacagaggaccccacaagacaaucaacuugccuacguuguuauagguuuacuauuuaugauauugacggucgcagcaaaugaaaugggauuacucgaaacgacuaagaaagauuugggaaucggucaugucgcggcagaaaaucaccaucacgcgacuaugcuggauguagauuugagaccagcaagcgccuggacauuauaugcaguggcgacgaccguuauuacuccuaugaugagacauacaauagaaaauacaacagcuaauauaucacuuacugcgaucgcaaaccaagccgcuauacuaaugggguuagacaaaggauggccuauuucaaaaauggauaucggugugcccuugcuagcucugggcuguuacucgcaaguuaacccucuuacucugaccgcugcaguauugaugcuugucgcgcauuaugcuauuaucgguccaggucuucaagcaaaggcaacacgugaagcgcagaaacgaacugcggcuggcauaaugaaaaauccgacuguggauggaauaguagcaauagaucuugacccaguuguuuacgaugcaaaauuugagaagcaauuaggucagauaaugcuccuuauuuuaugcacaucacaaauacuauuaaugagaacgacaugggcacuuugugaaucaauuacacucgccacaggaccacucacuacacuuugggaagguuccccugggaaauuuuggaacacaacaauugcugugagcauggcaaacaucuuucgaggcucauauuuagcuggugcagggcucgcguuuagcuuaaugaagucacuuggagguggccgacgaggaacuggcgcccagggcgaaacacugggagagaaauggaaacgucaacuaaaucaauuaaguaaaagugaguuuaauacauacaaacgaucugggauaauggaaguggacaggucagaagcgaaagaaggacuuaaaagaggagagacaacaaaacaugcgguguccagagggacggcaaaauuaagguggcugguagaacggaauuuaguuaaaccagaagguaaaguaauagacuuagguuguggacgcgguggauggucauacuauugcgcugggcucaaaaagguaaccgagguuaaaggauauaccaaaggagggccuggucacgaggaacccauaccaauggcuacauauggcuggaacuuagucaaacuuuacagugggaaggauguauucuuuacaccacccgaaaaaugugacacacuauuaugugauauaggcgaaucgagcccaaauccaaccauugaggaggggcgaacauugaggguacuuaaaaugguagaaccgugguuacgaggcaaucaauuuuguauaaaaaucuuaaauccguauaugccgaguguuguugagacacuugagcagaugcaacguaaacacgguggcaugcuaguuagaaacccauuaucuaggaacaguacacaugagauguacuggguaucauguggaacugggaacauaguuucugcaguaaacaugacgagucguauguuguuaaacagauucacuaugguccaccgaaaaccaacauaugagcgggaugucgauuuaggagcugguacucgucauguagcaguagaaccagaaguagcgaaccucgauaucaucggacaacguauugaaaacauuaaaaacgaacauaaaaguacauggcauuaugaugaagauaauccguauaaaacuugggcuuaucauggaagcuacgaaguaaagccaaguggaucggcaucaaguaugguaaaugguguuguaagauuacuuacaaagccaugggacguaaucccaauggugacgcaaaucgcaaugacggacacaacaccuuuuggacaacaaagagucuucaaagaaaaaguugacacucguacaccaagagcuaaacguggcacugcacaaauaauggagguaacugccaaauggcuaugggguuuccuuaguagaaacaagaaaccaagaaucuguacacgggaagaguucaccagaaagguaagaucuaacgccgcgauuggcgcaguauuuguagaugaaaaccaauggaacagugccaaagaggcuguugaggaugaaagauucugggaccucgugcaucgagagcgugaauugcauaaacaagggaaaugcgcgacauguguauauaauaugaugggaaagagggaaaagaagcuaggcgaguucggaaaggcuaaaggaucuagagcaaucugguacauguggcuuggggcaagauuuuuggaguucgaagcgcuaggguucaugaaugaagaccacugguuuucaagagaaaauucauuuagcggaguagagggcgacggauugcauaagcucggguauauccuacgagauauaucuaagauuccgggaggaaauauguaugcagaugacacagcagggugggauacuagaauaaccgaggacgaucugcagaacgaagcaaaaauaaccgauauaauggaacccgaacaugcauugcuagcuacuuccaucuucaagcuaacuuaccagaauaaagucguaaggguccaacggccugcaaagaacgggacuguaauggauguaauaucgagaagagaucaaagagguucuggccaggugggaacauauggauuaaauacuuuuacgaacauggaagcucaacuuauuaggcagauggaaagcgaaggaauauuuuuaccauccgaauuagaaacaccaaaucuugcagagcgaguauuagacugguuagagaagcauggaacggaacgccuaaaacgcauggcaauuucaggugaugauuguguggugaaaccaguggaugauagauuugcgacugcacucacagcacuuaaugauaugggcaaaguuaggaaagauauuccacaaugggaaccuucgaaaggauggaaugacuggcagcaaguaccguuuuguucacaccauuuucaccagcuaaucaugaaagauggaagagagauugugguaccauguagaaaucaagaugagcuugugggacgugccagaguaagucaaggugcuggcuggucuuugagagaaacugcaugucucggcaaaucuuacgcacaaauguggcaguuaauguauuuccauagacgggaucuucgacuagcagcuaaugccauauguucagccguaccuguggauuggguaccaacuagcagaacaacauggucaauacacgcucaucaucaauggaugacaacugaagauauguuaucuguauggaacagaguuuggaucgaagaaaauccauggauggaagauaaaacucacgugucaaguugggaagaaguaccuuaucuuggaaaacgagaagaccaaugguguggaagucuaauaggccugacagccagagcuacuugggcuacaaauauacaaguggcgaucaaucaagugaggagacuuauagggaacgaaaauuaccuagauuacaugacaaguaugaaaagauucaaaaacgagucagaucccgaaggagcccugugguaa

SEQ ID NO: 21380 - RNA, 9879 nt, Artificial Sequence
  derived and/or modified CDS sequence (opt6) from DENV-1__FJ410173__SS-prME
uccguuaccauguuacugaugcuccucccuacugcguuagcauuccaucuaacgacucgaggaggagaaccgcacaugauugugagcaaacaagaacggggaaaaagccuucuauuuaaaacuuccgcaggaauaaacauguguacgcugauugcaauggacuuaggggaacuuugcgaagauaccaugacauauaaauguccacgaauuaccgaagcggaaccugaugacguugauugcugguguaacgcaacugauacaugggugaccuauggcacauguucucaaacgggagaacacaggcgagacaaaagaagcguggcuuuagcaccacacguaggccuuggcuuggagacacgcacagagaccuggaugucaucagaaggcgcauggaaacaaauucaaaaaguugaaacaugggcucuaaggcauccaggauuuacagucacugcacuauuccuagcacacgcaauaggaacaucgauaacccaaaaaggcauaaucuuuauacuucuuaugcucgugacuccaaguauggcuaugagauguguaggaauaggaaaucgugauuuuguggagggacuaaguggcgcaacguggguagauguaguucuugagcauggaucauguguuacaacaauggcgaaagauaaaccgacauuagacauugaauuacugaaaacagaaguaacaaauccagcaguauugagaaaacucuguaucgaggcuaaaauauccaauacuacuacagauuccagaugcccaacacaaggcgaagcaacucuaguagaagaacaagauagcaacuucgugugccgcagaaccuuuguugacagaggaugggguaauggauguggccucuuugggaaaggaucucuacuuaccugugcuaaauucaaaugcgucacaaaacuagaaggaaaaauagugcaauaugaaaauuuaaaguacagcgugauagucacaguacacaccggggaucaacaccaaguagguaaugaaacaacagagcacgggacaauagcaacaaucacaccucaagcgccuacaacagaaauacaguuaacagauuauggagcauuaacacuugacugcucaccgagaacgggcuuagacuucaacgaaaugguauuguuaacaaugaaagagaagucauggcuugugcacaaacaaugguuuuuagaccucccguugccguggacgucaggcgcuucuacaagccaggagacauggaauagacaagauuuacuugucacauuuaaaacagcucaugcaaagaaacaagaaguaguaguucuaggaucucaggagggagcaaugcacacagcuuuaacuggagcaacagaaauacaaaccucaggaaccacaacaauauuugcgggacaucuaaaaugucgccuaaaaauggauaaacuaaccuuaaaaggaaugucauacguaauguguacuggcaguuuuaagcuggaaaaagaaguagcugaaacucaacacggcacaguguuaguacagguaaaauaugaaggcacggaugcgccaugcaaaauuccauucagugcacaagaugagaaaggcguaacgcaaaauggucggcuaauaacugcuaauccaaucgugacggauaaggaaaagccgguaaauauagagaccgaaccuccauucggagaaagcuacauaguuguaggagcgggagaaaaagcucuaaaacuuaguugguuuaaaaaggguucguccauagguaaaauguucgaagccacugcucgaggggccagaagaauggccauucuaggagacacagcaugggauuuuggcaguaucggcggaguauuuacaucaguagguaaacuuguccaccaaguauucggugcagcauauggaguucuuuucuccggaguaucauggacuaugaaaauugguauugguauccuacuaaccugguuaggcuuaaacuccagaucuaccaguuugagcaugacuuguauugcuguaggcauggugacccuuuaccuggguguuaugguccaggcagauucagguugcguuauaaauuggaaaggaagggagcuaaaaugcgggaguggaauuuuuguuacgaaugaagugcauacuuggacggaacaauauaaauuucaagccgacaguccuaaaagacuaucugcugcaauagguaaggccugggaagaaggcgugugcgggauaagaagcgcaacaaggcuugaaaacaucauguggaaacaaauaucuaaugagcucaaucauauucuauuagaaaaugauaugaaauuuacggucguaguaggagaugcaaacggaauauuagcucagggcaagaaaaugauuagaccacaaccaauggaacaucguuauucuuggaaaagcugggggaaagcuaagauaauuggcgcagauauacaaaacagcacauuuauaauagauggaccagauacaccugagugcccggaugaucaaagggcauggaacauaugggaaguggaggauuauggauuuggaaucuuuacuacaaauaucuggcuuaagcuacgcgauagcuauacccagaugugugaucaccgccuaaugagcgccgcgauuaaagauaguaaggccguccaugcggauaugggauacuggauagaaucugagaaaaaugaaacauggaagcuagcaagagcgagcuucauugaaguaaaaacauguauuuggccuaaaagucacacacuuuggagcaaugguguauuggaaagcgaaaugauaauaccgaagaucuacggugggccaauaucacaacauaacuaucgaccggguuacuuuacacaaacugcaggaccuuggcacuuggguaaacuagaauuagauuuugaccugugcgaaggaacuacugucguaguagacgaacauuguggcaaccgagggccuucauuaagaacaacuacaguuacaggaaagaucauacaugaaugguguugucgaaguugcacacuaccgccgcuaagauucagaggcgaagauggaugcugguaugguauggaaauuagaccaguaaaagaaaaggaagaaaauuugguacggagcaugguaagugcggguaguggagaaguagauucauuuucacuggggaucuuauguguaucaauuaugauagaagaagugaugagaaguagauggucaagaaagaugcuaaugacggguacgcuagcaguauuuuugcuacuaauaaugggucagcucacauggaacgauuuaauaagacuuugcauaaugguaggagccaaugccagugacagaaugggaauggguacaacauauuuggcgcuuauggcuacguucaaaaugaggcccauguuugcgguagggcuccuguuuaggcguuuaacuucacgugagguccuacuauuaacgauuggguuauccuugguagcaucuguagaguuacccaauucauuggaagaauuaggagacggacucgcaaugggaaucaugauguuaaaacuuuuaacugaguuucagccccaucaauuguggaccacguugcuaucauugaccuuuauaaagacaacauugucacuagauuacgcauggagaacaauggcuaugguguuaagcauuguaagucuuuucccauuguguuuaagcacaacgucacagaagaccacuugguuaccuguuuuacugggaaguuuuggguguaagccauuaacaauguucuugauuaccgaaaauaagauaugggggagaaaaagcuggcccuuaaaugaaggaauaauggccauaggaauuguaaguauacuacuuucaaguuuacuaaagaaugauguccccuuagcaggaccauugaucgccggugguauguuaauugcuuguuauguaauaucugguagcucagccgaucuuucauuggaaaaagcagcggagguuucaugggaagaagaagccgagcauucagguaccucgcauaacauccuaguugaaguucaagaugaugggaccaugaaaaucaaagaugaggagagagacgauacauuaacuauucuucuuaaagccacccuauuggcaguuagugguguguauccgaugucaauaccugcaaccuucuuuguaugguauuucuggcagaagaagaaacagagaagugguguauugugggacacgccgucgccgccggaaguagaaagagccguacuggaugaugggauauaucgcauacuacaaagaggauuacuaggcaggucucaaguagguguggguguuuuucaagauggaguauuucacacaauguggcacguuacgagaggagcagucuugauguaucaaggaaaaaggcuugaacccucuugggcaagugucaagaaagaucuuauuaguuauggagguggcuggagauuccaagggucauggaacacgggagaagagguccaaguaauugccguagagccaggcaagaaccccaaaaauguacaaaccacaccugggacuuucaagacaccggaaggugagguuggugcaauagcgcucgacuuuaagccggggacgaguggauccccuauuguaaacagggaagggaaaauugucggauuauauggaaaugggguugucacaacaaguggcacuuacguaucagcuauugcacaggcaaaaacuucacaagagggacccuuaccagaaaucgaggaagaaguauuuaagaaacgaaaucucacaauaauggacuugcacccaggaucaggaaaaacgagacguuaccuaccugcaauuguuagagaggccaucaagaggaaauugcgcacacuaauuuuagcaccuacuagggucgucgcuucagaaauggcggaagcccuaaaaggaaugccuauccguuaccaaacgacagcagugaaaucugaacauaccggacgagaaaucguagaucuaaugugucacgcaacguucaccaugcgccuauuauccccaguuagagugccgaacuacaauaugauaauuauggacgaagcucauuucacagacccggcgagcauagcugcaagaggauacauaaguacuagaguaggaaugggagaggcagcagcaauauuuaugacggcaacgccuccaggaaguguagaggcuuucccacaaaguaaugcagugauacaagaugaagaaagagauauaccagaacggucauggaacucuggauacgauuggauuacggacuucccagguaaaacaguaugguuugugcccucaauuaaaucugguaaugauauagcuaacugccuaaggaaaaacgggaagcggguaauacaauuaagcagaaaaacguucgauacagaauaucagaaaacccgaaauaacgauugggauuauguaguaacaacagacauaucagaaaugggagcuaacuucagagcugauagaguaaucgacccucgaagaugucugaaaccaguaauacuaaaagacggaccagagcguguuauucuagcggguccaaugccaguaacuguggcuagugcggcccaaaggcgagggagaauaggucgaaaucaaaauaaagaaggggaucaauauguauauaugggacaaccacuaaauaacgaugaagaccacgcacacuggacugaagccaaaauguuacuugacaauauuaauacuccagaaggaauaauuccugccuuguucgaaccagagcgugaaaaaucugcagcaauagacggagaauaccgcuuacgaggcgaagccagaaagacuuuuguagaacuuaugagaagaggagauuuaccuguguggcugucuuacaaaguagcgagugaagguuuccaguauucagauagacgcugguguuuugacggagaaaggaauaaucagguacucgaagagaacauggauguugagauuuggacuaaggaaggagagagaaagaaacuaagaccacgcugguuggacgcacgaacuuacagcgacccuuuggcguuaagagaauuuaaggaauuugcagcaggacgacgaucgguauccggcgaucuaaucuuggaaauugggaaacuaccacaacaucucacguuaagagcccaaaaugcacucgacaaucuugugaugcuacauaacagcgaacaaggugggaaggcuuaccgccaugcaauggaagaauuaccugauacgaucgaaacucuaauguuacuagcauuaaucgcuguacuaacaggaggaguaacacuauucuuuuuaagugggaagggccuagggaaaacaagcaucggucuauuguguguaauggcaaguagugcacuuuuauggauggcaaaugucgaaccgcauuggauagcugcgaguauaauacuugaauuuuucuugaugguuuuguugauaccggaacccgacagacagagaaccccgcaggacaaucaauuagcauacguaguuauaggcuuacuguuuaugaucuugaccguagcugccaaugaaaugggauuauuggaaacuacgaaaaaggaccugggaauaggucauguagcugcagaaaaucaacaccacgccacaauguuggacgucgaucuaagaccagcaucugcuuggacuuuauaugcaguagcaacuacaguaaucacaccuaugaugcgacauacaauagaaaacaccaccgcuaauauaucgcuaacggcaauugcuaaccaagcggcaauucuaaugggauuagacaaaggcuggccaaucaguaagauggauauagggguaccuuuacuggcacuaggauguuauucucaaguuaauccauugacacuaacggccgcuguguugaugcuaguggcucacuacgccauuaucggccccgguuuacaggcuaaagcgacccgggaagcucagaaaagaacugcagcugguauuaugaaaaauccaacaguagaugguauuguugcaauagaucuugauccuguaguuuacgaugcaaaguucgaaaagcagcuugggcagaucaugcuucuuauacugugcacuucacagauuuuauuaaugcguacuacaugggcacugugugaaucgaucacacucgcuacaggcccacuaacgacguugugggaaggaaguccuggaaaauuuuggaacacaacaaucgcaguuaguauggcaaacauuuuuagaggaucuuaucuugccggugcaggucuagccuuuagucugaugaagucacuugguggaggaagacgcgggacaggugcgcaaggagaaacacuuggggagaaauggaaacgucaacuaaaccaacuaucaaaaucagaauuuaauaccuacaagcgaagcgguauuauggaaguagacagaucagaagcaaaagagggauugaaaagaggcgaaacuacaaaacaugccguuuccagaggcacugcaaaacucagaugguuuguugaacgaaaucucguuaaaccugagggaaaaguuauagaccuugguugugguagaggcgguuggucauauuauugugcgggacugaagaaaguaacugaaguaaaagguuauacaaaaggcggaccuggucacgaggagccgauuccaauggcgacguaugguuggaaucucgugaaacucuauucugguaaggacgucuucuuuaccccacccgaaaagugugauacauuauugugugacauaggagagucuucaccuaacccuacgauugaagaggggagaacucuucguguguugaaaauggucgagccuuggcuacgagguaaucaauuuuguauaaaaauacugaauccauacaugccaucuguaguagaaacccuagagcaaaugcagaggaaacacgguggcauguuaguuagaaacccacuaaguaggaacagcacacacgaaauguauugggugucuuguggaacuggaaacaucguaucugccgucaacaugacuucaagaaugcucuuaaacagguuuacgaugacacauaggaagccgacguacgagagggacgucgaucuaggugcagggacgcgacacguagccgucgaacccgagguugcgaaucuagauauaauaggacaaaggauagaaaauaucaaaaaugagcauaaaucuacauggcacuacgaugaagacaauccauauaagacgugggcuuaccaugguagcuacgaagucaaacccucaggaagcgcuucaaguaugguaaaugggguagugagacuuuuaacaaaaccuugggaugugauuccgauggucacucaaauagccaugacagacacaaccccuuucggccaacagcgaguguuuaaagaaaaaguagacacucgcacaccaagagcaaaacgcggaacggcacaaauaauggaaguaacagccaagugguuauggggcuuucuuucacguaauaaaaagccucgaauaugcacgagagaagaguucacgagaaagguuagaucuaaugcggcaauaggcgccguguucguagacgagaaucaauggaacuccgcgaaagaggcgguugaagacgaacgcuucugggacuuagugcaccgugaaagagaacuacauaaacagggcaagugugcuacguguguauauaauaugaugggaaaaagggagaagaaauugggcgaauuuggaaaggcuaaaggaaguagggcgauuugguauauguggcuaggugcucgguuucuugaauuugaagcauugggauuuaugaacgaggaccacugguuuucgagagaaaauaguuuuagcgggguagagggcgaagguuuacacaaguugggauauauacuucgcgauaucagcaaaauuccaggaggcaauauguacgcugacgacacugcuggaugggauacccguauaacagaagaugaccuacaaaacgaagcaaaaauaacagauauaauggaacccgaacaugcucuauuggcgacaagcauauuuaaacuaacuuaccaaaauaaaguaguucgaguucaaagaccagcuaagaauggcacggugauggacgucauuagccgcagggaccagcguggauccggccaaguugguacuuauggacuuaauacuuuuacuaauauggaaguucaacucauuaggcaaauggaaucugaagguaucuucuugccuucagaauuagaaacaccaaaucuagcugaaagagugcucaauuggcuggagaaacauggaacugaacguuugaagagaauggcgauaucgggagaugacuguguagucaaaccuguagacgauagauucgcuacagcuuuaaucgcguuaaacgacauggggaaaguaagaaaagacaucccacaaugggagccaucuaaagguuggaaugacuggcaacaggugccguuuugcucccaccauuuucaucaguuaauaaugaaagacggacgggaaauaguuguuccaugcagaaaccaggaugaauuaguaggccgagcgcggguuagucaaggagcagguuggucucucagagaaacagcaugucucggcaaaaguuaugcccaaauguggcaauuaauguauuuucauaggagagacuugagacuggccgcaaaugccauauguucagccguucccgucgacuggguaccaacgucuagaacuacauggaguauccaugcucaccaucaauggaugaccacagaagacaugcucuccgucuggaaccggguguggauagaggaaaacccauggauggaagacaaaacgcauguaaguuccugggaagagguccccuaucuaggaaagcgcgaggaucaauggugcgggagccuaauaggcuuaacagcccgcgcgacaugggcgacuaauauucaagucgccaucaaucaaguuagaaggcugauuggaaacgaaaacuacuuagacuauaugacaaguaugaagcgauuuaaaaaugagagugaucccgaaggagcccuaugguaa

SEQ ID NO: 21381 - RNA, 9879 nt, Artificial Sequence
  derived and/or modified CDS sequence (opt6) from DENV-1__FJ410174__SS-prME
ucagucacuaugcugcucaugcucuuaccaacugcacuugcuuuucauuuaacuacuagaggaggagaaccccauaugauaguaucuaaacaagaacgaggaaaaagccugcuauucaaaaccucggcugguauaaacauguguacacuuauagcuauggauuuaggugaauugugcgaagacacaaugacuuacaaaugcccgagaaucaccgaagcugaaccggaugacgucgauuguugguguaacgcaacugacacgugggugacguaugguacuugcagucaaacgggagaacauaggagagauaaacggucaguagcgcuagcaccucacguaggauuaggguuagaaacacguacagaaacauggaugucgucagaaggggcuuggaaacaaauacaaaaaguagaaacgugggcguuaagacacccuggguuuacuguaacagcgcuauuucuagcacacgcaauagguacaaguaucacucagaaggguaucaucuuuauacucuuaaugcuuguaacaccaaguauggcgaugagaugugugggaauuggaaaucgcgauuuuguagaaggauugucaggcgcaaccuggguugauguaguuuuagaacaugggucgugcgugacuaccauugcaaaagacaagccgacguuagacauugaauugcugaagacugaaguaacaaacccggcuguauuaagaaaacuauguauagaagcuaaaauuucaaauacuacaacagauuccagguguccuacacagggugaagcaacauuaguggaagaacaggacucaaacuucguuugcagaagaaccuuuguugauagagguugggggaacggaugcgguuuguuuggaaaggggagcuuacugacaugugccaaauucaaaugcgucacaaaguuagaggguaagauaguacaauacgaaaacuuaaaauacuccgugauaguuacaguccacacaggugaccaacaccaaguagguaacgagacaacagagcaugguacaauagcuacgauaacaccacaagcgcccacgagugaaauccaguuaaccgacuauggugcauuaacauuagacuguuccccacggacgggcuuggauuuuaacgagaugguccugcuuacgaugaaagaaaaaucauggcuuguacauaaacagugguuuuuggaucuaccauuaccauggaccucaggugcaucaacaagccaagagacuuggaaccgucaagaucuuuuggucacuuuuaagaccgcucaugcaaagaaacaggaaguuguagugcuagguagccaggaaggagcuaugcauacggcccuaaccggagcgacagagauacaaacaucagguacaacaacuaucuuugccggucaccuaaaaugucgccuuaaaauggacaaacuuacacucaaaggaaugucauauguaauguguacaggcucguuuaaacuggaaaaagagguagccgaaacucaacacggcacaguuuuggugcaggucaaauacgaagggacugaugcccccuguaaaauacccuuuucggcucaggaugagaaaggaguaacccaaaacggucgacuuauuacugccaauccuauaguaacagacaaggaaaagccaguuaauaucgagacugaaccuccuuucggagagucguacauuguaguuggagccggcgagaaagcucuuaaauuaaguugguucaagaaaggauccucgaucggcaaaauguuugaagcuacggcgagaggggcaagaagaauggcaauccuaggcgauaccgcgugggauuuuggaagcauagggggaguuuuuacuucuguagggaaauugguacaucaagucuuuggagcagcuuaugguguacuauucuccgggguaaguuggacuaugaaaauagggauuggaauccuauugaccugguugggguuaaauagucguaguacgaguuuaagcaugacaugcauagcuguuggaaugguaacuuuauaucuagguguaaugguacaggcagacaguggauguguaauuaauuggaagggccgugaacuuaaaugcggaucuggaauauuuguuacaaacgaaguccauacauggacugagcaauauaaauuucaagccgacucaccaaagagauuaagcgccgccauagguaaggcuugggaagagggaguauguggcauccguucagcaacgagguuagaaaauauuauguggaagcaaauaucuaaugaauugaaccacaucuugcuugagaaugacaugaaguuuacuguggucguaggagaugcaaacggcauauuagcccaaggcaagaaaaugauuaggccacaaccaauggaacauagauacucguggaaaucguggggaaaagcuaagauuauaggcgcagauauucagaauacaaccuucaucauagauggacccgacaccccagaauguccagaugaucaaagagcuuggaacauuugggaagucgaagauuauggcuucggcauauuuacgacuaacauaugguuaaaguuaagagauucauauacacaaaugugcgaccaccgacuaauguccgcggcaauaaaagauuccaaagcuguacacgccgacaugggguauuggauagagagcgagaaaaacgaaacauggaagcuggcucgagcaucuuuuauugaaguuaaaacauguauauggccaaaaagccacacuuuauggucaaacggcguguuggagucagaaaugaucauuccaaaaauauacggugggccuauuagccagcauaacuaucgcccuggauauuuuacgcagacggcgggaccguggcacuugggcaaacuggaacuagauuuugaucucugcgaaggcacaacugugguuguagaugaacacugcggcaacagagguccaagccuuagaacaacgacugucacagguaaaauaauccacgaaugguguuguagaagcuguaccuuaccgccuuugagauuuagaggagaagacgggugcugguacggaauggagauuaggccgguaaaggaaaaggaagaaaacuuaguaagaucgauggugucagcgggcucaggggaaguugauagcuuuucauuaggaauacuuugcguuucuauaaugauagaagaaguuaugagaucucgauggucucgaaaaauguuaaugacaggcacauuagcagucuuucuauuauuaauaaugggucaauuaacuuggaacgauuuaauacggcuauguaucauggucggggcuaaugcaucggauagaaugggcauggguaucacauauuuagcacuuauggcaacauuuaaaaugcgaccgauguuugcugugggguuauuauuccgccgucuaacaucuagggaggucuuacuacugaccauaggucuuaguuuaguagccagcguagagcugccgaacagucuagaagaauugggagaugguuuggcgaugggaauuaugaugcuaaagcuacuaacggaguuucagccacaccaguuauggaccacgcuccugucuuuaacguuuauaaaaacaacacuaagucuggauuacgcauggcggacaauggcuaugguacuguccauugucagucuguucccauugugucuuuccaccacaucacaaaagacaacuuggcuuccuguucuacuaggauccuuugguuguaaaccacuuaccauguucuuaaucacagaaaauaaaauaugggggcgaaaaaguuggccauuaaacgaagguauaauggccauuggaauaguuaguauucucuuaucauccuugcugaaaaaugauguaccacuagcaggaccacucauugcaggagguauguugaucgcguguuacguuauaucgggaucaagcgcugauuuaaguuuagaaaaagcagcggaaguuagcugggaagaagaagccgagcacucagguacgucacauaacauuuugguagaagugcaagacgauggaacgaugaagauaaaagaugaagaacgagaugauacuuuaacgauacuauuaaaagcuacacuucuagcuguaucagguguuuauccaaugagcauaccagcuacgcuuuucguuugguauuuuuggcaaaagaagaaacaaagauccggcguacuaugggacacacccucgccaccagaaguagaaagagcaguacucgaugauggcauauacaggaucuuacagagaggucuauugggucgaucacaaguuggggugggugucuuccaggacggaguuuuccacacgauguggcacgucaccagaggugcaguccuuauguaucaaggaaaacgacuagaacccucgugggcgagcguuaagaaagaccuaauuucauacggagguggcuggagauuucaaggaucguggaauacaggcgaggaaguucaagucauugccguggaacccggcaaaaaccccaaaaacguacaaacaacaccagggaccuucaagacgccagaaggagaagucggagcaauugcacuagauuuuaaaccuggcacuagcggaaguccaauaguaaauagagaaggaaaaauaguuggcuuguauggaaacggcguaguaacgacaaguggcacuuauguaagugcuaucgcacaagccaagacaucccaggaagguccucuuccugagauagaagaggaaguauuuaagaaaaggaaccugacuauuauggauuuacauccgggaaguggaaaaacacgccgguacuuaccagcaauaguccgagaagccauaaaacguaaacuacgcacacugauacuagcaccaacacgaguaguugcaagugaaauggcagaagcauuaaaaggcaugcccauuagauaucaaacgacagccguuaagucagagcauacaggacgugagauaguugaccuaaugugucaugcgacuuucacaaugagauuauuaucaccaguacgagugcccaacuauaauaugauaaucauggaugaagcacauuucacagauccggccucaauagcagcucguggauacauaaguacuagaguuggcaugggagaagcagccgcgauauucaugacugcuacgccuccaggaaguguugaggcauuuccgcagucuaacgcgguaauacaagaugaggaacgagacaucccggaaaggucuuggaacucuggguacgauuggauaacugacuucccgggcaaaaccguaugguucgucccuagcaucaagagugguaaugauauagcaaacugucuuaggaagaacggcaaacguguaauacaacuuuccagaaaaaccuucgauacggaguaccagaaaacgaaaaauaacgauugggauuauguggucacuaccgacauauccgaaaugggugccaacuucagagcagaccgugucauugauccacgaagaugccuuaaaccagugaucuuaaaagauggaccagagcgaguaauacuagcgggaccgaugccaguuacuguggccucagcggcgcaaagaagaggucguauaggacgaaaccaaaauaaggaaggcgaccaauauguuuauaugggucagccguuaaacaacgaugaggaucacgcucauuggacagaagcaaaaauguugcucgacaauaucaauaccccagaagggaucauuccagcuuuauuugagccugaaagagagaaaagugcagcuauugacggggaauaucgacucagaggggaggcuagaaaaacuuuuguugaguuaaugagaaggggugacuuacccguauggcuuucauauaagguagcaagugaaggauuccaauauucugaccgcagauggugcuucgauggagaacgcaacaaucagguucuagaagaaaauauggacguagaaauuuggaccaaggagggugaaaggaagaaauuacggccuagaugguuagaugcacgcacauacagcgauccauuagcacucagagaguucaaagaguuugccgcgggaaggcggagugugaguggagauuugauacuagaaauagguaaauugccacaacacuuaacuuuacgugcgcaaaaugcucuagauaaucucguaauguuacauaauagugaacaaggaggaaaagccuaucgacaugcgauggaggaacugccugauacaauugaaacuuuaauguuauuagcuuuaauagcuguguuaacagguggugugacuuuauuuuuccuaucagguaaagguuuggggaagacaaguauaggacuguuaugcguaauggcuucaucugcguuacucuggauggcaaauguggaaccccauuggauugcagcaucaauaauucuugaguucuucuugaugguauuacuaauaccagaaccagauaggcaaagaacaccgcaagacaaucagcuggcauauguaguuauaggauuacuauuuaugauuuuaacuguugcagcuaaugaaaugggccuuuuagaaacaacuaagaaagacuuggguauaggacauguagcugccgaaaaccagcaccaugcaacuauguuagauguagaccuacgacccgcaagcgcguggacgcuuuacgcugucgcuacuacaguaauaacuccaaugaugcggcacacaauagaaaauacgacggccaacauaucucucacagcaauugcaaaucaagcagccauucuaaugggacuagauaaaggauggcccauuuccaaaauggacauuggugucccacugcuugcauuggguugcuauagccaaguaaauccguugacauuaaccgcugcuguacuaauguuaguagcacacuaugcuauuauagggccagguuuacaagcuaaggcgacaagggaggcccagaaaagaacugcggcuggaauaaugaagaaucccacaguagaugguauuguagcgauagauuuggauccgguuguauaugacgccaaguuugaaaagcaguuggggcaaauuaugcuucuaaucuuaugcaccucucagauucuauuaaugcgcacuacuugggcauugugcgagucuaucacauuggcaacagguccuuuaacaacauuaugggaagguaguccuggcaaauuuuggaauacaacgauagcggucucaauggcaaauauauuuagagguaguuacuuagccggugcagcucuugcguucagucuuaugaaaaguuuaggaggaggaagacgagguacaggugcgcaaggcgaaacguuaggagaaaaauggaaacgacaguugaaccagcucaguaagucugaauuuaauacguauaagagaucuggaaucauggaaguugaucgcagugaagcaaaagaaggacuaaaaagaggagaaacaacaaaacaugccguaaguagagguacugcaaaacuccgcugguuuguggagcgaaauuuagucaagccagagggaaaaguuauagauuuaggaugcggacgaggagguugguccuauuauugugcaggacugaagaaaguuacagaagucaaggguuacacuaaagggggaccgggacacgaggaaccaauaccaauggcaacauaugguuggaacuuaguaaaauuauacucugggaaagaugucuucuucacaccuccugaaaaaugugacacccuccucugcgacauuggggaaucuucaccaaauccuacaauagaagaaggacgaacacuacgaguucuaaaaauggucgagccaugguuaagaggcaaucaguuuuguauuaaaauucugaacccguacaugcccagcgucgucgagacauuagaacaaaugcagcguaaacauggagguauguuaguccgaaacccauuaagucgaaauaguacacacgagauguacuggguuucaugugguacuggaaauaucguaucagcuguuaauaugacuucacgcaugcuucuaaauagauucaccaugacccacaggaaaccgacguaugaacgagauguugacuuaggugcagguacaagacacguagcaguggaaccugaaguggcuaauuuagacauaauuggacaaagaauugaaaacaucaaaaaugaacauaaaaguacguggcacuacgacgaagacaauccguauaaaaccugggcuuaccaugguagcuaugagguaaaaccaagugguucggcgagcagcaugguaaacggaguaguacggcucuugacgaagccgugggaugugauuccgauggugacgcaaauagcaaugacagacacgacuccauucgggcaacaaagaguauuuaaagagaaaguagacacaagaaccccaagggccaaaagaggaacggcccaaaucauggaagugacggcaaaauggcuauggggauuuuuaaguagaaauaagaaaccuagaauuuguacaagggaagaauuuacccgaaaaguaagauccaaugcagcuauaggagcggucuucguagacgagaaccaguggaauagugcaaaagaggcgguagaagaugaacgauuuugggaucuagugcaccgggaacgagaguuacauaagcaagguaaaugugcuacaugugucuacaauaugaugggcaaacgugagaagaaacuuggagaauuugguaaagcaaaaggaucacgggcgauaugguacauguggcugggcgcgagauuccuugaguucgaggcacuaggauuuaugaaugaagaucauugguucucaagagaaaauagcuucucuggcguagaaggagaaggguuacauaaauuagguuacauacuacgagauauaucaaaaaucccgggcggaaauauguacgcagaugacacagcuggaugggacacacgaauaacagaggaugaucuucagaacgaagccaaaauaaccgacaucauggaagcagagcacgcgcuucuggcgacuucuauauuuaaauuaaccuaucaaaauaaaguaguuagagugcagagaccagccaaaaacgguacaguuauggacguaauaaguagacgggaccagaggggaucaggucaaguuggaaccuauggucuaaacaccuuuacuaauauggagguucaacugauacgacagauggaaucagaggggaucuuucuuccuucagagcuagagacuccuaaucucgccgaacgaguauuagacuggcuagagaaacauggcacagagcgacugaaacgcauggcuauaucuggagaugauugcguaguuaaaccagucgaugaccguuuugcaaccgcacuuaucgcccugaaugauaugggaaaggugcgaaaagauauuccgcaaugggagcccaguaaagguuggaacgauuggcaacaaguuccuuuuuguucccaccauuuucaucaguuaauaaugaaggauggcagagagauaguggugccuuguagaaaucaagaugaacucguugguagagcgagaguuucucaaggggcgggguggucuuuacgcgaaacagcauguuuaggaaagagcuaugcgcaaauguggcaauuaauguacuuucauaggagagaucuaaggcuugcagcaaacgcaauauguagugcgguaccaguugacuggguuccaacuucccgaacgacauggagcauacaugcucaucaucaguggaugacaacugaagacaugcucuccgucuggaacagaguauggauugaggagaacccguggauggaagauaagacccacguuucuuccugggaggaaguaccuuaccuggggaaaagggaagaucaaugguguggaucgcuaauuggguugacugcucgagcuacuugggcgacuaacauacaagucgccauuaaccaaguccggcgauuaauaggcaaugaaaauuaucucgacuauaugacuuccaugaaaagauucaagaaugaaucggauccagaaggcgcccuaugguaa

SEQ ID NO: 21382 - RNA, 9879 nt, Artificial Sequence
  derived and/or modified CDS sequence (opt6) from DENV-1__FJ410175__SS-prME
aguguuacuauguuauuaaugcuacuaccaacugcgcuagcuuuucauuuaacuacucgaggaggugaaccucauaugaucguaucaaaacaagaacgagggaaaaguuuauuguucaaaacaagugcagguauaaacauguguacauuaauugcuauggaucuuggagaacuaugcgaagauaccaugacuuacaaauguccgcggauuacugaagcugaaccugacgacguugacugcugguguaacgcuacugauacuuggguuacauacggaacgugcucacaaacaggagagcacaggagggacaaaagaagcguugcguuagcaccacauguaggucucgguuuggaaacacgaacugaaacauggaugaguucggaaggggcguggaaacaaauucaaaaaguagaaacaugggcauuacgucauccgggauucaccguaacugcucuuuuccuugcucacgcaaucggaacguccauaacucaaaagggaauaauauucauacuacugauguuaguaacaccuuccauggcaaugcgcugcgucgggauugguaaccgagacuuuguggaaggucuaucgggugccacauggguagauguuguucuggagcacggcagcugcguuacgacaauggccaaagauaaaccuacguuggacaucgaguuacuaaagacugaaguaacuaacccagcaguuuuaagaaaacuuuguauugaagcaaaaauaagcaacacaacaacagacagcagaugcccaacacaaggagaagcaaccuugguggaagaacaagauaguaauuuuguaugcagaaggaccuuuguagauaggggcuggggaaacgggugcggacuauuugguaaaggaucuuugcucaccugugccaaguuuaaaugcgucacgaaauuggaggguaagauuguacaauacgagaaucuaaaauauucaguaauagucacagugcacacgggggaccaacaucaaguaggaaaugaaacuacugaacaugggacaauugcaacuauaacaccgcaagcaccuacaagcgaaauacaauuaacagauuacggagcacucacauuggauuguaguccacgaacuggucuagauuuuaacgagaugguauuauuaacuaugaaagagaaaucaugguuaguucauaaacagugguuuuuagaucuuccgcucccguggaccagcggagcgucuacaucucaggaaacguggaauagacaagaccuauugguuacguuuaagacugcacacgcuaaaaagcaggaagucgucguauuaggaucucaagaaggagcuaugcacacugcuuuaacaggagcaaccgaaauucaaacaagugguacaacaacuaucuuugcgggucaucuuaaaugccgucucaaaauggauaaacucacacuaaagggcaugucauacgugauguguacaggaucauuuaaacuagagaaagagguagccgagacccagcacgggacaguguuaguacaaguuaaauaugagggaacugacgcgcccugcaaaauaccuuucucugcucaggaugaaaagggaguuacucaaaauggucgcuuaaucacagcuaacccaauaguuacugauaaagagaaaccggugaauauagaaaccgaaccgccauuuggcgaaaguuacauuguuguaggcgccggugaaaaagcauuaaaacugagcugguuuaagaaagguagcagcauuggcaaaauguucgaggcuacugcuagaggggcuagaaggauggcuauauuaggagauaccgcaugggauuucggaaguauaggaggugucuucaccucaguaggcaaguuaguucaucagguguuuggugcggcauaugggguacuauucucaggcgucuccuggacgaugaagauagggauugguauuuuauugacaugguuagguuuaaauucccgauccacaaguuuguccaugacaugcauagcaguugggauggugacauuauaucucggaguaaugguacaagcagauucagggugugucauuaacuggaaaggaagagaacuuaaaugcggaucagguaucuuuguaacaaaugaaguacauacauggacggaacaguacaaauuccaagcagauaguccuaaaagacuaucggcagccauaggaaaagcaugggaggaaggaguguguggaauaagaucugcaacaagauuagaaaauauuauguggaagcagauuucuaacgaacuuaaccauauucuccuagagaaugauaugaaauuuacaguagugguaggcgaugcaaaugggauacuagcacagggaaagaaaaugauacggccucagccuauggaacauagguacucauggaaaucaugggguaaagcgaaaauuauaggggcagauauucaaaacacgacuuuuaucaucgacgguccagacacgccggaaugcccugaugaucaaagagccuggaauaucugggagguugaagauuauggguuugguaucuucaccaccaauaucuggcugaaacucagagacucauacacacagaugugugaucaucgacuaaugagugcagcuauaaaagacucuaaagcaguccaugcagauaugggcuacuggauagaaagcgagaaaaaugaaacuuggaaacuagcacgagccucauucauugaaguuaaaaccuguauauggccuaaaucucauacucuauggucaaauggaguacucgaaucagagaugaucauuccaaaaauuuacggcggcccaauuagucaacauaauuaccggccaggauauuuuacucagacugcaggaccauggcaccuagguaaauuagaauuagacuuugauuuaugcgaaggaacaaccguuguaguggaugagcacugugggaaccgaggacccagccucagaacaaccaccguaaccgggaaaaucauucacgaaugguguuguagaaguuguacuuuaccaccuuuacguuuuaggggugaagacggguguugguaugggauggaaauaagaccaguuaaagagaaagaagaaaaucugguacgcucgaugguaagugcuggcagcggagaaguagacuccuuuucacugggcauacugugcguaagcauuaugaucgaggaagucaugaggucucgcuggucaaggaaaaugcugaugacaggaacacuugcaguuuucuuauuauugauaaugggucaacugacuuggaaugacuuaaucagauuguguauuauggugggagcuaacgcuagugaccgaaugggcaugggcacaacauaucuugcccuuauggcaacauuuaaaaugcgacccauguuugcugucggccuauuauuuaggagacucacuagcagagagguacuacuacuaacgaucggacucaguuuaguagcaucuguagagcuaccuaauagucuagaagaauuaggggacggcuuagccauggguauaaugaugcucaagcuccuaacugaguuucagccucaccaacuauggacgacacuucuaucccuuacauucauaaaaacaacguuaagccuagauuaugcauggagaacaauggccaugguacuaaguauuguuagcuuguuuccauuauguuuaucgaccacaagccagaaaacaacauggcugccuguguuacuaggauccuuuggcuguaaaccuuuaaccauguuuuugauuacggaaaacaaaauauggggacgaaaaagcuggccucuaaaugaagguauaauggcaauaggcaucgucucuauuuugcuaaguucacuacucaaaaaugauguuccguuagcaggacccuuaauugccggugguauguuaaucgcguguuaugucaucagugggaguagcgcagaccuuucauuagaaaaggcugcagaggugucuugggaagaagaagcagaacacucagguacaucgcauaacauucugguagaaguacaagaugaugguacuaugaaaauaaaagaugaagagagagaugacacccuaacgauucuacucaaagcgacuuuacuugcagugucugguguauauccuaugaguauccccgcuacauuguucguuugguacuuuuggcagaaaaagaaacaacgcucugguguguuaugggacacaccuucuccgccagaagucgaaagagccguucuagaugaugguauauauaggauucuucaacguggacucuuaggaaggucacagguaggagugggaguguuccaggaugguguguuccauaccauguggcacguaacgcgaggggcaguauuaauguaucaagguaaacgucuugaacccucuugggcuucggucaagaaagaucucauuucauauggcggcgguuggcgauuucaaggcucuuggaauacuggugaagaaguacaagugauagcuguagagccuggcaaaaaucccaaaaauguucaaacaacgccuggaacuuucaaaacaccugaaggagaaguuggugcaaucgcauuggauuucaaaccgggaaccucaggcagucccauugucaauagagaggggaaaauagucggcuuguacggaaacggugucgugacuacaagugggaccuacguaucugcaauugcgcaggcuaaaacgucccaagaagguccuuuaccugaaauagaagaagaaguuuuuaagaaacguaaccuaacaauuauggaccuacauccagguucgggcaagaccagacgauacuuaccggcaauaguccgugaggcaaucaaacgaaaguuaaggacuuugauauuagcgccgacacgaguaguagcauccgaaauggcugaggcauugaaaggaaugccaauacguuaucaaacaacagccgucaaauccgaacauacaggaagagaaauuguugaccuaaugugccacgccaccuuuacaaugagguuauugagcccgguuagggucccaaacuauaacaugauuauaauggacgaagcacauuucacugacccggcuagcauagcugcgagaggcuacauuucgaccagagucgguaugggugaagccgcagcaauauucaugacagccacgccaccaggaucagucgaagcguuuccccaaaguaaugcaguaauacaagaugaagagagggacauaccagaaagaaguuggaacuccggguaugauuggauaacugauuuuccugguaagacagucugguucguaccaaguauaaaaagugguaaugacauagcgaauuguuuacgaaagaaugguaaaagaguaauacaguuaagcagaaaaacuuuugacaccgaauaccagaaaaccaaaaacaaugacugggacuauguugugacaacugauauuucggagaugggagcaaacuuccgugcggaucgugugauagaccccagaagaugucuuaagccugucauauuaaaagacggacccgaacgaguuauuuuagccggaccgaugcccguuacgguagcaucggcagcccaaagacguggaaggaucgggcgaaaccaaaauaaggaaggcgaccaauacgucuauaugggucagccauugaacaacgacgaggaucacgcgcauuggacugaggcaaagaugcuauuagacaauauaaauacuccagagggcaucauccccgcucucuuugagccugaacgugaaaaaucugcagcuaucgauggcgaauacagacuucgaggugaagcaaggaaaacauuuguugaauugaugaggagaggagacuuaccugucugguuauccuauaaaguugcuucugaaggauuccaauauuccgaucgaagauggugcuuugacggagagagaaauaaccaaguccuagaagagaauauggauguagaaauauggacgaaggaaggcgaaaggaagaaacuccgcccuagauggcuggacgccagaacauacagugauccucucgcauuaagagaauuuaaagaguuugcugcgggacgacgcagcguaucaggugaccuuaucuuggagauagggaaauugccgcaacaccuaaccuuaagagcccaaaacgcgcucgacaaccuaguaaugcuucauaauucagaacaaggugggaaagcauacagacacgcaauggaagaauuaccugacaccaucgaaacuuuaaugcuacuagcauuaauagccguauuaacugguggaguuacucuauucuuucucaguggaaaaggucucggcaaaacgucuauaggucuauuaugugucauggcaucaucagccuuacuauggauggcuaauguugaaccucauuggaucgcagcuaguauaauauuagaauuuuucuugaugguauuauugaucccagaaccggaccgucaaagaacaccucaagacaaucaguuagcauauguggucauaggacuuuuguucaugauuuuaacgguugcagccaacgagaugggacuacucgagacaacuaagaaagacuuaggaauaggacacgucgcagcagaaaaccaacaucacgcaaccaugcuagauguugacuuaaggccugcaagcgcuuggacucuuuacgcuguggccacgacgguuauaacacccaugaugcgacacacaauugagaauaccaccgcaaauauaucuuuaacggcaauagcgaaccaagcagcaauauugaugggacuugacaaaggauggccuauaucgaagauggacauuggcgucccuuuauuggcgcuaggcugcuacucacaaguaaacccauuaacccuaacagcagcgguucuaauguuagucgcacacuacgccauaauagggccgggacuucaagcaaaggcuacacgagaggcucagaaacgaacugcugcaggaauaaugaagaaucccacagucgacggaauaguagcuauagaucuggacccgguuguauacgacgcaaaauuugagaaacaacuaggucagauaaugcuccugauauuauguaccucgcagauauuacuaaugagaacaacuugggcguuaugugaaucuaucacacuugcaacaggaccacuuacaacucuaugggaagguucgccugguaaauuuuggaacacaacgauagccgugucgauggccaacauauuccgugguagcuauuuagcuggugcggggcucgcauuuucacuaaugaaaucacucggcggggguaggcgagguacaggagcgcaaggagaaacccuuggggaaaaauggaaaaggcagcuuaaccaacuuucuaaaucagaguucaauacguauaaacgaagcggcauaauggaaguagaucgcucugaggcgaaggaggggcucaaacgaggcgaaacuacuaaacacgcagucaguagagggacagccaaauuaagaugguucguugaaaggaacuuaguuaaaccagaaggaaagguaauugauuuagggugugguagagguggguggucauauuauugugcaggucuaaagaaagugacggagguaaaaggauauacuaaaggugggccuggacaugaggaaccuauacccauggcaacauauggcuggaaucucguaaaacuauacucagguaaagauguauucuuuacuccaccggagaaaugugauacccuacuaugugauauaggagaaucauccccaaauccuacaaucgaagaagggcguacgcuacggguacuaaaaaugguggaacccuggcuaagaggaaaucaguuuugcauuaaaauccuuaauccauacaugccaaguguuguugagacauuagaacaaaugcaaagaaagcacggaggaauguuaguucgaaacccuuuaaguagaaauaguacacacgaaauguacuggguaagcuguggaaccgguaauauugugagugcagucaauaugacgucaaggaugcucuuaaacagauuuacaaugacacacagaaaaccaaccuaugaacgggacgucgacuuaggugcgggcacuaggcauguagcaguugaaccggaaguagcuaaucuagauauaaucgggcaaaggauagaaaauaucaaaaacgaacacaaaucaacauggcauuacgaugaagauaacccauacaaaacgugggcuuaucacggaucauaugaagugaaaccaagcggaucugcaucuucgaugguaaauggggugguaagacugcucaccaaaccgugggacguaauaccaaugguaacccaaauagcgaugacagacaccacgccguuuggccaacaaagaguauucaaagaaaaaguugacacgagaacgccacgggccaaacgagggacagcacaaauaauggaaguuacagcaaaaugguuguggggauuuuuaaguaggaauaagaaacccaggauaugcacccgugaagaguuuacucgaaaagugcguucuaaugcugcgauaggagcuguuuuuguugaugaaaaucaguggaauagcgccaaagaggcagucgaagaugaaagauucugggaucugguccaccgugaaagagaacuacacaaacaggggaaaugugcgacaugcguauauaauaugauggggaagagagaaaagaagcuaggugaguuuggcaaggcaaaaggcucucgagcaauuugguauaugugguuaggcgcccgauuuuuagaauuugaggcuuuaggauuuaugaaugaagaccauugguucucaagagagaacaguuuuucuggcguugaaggagaaggacuacacaaauuggguuacauacuuagggauauaagcaaaauccccggcgggaacauguacgcugaugauacggcaggaugggacacuagaauaacggaagacgauuugcaaaaugaggcaagaauuacagauauaauggagccugaacaugcgcuucuagcaacgaguauauucaaauugacuuaucaaaacaagguaguccgaguccaacguccagccaaaaacgggacaguaauggauguuauaagcaggcgagaccaaagagguaguggacaaguuggcacuuauggauuaaauacguucacuaacauggaaguucaauuaaucaggcagauggaaagugaaggaauuuuccucccuucagaacuggaaacucccaaucuagcggaacgaguuuuagauugguuagagaaacacgguacagagcgacuuaaacggauggcaaucaguggggaugacugugucguuaaaccuguugaugaucgcuuugcuacagcucuuauugccuugaaugauaugggaaaaguucggaaagauauuccacaaugggagcccuccaaagguuggaacgauuggcaacaaguuccauuuuguucgcaucacuuucaucaauuaauaaugaaggauggacgugaaaucguggugccaugucgaaaucaggaugaauuggugggcagagcacguguaucccaaggcgcagguuggaguuuaagggagacagcuugucuagggaaaagcuacgcacaaauguggcaacuuauguauuuccacagacgagauuuaagguuagccgcaaacgcuauauguucagcuguuccgguagauuggguaccgacuucgcgaacgacauggucgauccaugcacaucaucaauggaugacaacugaagauaugcuaucgguuuggaauagaguguggauugaagaaaacccuuggauggaggacaaaacccacgucuccucaugggaagaaguacccuauuuaggaaaaagagaggaucaaugguguggaaguuuaauuggucucaccgcacgagcuaccugggcaacgaacauacaaguagcuauaaaccagguucguaggcuaaucggaaacgaaaauuaucuugacuauaugacgucgaugaaacgguuuaagaaugagagugauccugaaggggcguuaugguaa

SEQ ID NO: 21383 - RNA, 9879 nt, Artificial Sequence
  derived and/or modified CDS sequence (opt6) from DENV-1__FJ562105__SS-prME
ucaguuacaaugcuacugaugcuauugccaacuguauuagcuuuccauuugacuacaaggggaggagaaccacauaugauaguuggaaaacaagaacgagggaaaaguuuauuguuuaaaacaagcgcaggagucaauauguguacucuaauagcaauggaucuaggagaauugugugaagauacuaugacuuauaaauguccuagaauaacagaagcagaacccgaugacguagacuguugguguaacgcaacggacacaugggugacauaugguacauguucacaaaccggagaacaccgacgcgauaagagaucaguagcucuagcgccgcauguuggauuaggccuagaaacccgaacagaaacguggaugucaucggaaggagcauggaaacaaauucaaaaagucgaaacuugggcuuuacggcacccuggauucacagucauagcauucuuccuugcacaugccauagguaccucaaucacacagaaaggaauuaucuucaucuuauugaugcuagucacaccaucaauggcgaugcgcugugucgguaucggaaacagagacuucguagaagguuugaguggggcuacauggguagauguuguauuagaacacggaucguguguaacaacaauggcuaaaaauaaaccgacacuugauauagaauuacuaaaaaccgaaguuacaaacccugcaguacuacguaaauuauguaucgaagcaaaaauuagcaacacuaccaccgauagcagaugcccuacgcaaggagaagcaacuuugguugaagaacaagaugcaaacuuuguaugccgaaggacauucguugacagggguuggggcaauggguguggcuuauuugggaaaggaaguuuacuaacgugcgcuaaauucaagugugugacuaagcuagaggggaaaauaguucaauaugagaaccuaaaauauucagugauuguuacagugcacacuggagaccaacaucaaguaggaaacgaaacuacagaacauggaacaauagcaacuauaaccccucaggcucccacaucggagauacagcugacggauuauggugcgcuuacuuuagauuguucuccacgaacuggucuagauuuuaaugaaauggugcuacuuacuaugaaagagaaaucuuggcucguccacaaacaaugguuuuuagaccuuccccuacccuggacgaguggagccucaaccucucaagagacauggaacagacaagaucucuuagucacauucaagaccgcucaugccaagaaacaagaagucguuguauuaggaucacaagaaggagcaaugcauacagccuugacuggggccacugaaauucagacaaguggaacgacaacuauauuugcaggacacuuaaaauguagacuaaagauggauaaauuaacacuaaaaggaauguccuaugucauguguacuggaucuuucaaacuagaaaaagagguugcggaaacgcagcacggaaccguguuaguacaaguuaaauaugaggggacagaugcacccuguaagaucccucuuaguacucaggaugaaaaaggcgucacacaaaacggaagauuaauaacagcaaacccuauagucacagacaaggaaaaaccaguuaauauugagacugaaccaccuuuuggcgagaguuacauaauaguaggugccggugaaaaagcacucaaacucucaugguucaagaaggguucaaguauuggaaaaauguuugaagcaacagcucgaggcgcuaggagaauggcgauucuaggcgauacugcaugggacuuuggaucuauaggagguguauucacaaguguugggaagcuaguucaucaaguauucggaaccgccuauggaguauuauucaguggaguuucauggacaaugaaaauaggaaucggcauucuucuaacauggcuagguuuaaauucuaggucagcgaguuuaucaaugaccugcauugcuguagguauggugacguuauacuuaggcguaaugguacaagcagauucuggcuguguaauaaacuggaaaggacgugagcuuaaaugcggcagcggaauauucguuacgaaugagguucauacauggacugaacaguacaaauuucaagcugacucaccaaaacgucucucagcagcaaucgggaaagcaugggaggaaggugugugcgggguucgaagugccacccgccuugaaaacaucauguggaaacaaauaagcaacgaauugaaucauauccuccuagaaaacgacaugaaauuuacgguaguaguuggugacgcaaaugguauccuugcucaggggaaaaagaugauccgcccacaaccaauggaacauaaauacucguggaaaucaugggggaaagccaaaauaauaggugcugauauucaaaacaccacguuuauaauagacggaccagacacgccugaaugcccggacgaucaaagggcuuggaauaucugggaaguugaggauuauggcuuuggaauauuuaccacuaauauaugguuaaaacuccgcgauucauauacucaaaugugugaucauagauuaaugucagcugcuauaaaagacuccaaagcaguucaugcagauaugggguacuggauagagucggaaaagaaugaaacauggaaacucgcucgagcauccuucaucgaaguaaaaacaugcauauggccuaaaucucacacacuauggagcaacggagucuuggaaucugaaaugauaauaccaaaaaucuaugguggaccuauaagccaacacaacuaccgaccgggauacuuuacacaaacugcaggaccauggcaucuuggcaaacuagaacuagacuucgaucugugcgaagguacuacaguugugguugaugagcauugcggaaauagagguccuucccuacguacgacaacgguuacaggaaaaaucauucacgagugguguugucgaucauguacucuaccaccccuaagguucagaggagaagacgguuguugguacgggauggaaauacggccaguaaaagagaaagaagagaaccuagugcgauccauggugucagcuggaaguggagagguagauucauuuaguuuaggaauccuuugcuuaucgauuaugauagaagaagucaugagaucuagauggucacgaaaaaugcuuaugacaggaacacuagcaguauuucuauuauuaauaaugggacaguuaacuuggaaugaucucaucaggcuguguauuauggugggagcgaacgcuagugaucgaauggguauggguacgacguaccuagcucuaauggccaccuuuaaaaugagaccgauguuugcuguuggcuuacuauuccgucgguugacaucacgugaaguauugcuauuaacuauaggacugucuuuaguagcuucaguagaacugcccaauucgcuugaggaauugggagaugguuuagccaugggaauaaugauguugaaacuuuuaacagaauuucaaccacaccaguuguggacgaccuugcuaagccugacguucaucaagacaaccuuaucgcuggauuacgcauggaaaacuauggccaugguauuauccauuguaagccuauucccacuaugucugagcacaacaagucagaaaacuaccuggcuaccaguauuacucgggucauuuggauguaaaccuuuaacaauguuucuaauaacggaaaacaaaauuuggggacguaaaucuuggccacuaaacgaagggaucauggccauaggaauugugucaauauugcuuagcuccuuacuaaagaacgauguaccucuagcaggacccuuaauagcuggagguaugcuuaucgccugcuauguuauuucggguuccagcgcagaccuaaguuuagaaaaagcagcagagguaagcugggaagaagaggcagaacacucaggaacuucacacaauauacugguugagguacaggaugauggaacuaugaaaauaaaagacgaagaaagagacgacacucugacuauacuccuaaaagcuacuuuauuggccguuucugggguauacccuaugucaauacccgcaacucuauucguuugguauuucuggcaaaagaagaaacaaagaucuggagugcuuugggauaccccaucaccacccgaaguggaaagggccguuuuagacgacggaauauaucgcauauuacaacgaggccugcuagggaggucucagguaggagugggaguauuucaggauggggucuuucauacaauguggcacgucacacgaggugccgugcucauguaucaaggaaaacgucuagaacccucgugggcaucagugaagaaagaccuaauaucuuauggagggggcuggagauuccaggguucauggaacacaggcgaagaaguucaagugauugccguagaaccaggcaaaaaccccaagaacguacaaaccacuccgggaaccuuuaaaacccccgaaggcgaagugggagcgguagcauuagacuucaaaccaggcacauccgguuccccaaucguaaacagagagggcaagauugucggacuauacgguaacgguguugugacuacuucuggaacauauguuucugcaauugcucaggcuaaagcgucacaagagggaccguugccugagauagaagacgagguguuuaagaaacgaaaucuaacaauaauggaucugcauccaggcuccggaaaaacuagacgauaucuaccggccauagucagagaggccauaaaacggaaauuacgaaccuuaauuuuagcaccaacgagagucguugcuagugaaauggcugaagcgcuuaagggaaugccaauaagauaucagacuacugcggugaaaagcgaacauacuggaagagaaauuguagaucuuaugugccaugcuacuuucacuaugagguuauuaaguccggucagaguaccuaauuauaauaugauuauuauggacgaggcccauuucacagaucccgcaagcauugcagccagggguuacauuaguacacgagucggaaugggugaggccgcagcuauauuuaugacugcaacgccaccagguuccguugaagcauuuccacaaagcaaugcuguaauacaagacgaagaaagagacauaccugagcgaaguuggaacagugguuaugauuggauuacagauuuucccgggaaaacugugugguucguaccgucgauaaaaagugguaaugauauugcuaauugucuaagaaagaacgguaaacggguuauucaauuaucuaggaaaacauuugacaccgaauaccaaaagacuaagaauaaugauugggacuacguugucacuacugauauaagugaaaugggagccaacuuucgcgccgaccgggucauagauccgcgcagaugccuaaaacccguaauacuuaaagacggucccgaaagaguaauacuagcuggccccaugccagugacaguugcgagugcagcucaaaggcgcggacgaauuggcagaaaucagaauaaagagggcgaccaauauguauacaugggacagccacucaacaaugacgaagaucaugcgcacuggacagaggcaaaaaugcuacuagauaacauuaauaccccagaaggcauaauuccagccuuauuugaaccggaaagagagaaaagcgcagccauugauggggaauacagacuccgaggcgaagcucggaagacauucguagaacuaaugagaagaggcgaccucccuguuuggcuaaguuauaagguagcuucugaaggcuuccaauacagcgauagaaggugguguuuugacggcgaacgaaacaaucaaguuuuagaggaaaauauggauguagaaauauggaccaaagaaggggagaggaagaagcuacgaccgcguuggcuugacgcgagaacuuacucugauccauuggcacuaagagaauuuaaagaguucgcugcaggaaggcggucaguuaguggagaucugauucuagaaauuggaaaacuuccccaacaucucacgcuucgagcgcaaaaugcauuagauaaucuaguuauguugcacaauagugagcaaggugguaaggcuuaccgucaugcaauggaagaauuaccggauaccauagaaacccuaaugcuucuagcacuaaucgcuguucuaacagguggcgugaugcuauucuuucuaagugggaaggguuuagggaaaacguccauaggccuucuguguguaauggcauccucugcgcuauuguggauggcaaguguagaaccacauuggauugcagcaucaauuauacuggaguucuuccuaaugguacuacucauuccagaaccggauagacaacgaacaccacaggacaaucaacuugcguauguagucauuggauugcuauucaugauauuaacuguggccgcaaaugaaaugggucuauuagagacaacuaagaaagauuuaggaauugggcacguugcagcugaaaaucaccaucaugucacaaugcucgauguggauuuaaggccugccucagcauggaccuuauaugcuguugcgacgacaguuauaacuccuaugaugcgucauacaauagaaaacacuaccgccaacauuucuuuaacagcuauugcaaaccaagcagccauucuuaugggacuagauaaaggauggccuauaucaaaaauggauauaggugucccacuguuggcucugggauguuacucacaaguaaacccguugacucucacagcagcugugcuaauguuaguagcucacuaugcgauuauaggcccuggacuacaggcuaaagcgacucgagaggcgcaaaagcgaacagcugccgguauaaugaagaauccgacaguagauggcaucguagcuaucgauuuggaccccgucguauaugaugcuaaguuugaaaaacaauuaggccaaauaaugcucuuaauucucugcacgucccaaaucuugcuaaugagaacaacuugggcacuaugugaaaguauaacauuagccacgggaccacugaccacguuaugggagggaaguccuggaaaauuuuggaacacuacuauagcagucaguauggccaauauauucagagguucguaccuggcaggagcaggccuggccuucucccuuaugaaaucacuaggggguggacgaagaggaacaggugcccaaggggagacguugggugaaaaauggaagagacaacuaaaucaacuuucgaaaagugaguuuaauacuuacaaacgaucaggcauaauggaggucgauagaagcgaagcaaaggaggguuugaaaaggggagagacuacgaaacaugcugucaguagggggacagcaaaacuacgcugguuugucgaaaggaauuuaguaaaaccagaggguaaaguuauagaucuagguugugggagaggaggguggagcuauuauugugcgggccuaaagaaagugacugaagugaagggguacacuaaaggugguccaggacacgaggaaccaaucccuauggccacguaugguuggaauuuaguaaaauugcauagcggaaaagauguguucuuuacgccuccagaaaaaugugacacguugcugugcgauaucggagaaucuagcccaaauccaacgauugaagaagggcggacauuaaggguuuuaaaaaugguugagccaugguuaggaggaaaucaauucuguauuaagaucuuaaaccccuauaugccuagcgugguugaaacauuagaacaaaugcagcgaaaacacgggggaauguugguucggaacccacuuuccagaaacucuacacacgagauguacuggguaucuugcggaacuggcaauauugugagcgcaguuaauaugacaucaaggaugcuucugaauagauucaccauggcccauagaaaacccacuuaugaaagggacguugaucugggugcgggaacgagacacguagcgguagaaccagaaguagccaaucuggguauuaucggccaacguauagaaaauaucaaaaaugaacacaaaagcacauggcacuacgaugaagauaacccauacaaaacaugggcguaucacggguccuacgaaguuaaaccauccggauccgcgucuucaaugguuaaugguguuguccgauuacucacaaaaccaugggauguuauacccauggugacacaaauagcaaugaccgauacuaccccguucggacaacagagagucuuuaaagagaaaguagacacaagaacuccgcgagcaaaacggggaacggcucagauaauggagguuacagccaaaugguuaugggacuuuuugucacguaacaagaaaccgagaauuuguacuagagaggaguucauucgcaagguuaggaguaacgcggccauuggagcaguguuuguggacgagaaccaauggaauagcgcgaaagaggcuguagaggacgaaagauucugggauuuggugcauagagagcgugaacugcauaaacaaggaaagugugcgacauguguguacaacaugaugggcaaaagagagaaaaaguuaggagaguucggaaaagccaaggguuccagagcuauaugguauauguggcugggcgcaagauucuuagaauuugaagcguuaggcuucaugaaugaagaccacugguucaguagagaaaauucacucagugggguggaaggcgaagggcuacacaaauuaggguauauacucagagacauauccaaaauaccaggaggaaauauguacgcagaugauacagcaggaugggauacaagaauuacagaagaugaucugcaaaaugaagcgaaaauaacagauauuauggaaccggaacaugcucuauuggcuaccucuauauucaagcucacguaucaaaacaaagugguaagaguccaaaggccggccaaaaauggaacuguaauggacgugauaagcaggagagaccaacguggaucgggacagguugguacauaugguuuaaauacauucacuaauauggaaguccaauuaauacgacagauggaaagugagggaauauuucuuccuucagaacuggaaacaaccaacuuagcugagagagugcucgauugguuggaaaaacacggaguugaaagacuaaagagaauggcaauaucgggcgaugauugcguaguaaaaccaaucgaugacagguuugcaacagccuuaauagcacuaaacgauauggggaaaguacgaaaagacauaccccagugggaaccuucaaaaggcuggaacgauuggcaacagguuccauuuugcagucaucacuuucaucaacugauaaugaaagacgguagagaaauaguaguaccuugcagaaaucaagaugagcuaguagggagagcacggguaucacaaggcgcggguuggucacuacgagaaaccgcaugcuuaggaaaaucauaugcucaaauguggcaacuuauguacuuucauagacgagauuuacgacuugcagccaaugccaucugcucugcaguaccaguagauuggguuccaacuucaaggacaacuuggucaauucaugcucaucaucaauggaugacaacggaagauaugcuguccgucuggaauagaguauggauagaagaaaacccauggauggaagauaaaacgcauguauccucaugggaggaggucccuuauuugggaaaaagagaagaucaauggugcggaucuuugauaggguuaacugcaagggcaacaugggcaacaaauauacagguagcuaucaaccaagugcgacgacugauaggaaacgaaaacuaucuggauuacaugacaaguaugaagagguuuaaaaacgaaagcgaccccgaaggagcuuuaugguaa

SEQ ID NO: 21384 - RNA, 9879 nt, Artificial Sequence
  derived and/or modified CDS sequence (opt6) from DENV-1__FJ562106__SS-prME
aguguaacuauguuguuaauguuacuacccacugcucuagcuuuucaucuaacuacaagagguggagaaccacauaugauuguaaguaaacaagaaagggguaaaucgcuauuauuuaaaaccagcgcgggugugaacauguguacacuaauagcaauggaccuaggagaacucugugaagauacaaugacauacaaaugcccucgaauaacagaagcagaacccgacgauguagacuguuggugcaaugcgaccgauaccugggucaccuacgguacauguucacaaacaggagagcaccgcagggacaaaaggagcguagcgcuagcaccgcacguaggacuuggauuagaaacacgaacagaaacguggaugaguuccgagggggcuuggaaacaaauucaaaaaguagaaacaugggcauuaagacauccaggcuucacaguuauagcgcuguuucucgcccaugcaauuggaacaaguauaacccaaaaagguauaauauuuauucuauuaauguuagugacuccuucuauggcgaugagaugcguaggaauaggcaaccgagacuuugucgaaggguugucaggugcuacuuggguggaugucguccuggaacauggauccugugugacuacuauggccaaaaauaaaccuacauuagauauugaacuucuaaaaacagaagucacuaauccggcgguauugcgaaaauuaugcauugaagcaaaaauuaguaauacaacaaccgauagucgcugcccaacacaaggugaggcuaccuugguagaggaacaagacgccaauuuuguaugcagaaggacuuuuguugaucgcgguuggggaaacgguuguggauuauucgguaaaggcucacuuuuaacuugcgcgaaauuuaaauguguuaccaaacuagaggguaaaauagugcaauaugaaaaucuuaaauauuccguaauaguaaccgugcauaccggugaucaacaccaagugggcaaugaaacuacagagcacggaaccaucgcuacuauaacuccccaggcgcccacuucagaaauacaacuaaccgauuacggugcacugacauuagauuguucgccaagaacaggauuagauuuuaacgaaaugguucuccuuacuaugaaagaaaagucuuggcuaguccauaagcaaugguuucuugauuuaccacugccauggaccagcggagcuuccacaucucaagagacauggaauaggcaagaccucuuagucacauuuaagacagcacaugccaagaaacaagagguuguaguucucgguucacaggaaggcgcuaugcauacagcacuuacuggagcaacagaaauacaaacgucuggaacaaccaccaucuuugcaggccacuuaaagugcagacuaaaaauggauaaacuuacccuuaaaggaaugucauaugucaugugcacaggaucuuuuaaacuugaaaaagaaguagcggaaacacagcauggcacggucuugguacagguaaaguaugaaggcacagacgcaccgugcaaaauuccuuuuaguacacaggaugagaaaggaguaacucaaaauggcagguugaucaccgcaaauccuauuguaacagacaaagagaaaccagucaauauugaaacggagccaccuuucggagaaaguuauauaaugguaggugccggugaaaaggcucuaaaguuaucaugguucaagaaagggaguucuauugguaaaauguucgaggcaacugcaaggggagcaagacgaauggcgauacuaggcgacacagcuugggauuuuggaagcauaggaggaguguuuaccucgguuggcaagcuaguucaucaaguuuucgguacagcauauggaguucuuuuuagcggagugucuuggaccaugaaaauugguaucggaauccugcucacgugguuaggauugaacaguagaucagcaucucucagcaugacuuguauugccgucggaauggugacucuauauuuaggcguaaugguucaagcugacucuggaugugucauaaacuggaaagggcgugaacuaaaaugcggaagugguauauucguuacaaaugaaguacacaccuggacugaacaauauaaauuucaagccgauucacccaaacgauugucagcagcgauaggaaaagcaugggaagagggagugugcggcaucagauccgcaacccgauuagagaauauaauguggaaacaaauaagcaaugagcucaaucauauacuguuagaaaacgauaugaaauuuacgguagucguaggcgaugcaaauggaauuuuagcccaagggaagaaaaugauacguccacaaccaauggaacacaaauauucguggaagaguuggggaaaagcaaaaauuauaggggcugauauucaaaauacuacauucauaaucgauggaccagacacacccgaaugcccagaugaccagcgugccuggaauaucugggagguggaagacuauggauuuggcauuuucacaaccaauauuuggcuaaaacucagagauucuuacacacagaugugcgaucaccgacuaaugagugcagcuaucaaaaacucaaaggcuguucacgcugauauggguuauuggauugaaucugagaaaaacgagacguggaaauuagcaagagcuaguuucauugaaguuaaaacuugcauuuggccuaaaucccauacacucuggagcaauggcguuuuagagucugagaugauuauaccuaaaauauauggagguccaaucucucaacauaauuaucgaccaggauacuucacucaaaccgcaggaccauggcaucuaggaaagcucgaauuggacuuugguuuaugugagggaacaacuguuguaguagaugaacauugcggaaaucgagguccaucauuacguacaaccacuguaacaggaaagaucauccaugaaugguguugccguucuuguacauuacccccgcuaagauuuagaggagaggacggauguugguacggaauggaaauacgaccgguuaaagaaaaggaagagaaucugguucguaguaugguaucagcaggaaguggggagguagacaguuuuucacuaggcauucuuugugucucaauaaugauagaagaaguuaugagaaguagauggagcagaaaaaugcucaugacaggcacgcuagcuguauuccuacuuuuaauaaugggucaacuuacguggaacgauuuaauaagauuguguauaaugguaggggcaaaugccucagaucgaauggguauggguacaacauacuuagccuugauggcaacguuuaaaaugcgccccauguuugccguagguuuguuauuucggagauuaacuucacgcgaaguuuuacucuugacaauaggccucagccucgucgcuucaguagaacucccuaacucguuagaagaacuaggagauggucuagcaauggggauuaugaugcucaaacuauugacagaauuucaaccacaccaauuguggacaacuuuauuaucucuaacauuuauaaaaaccacauuuagcuuggauuacgccuggaaaaccauggcuaugguacuaucaauaguuucacucuuuccucugugccuaucaacuacaagucagaaaacuacuuggcuuccuguacuauuaggcucguuuggguguaaacccuuaacgauguuucuuauuacagagaauaaaauaugggggcguaagucauggccacugaaugaggguauaauggcuauuggaauuguaagcauauugcugucuagcuuacuuaaaaaugauguuccucucgccggcccgcuuauagcaggaggaaugcucauugcaugcuacguaauaucuggcaguucugcugaucuaucauuagaaaaagcagcagagguuaguugggaagaagaagcugaacauagcggaaccucucauaauauuuuaguugaaguacaagacgacggaaccaugaaaauaaaagaugaagaaagagaugauacccugaccauuuugcuuaaggccacacuacucgcuguaucuggugucuauccuaugucaauuccugcaacucuguucguaugguauuucuggcagaagaagaaacaacguucagguguacuuugggauacgccaucacccccugaaguggaacgagccguacuggaugauggcauauacagaauuuuacagcgcggacuacuugggaggucccaaguuggcgugggcguauuucaggauggaguauuucacacuauguggcaugucacucggggagccguacuaauguaucaggggaagcgccuugaacccucgugggcuucagucaaaaaggauuuaauaagcuacgguggaggauggcgcuuucaagguuccuggaauaccggugaagaaguccaagugauagcuguugagccgggaaagaaccccaagaauguacaaaccaccccugguacuuuuaaaacacccgaaggcgaaguaggugccauagcucuagacuuuaaaccuggaacaagcggaucgccaauugucaaucgcgaggguaaaaucguggguuuauauggaaacggaguaguaacuacaucgggaaccuacguaagcgcaauugcucaggcuaaagcgagucaagaggguccacugccagaaauugaggacgagguguuuaagaaacgcaaucugacuaucauggaucuucaccccgguaguggcaagacaagaagauaucuuccggcaauuguccgugaagcaaucaaaagaaaauugagaacguuaauauuggcuccuacacgcguaguggcuagugagauggcugaagcauuaaaaggaaugccgauccgauaccaaacaacagcaguuaaaucggaacacacaggcagggagauaguggaccugaugugucacgcgacauucacuaugagauuauuaucgccaguacguguaccuaauuauaauaugaucauaauggaugaagcucacuuuacagaucccgcaucuaucgcugcccgcgguuauauaucaacgcgcgucggaaugggggaggcagcagcgauauucaugacugcaacgccuccgggauccguggaggcauuuccucaaucaaaugcaguaauacaagaugaagaaagagauauaccggaaagaucuuggaacucuggauacgacuggauaacugauuucccagggaaaacgguaugguuuguaccuucgauuaaaucuggaaacgacauugcuaauuguuugaggaaaaacggaaaaaggguaauacaacuaagcagaaaaacuuucgauaccgaauaccaaaagaccaagaauaacgacugggauuacgucgugacuacagauaucucagagaugggagcgaacuuucgggccgauagaguaauugacccaagaaggugccuaaaaccuguaauauuaaaggauggcccagaacguguuaucuuggcaggcccaaugccaguuacgguggcuucagcugcgcaaagacgagggaggauaggaagaaaucaaaacaaagagggagaucaauacguuuauaugggucagccauuaaauaaugacgaagaucaugcccacuggacagaggccaagaugcuauuagauaauauaaauacuccugaaggaauuauccccgcuuuguucgaaccagaaagagaaaaaucagcggcaaucgauggcgaauacagacuaagaggggaagcaagaaaaacguucguagaacuaaugcguagaggggauuugccuguaugguuaucguauaagguagcuucggaagguuuccaauauucugaccgacguuggugcuuugauggugaacgaaacaaucaaguguuggaagaaaauauggauguggaaauauggacgaaagaaggagaacggaaaaagcuacgccccagauggcuagaugcgcguacauacagugauccacuugcacuaagagaguucaaagaauuugcugcagggcgacgaaguguaucaggagaucuuauuuuagaaauuggaaaguuaccacaacaccugacucuucgggcgcaaaaugccuuagacaauuuaguuaugcuucacaauucagagcaggguggcaaagcauauagacacgcgauggaagaauuaccagauacuauagaaacacuuaugcuacuagcgcuuauagcuguacuaacaggaggaguuacccuauucuuucucucagguaagggucugggaaagacuagcauaggauuacucugcgucauggcaucaucugcacuauuguggauggcaagcguggagccgcauuggauagcggcgagcauaauauuagaguucuuucucaugguccuuuuaauccccgaaccggaccgucagaggacaccacaagauaaucagcuagcuuauguuguaauugggcuauuauucaugauacugacuguagcggccaaugaaauggggcugcuagaaacgacuaagaaagaccucgguauugggcauguagcugccgaaaaccaccaucacgcaacaauguuagaugucgacuuaaggccagcuagugcguggacgcuauaugccguagccacaacagugauaacgccuaugaugcggcauacaauagagaacaccacagcaaauauuagucuuacagcuauugcgaaucaggcagccauacuuaugggccucgacaaaggguggcccauaaguaaaauggacauaggaguaccgcuacuagcauuggguugcuacucacaaguaaauccacuaacauuaacagcagccguacucaugcuagucgcccacuaugcaauuaucgggccgggucugcaagcaaaagcaacacgcgaagcgcaaaaacguacagcugccgggauuaugaagaauccaacgguagacggaauagucgcuauugaccucgauccuguuguuuaugaugcaaaguucgagaaacaguuagggcaaaucaugcuacucauuuuguguacuucacaaauucuauugaugcguacuacgugggcauugugugaauccauuacguuggccacagguccacuuacaacccuuugggaaggaucacccgguaaguucuggaacacgacuauagcaguauccauggcuaauauauuuagagguaguuauuuagcaggagcaggacuugcauucagcuuaaugaaaucucuuggaggagggaggcggggcacaggagcgcagggggaaacccucggggagaaguggaaaagacagcuaaaucaacugucaaaaucugaauuuaauacguauaagcgcucagguauaauggaaguagaucgaucugaggcuaaagaaggcuuaaagcgaggagaaacuacaaagcacgcaguuucaagggguacugccaaacuucgaugguuuguagagcgaaaccucguaaaaccagaaggaaaagugaucgaucugggaugugguagggguggauggagcuauuacugugcaggucuaaagaaaguuacagagguaaaagguuauacaaagggugguccaggacaugaagaacccauaccaauggcgacuuauggauggaacuuaguuaagcuacauucagggaaagaugucuucuucacaccucccgaaaagugugacacccucuugugcgacauuggagaaagcaguccaaauccgacaaucgaagaaggacgaacgcugcguguucuaaagaugguagagccguggcugcgcgguaaucaauucuguauaaaaauuuuaaacccguauaugccgucuguuguagaaacucuugaacaaaugcaaaggaagcacggagguaugcucguaagaaacccauuguccaggaauaguacucaugaaauguacugggugagcugugggacggguaauauaguuagcgccguuaacaugacaucuagaaugcugcuaaauagauuuacaauggcacaucggaagccgacuuacgaaagggacgucgaccucggggcuggaaccaggcacguggcugucgaaccugaaguugccaaucuagacauaauuggacaaaggaucgaaaacaucaaaaacgaacauaaaucuaccuggcacuacgaugaggauaauccauauaagaccugggcuuaccacggcucuuaugaggucaaaccuuccggaucugcgaguucuaugguuaauggggucguucgccuauuaacaaaaccuugggaugucauacccaugguaacacaaauugcaaugaccgacacuacaccauucggccaacaaaggguauuuaaagaaaaaguagauacaaggacaccgcgugccaagagaggcacagcccaaauaauggaaguuacggcaaaauggcuuuggggcuuuuuaaguaggaacaagaaaccuagaauauguacaagagaggaauuuacgagaaaagugcguucaaacgcugcaauaggagcgguauucguagaugagaaucaguggaacucagcaaaagaagcaguugaggacgaacguuucugggacuugguacaucgagaaagagaacuucacaaacaggguaagugugcaaccuguguguacaacaugaugggaaaacgggagaagaaauuaggugaguuugguaaagccaaggggagucgagcuauuugguacaugugguuaggcgcgcgguuucuagaauuugaggcuuuggguuuuaugaaugaagaucacugguuuucuagggagaacaguuuaucugggguagaaggcgagggauuacacaagcucggauauaucuuacgcgauauaucaaaaauaccugguggaaauauguacgcugaugacacagcuggaugggauacgaggauaacugaagaugauuuacaaaaugaagccaagauuaccgacauaauggaacccgaacacgcucuguuggcaacuucuauuuucaaauuaacguaccaaaacaaagucguaagaguucaacguccagccaaaaacggcacagucauggauguuauaucacggagggaucaaagagguucaggacaaguagguacuuauggauuaaauacauuuacgaauauggagguacaauuaauaagacaaauggagucagaagggauauuccuaccgugcgaacuagaaacuccaaaccuagcagaacggguauuagauuggcuggaaaaacacggggcggaaagacuaaagagaauggcaauauccggagacgauuguguaguuaaaccaauagaugacagguuugcaacggcguuaaucgcgcuuaaugauaugggaaaagucagaaaagauauuccccaaugggaaccaaguaaaggguggaaugacuggcaacaagugccauucugcagucaucauuuucaccaauuaaucaugaaagauggaagagaaauaguagugccuugucgaaaucaagaugaguuaguaggaagggcucgugugucacagggugcuggauggagcuuacgggaaaccgcaugucuuggaaaaagcuaugcgcaaauguggcaacucauguauuuucauagacgugaccuccgccuggcagcuaaugcaauauguucagccgugccaguagauuggguccccacaaguagaacuacuuggaguauucaugcccaccaccaauggaugacuacagaggauauguuaucaguauggaaucgaguuuggauagaagaaaauccguggauggaagacaaaacacauguaaguaguugggaagaggugccauaucuuggaaaaagggaagaccaauggugcggaagucuaaucggauuaacuacaagagcaacaugggcaacaaauauacaaguagcuauaaaucaagugagaagacucaucgguaaugaaaauuauuuagauuauaugacaagcaugaaacgguuuaaaaaugaaucagacccagaaggagcgcuaugguag

SEQ ID NO: 21385 - RNA, 9879 nt, Artificial Sequence
  derived and/or modified CDS sequence (opt6) from DENV-1__FJ410179__SS-prME
aguguuacuaugcuccuaaugcugcucccaacugcguuagcauuucaccuuacuacaaggggaggagaaccacauaugauuguuucuaaacaagaaagaggcaaaagccuacuauucaaaacauccgcuggaaucaauaugugcacauuaauagcaauggaucuaggagaauugugugaagauacuaugaccuauaaauguccacgaauuacugaagcagaaccugacgacguugacuguugguguaaugcuacugauacauggguaacauacggcacuugcagucaaacuggggaacauagacgggauaaaagaucgguugcacuugccccacacgugggucucggucuggaaacacguacagaaacauggaugagcagugaaggugcauggaaacaaauccaaaaaguggaaacuugggcccuacgacacccaggauuuaccguaacagcguuauuuuuagcucacgcuauugguacuagcaucacgcaaaaaggaauaauuuuuauacuacucaugcuaguaacaccaagcauggcgaugagguguguagguauagguaacagggauuuuguugaagggcuuuccggagccacuugggucgaugucgucuuagaacaugguagcugcgugacuacaauggcaaaagauaaaccaacucucgauauugaacuauuaaaaaccgaaguaacaaauccagcaguauuacguaaacuuugcaucgaagcgaaaauuaguaauacaacgaccgacagcagaugucccacacaaggugaggcuacauuagucgaggagcaagauuccaauuucgucuguagaaggaccuuuguagaucgggguugggggaaugguuguggacuauuuggaaaagguucuuuauuaacaugcgcgaaauuuaaauguguuacaaaauuggaaggaaaaauuguucaauacgaaaauuuaaaauacucuguaaucguuacaguacacacuggagaccaacaucaaguaggaaaugagacaacagagcacgggacaauagccaccauaacgccgcaagcuccuaccucugaaauucaacuaacggacuauggugcuuuaacucuagauuguaguccgcguacgggauuggauuucaaugagaugguuuuguugaccaugaaagagaaaaguuggcuagugcacaaacaaugguuuuuagacuuaccccuuccguggacgaguggugcaucuacgucccaagaaacauggaacagacaagaucucuugguuacauucaaaacugcgcaugcuaagaaacaagaaguggucgucuuaggaucccaagaaggagcaaugcacaccgccuuaaccggugcaacugaaauccaaacaucgggaacaacaacuauuuuugcaggacaucugaaaugccgguuaaaaauggacaaauuaacauuaaagggaaugucauacgugauguguacuggcagcuuuaaauuagaaaaagaaguagcggaaacgcaacacggcacuguauuaguccaaguaaaauaugagggcacagaugccccauguaaaauaccauuuucagcacaagacgaaaaggguguaacgcaaaacgguagguuaauuacugcgaauccaauagugaccgauaaagagaaaccuguaaauauugagacagagccaccauuuggggaauccuauauuguagucggggccggugaaaaagcacugaagcuaucuugguucaagaaaggcucauccaucggaaaaauguuugaggccacagcgagaggagcuagaagaauggcaauccuaggagacacugcaugggauuucggaagcaucggcgguguauuuacgagcgucgggaaacugguucaucaaguguucggcgcugcguauggcguuuuauuuucaggcguuagcuggacgaugaaaauugguauagguauauuauugacuuggcuagggcuuaacucacgcucuacgagcuugucaaugaccugcaucgcuguuggaaugguaaccuuguaucuaggaguaaugguacaagcagacucggguugugucauaaauuggaaaggaagagagcuaaaaugcggaaguggcauuuucguuacaaacgaggugcacaccuggacagagcaguauaaauuccaagcagacucacccaaaagacuuuccgcugcuauuggaaaagcaugggaggaaggaguuuguggcauacgcuccgcaacuagguuggagaauauaauguggaaacagauaucgaaugagcuaaaucacauauugcuugagaaugauaugaaguucaccguaguuguuggagaugcaaacggcauucuagcucagggcaaaaagaugauucggccacaaccgauggagcaccgguauagcuggaaaaguuggggaaaagccaaaauuauuggagcagauauacagaacucgacuuucauaauagacggaccagauaccccugaaugccccgaugaucaaagggcauggaauauuugggaaguagaggauuauggcuuuggaauauucacuacuaauauuugguugaaacugagagauuccuauacacaaaugugcgaccaccgacuaaugagcgcggcuauaaaagauucaaaagcggugcaugcugacauggguuauuggauugaaucugagaaaaacgagacuuggaagcuagcgcgagcgaguuucauagaggucaagaccugcauauggccgaaaagucacacacuauggucuaacgggguguuagagagcgaaaugauaauaccuaaaauguaugguggaccaauaucucaacacaauuauagacccggauauuuuacacaaaccgcugggccauggcaccuugggaaacuugaacuagacuucgaucuaugcgaaggaacaacuguaguaguagacgaacauugcggcaaucguggaccgagccuuagaaccaccacaguaaccggaaaaauaauucaugaaugguguugucggagcuguaccuugccuccauuacguuuuaggggugaagaugguuguugguauggcauggagauucgcccgguaaaagaaaaggaagagaauuugguuagaucgaugguaagugcuggaucuggagaaguagacaguuuuucuuuaggaauauuauguguaucuauaaugauagaggaggucaugagaucuagauggagucggaagaugcuaaugacaggaacucuugcaguauuuuuguuacuaauaaugggucaguuaacuuggaacgauuuaauacgacuauguauuaugguaggcgcuaacgcuucagauagaaugggcaugggaacuacuuaucucgcgcucauggcgaccuucaagaugcgaccgauguucgcgguuggacucuuauuuaggcgguugacuuccagagaaguguugcuccuuaccauuggauuaagucucguugcuuccguugagcuccccaauuccuuagaagaauuaggagacggacuggccauggggauuaugaugcuaaagcuacuaacagaauuucaaccccaucaacuguggacaacacuguugucacuaacuuuuauuaaaacaacguuaucauuagacuacgcauggagaacgauggcgaugguccuaagcauaguaagccuauuuccuuuauguuuaagcacgacaucgcagaaaacuacuugguugccuguucucuugggcucauuuggauguaaacccuuaacuauguuuuugauaacagaaaauaaaauauggggacguaaauccuggccccuaaacgaaggaauaauggcaauaggaauagugucgauucuauuaaguagccuacucaaaaacgauguaccuuuagcaggcccuuugauagcugguggaauguugauugcuuguuauguuaucucagguucaucugcugaccuaagucuggaaaaggcagcagaaguuucaugggaagaagaggcggaacauucaggaacaucacauaauauucuuguagaaguccaagacgaugguacaaugaaaauaaaagacgaggaacgcgaugauacucugacuauacuguuaaaagcgacguuacuagccauuagcggaguuuaucccaugaguauaccugcuaccuuauucguaugguauuuuuggcagaagaagaaacagagaagugguguacuuugggacacuccaaguccgccugaaguagaaagagccguucuagaugaugggauauacaggauucuacaacgaggacuacucggaagaucgcaagucgggguaggugucuuccaagauggaguuuuccacacaauguggcaugugacgagaggcgcgguucugauguaucagggaaaaagauuagaaccaucuugggccucggugaagaaagauuuaauaucuuaugggggcggguggcgguuucaaggaaguuggaauacuggugaagaagugcaaguuauugcagucgagccuggcaaaaaucccaaaaauguccagacaacuccugguacguuuaaaaccccagagggggaaguuggagccauagcauuagacuuuaaaccaggaaccucagguucaccaauugugaaccgcgaagguaaaauagucggauuguaugggaauggugucguuacuaccaguggcacauacgugagugcaauagcacaggcuaagaccagucaggaaggcccuuuaccggaaauugaagaagagguuuucaagaaaagaaacuugacaauaauggacuugcauccagggucugggaaaacgagaagguacuuaccugcuauaguacgggaggcgauaaaaagaaaacuacgaacguuaauuuuagcucccaccagagugguggcuucggaaauggcugaggcuuuaaaagguaugccaauaagauaccaaacaacagccguuaaaagcgaacauacaggacgagaaaucgucgaucuuaugugucacgcgacauuuacaaugcgucuauuauccccaguacgcgugccuaauuauaauaugauaauaauggacgaagcacacuucacugaucccgcuucgauagcggcacgcggcuauauaucuacucgaguugguaugggagaggcagcagcaauuuuuaugacggcaacuccaccugguucaguugaagcauuuccacaaucaaaugcgguaauucaagacgaagaaagagacauuccggagcggucguggaacagcggguacgauuggauuacagauuucccagguaaaacgguaugguucgugcccaguaucaaaucuggaaaugauauagcuaauugccuuaggaaaaacgguaagagaguuauacaauuaagcaggaaaacauucgauacagaguaucagaaaacgaggaacaaugauugggacuauguagucacaacugauaucucagaaaugggugcgaauuuucgagcagaucgaguaauagauccucgacgcugucucaaaccaguuauuuuaaaggacggcccggagcguguaauuuuagccgggccuaugccaguaaccguagcaucagcggcacagcgacguggacguauuggcagaaaucaaaacaaagagggugaucaguauguauacaugggacaaccucuaaauaaugaugaggaccaugcacauuggacggaagcuaagauguuauuggacaacauuaauaccccugaaggcaucauacccgcucuauuugaaccagaaagagagaaaagugcagcaaucgacggagaauauagacuucgaggagaagccagaaaaacguucguugaacuaaugcggagaggcgacuuacccguuuggcugaguuacaaagucgcaucagaaggcuuucaauauucugauagaaggugguguuuugauggagaacguaacaaccagguauuggaagaaaacauggaugucgaaaucuggacaaaagaaggagaacggaagaaauugcgcccaagaugguuggacgccaggacuuauuccgauccgcucgcauugcgagaauuuaaagaguuugcagcagguagacgaucuguuagcggcgaccucauacuagaaaucggcaaacuuccacaacauuugacuuugagagcacaaaacgcacuggauaacuuggucauguuacauaacuccgaacaagggggaaaggccuacagacaugcaauggaggaauuaccggauacgauagaaacauuaauguuguuagccuuaauagcaguacucacuggugguguaacguuauucuuccuaucugggaaagggcuugggaaaacaagcauuggucuauuauguguaauggcuucuucagcgcuguuguggauggcaaacguugagccacacuggaucgcagccucgauaaucuuagaguucuuuuugaugguacuauuaauaccagagcccgaccgccaacgaacaccacaagacaaccaacuggcguauguuguaauaggauuauuauucaugauauugacuguugcggcuaacgaaaugggguuacuggagacaacuaagaaggaucuuggaauaggucacguugcagcggaaaaucagcaccacgcuacaaugcuagauguggauuuaagaccggcaucugcauggacccuauacgcaguugcaacaacuguaauaacucccaugaugagacacacaauugaaaauaccacggcaaacauuucucuaaccgcuauugcuaaucaagcagcgauacuaaugggauuggacaaaggauggccaauaaguaagauggauauaggaguccccuugcuagcguugggaugcuauagccaagucaacccuuugacauuaacugcagcagugcucaugcuaguugcacacuaugcaauuaucggcccaggucuacaggcaaaagcuacgcgugaggcucagaagagaacagcagccggaauaaugaaaaaccccacuguagacgggaucguagcaauagaccucgauccuguaguauacgaugcaaaauuugaaaagcagcuaggucagauaaugcucuuaaucuuauguacaucucaaauauugcuaaugaggacuacaugggcacucugugaaaguauaacucuagccacagguccacuuacgacgcuaugggaagggagcccuggcaaauuuuggaauaccacgauagccguaaguauggccaacauuuuucgaggaaguuauuuggcgggugcuggccuagccuucagccuaaugaaaagccuaggcgguggaaggagaggaaccggagcucaaggagaaacgcuaggcgaaaaauggaagcgucaauuaaaucaauuaaguaaaucugaauuuaauacguacaagagaucuggaauuauggaaguugaccgaucagaagcaaaagaaggacugaaaagaggggaaaccacuaaacaugcgguaucacgaggcaccgcaaagcucagaugguuuguugagcguaauuuaguaaagccagaaggaaagguuauugauuuagggugcggacgaggaggaugguccuacuauugugcgggacuaaagaaaguaaccgaaguuaaaggauauacuaaaggcgguccugggcaugaggaaccaaucccuauggcgacauauggauggaaccuuguaaaacucuauaguggaaaagauguuuucuuuacaccaccagaaaaaugcgacacucuccuuugcgacauaggagaaaguaguccuaauccuacaauugaggagggaaggaccuugagaguauuaaaaaugguagagccaugguugagaggaaaccaguuuuguauaaaaauauuaaauccauacaugccaucaguaguagaaacauuagaacaaaugcaaagaaaacaugggggaaugcuugucagaaauccgcugagccgcaacucuacgcacgagauguauuggguuucguguggaacaggaaauauagucagcgcugugaacaugaccucucggauguugcuaaacagguucaccaugacccaucguaaaccuacuuacgaacgugacguugaccuuggggcgggaacacgacauguggcaguggagccggaaguagcaaaccuagauaucauaggccaacgaauagaaaauaucaaaaacgaacauaaguccacuuggcauuacgacgaagauaauccuuacaaaacaugggcguaucaugguaguuaugaagucaaaccgucuggcagugcgagcuccaugguuaacggaguagugcgacuacuuaccaagccaugggacguaaucccgaugguaacgcagauugcuaugacagacaccaccccguucggucaacaaagaguauucaaggagaaaguugauacacgcacuccacgugcaaagcgagguaccgcacaaauuauggaagucacagcaaaaugguuauggggauucuuaucgaggaacaagaaaccccgaauaugcacucgcgaggaauuuacgcguaaaguaaggucgaaugcugccauaggggcaguuuuuguagaugaaaaucaauggaacuccgccaaagaagcaguggaggaugaaagauuuugggauuugguccacagggaacgagaauuacacaagcaaggcaaaugugcaaccuguguauauaauaugaugggaaaacgagagaagaaacucggugaauuuggcaaagcaaaaggaucccgagccaucugguauauguggcuuggagcacgguuucuggaauuugaggcucuuggguuuaugaaugaagaccauugguuuucaagggaaaacagcuuuaguggaguagaaggagaaggcuuacacaaguuaggguacauuuugagggacaucuccaaaauacccggaggaaauauguaugcggaugacacugccggcugggauacuagaauaacagaagaugaccuucaaaacgaagcuaaaaucacggauauuauggaaccagagcaugcauuauuagcaacaaguauuuuuaaguuaaccuaucagaauaaaguggucagaguccaacgaccagcaaagaacgggaccguaauggacguaaucucuagacgagaccaaagagggaguggacaagucgguacguacggacugaauacuuuuacaaauauggaaguacaguugauacgacagauggaaagugaagggaucuucuuaccuagugagcuagaaacaccuaauuuagcagagagaguccuagauugguuagagaaacacggaacugaacgucucaaacggauggcaauaucuggagacgauugcgucguuaagccgguugaugauagguuugcuacugcacugaucgcccugaacgacauggggaaaguccgaaaagacaucccccaaugggaaccuucaaaagguuggaacgauuggcaacaaguuccuuucuguagucaucauuuucaccaacuuauuaugaaagauggucgagaaauaguuguaccaugcagaaaccaagacgagcuagucgguagggcaagaguaucucagggagcaggauggucauuaagagaaacagcaugucucggcaaaucuuaugcgcaaauguggcagcuaauguauuuucacagacgggauuuaagacuagcggccaacgccauauguagugccgucccaguugacuggguaccaacuucccgcacgacuuggaguauccacgcacaccaccaauggaugacgacggaggauaugcuuucugucuggaaucgaguguggauagaagaaaaccccuggauggaagauaaaacccauguuucaagcugggaagaaguaccauaucuaggaaagcgcgaagaccaauggugcggaucccugauuggauuaacagcuagagccaccugggcuacaaauauucaaguugccauaaaucagguuaggagguuaaucggcaacgaaaauuacuuagauuauaugaccaguaugaaaagguucaaaaacgaaagcgauccagagggagcacucugguaa

SEQ ID NO: 21386 - RNA, 9879 nt, Artificial Sequence
  derived and/or modified CDS sequence (opt6) from DENV-1__FJ410181__SS-prME
ucaguaaccaugcuauugaugcugcuaccaacggcacucgcauuccaucucacaacaagaggaggagaaccgcauaugauaguuuccaaacaagaaaggggaaaaucguuacuauucaaaacaucaguaggcauaaauaugugcacguugauagcaauggacuuaggcgaauuaugugaagacaccaugacuuauaaauguccccgaauaacugaagcggaacccgacgacguggauuguuggugcaacgcuaccgauacuuggguaacauaugguacaugcucacaaacaggagaacaucggagagauaaaagguccguggcacuugcaccacauguaggacuuggacucgaaacuaggacagaaaccuggaugucaucagaaggagcuuggaaacaaauacaaaaaguagaaacgugggcccuacggcauccgggcuucacuguuaccgcauuguuccuagcacacgcuaucgguacaucuauaacccaaaaaggaauaauauucauccuguugauguuaguaacaccaucaauggcgaugagguguguggguauaggcaauagagauuuugucgaagggcuuagcggugcaacauggguggauguagugcucgaacaugguaguuguguuacuaccauggcaaaagauaaacccacacuagacauagaauuacuaaaaaccgaaguuacuaauccugcagucuuaagaaaacuauguauugaagcuaaaauaagcaauacaacaacggauaguagaugcccuacgcaaggagaagcgacgcuaguggaagaacaagauuccaauuuuguaugcagacgaacguuuguagaucgggguuggggaaauggauguggccuauuuggaaaaggaucacugcucacaugugcaaaauuuaaaugcgucacgaaauuagagggaaaaauuguucaguaugagaaucuuaaauauaguguaauagugaccguacauacuggcgaucagcaccagguaggcaaugagacuaccgaacacgggacgauagcaacuauuacgccccaagccccuacuucagagauccaacuuacagauuacggggcacucacacuugauuguucaccucgaacgggucuagauuucaacgagaugguauuacuaacuaugaaagaaaaauccuggcuuguucacaaacaaugguuuuuagaucucccacuuccuuggaccucgggugcuaguacaagucaagaaacauggaauagacaggaucuccuaguaacauuuaagacugcgcaugcgaagaaacaagaaguaguagugcuaggaucgcaagagggagcgaugcauacggcccugacuggugcaacagaaauacaaaccucaggaacaacaacaaucuucgcgggacaucuaaaguguagauuaaaaauggauaaacugacucuuaaaggaaugucauacguuaugugcacaggaaguuuuaaauuagagaaagaaguggcugagacucaacacgggaccgucuugguacaagugaaauacgaagguaccgacgcucccugcaaaauaccuuucagcgcucaagaugaaaagggaguuacccaaaacgguagauuaauaacagccaauccaaucguaacugacaaagaaaaaccgguaaacauagaaacugaaccuccguuuggggaaucauacauugugauaggagcaggagagaaagcacuaaaacucaguugguucaagaaagguagcagcaucgguaaaauguucgaagcuaccgcucggggagcgcguaggauggcaauauuaggggauaccgcaugggauuuuggaucgauuggaggaguauuuacgagugugggaaaauuaguacaucaaguuuuuggcgcugcauauggaguucuauuuagcggcgucucauggacuaugaaaaucggaauuggaauccuacuaaccugguuaggacuuaacucaagaucuacaaguuuaagcaugacauguauagccgugggaauggucacgcuuuauuuaggggugauggugcaagcagacagugggugugucaucaauuggaaagguagggaacuaaaaugcggaaguggcauauucguuaccaacgaaguacauacauggacagaacaauacaaguuucaagcugacucgccaaaaagauugucugcggcaaucgguaaggcuugggaggaaggaguuugcggcauccgaucggcaaccagauuggagaauauaauguggaaacaaauaaguaaugaacuaaaccacauacuauuagagaaugacaugaaauucaccguaguggugggagacgcuaauggaauauuagcccaagggaaaaagaugauaagaccacaaccuauggaacaccgguauagcuggaaaucuuggggaaaagcaaaaauaauuggagcagacauucaaaauacaacauuuauuauugacggcccugauacgccagaguguccugaugaccaaagggcauggaauauuugggaggucgaagacuacggcuuugguauauucacaacaaauauuugguuaaaacuaagagacucauauacucagaugugcgaucauagguugaugagugcugcgauaaaagauucuaaagcaguucacgcugauaugggauauuggauagaaagcgagaaaaaugaaacauggaaauuagcucgugcuucuuucaucgagguuaaaacauguaucuggccaaaaagucauacacuauggucaaacggaguacuugagagugaaaugauaauuccuaaaaucuauggaggcccaauaucacaacauaauuauagaccugguuacuucacacagacugcagguccguggcaucuuggaaaacuagagcuagauuucgaccuaugugaaggaacgacaguaguaguggaugaacacugcgguaauagggguccaagucuaagaacgaccacuguuacagguaagauaauacaugagugguguuguagaucaugcacuuuaccuccccuuagauuccguggcgaggacggcuguugguauggaauggaaauaaggccaguaaaagagaaagaagaaaauuugguaagaucuaugguuagugcggguaguggagaaguagauagcuucucguugggcauucuuuguguaucaauaaugauagaggaagugaugcguucgagauggucaagaaaaaugcuaaugaccggaacacuugcuguguuccuauuacugauaaugggacaauugacguggaaugaccuaauacguuuaugcauaaugguuggggccaaugcgagugaccggaugggaauggggacaacauauuuagcacucauggcaacauuuaagaugagaccgauguucgcgguaggacugcuauucagacgacuaacgucucgggaaguauuacuuuuaacuauaggauugagcuuaguggcaagugucgaacuaccuaacagccuagaagaacuaggggacggucuagccauggguaucaugaugcuaaaacucuuaaccgaauuucaaccucaccaacucuggacaacauuguuaaguuuaacauuuauuaaaacaacgcucucccuggacuaugcauggcgcacaauggcaaugguuuuaucuauagucaguuuauuuccguuauguuuaucgacaacaucgcagaaaacuaccuggcuuccagugcuccuaggaucauuuggcugcaaaccuuuaacuauguuuuuaaucacagaaaacaaaauauggggaagaaaaagcuggccucuaaacgaaggcaucauggcaauaggaauugugucgaucuuauuaucuagucuacuuaaaaaugacguaccuuuagcgggaccguuaaucgccggugggauguuaauugcauguuauguaauuucagguucuucggcugacuuaucacuugaaaaagcagccgaaguuaguugggaagaagaggcugaacacagcggaacaucgcauaacaucuuaguggagguccaagaugacggcacuaugaaaauaaaggaugaagaaagagaugauacucugaccauucuacucaaagcaacuuugcuagcaguaucagggguauauccgauguccauaccggcaacccuauucgugugguauuucuggcagaagaagaaacaaagaagcgguguacuaugggauacuccgucuccuccugagguagaacgagcaguauuagacgacggaauauaucgaauccuacaaaggggacuuuuaggaagaucccaaguaggaguaggaguuuuccaggauggagucuuucauacaauguggcaugugacucguggcgcagucuuaauguaccaaggcaagcgucuugaaccuagcugggcuuccguaaagaaagaccuaauuaguuaugguggcggauggcguuuccaaggcaguuggaauacuggagaggagguacaagucauagcaguugaaccagguaaaaauccgaagaauguacagacgacuccgggaaccuuuaagacuccagagggagaaguaggggccauugcuuuagacuucaagccagggacaagugguaguccaaucguaaaucgcgaaggcaaaaucguuggccucuaugggaacgggguuguuacgaccuccgggacuuauguauccgccauugcgcaagccaaaacgagucaagaaggaccuuuaccugagauugaagaugaaguauuuaagaaacggaaucuuacaaucauggaucuucauccggguagcgguaagacuaggagguacuuaccugcuauaguacgcgaagcgauuaaacgaaaguugcgaacauugauucuagcuccaacgaggguggucgccucagaaauggcagaggcguugaaagggaugccaauacgauaccagaccaccgcuguuaaaucagaacauacagggagggaaaucguugaccuaaugugucaugcuacuuucaccaugagauuauuaucuccaguacgugugccaaacuauaacaugauaauuauggaugaggcacacuucacagaccccgcuaguaucgcugcucguggguauaucucgacaaggguaggcaugggugaggcagccgcaauauuuaugacggcaacaccuccgggaucuguugaagcauuuccacagucaaaugccgucauccaagacgaagaacgagauaucccggaacgaucguggaacagcggauacgauuggauuacugauuuuccaggcaaaacagucugguucgugccaucaauaaaaagugguaaugauauagcuaauugcuugcggaagaauggaaaacgggugauucaguuaagucgaaaaaccuucgauacagaauaccagaaaacuaaaaauaaugauugggauuacguaguaacgacagacauaagcgaaaugggcgcaaauuuuagggcagauagagucauugacccacguagaugccuuaaaccaguaauacuuaaggaugggccagaacgaguaaucuuggcaggaccaaugccaguuacaguagcaucggcugcucaacgccgcggaagaauaggaaggaaccaaaauaaagaaggggaccaauaugucuacaugggacaaccauuaaauaacgaugaggaucaugcgcauuggacagaagcaaagaugcuacuggauaacauuaauacucccgaaggaauuauaccggcuuuauuugaacccgaacgugagaaaagugccgccauagacggcgaguauaggcuaagaggcgaagcaagaaagacauuuguugaacuaaugcgaaggggagaucugccaguuugguuaaguuauaaggucgcuagcgaagguuuucaauacucagauaggagaugguguuucgacggugaaagaaauaaucaagugcuagaagaaaacauggacguugaaauuuggacaaaagagggagaaaggaagaaacuaagaccccgauggcuggacgcucgaacuuacucagauccauuagcauuacgugaguucaaagaauuugcugcugggcgacgaucugucucgggugaucugauccuugaaauaggaaaauugccucaacacuuaaccuuacgcgcgcaaaaugcauuggauaauuuggucauguugcacaauucagaacaaggaggaaaagcauauaggcaugcgauggaagaacuaccugauacgauugaaacauuaauguugcuugcauuaauugcuguuuugacagguggaguuacauuauucuuuuuaaguggaaaaggccucggcaagacaaguaucgguuuacuauguguuauggccucaagugcauuauuguggauggccaaugucgaaccucauuggauagcagcuucaauaauauuagaauuuuucuuaaugguacuauuaaucccugagcccgauaggcaacguacgccucaagauaaucaacuggcguaugucgucauaggacuacucuucaugauauuaacaguagcugccaaugaaaugggauuguuagaaacaacgaagaaagauuuagguaucggucacguagcagcggaaaaccaacaucaugcaacgauguuagauguagaucuacguccugccucugcauggacucuauaugcuguugccacgacggugauuacaccaaugaugagacauacgauagagaacacgacugcuaauauaucauugacugcuaucgccaaucaagccgcaauuuuaaugggucucgauaaaggcuggccaauuucaaaaauggauauaggagucccguuauuggcgcugggaugcuacucucaaguuaauccccuuacauuaacggcagcaguucucauguuaguggcccacuacgcaauaauagggccuggauugcaagcuaaagccacgcgugaggcacagaaacgcacagccgcagguauuaugaaaaauccaacaguugauggcauaguugcgauagaccuugauccaguaguguaugaugcaaaauucgaaaaacaacugggacagauuaugcugcuaauacucugcacaucgcaaauucuuuuaaugagaacaacgugggcacucugugaaagcauaacauuagccacgggaccacuaacaacccuaugggaaggaaguccuggcaaauucuggaacacuacaauagcgguuagcauggcaaacauauuccgaggaagcuacuuagccggugcagguuuagcuuuuagcuuaaugaagucauuaggaggagguaggagggguaccggcgcacaaggggaaacucuuggugagaaauggaaacgacaauugaaucagcuauccaaaucugaguucaauaccuauaagcgaagcggaauaauggaaguagaccggucugaagccaaagaagggcucaaacgcggcgaaaccaccaaacaugcggucuccagaggaaccgcaaaauugagaugguuuguagaaagaaaucuaguuaaaccugaaggcaagguaauugauuugggcuguggaagaggcggguggucguauuacugugcuggccucaagaaagugacagagguuaaagguuauacaaaaggcgguccaggccaugaagaaccuauuccgauggcuacauaugguuggaaccuaguuaaacuauauuccggaaaggacguauucuuuacacccccugaaaagugugauacuuuauuaugugacauaggcgaaucgucaccgaauccaacaaucgaggaagggaggacacuuagaguuuugaaaaugguagaaccuugguuaagaggaaaucaauuuuguauaaagauacuaaaucccuacaugccuagcgucguagaaacguuagaacaaaugcaacgcaaacacgggggcaugcuaguuagaaauccauuaagccgaaacucuacucacgaaauguauuggguaagcugcggaacagguaauauaguaucagcugucaacaugacgagcagaauguuacucaacagauuuacaauggcacauagaaaaccuacauaugagagagacguagaucugggagcugggacacgacacguggcaguagaaccagaaguagccaauuuggacauuauaggucaacgaauugaaaacauuaagaaugaacauaaaucgaccuggcacuaugaugaggauaacccauacaaaacaugggcauaucacggcaguuacgaggucaaaccuaguggaagcgcgucgaguaugguuaauggggucguuagacuucugacaaaaccuugggaugugauuccuaugguuacacaaauagccaugacagacacuacaccguuuggucagcaaaggguuuucaaagaaaaggucgauacuagaacaccccgggccaaacguggaacagcacaaaucauggaagucacagcuaaaugguuauggggauuucuaucuaggaauaagaaaccccgaauauguacuagggaggaguucacuagaaaagugagaaguaaugcggcaauaggagccguauucguggaugagaaucaguggaauagugcaaaggaagcuguggaggaugaaagauuuugggacuuaguuuaccgcgaaagggagcuacacaaacaagguaaaugugcaacaugcguguacaacaugauggggaagagagagaagaaacuaggugaguuugguaaggcgaaagguagccgugcaaucugguacaugugguuaggagcacgguuuuuagaauuugaagcacuaggauucaugaaugaagaucauugguuuucuagagaaaauucauucagcgguguagaaggcgaagggcuacacaaacuaggauauauauuacgggacaucucuaaaauaccaggagguaauauguacgcggacgacacggccggcugggauacgcggauaacugaggaugaucugcaaaaugaagcaaagauaaccgauaucauggagccagaacaugcacuuuuagcaacaaguauauucaaacuuacguaccaaaauaaaguaguaagaguucagaggcccgcuaaaaaugguaccguaauggauguuauuagcaggcgagaucagaggggaucaggacagguugguacuuacggacugaauacguucacgaacauggaaguucagcuuauacgccagauggaguccgagggaaucuucuugccgagcgaauuggaaacaccuaauuuagcugaaagagugcuagacuggcuagaaaaacacgguacggaacgacucaaaaggauggccauuucaggugaugacuguguuguaaaaccaguugacgaccgauucgcaacagccuuaauagcauuaaacgauauggguaaaguacgaaaagacauaccacaaugggagcccuccaaagguuggaaugauuggcagcagguaccauuuugcucacaccauuuccaucaauugauaaugaaagacggacgagagauaguaguaccaugcaggaaucaagacgaguuaguaggacgagcaagagucucacaaggugcuggauggucuuuacgagaaacagcaugcuuagguaagucauacgcccaaauguggcaacucauguauuuucaccggcgcgauuuacggcuagccgcaaacgcuauauguucagcggucccaguugauuggguuccuacaucuaggacaacuuggaguauucaugcccaccaucaauggaugacgacugaagauauguuaucaguuuggaaucgaguuuggaucgaggaaaacccauggauggaagauaagacacaugucucgaguugggaagaaguuccauaucugggcaaacgugaagaccaauggugcgggucauuaaucggauugacugcaagagcuacaugggccacuaauauccaaguagccauaaaccaaguucgaagacucauaggaaaugagaacuacuuagacuauaugacaucaaugaagcgauuuaagaaugaaagcgauccagaaggagccuuaugguga

SEQ ID NO: 21387 - RNA, 9879 nt, Artificial Sequence
  derived and/or modified CDS sequence (opt6) from DENV-1__FJ547086__SS-prME
agugugacuaugcuauuaaugcuauuaccaacugcacuugcauuucaucuuacuacacgugguggggaaccucauaugauaguuucuaaacaagagagaggaaagagcuuacuuuuuaaaacuucugcaggaguuaauauguguacacuuauagcaauggaccuuggagaguuaugugaagauaccaugacauauaaaugcccccgaauuacagaggcugaacccgaugauguugacuguugguguaacgcaacagauaccuggguuacauauggaaccuguagucaaacaggcgaacaucggagagacaaacgcaguguggccuuagcuccccacgucggauuaggauuggagacgcgaacagaaacuuggaugagcucagaaggagcauggaaacaaauacaaaaaguggaaacaugggcuuugaggcacccgggauuuacagucauugcauucuuucuagcgcacgcgauaggaacauccauaacccaaaaaggcauaaucuuuauacuacugauguuagucacaccaucaauggcuaugcgauguguagggaucggaaauagagauuuuguagaagggcugucgggcgcaacauggguggacguaguauuagagcauggaucaugcguaacuacgauggcuaaaaauaaaccaacccuugacauagagcuuuuaaaaacagaagucacgaauccggcuguacuuagaaaacuauguauagaagcaaaaauaagcaauaccacgacggacagucguugccccacccaaggugaggccaccuugguugaggaacaagaugccaacuuugugugccgccguacauucguugaccgagguugggggaauggaugcgggcuuuucggcaaagguagucuuuuaacaugcgccaaauuuaaaugcguuacaaaauuggaagguaaaauaguccaauaugaaaaccuaaaauacaguguaauuguaacagugcauacaggagaucaacaccaagucggcaacgaaaccacagaacauggcacaauugccacuauaaccccgcaagcuccaacgucugaaauacaauuaacugauuacggggcgcugacucucgacuguucuccaagaacgggauuggauuuuaaugaaaugguauuacugacuaugaaagagaaaucauggcucguucacaaacaaugguuuuuggacuugccguuaccguggacaucaggagccucgacuucccaggagacuuggaaccgccaggaucuacucguuacauuuaaaacagcucaugcuaagaaacaagaaguuguuguucugggaagccaagaaggugcuaugcacacagcauuaaccggagcgacggaaauacaaacgucagguacaacaacaauauuugcgggucaccuaaaaugcagacucaaaauggauaaauugacacuaaaaggcaugaguuaugugaugugcacagggagcuucaaacuugagaaagagguagccgagacucaacacgguacaguuuuaguacaaguaaaauaugaaggcacagaugccccaugcaaaauuccauuuagcacccaggacgagaaagguguuacucaaaacgguagacucauaacggcaaauccgauuguuacagacaaagagaaaccgguuaauauugaaacagaaccaccguucggagaaaguuauaucaugguaggcgcaggagaaaaggcuuuaaaacuuaguugguuuaagaaaggaaguagcaucggaaaaauguuugaggcgacagcaagaggcgccagaagaauggcuauacugggugacacagcgugggauuucggaucaauuggcgguguauucacaaguguugguaagcuaguccaccaaguuuuuggaacagcguaugguguucuauuuucaggugucaguuggacgaugaaaaucggaauaggcauuuugcucacauggcuuggcuuaaacuccagaucggcuaguuuaucaaugacauguauugcagucgguaugguaacuuuauacuuaggugugaugguacaagcggauagugguugcgcgauaaacuggaagggucgugaacuuaagugcgggagugguauauuuguuacaaacgaaguccacaccuggacggaacaguacaaguuccaggcugacagucccaagagauuaucggcugcgauugguaaagcgugggaagaaggaguaugcgguauucguuccgccacaagauuagaaaacauaauguggaaacaaauuaguaacgaacuuaaucauauacuacuggaaaaugauaugaaauuuaccgugguuguaggagaugcgaaugggauucuugcacaaggaaagaaaaugauucggccacaaccaauggagcacaaguauucauggaaaaguugggguaaggcuaagauaauuggcgcagauauacagaauacaacguuuauaauugaugggcccgauaccccagagugcccugacgaucagcgugcauggaacauuugggaaguagaagacuaugguuucggaauauuuacaacaaauauauggcuuaaacuaagagauagcuauacacaaaugugcgaucaccgacugaugagcgccgcuauaaaagacaguaaggcuguccacgcugacaugggauauuggauugaaagugagaaaaaugaaacauggaaauuagcuagggccucauuuaucgaaguuaagacaugcauauggcccaaaagucacacgcuguggagcaauggcguacuggaaucggaaaugauuaucccaaaaauauacggaggcccaauuucucaacauaauuaucgaccuggguauuuuacacaaacugcgggaccguggcaccuggguaaauuggaauuagacuucgauuuaugugaggguacgacuguaguugucgaugaacauugugguaacagggguccaaguuuacguaccacaacagucacagguaaaauuauccacgaaugguguuguaggagcuguacauugccacccuuaagauuuagaggagaagacggcuguugguacgguauggagauuagacccguaaaggaaaaggaagagaaccugguuaggaguauggugucagccgguucaggagagguagauucauuuucacucgguauacuuugcguuaguauaaugauagaggagguuaugcgcagcagauggucacggaaaauguuaaugaccgguacgcuagccgucuuucuacuauugauaaugggucagcuuacauggaaugaucuaauacgauuauguauaaugguaggcgcuaaugccagcgaucgaauggggaugggaaccaccuacuuagcauuaauggcaacauucaaaaugcgaccaauguucgccgucggacucuuauuuagaagauuaacaaguagggaagugcuuuuauugacaauuggauuaagucuaguagcuuccguagagcugcccaauucauuggaggagcugggugaugguuuggcaaugggcauaaugaugcuaaaacuacuuacugaguuucaaccacaccaacuauggacgacccugcuuucacuuacauuuauaaaaacaacgcugucacuagauuacgcuuggaaaacaauggccaugguacuuaguauaguuucauuguucccacuaugccuuucaacaacaucucagaaaaccacauggcuccccguucuauuaggcagcuuugguuguaaaccuuuaacaauguuucugauaacagagaauaaaaucuggggucggaaguccuggccacugaaugaaggaauaauggccauagggauaguaucaauucugcuaaguucauuauuaaagaacgacgugccguuggcaggaccgcuaaucgcaggcggcauguuaauugcauguuaugucauaucaggaucaucggcagacuuaucauuagagaaagcagcagaaguuuccugggaggaggaggcagaacauagcggcacuucacauaauauucuaguagaaguccaagaugauggaacaaugaaaauaaaggacgaagaacgagaugacaccuuaaccauauugcuuaaggcgacacuucuagcaguaagcggaguauauccuaugagcauuccugcgacauuguuugucugguacuuuuggcagaagaagaagcaaagaagugguguuuugugggauacacccagcccgccagaaguugaaagggcaguuuuagaugaugggaucuaucguauacuucaaagaggacuacuaggacguucacagguagguguugguguauuucaggauggaguauuccauacgauguggcacguaacaagaggcgcggugcuaauguaccagggaaaacgauuagaaccaagcugggcaaguguuaagaaagaccuaauuucguacggaggugguuggagguuucaagguaguuggaauacaggggaagaaguccagguuauagcagucgaaccaggcaaaaauccgaaaaauguccaaaccacgccaggcacuuuuaagacaccagaaggagaaguaggugcgauagcacuugacuuuaaaccaggcacaucgggaagucccaucguaaauagggaagggaaaauaguaggauuguaugggaacggcguaguaacaaccagugguacauacgucagcgcgauagcgcaagcuaaggcaucacaacaaggaccguuacccgaaaucgaagaugaagucuucaagaaacgcaacuugacaauaauggaucuccauccagguaguggcaaaacacgaagguauuugccugcaauaguucgugaagcgauaaaaagaaaacuaaggacauugauccuagcaccgacaagaguuguagcauccgagauggcggaagcauugaaagguaugccaauaagguaucaaacgacugcuguuaaaagcgagcacacaggacgcgagauagucgaccugaugugccacgcaacuuucacuaugcgccuauugucuccuguuagagucccaaauuauaauaugauaauuauggacgaagcucauuuuacugacccagcuagcauagcugcgcguggauauauuagcacaagagucggcaugggagaagcggcugcuauauuuaugacugcaacuccuccagguucuguagaagcauuuccucaaagcaaugccguaauacaagaugaggagcgagauauaccagaaagaucuuggaacucgggcuacgacuggauaacagacuuccccgguaaaacaguaugguuuguaccuucgauaaaauccggaaacgauauagcgaacugucuaaggaagaacggcaaacguguuauccaauuaucucgcaagacguuugauacagaauaucagaaaaccaaaaacaaugacugggacuauguaguaacgacugauaucucugaaaugggagccaauuuucgcgcugaucgaguaauugacccgcgucggugccuuaaaccagucauauuaaaagaugguccugagagagucauauuagccgguccaaugccaguuacuguagcgagugcugcccaacggcgaggucggauugggagaaaucagaauaaagagggagaccaauacgucuauauggggcaaccacuaaauaaugaugaagaccacgcccacuggacggaagcaaagaugcuucuugacaacauaaauacgccggaagggaucauaccggcccucuuugaaccagaaagagagaaaagugcagcaauagacggagaguauaggcuuaggggagaagcacguaaaacuuuuguagaguuaaugcgacgaggcgaccuaccagugugguugagcuauaaaguagcuuccgaaggauuucaguacucagauagaagaugguguuuugacggagaacguaacaaccaagucuuagaagagaauauggacguagagaucuggacuaaagaaggagagagaaagaaauuacgaccuagguggcuugacgcgaggacuuauagugaccccuuagcucuacgagaauuuaaagaauuugcagccgggaggcgaucaguaucaggagaccugauccuagaaauagguaaacucccccaacaucucacacuaagagcacagaacgcacucgauaaccuaguaaugcuacauaacuccgagcaaggaggcaaggcuuaccggcaugcaauggaagaauuaccagauacuauagaaacgcucauguuacuugcacuaauugcaguguuaacugguggaguuacauuguucuuucuuuccgguaaaggauuaggaaaaacaucgauuggccuccuuuguguaauggcaaguagcgcauuauuauggauggccagcguagaaccacauuggauagcagcauccauaauccuagaguucuuuuuaaugguucuauuaauaccggaacccgaucgacaacguacaccacaggauaaccaacucgcauauguugugaucggacuucuauucaugauacucaccgucgcagcgaaugaaauggguuuacuagaaaccaccaagaaagacuuaggcaucggacauguagcggcagaaaaucaccaucacgcgaccauguuagauguggaccuccgacccgcaagcgcuuggacccuuuaugccguagcaacaacaguaauuacgccaaugaugcgccauacaaucgagaacacaacugcaaauaucucgcuaaccgcuauugcuaaucaagcugcaauauuaaugggauuagauaaaggcuggccaaucucaaaaauggauauagguguaccucuauuagcguuaggcugcuauagucaagugaauccguuaacgcugacugcugcuguccuaauguugguagcucauuaugcgaucauuggcccaggcuuacaagcaaaggcaaccagagaagcucaaaaacgaacagcagcaggaaucaugaaaaauccuacgguagaugguauuguagcaauugacuuagacccgguuguauaugaugcaaaguuugagaagcaacuaggucaaauuaugcuucucauccuaugcacaagucaaauucuccuaaugcgcacaacgugggcgcugugcgaaucaauaacgcuggcgaccggacccuuaacaacauuaugggaaggaucuccaggaaaauuuuggaauacuaccauugccguaucaauggcgaacaucuuccggggaucauauuuagcgggcgccggacuugcauucucuuugaugaaaucacuaggaggcgggagacgaggaaccggcgcccaaggagaaacauuaggugaaaaguggaagagacaacuuaaucaacuaucuaaauccgaauuuaauacauauaaacggagcgggauaauggaaguugaucgaucagaagccaaggaggguuuaaaaagaggcgaaacgacaaaacaugcugucucccgagguacagcgaaguuacguugguuugucgagagaaacuuaguuaagccagaaggcaaagucaucgaucuaggaugcgguagggguggaugguccuacuauugcgcaggacucaagaaaguaacagaaguaaaaggcuacacaaaaggaggaccgggucaugaggagcccauacccauggcgaccuauggcuggaauuugguaaaacuacauagcggaaaggauguauucuucaccccuccggaaaaaugugauacacuauugugugacauuggagaaaguucuccaaauccgacuaucgaagagggcagaacauugagaguacuuaagaugguagagccaugguugcgcggaaaucaauuuuguauaaaaauacuaaacccuuacaugccaucugucgucgaaacucuagagcaaaugcagaggaagcauggcgguaugcuaguuagaaauccauuaucaagaaauucaacacacgaaauguacuggguuagcugcggcaccggcaacauagucagugcagucaacaugacuucuagaaugcuuuuaaaucgauucacgauggcacaucgaaaaccgacauaugaacgugacgucgaucuuggagcgggaacaagacacguggcaguagaaccagaaguagcgaacuuggauauuaucgggcagagaauugagaauaucaaaaaugaacauaagucuacauggcauuaugaugaggauaauccguauaagacaugggcguaccacgguucuuaugaaguuaaaccuuccgguucggcgucuucuauggugaauggugucguaagauuauuaacgaaaccgugggaugugauuccaaugguaacucaaauagcaaugaccgacacgacuccguuuggccaacagagaguguuuaaagaaaagguagauacccggacgccaagagcuaaacgaggaacggcacagauuauggaaguaacagcaaagugguuguggggauuucuaagcagaaauaagaaaccuaggauaugcacuagagaagaauuuacgagaaagguccgguccaacgcagcaauaggugcuguauuugucgacgaaaaucaguggaacucagcgaaagaggcaguagaggacgagagauuuugggaucugguccaucgagaaagagaauuacauaaacagggaaaaugugccaccugugucuacaauaugaugggaaagcgagagaagaaacucggagaauuugguaaagcgaaaggaucacgggcaauaugguauaugugguuaggugcacgauuccuugaguucgaagcacuagguuuuaugaaugaagaccacugguuuucuagagaaaauagucuaucgggaguugaaggagaaggccugcacaaacucggauauauuuuaagagacauuagcaaaauaccuggcggaaauauguacgcugaugauacggcugguugggauacaagaauaacugaagaugacuugcaaaaugaagcaaagauaaccgacauaauggaacccgaacacgcuuuacucgcuacaucaauauuuaagcugaccuaccagaacaaaguggugagaguacaaagaccagcgaaaaauggaaccguaauggacguuaucucuaggagagaccaacgggggaguggccaagucggaaccuaugggcucaacacguucaccaacauggaaguucaauuaauacgacaaauggaaagugaaggaauauuccuaccuugugaauuggaaacgccuaacuuagcagaaagaguauuagacuggcucgagaagcauggagccgagagacuuaaaagaauggcuauuucaggugacgauuguguuguuaagccuauugaugacagauucgccacagcuuugauagcucucaacgauaugggaaaagugagaaaggauauuccacagugggagccuucaaaaggauggaaugauuggcaacagguacccuuuuguucacaucauuuccaucaacucauuaugaaagaugggcgugaaauaguuguaccaugccgaaaccaggaugaauuaguaggacgggcucgugugucacaaggcgcuggauggucacuaagggaaacagcuuguuuaggaaaaagcuaugcacaaauguggcaacuaauguauuuucauaggagggaucugagacuugcggcaaaugcgauauguucggcaguaccuguugacuggguuccuacuagcagaacuacauggaguauccacgcccaucaccaguggaugacgaccgaggacauguugaguguauggaauagaguauggauagaggaaaauccauggauggaagauaagacacacguaucuucgugggaggagguuccauaccuuggaaaaagagaggaucaaugguguggcaguuugauagggcuuacagcaagagcaacaugggcaacuaacauacaaguugccauuaaccaaguaagaagauuaaucggaaaugaaaauuauuuggacuacaugacuuccaugaaaagauuuaaaaacgagucaaaccccgaaggagcacucugguaa

SEQ ID NO: 21388 - RNA, 9879 nt, Artificial Sequence
  derived and/or modified CDS sequence (opt6) from DENV-1__FJ410183__SS-prME
ucgguaacaaugcucuuaauguuauuaccaacugcguuagcuuuucaccuaacuacucgaggaggggaaccucauaugauugucuccaaacaagaacgagggaaaucucuuuuauuuaaaacuucagcagggaucaauaugugcacacuuauugcuauggaucuuggcgaacuaugugaagauaccaugacauacaaauguccucggauaacagaagcugaaccggacgacguggauuguuggugcaaugccacagacacuuggguuacauacgggacuugcucucaaacgggugaacaucgacgugacaaacguucgguugcauuagcaccacauguuggucuugguuuagaaacacgaacggagacuuggaugagcucagaaggagcuuggaaacaaauucaaaagguggaaacaugggcacuaagacacccggguuuuacaguuacugcguucuuuuuagcacacgcuauugguacuagcaucacacaaaagggcauaauuuuuauccugcuaauguugguaacaccuaguauggcaaugagauguguugguauaggaaauagagacuuuguggaagguuugucaggagcaacguggguagacgugguacuugaacaugguaguugcguuacuacuauggcaaaagauaaaccaacgcucgauauagaauuguuaaaaacagaaguaacaaacccugcaguucuacgcaaacucugcauagaagcaaaaaucucaaacaccaccacagacagucgcuguccuacucaaggcgaagcaacuuugguagaagaacaagauaguaauuuuguuugucgacguaccuuuguggauagggguuggggaaauggauguggucucuuuggaaagggaucguuauuaacaugugccaaauuuaaguguguaacgaaauuagaggggaaaauaguucaauacgagaaccuaaaauauucagucauuguaacaguacacacuggcgaucaacaucaagugggaaaugaaacaacagaacaugguaccauagcaacaauuacaccacaagcccccacaagugagauacaauuaacggauuacggagcucuuacuuuagauuguagcccuaggacuggacuagauuuuaaugagaugguucuacuaacaaugaaagagaagaguugguugguucacaaacaaugguuucucgauuuacccuuaccuuggacaucgggcgccaguacaucucaagaaacauggaaucggcaagauuuauuggucaccuuuaaaacugcacacgcuaaaaagcaagaaguggucguacuuggaucucaagaaggggcaaugcacacugcacuaacaggagcuacagaaauacaaacauccggcaccacgacuauauuugcagggcacuuaaaauguagauugaaaauggauaaacucacauuaaaagguaugucuuacguaauguguacagguucguuuaaguuagagaaagaaguggcugaaacgcaacauggaacuguuuuggugcagguuaaauaugagggaacagacgcaccuuguaaaauaccuuuuuccgcgcaagaugaaaagggaguaacucagaauggucgcuuaaucacggcgaauccaauagucacggacaaggaaaaacccgucaauauagagacagaaccaccuuucggggagagcuauauuguaguaggagcgggcgaaaaggcucuaaaacucaguugguucaagaaagguucaucaauaggaaaaauguucgaagccacagcacgcggggcuagaagaauggcaauauugggagauaccgcaugggauuucggaagcaucggagggguguuuacuucuguagguaaauugguacaucaggucuuuggcgccgcauacgggguacuauucagcggaguaucauggacgaugaagauaggcauuggaauacuacucaccugguugggacuaaauagccgaucaacaagucuaucaaugacuuguaucgcugucggaaugguuacuuuauauuuagggguuaugguacaagcagauucuggauguguaauuaauuggaaaggacgagaacuaaaaugcggcagcggaauuuuuguuacaaacgagguacauacauggacugaacaauacaaguuucaggcugauaguccuaagaggcuuagugcggcuauuggaaaagcaugggaagaaggagucugugguauccguucggcuacacgccuugaaaauauaauguggaaacaaauaucaaacgagcuuaaucacauucuucuugaaaacgacaugaaguuuacgguuguggugggugacgccaacgggauccuugcccaagguaaaaagaugauaagaccgcaaccuauggagcauagguauucuuggaaaucauggggaaaagcaaaaauuauaggagcugacauacaaaauaccacauuuaucauagaugguccggacacucccgaaugucccgacgaccaaagagcuuggaauauaugggaaguugaagacuauggauucgguauuuuuacaacaaauauaugguuaaaauuaagagauagcuauacgcaaaugugcgaucacagauuaaugucugccgcgauaaaggauucaaaggcaguucaugccgacauggguuacuggauugaauccgagaaaaaugaaacuuggaaacuagcgcgagcgucuuucauagagguuaaaacauguauuuggcccaaaagccacacacuauggucuaaugguguacuagaaagcgaaaugauaauuccaaaaauguaugggggcccaacuucccaacauaacuaucgcccggguuauuuuacccaaacagcggguccuuggcauuuagguaaacucgaacuugauuuugauuugugugaaggaacuacaguaguuguugacgaacauuguggaaauagaggaccuucacuucgaacaacaacaguaacaggcaaaaucauacaugaaugguguugucggucguguacacucccuccacuacgauuccgaggagaagauggauguugguacggcauggagauaagaccugugaaagaaaaggaagaaaauuuggucagaucaauggucucggcggggucaggggaaauggacuccuuuucacucggaaucuuaugugucaguaucaugauagaggagguuaugcgaucuagguggucaagaaagauguuaaugacagggacauuagcuguauuucuacuauuaauuaugggucaacucaccuggaaugacuuaauaagacuguguauaauggugggagcaaacgcaagugaucgcauggggaugggcacaacauaccuugcgcuaauggccacauuuaaaaugagaccuauguucgcaguaggacuauuauuuagaagacuuacaucucgggagguucuacugcucacuaucggucuaucccugguagcuaguguagaauuaccaaauucucucgaagaguugggcgacggccuggcaaugggcauaaugaugcugaaacugcucacggaauuucaaccacaucaauuauggacuacauuacugucguuaaccuuuauuaaaacuacucuaagucuagauuacgcuuggcgcaccauggccaugguauuaaguauaguaucauuauucccgcuaugcuuaucaacaacuagccagaaaacgacuuggcuaccaguacuacuugggaguuucgggugcaaaccuuuaaccauguucuuaauuacagagaauaagauauggggaagaaaaaguuggccguuaaaugaagguauuauggcaauuggaauagugaguauucuucuaucaucuuugcuuaaaaaugauguaccgcuagcuggaccuuuaauugccggagguaugcuaauagcgugcuacguuauuucuggcagcucugcugauuuaucacucgaaaaggcugcggagguuucaugggaagaagaagcugaacauagcgguacaucccacaacauccuaguggaagugcaagacgaugguacaaugaagauuaaagacgaagaaagagacgacacgcuaacuauauuacuuaaggcuacauuauuagcugugucaggcguauacccaaugaguauaccggcaacuuuauucguaugguauuuuuggcagaaaaagaaacaacguucagguguacuaugggauacacccaguccuccagagguugaacgggcgguauuagaugacggaaucuacagaauuuuacaaagaggccuccuaggacguagucaagucgggguugguguuuuccaagauggcguauuccacacgauguggcacguuacuagaggggcugugcugauguaccaagggaaacgucuagaacccucaugggcuagcguuaaaaaggaucuuauuuccuacggaggggguuggagauuccaaggaaguuggaauacgggagaggaaguucaaguaauugcgguagaaccuggcaaaaauccgaaaaaugugcaaacuaccccaggaacuuuuaaaacuccagaaggagaagucggagcuauagcucuggacuuuaagccgggcacgucgggaaguccuauaguaaauagagaaggcaaaauaguaggguuguauggcaaugggguaguuacuacguccgguacauaugugucagcaauugcacaagccaaaaccagccaagaaggaccacuaccagaaauagaagacgaaguuuucaagaaaaggaaccuaacgauaauggaucuucacccuggaaguggaaaaaccaggagauaucuacccgcuauuguacgagaagcaauuaaaaggaaacuaagaacauuaaucuuggcaccuacacgggugguagcuucugaaauggccgaggcuuugaaggggaugccaauaagguaccagacuacagccguuaagucggagcauacaggaagagagauaguagaccuaaugugccaugccacguucacaaugcgccuacuuaguccagucagaguaccuaacuauaauaugauuauuauggaugaagcacauuucacggauccagcaaguauagccgcacgcgguuauauaucaacaagaguaggcaugggggaagcugcggcaauauuuaugacagcaaccccaccgggaucugucgaggcuuuuccacagaguaaugcugugauacaagaugaagaaagggauaucccagagcguuccuggaacagcggcuaugauuggaucacugacuucccuggaaaaacaguaugguucguaccuucgauaaaaaguggaaaugauauagcaaacugccuacgaaagaaugggaaaagaguaauacagcugucgaggaaaaccuucgauaccgaauaccagaaaaccaaaaacaaugacugggacuauguagucaccacagacauaucagaaaugggggcgaacuuuagagcugaucguguaauugacccgcgacgauguuuaaaaccuguaauauuaaaagacgguccugagcgagugaucuuggcaggacccaugccaguaacaguagcgucggcagcccagcgcagagguagaauuggaagaaaccaaaauaaagagggcgaccaauacguuuauaugggucaaccguugaauaacgacgaggaucacgcucauuggacugaggcuaaaaugcugcuagauaauauuaacacgccugaaggcauuauaccugcucuauucgagcccgagagagaaaaaucggcagcaauagauggugaauaccgucuuagaggugaagcacgaaaaacauuuguugagcuaaugcgaaggggugauuugccgguauggcucaguuacaaaguagcgagugaaggcuuucaguauagcgaucgucguugguguuuugacggagaaagaaacaaccaaguccuagaggaaaauauggauguagaaauuuggaccaaagagggcgaaagaaagaaacuaagaccucgauggcucgacgcucgcacauauucagauccacuugcacuaagggaauuuaaagaauuugcggcugguagaagaucaguaucuggcgaucuuauacuagaaauaggaaaauuaccacaacaccuaacauuaagggcucaaaacgcauuagacaaucuuguuauguuacacaauagcgaacaaggcgggaaggcauacaggcacgcaauggaggagcuaccagauaccauagaaacauuaaugcuccuagcguuaauagcuguccuuacuggaggugucacucuguucuuuuuaucugguaaaggguugggcaaaacuucaauuggacuauuaugcguaauggcuucaagugccuuacucuggauggcuaauguugaaccucauuggauugcugcaaguaucaucuuagaguucuuuuuaaugguauuacucauaccggaaccugauaggcaacguacaccucaagacaaucagcuagcauacgugguuauaggauuacuauuuaucauacuaacuguagcagccaaugaaauggggcuacuagaaacaacaaagaaagaucugggcauaggccacgucgcagcagaaagucaacaccacgcaacuaugcucgauguugauuuacguccagcuagcgcguggacacuauacgccguugcgacgacugucauuacucccaugaugcgacauaccauugagaauacaacagcaaauauaucacuuacugccauugcuaaccaagcagcgauacuaaugggucuagauaaaggauggccuauaaguaaaauggacauaggggucccuuugcuagcacuuggcuguuacagucaaguaaauccacucacacuuaccgcugcuguacuaaugcuugucgcccauuaugcaaucauuggacccgggcuucaagcgaaagcuacuagagaagcgcagaaaagaacagcggcgggcauaaugaaaaauccgacaguugacggaauuguagccauagacuuagacccugucguuuaugaugcaaaauucgaaaagcaguuaggacaaauuauguugcugauacucugcaccucacaaauucuauuaaugagaacgacaugggcauuaugcgagaguauaacacucgcgacuggcccauugacuacacucugggagggcucuccgggaaaguuuuggaauaccacaauagcugugagcauggcgaacauuuucagaggaagcuaucuagccggcgcagguuuagcguucucccuaaugaaaagccuaggcgguggaagacgaggcacaggagcgcagggugagacacuuggcgaaaaguggaaacgacaauuaaaucaacugagcaaaagcgaguucaacacuuauaaaaggagugguaucauggaaguagacagaagugaggcaaaggagggauugaaaagaggagagaccacaaaacacgcaguuucuagaggaaccgccaagcugcggugguuuguagaaagaaacuuaguaaaaccagagggaaaagucauugauuugggcuguggcaggggugguuggaguuacuauugugcggguuugaaaaaggucacugaaguaaaaggauacacaaaggguggaccaggacaugaagaaccuaucccuauggcaaccuauggcuggaaccuagucaaacuauauuccgggaaagacguauucuuuacgccgccugaaaaaugugauaccuuacuaugugauauaggcgaaagcuccccaaauccuaccauugaggaagggaggacgcuuagaguacuaaagauggucgagccguggcuucggggaaaucaauucugcaucaaaauacuaaacccauacaugccgucuguaguugaaacauuggaacagaugcagaggaagcacggaggaauguugguaagaaacccguuaucccgaaauucuacccacgaaauguauuggguuucuugugguacugguaauauuguaagcgcugugaauaugaccucaagaauguuacuuaauagguucacaauggcucauaggaaaccgacguacgaacgcgaugucgaccucggagcagguacaagacacguagcugucgaaccagagguagcuaaccuggauaucauuggccaacgcauagagaacaucaaaaaugaacauaaaucuacauggcacuacgaugaggauaauccguauaaaacgugggcguaccacggaucuuacgaagugaagccuucuggcucagcaucgucaaugguaaacggaguaguacgacuacucacaaagcccugggacguuaucccuaugguaacccagauagccaugacagacacgacacccuucggccagcaacgugucuuuaaagaaaaaguagauacuaggacaccucgcgcgaaaagagguaccgcgcaaauaauggaagucacugcaaaaugguuguggggauuucuuucuagaaacaagaaaccccgaauuuguacgcgggaagaauuuacaaggaaaguucggaguaaugcagccauuggugccguauuuguugacgaaaaucaauggaauagugcaaaagaagcgguggaggaugaaagauuuugggacuuaguucauagagagagagaauuacauaaacaagggaaaugcgcaacauguguauauaauaugaugggaaaacgagagaagaagcuaggugaauuugggaaagcuaaaggaucccgagcaaucugguauauguggcugggagcaagauuucuugaguuugaagcauuggguuuuaugaaugaagaccacugguuuagucgugagaacagcuuuucuggaguagaaggugaaggacugcauaagcucgguuauauccuacgcgauaucaguaaaaucccuggaggaaauauguaugcugaugacacagcuggcugggacacgagaauuacggaagaugacuuacaaaaugaggccaagaucacagacauaauggaaccagagcacgcacuauuggcuaccucaaucuuuaaacuuaccuaccaaaacaaaguagucaggguacagagacccgccaaaaaugguaccguuauggaugucauaucaaggagggaucaaagagggagcgggcaggucggaacauacgguuugaauacguuuacaaacauggaggugcaacuuauacgacaaauggaaagugaaggaauauuccuaccauccgaguuagaaacaccuaacuuggcagaacgcgucuuagacuggcuagaaaagcaugguacugagagacuuaaaagaauggcgauaagcggggaugauuguguugugaagccaguagacgauagguucgcaacagcucucauugcucuaaacgauauggguaaaguucguaaagacauuccacagugggagccaucgaaaggauggaacgauuggcaacaagucccguuuuguagccaccauuuccaucaauuaauuaugaaggauggacgagagauuguaguuccaugucgcaaucaggacgaauuagucggccgagcuagaguaagccaaggcgcagguuggucgcuucgagagacagcaugccuagguaaaucauacgcccagauguggcaauuaauguauuuccaccgucgagaucuaaggcuugcagcaaaugcaaucugcucagcaguaccaguagauuggguccccacuucaagaacgacauggaguauccaugcgcaccaucaauggaugaccacugaggauauguuaucagucuggaacaggguuuggauagaggaaaauccuuggauggaggauaaaacccauguaucaucuugggaagaaguuccuuauuuggguaaaagggaggaccaauggugcgguaguuuaauaggacucacagcaagagccacaugggccacaaauauccagguagcuauuaaccaaguuagaagguuaauagguaaugaaaauuaucuagacuacaugacgagcaugaaaagauuuaaaaacgaaucagauccagaaggagcccuaugguga

SEQ ID NO: 21389 - RNA, 9879 nt, Artificial Sequence
  derived and/or modified CDS sequence (opt6) from DENV-1__FJ410184__SS-prME
aguguaacuauguuauugauguuauugccgaccgcuuuagcguuucaucuaacgacuagaggaggcgagccucauaugaucguuaguaaacaagaaagagguaaaucacuuuuguucaaaacuucagcaggaauaaacauguguacacuuauagcaauggaucuaggcgaacuaugugaagauacgaugacguauaaauguccuaggaucacggaggcugaaccggaugauguggacugcugguguaaugccacagauacuuggguuacuuauggaacaugcucgcaaacuggggagcacaggcgagauaaaagauccguggcccuugccccucacguuggauuaggguuagagaccagaacagaaacuuggaugucaagugagggugcuuggaaacaaauacaaaaaguagaaacaugggcauuaagacaucccgguuucacugugauagcacucuuuuuagcccacgcaaucggaaccagcauaacacaaaaagguauaauuuucauacuccugauguuaguuaccccaagcauggcaaugcgcuguguggggauugggaaucgugacuucguagaaggauuaucuggagccacauggguugaugucguauuagaacauggaaguuguguuacgacuauggcgaaagauaaacccacguuagacauagaauuacuuaaaaccgaaguuacaaauccggccguguuaagaaaacucuguauugaggcuaaaauuucgaauaccacaacggauagucggugcccaacucaaggagaagccacccuaguagaggagcaagaugcaaauuuugugugucgacggacauucguugauagaggaugggggaacggaugcggccuauuuggaaaagggucuuuauugacuugcgcuaaauuuaaaugcguaacaaaacuagaagguaaaaucguccaauaugagaaucugaaguauucugucauaguuacgguccauacaggagaccaacaccaaguuggaaacgaaacaacugaacacgggacuauugcaacaauaacuccucaagcuccaacaucugagauccaauuaacugauuacggugcguugacacuagacuguaguccacguacagggcucgacuucaaugaaauggugcucuugacaaugaaagaaaaaucaugguugguacauaaacaaugguuucuugaucuuccacuuccauggacaaguggugcuaguaccagucaagaaaccuggaacagacaagaccuauuaguaacuuuuaagaccgcucaugccaagaaacaggaaguaguaguccuaggcagucaagaaggggcgaugcauacagcauuaacuggcgcaacggaaauccaaaccucaggcacuacuacgaucuucgcuggucaucuuaaauguagacucaaaauggauaaacuaacguuaaaagguaugucauacgucaugugcacaggaucauucaaacuugaaaaagaaguugcagaaacucaacauggaacugugcuuguccaagucaaguacgaagggaccgaugcuccuugcaaaauaccauuuucugcacaggaugaaaaagggguaacacaaaacggcagauugaucacagccaauccuauaguaacagacaaggaaaaaccagucaacaucgaaacugaacccccuuucggcgaaucuuauauaguuguaggcgccggcgaaaaggcauuaaaacuaaguugguucaagaaagguucaucaauagggaaaauguuugaagcaaccgcaagaggggcaagaaggauggcaauccuaggugauacggcaugggauuuuggcuccauaggagguguauucacaucaguggguaaauuagugcaccaaguuuuuggaacagcuuacggaguucuuuuuagcggcguaagcuggacuaugaaaaucgguauuggaaucuuauuaacguggcuaggccugaauaguaggucaacuucauuaucaaugacaugcauagccguuggaaugguaacacuuuaccuagggguaaugguacaagcagacuccggcuguguaauuaauuggaaaggaagggaacuaaaaugugguaguggcaucuuuguaacuaacgaaguucacacauggacagaacaauacaaauuucaggccgauagcccuaaaagauuaagcgcggcaauagguaaggcuugggaagagggagucugcggaauaagaagugcaacacgauuagaaaauauaauguggaaacaaaucucaaaugaguuaaaucacauacuuuuagagaacgacaugaaauucacugugguugucggggaugcaaauggaauauuagcacaaggaaagaaaaugauacguccgcaaccaauggagcauagguauucguggaaaaguugggguaaagcgaagauaauaggcgcagauauccaaaacaccacuuuuauuauagacggcccagacacuccagagugcccagacgaucaacgagccuggaauauaugggaggucgaggauuacggauucggaauauucacaacaaacauaugguuaaaauugagggacucauacacccagaugugugaucauaggcucaugucugcagccauuaaggauaguaaagcaguacacgccgacaugggauacuggauagaauccgagaaaaaugaaaccuggaaacuugcuagagcauccuucauugaagucaaaaccuguauuuggccuaagucucacacacuaugguccaauggaguucuugaaucugagaugauaaucccaaaaauuuauggagggccgauaucgcaacacaauuauaggcccggauauuucacucagacggcuggaccuuggcaucuuggaaaacuagaauuagacuuugauuugugugaagguacaacagugguugucgacgaacacuguggaaaucgaggaccaucgcuaagaaccacaaccguaaccggaaaaauuauccaugaaugguguuguaggucauguacucuuccaccucuaagauuucgcggugaggacggauguugguaugguauggaaauucgaccaguaaaagaacgcgaagaaaaucugguuaaaagcaugguuagugcuggauugggcgagguagauucauuuagucugggcauuuuauguguaucaauuaugauagaggaaguuaugcgauccagguggucgaggaagauguugaugaccggaacauuagcuguauuuuuacucuuaauaaugggacaacuaacauggaaugaucuuauuagauuaugcauaauggucggcgcuaacgcgucagacagaaugggaaugggcacaacuuacuuagcauugauggcaaccuucaaaaugcgaccaauguuugcgguggggcuccuauucaggagacucaccucaagagagguccuguuacuaacgaucggccuaucuuuaguugcaagcgucgaauuacccaauagccuugaagaacuuggugacggccuagcgaugggaaucaugaugcuuaaacuauugacagaguuccaaccacaucaacuauggacgacauuauuaaguuuaacauuuauuaaaacgacccuaucgcucgauuaugcuuggaaaacuauggcaaugguucucagcauaguaucauuguuuccacuuugucuuucaacgacaagucagaaaaccacaugguuaccggucuugcuagguucauuagggugcaaaccauuaacuauguuuuuaauaacugaaaacaaaauuuggggaagaaaaucuuggcccuuaaaugaggggauuauggcaauagguauaguuucaauucuauuaaguaguuuguugaaaaacgacguuccauuagcaggaccuuuaauagcuggaggcaugcucaucgcauguuacgucaucucggguucaucagcagauuuaucccuugagaaagccgccgaaguguccugggaagaggaagcugaacauagugguacaagucauaauauauuaguugaaguacaggacgauggaacgaugaaaauaaaagaugaagaacgagaugacacguuaacgauucucuuaaaagcgacucuacuugcagucucgggcguuuauccaaugucuaucccagcgacuuuauuuguaugguacuuuuggcaaaagaagaaacaacggucaggagucuugugggauacuccgucgccgccggaaguggaaagagcggucuuggaugacggaaucuauagaauccuucaaagagggcuacugggucgaucacaagugggagucggaguauuucaagauggcguauuccacacaauguggcaugugacuagaggagccguccuaauguaucaaggcaaaagauuagaacccaguugggcgaguguuaagaaagacuuaauuagcuaugggggcggcuggcgauuccaaggugcguggaauacaggagaagaaguccaaguuaucgcuguagaaccaggcaaaaauccuaaaaauguccaaacgacuccuggcacuuuuaaaacgccagagggugaaguuggugcuauagcauuagauuuuaaaccagguacguccggaaguccaauaguuaacagagagggaaaaaucguuggucuguauggaaauggggugguaacgacaagugguacauaugucucugcuauagcucaagcaaagacaucacaagaggggucguuaccggagauagaggaugaaguuuuuaagaaaagaaaccuuacuauuauggauuugcacccaggaucaggcaaaacgagaagauaccuucccgccauuguacgugaggcaauaaaaagaaaacuuagaacacuaauccuugcgccuacuagaguaguagcuucggagauggcagaggcccuaaaggguaugccaauacgcuaccagacaacugcagugaaaagugagcacacagggcgcgaaauuguugauuuaaugugccacgcaacauucaccaugcgguuauugucuccaguaaggguuccaaacuauaauaugauaauaauggacgaagcucacuucacagauccagcauccauugcggcucgaggguacauauccacaagagucgggaugggggaagcagcagcgauauuuaugacagcaacaccuccagguucagucgaagcauuuccacaaucuaaugcaguuauccaagaugaggaaagagauaucccggaacggaguuggaacaguggauaugauuggauaacagauuuuccgggaaaaaccgucugguucguaccaucgauaaagagcgggaacgauaucgcaaacugccuucgaaagaaugggaaaagaguaauacaauuaagucggaaaacauuugauaccgaauaucagaaaacgaagaauaaugacugggauuacguugucacaacugauaucucggaaaugggagcuaacuuucgggccgacagaguuauagauccucggagaugucuaaagccaguaaucuuaaaggauggcccugaacgcguuauauuagcagguccuaugccuguaaccgucgcaagugcugcacaacgaaggggccgaauugguagaaaucaaaauaaagaaggagaucaauacgucuauaugggacagcccuuaaacaacgacgaagaucaugcccauuggacagaggcgaaaauguuauuggauaauauaaacacacccgaagguauaauacccgcacucuucgagccggaacgcgaaaaauccgcugcuaucgauggcgaauauagguuaagaggggaggccagaaagaccuucguagaacuaaugcgaagaggcgaccuuccagugugguuaucuuauaagguugcgucagagggauuucaauauucugauaggagauggugcuuugauggagaaaggaacaaccaaguauuggaagaaaacauggacguagagauuuggacaaaagaaggcgaaaggaagaaacugcgaccccgcugguuagaugcaaggacguacagcgauccgcuugcauuacgagaguuuaaagaauuugcagccggccgucgaucaguaaguggugaccuuauccuagaaauaggaaaauuaccgcaacauuuaacauuacgagcacaaaaugcauuagauaaccuugugaugcugcauaauagugaacaaggaggaaaggcuuacaggcaugcgauggaagaguuaccugauacaaucgaaacccugaugcuucucgcgcucauagcaguauugaccggugguguaacccucuuuuuccucagcggaaaagggcuuggaaagacaaguauuggacuucuuugcguuauggcuagcucugcauuacuuuggauggcaucaguugaaccucauuggauagcagccucuauaauauuagaauuuuuccuaaugguacuuuuaauccccgagccagacaggcaacgcacaccucaggacaaucaauuagcauacguggugaucggauuguuguucaugauccucacaguggcagcaaacgagaugggacuuuuagaaacuacuaagaaagauuugggcauuggauauguagcugcagaaaaucaucaucaugcaacaaugcuugauguagaccuucggccagcuucagcuuggacccuauaugcaguagcaacuacaguaauuacacccaugaugagacacacuaucgaaaauaccacugcaaacauaucauugaccgcaauagcgaaucaagcugcaauucuaaugggucucgacaagggcuggccaauaucuaaaauggauauuggggucccucuacuagcguugggguguuauucccaaguaaacccacuaacccuaaccgcagcaguacuaauguuggucgcucauuaugcgauuaucgguccggguuuacaagcaaaggcaacucgagaagcccagaaaagaaccgccgcuggaauuaugaaaaacccuacggucgauggaauagucgcaauagaucucgauccuguaguuuaugaugccaaguuugagaaacaacuaggccaaauaauguuguugauuuugugcacaucucaaauacuguuaaugagaacgacaugggcuuuaugcgagucgauuacucuagcuacagggccgcuaacaacauugugggaaggaagccccgggaaauuuuggaacacaacaauugcagugucaauggcaaauauuuuuagggggucauauuuagcgggagcaggguuagcuuuuucauuaaugaaauccuugggagguggcagaagagggaccggugcacaaggcgagacacuaggugagaaauggaaacgucaacuaaaucaauugagcaaaucugaauuuaacaccuauaaaagaagcgguauaauggaagucgaccgaagugaagcaaaggaagguuuaaaacguggagaaacuaccaaacaugccguaucuagaggaaccgcaaaguugaggugguuuguagaacgaaauuuagucaaacccgaaggaaagguaaucgacuuaggaugugggcggggaggcugguccuacuacugugcgggauuaaagaaaguaacggaagugaaaggauauacuaaggguggaccgggucaugaagaaccaaucccaauggcaacauacgguuggaaccuagugaaauuacauucgggaaaagaugucuucuucacaccucccgagaagugugacacacuccuuugcgacauaggggaauccucacccaaucccacgauugaggaggguagaacgcucagagucuuaaaaauggucgaaccuugguugaggggaaaccaauucugcauaaaaauucuaaaccccuauaugcccucaguaguagaaacuuuggaacaaaugcagcguaagcauggagggaugcuugugcguaaccccuuaagucgaaauaguacacacgaaauguauuggguuucaugcgguacaggaaacaucgugucugcggugaacaugacaucgagaauguuauuaaauagauuuacgauggcgcaucgcaaaccuacuuacgaaagagauguggauuuaggugcggguacacgacauguugccguagaaccggaaguagcuaauuuagacauaauuggacaacgaauagagaauaucaagaaugaacacaaaucuacguggcauuaugaugaggauaauccguauaaaacaugggccuaccacggaucauaugaagucaaaccuucuggaagcgcaucuagcaugguaaacggggucguuagacuccuuacaaaaccuugggacgucauuccuaugguuacucaaaucgcaaugacagauacaacaccauuuggacagcaacguguuuuuaaagagaaagucgacaccagaacaccaagagcuaaacguggcaccgcacaaauaauggagguaacagcaaaaugguuauggggauuuuugucucgaaacaagaagccacgcauuuguacuagagaggaauuuacacguaagguucgauccaaugcagcaauaggagcaguuuucgucgacgagaaccaauggaacucugccaaagaggccguggaagaugagcgauucugggaucuaguacaucgugaaagggagcuucauaagcaaggaaagugugcaacuuguguauauaauaugauggguaaacgagaaaagaaacuaggugaguucggaaaagcuaaaggaagucgcgcuauuugguauaugugguuaggugccagauuucucgaguucgaggcucuuggauuuaugaacgaagaucacugguucucaagagaaaacuccuuuagcgggguagaaggggaaggguuacacaaacucggguacauccuuagagauauuucuaaaaucccuggugguaauauguacgcagacgauaccgccgggugggacacgcguauaacggaagaugaucuucaaaacgaagcgaaaauaacagauauaauggagccagagcacgcccuccuggcaacaucaaucuuuaaacugacuuaccaaaauaagguagucagaguacaaaggccagcgaaaaauggaacggucauggauguaauuucuagaagagaucaacguggaaguggacagguuggaacauauggcuuaaauaccuuuaccaauauggaaguucaauuaauacgucagauggaaucugaagggauauuuuuaccaucggaauuagagaccccaaaccuggcugagcgaguccuugacuggcuagaaaaacacgggaccgaaaggcuaaagagaauggcaauuuccggcgaugacugcgucguuaaaccuguagaugacagauuugccacagcacucauagcgcuaaaugacauggguaaaguacgcaaagacauaccacaaugggaacccucuaaaggauggaacgauuggcaacagguaccuuucuguucacaucauuuccaucaauuaauuaugaaggacggcagagaaauaguugugccauguagaaaucaagaugaauuagucggacgggccagaguaucucaaggggccggguggucauuaagagagaccgcaugucuaggcaaaucguaugcacaaauguggcaacuaauguacuuucaccguagagaccuaaggcuugcugcgaacgcaauauguucagcugucccuguagacuggguuccgacuucacggacaacguggucaauucaugcacaccaucaauggaugacuacagaagauaugcuuaguguguggaauaggguguggauagaagaaaaccccuggauggaagauaaaacacacgucagcaguugggaggaaguaccauaucucggaaaacgggaggaccaaugguguggcucuuuaauaggacuuacagcacgugcuacuugggcaacuaauauucaaguagcuauaaaccaaguuagaagacugauaggcaacgaaaacuaucuagacuauaugacaucgaugaaacgauucaaaaaugaaagugauccagagggggcacucugguag

SEQ ID NO: 21390 - RNA, 9879 nt, Artificial Sequence
  derived and/or modified CDS sequence (opt6) from DENV-1__FJ410185__SS-prME
ucuguuacaaugcugcucauguuacuaccgacggcccuagccuuccauuuaacaacucgaggaggugaaccucacaugauuguaucgaaacaagaaaggggaaaaucacuauuauuuaaaacauccguagggauaaacaugugcacccuuaucgcgauggaucucggagaacucugugaagauacaaugacguauaaaugcccgagaauuacagaagcugaaccggacgacguagauugcugguguaacgcuaccgauacauggguaacuuauggaaccuguucacaaacaggagaacaccgucgcgacaaacgaucaguggcauuagcgccacacgugggauuaggacuagaaaccagaacagaaacauggaugaguagcgaaggugcauggaaacaaauacaaaaaguugaaacaugggcacucagacauccgggcuucaccguuauagcacuauuccucgcgcacgcuauaggaaccucuauuacacaaaaaggcauuauuuucauacuucuuaugcucgugacgccauccauggcaaugagaugcguuggaauaggcaacagagauuucguagaaggauuaucaggcgcaacguggguugauguaguacuagaacacgguucaugcguaacgacuauggcgaaagacaaaccuacucuggauauugaauugcuaaaaacugaagucacuaauccagccguacuacggaaacugugcauugaagccaaaauaucaaauacgacaacggauagucgcugcccuacacaaggcgaagcaacauugguugaggaacaagacagcaauuuuguuuguaggcgaacuuuugucgaucgagguuggggcaacggcuguggccuuuuugguaaagguucguuauuaacaugugccaaauucaaauguguaaccaaauuggaaggcaaaauaguacaauacgaaaaucucaaauauagcguaauagugacgguccauacaggggaucaacaucagguaggcaaugaaaccacagaacauggaacuauagcuaccauaacaccacaagccccuacgucagagauacagcucacggauuacggggcccugacucucgauuguucuccaagaaccggucucgauuuuaaugaaaugguccuacuaacaaugaaagagaaaaguuggcuaguccacaaacaaugguuuuuagaucuaccacugccauggacguccggugcaucaacaucucaagaaaccuggaaucggcaagaccuguuaguuacauucaaaacagcucacgccaagaaacaagaagugguugucuuggguucucaggaaggggcaaugcacacugcgcugacuggagcaacagaaauacaaacaucuggaacaacaaccauauuugcaggacacuuaaaauguagacuaaaaauggauaaauugacacuaaaaggaaugucauaugugaugugcacggguagcuucaaacuagaaaaagaagucgcagaaacucagcacgguacagucuuaguacaaguuaaauacgaaggcacagacgccccaugcaagauaccauucucagcacaagacgaaaaagguguuacucaaaauggucguuuaauaacagcgaacccuauaguaacugacaaggagaaaccaguaaauauugaaacagaaccgccuuucggcgaaucauacauaguuauaggagcuggagaaaaggcuuuaaaauuaagcugguuuaagaaaggaagcucaauaggaaaaauguucgaggcaacugcgcgcggagcgagacguauggcaauucucggugauaccgccugggauuuuggcaguauuggcggcguguuuacaagugugggaaaacucgugcaccaaguguuuggagcagcuuaugggguauuauuuaguggcguuaguuggaccaugaagaucggaauugguauauugcuaacauggcuaggucuuaacucgagaaguacgagcuuaucaaugacauguaucgcaguuggaaugguaacccucuauuugggugugaugguacaggccgacucagguugcguaaucaauuggaaaggucgagaacuaaaauguggaucaggaauauuugugacaaaugagguccauacuuggacggaacaauauaaguuccaagcagauucucccaaaagauuaucagcagccauaggaaaagccugggaggaaggugucugugguauaagaagugcuacccgccuugagaauauuauguggaagcaaauuucuaaugaacugaaucacauacucuuagaaaaugauaugaaguuuaccgugguuguaggagaugcaaaugguauacuagcacaagggaagaaaaugauacgaccacagccuauggaacacagguacaguuggaaaucaugggguaaagcuaagaucauuggggccgauauacaaaauacaacguuuauaaucgacgguccagauacuccagaauguccugaugaccaaagggcauggaacauuugggaggucgaggauuacggcuucgggauauucacgacuaauaucugguuaaagcuccgcgauucuuacacccaaaugugcgaucacagacuaaugucugcagcuauaaaagauaguaaagcuguucaugcugauaugggcuauuggauagaauccgagaaaaaugagacuuggaaacuggcgagggcaucauuuauugagguaaaaacuuguaucuggccuaagucccacacauuguggucuaaugggguauuggaaagugagaugaucauaccaaaaaucuaugguggaccuaucagucaacacaauuauagaccaggguacuuuacucagacagcaggaccauggcaccucggaaaacuagaacuugacuuugauuugugugaaggcacgacagucguuguugaugaacauuguggcaaccguggaccgucacugagaacgacuacagugacagguaaaauaauacaugaauggugcugcagaucaugcacauugccuccucugcgauuuagaggagaagaugguugcugguauggaauggagauaagaccagugaaagagaaagaagaaaauuuaguacgaucaaugguuagcgcaggaaguggagaaguagauucauucucauuaggaauuuugugugugucaauuaugauagaagaagugaugagaucgagauggucacgaaaaaugcugaugacaggaacguuagcagucuuuuuauuacuuauaaugggacaacuuacauggaaugacuuaauacgauuauguauaaugguaggggcuaacgcuuccgacaggaugggaaugggaacuacuuaucuagcauuaauggcuacauuuaaaaugcguccaauguucgcagugggccuauuauuucgucggcucacaagccgagaaguacuauuauuaacaauaggucugagccuaguagcuucaguagaauugccgaacucuuuagaggaacuaggugaugggcuggcuaugggcauaaugauguugaaguugcuuaccgaguuucaaccacaucaauuauggacaacauuauugagcuuaacauucauuaaaacaacuuuaagccuagacuacgcuuggcgcacgauggcuaugguucuguccauuguauccuuauucccucuguguuuaucaacaacaagucaaaagacaaccugguuaccaguucuacugggcagcuucggauguaagccacuaacaauguuccuaaucaccgaaaacaaaauuuggggucgcaagagcuggccgcucaaugagggaauaauggcgauuggaauuguaaguauauugcuaucuucauuauugaagaaugacgucccucuugcaggaccccuuauugcgggugguauguuaauagcaugcuauguuaucaguggguccucugcggaucugagucuggaaaaagcugcggaaguuagcugggaagaagaggcagagcacucugggacaagccauaauauauugguagaaguccaagaugauggaacaaugaaaauuaaagacgaggaaagagacgauacccugacuaucuuacucaaggccacucuacuugccguuaguggcguauauccaaugucgauccccgcuacauuauucgugugguauuuuuggcagaagaagaaacaacgaagcgggguauugugggauacaccaucuccgccugaaguugagagagcaguucuggaugacgguauauauaggauauuacaaagaggauuacuggguaggucccaaguuggaguagguguauuccaggacggaguguuucauacgauguggcauguaacucguggagccguacugauguaccaagggaaacguuuagaaccaucgugggccagugugaagaaagaccuaaucucuuauggcggaggauggagauuccaaggaucuuggaauaccggagaagaaguacaaguuauagcuguagaaccuggcaaaaauccuaagaacguccaaacaacgccuggcacauuuaaaacaccugaaggagaaguuggcgcuauagcacuggacuuuaagccuggcacaucuggaucaccaaucguaaauagggaagagaaaauagucgguuuauacggaaacggagucgucacgacaucagguacguacguaagugcaauagcccaagcaaaaaccagccaagaaggaccauuaccagaaauugaggaugagguauuuaagaaacguaauuugacuauuauggaucuucauccaggaagcggaaaaacuagacgauaccuuccagcuaucgugagggaggcaauaaaacguaaauuacgaacgcugauauuggcuccuacaagaguaguugcaucagaaauggccgaagcccucaaaggaaugccaauaagauaccagaccaccgcaguaaaaagcgagcauacugggcgagaaauaguagaccuaaugugucacgcaacuuucacgaugcggcuauuaucuccgguacgagugccaaauuauaauaugauuauuauggacgaggcgcacuucacagacccagcgucaauugcugccagaggauacauaucgacuagaguaggcaugggcgaagcagcugccauuuucaugacugcaaccccuccugggucaguagaagcauuuccgcaaucaaacgcgguuauacaagacgaggaaagggacauaccagaaagaaguuggaauagugguuacgacuggauuacugacuuuccaggaaaaacuguaugguucguaccgaguauaaagucgggaaaugauauagcgaauuguuuacguaaaaacggcaagcgagugauacaacuuucacgaaagacauuugacacugaauaccagaaaacgaaaaacaaugacugggacuauguggucacaacugacaucagcgaaaugggggcaaauuuuagagccgaucgaguuauugauccuagaaggugcuuaaaaccaguaauacuaaaagaugguccggaaagggucauucuugcgggaccaaugccgguaacuguagcauccgcagcacaaagaagagggagaauaggacguaaucaaaacaaagaaggagaucaauacguauacaugggacaaccauuaaacaacgaugaggaccacgcacauuggacagaagcgaaaaugcuuuuagauaacauaaauacaccggaaggaauaaucccagcacuauuugaaccagaaagggagaaaagugcugcgauagauggugaauacagauuaaggggugaagcgcggaaaacauuuguugagcucaugaggaggggagacuuaccgguaugguuaucuuauaaagucgcaucagaagguuuccaguauagcgauagacgcuggugcuuugauggagaacgcaauaaucaaguucuugaggaaaacauggauguugagaucuggacaaaagagggagaaagaaagaaauugcgaccaaggugguuagaugcgagaaccuauucugauccgcuagcucugcgagaguucaaagaguucgcagcaggacgaaggagugucucgggugaccuuauacuugaaauagguaagcucccccagcaucuuacccucagggcucaaaaugcauuggauaauuugguuauguuacacaacucagagcaagguggaaaagccuauagacacgcaauggaagaacuacccgacacuauagaaacccuuauguuauuagcccuuaucgcaguacuuacgggaggagugacacucuucuucuugucagggaagggauugggaaaaacauccauuggccuuuuaugcgugauggcuucaucugcauuacuuuggauggcaaauguggagccacacuggauagcagcaucuauaauccuggaguuuuuccuaaugguauuguuaauuccagaacccgauagacaacguacaccccaagauaaucaacuagcauauguaguaauugguuuauuauucaugauacuuacaguugcagcaaaugagaugggauugcuggaaacgacaaagaaagaucuagggauuggacauguagcugcagaaaaccaacaucaugcgacuauguuagaugucgaucuaagaccugcauccgccuggacuuuguacgcuguagcgacaaccgucauuacgccaaugaugagacacaccauugaaaacaccacugcaaauauaucgcucaccgcaauagcaaaccaagcagcaaucuuaauggguuuagacaaaggguggccuauaucuaagauggacauaggggugccuuugcuagcucuaggguguuauucgcaaguaaacccacuuacacuaacggcagccgugcucauguuaguagcccacuaugccauaaucgggcccgggcuucaagcuaaagcuacuagggaagcacagaaacgaacagcugcugguauaaugaaaaauccaacgguugauggaaucguggcuauagaucuugauccuguaguuuacgaugcuaaauuugaaaaacaacuugggcagauaaugcuauuaauccuuuguacuucacaaauacucuuaaugaggacaaccugggcucuuugugaaaguauuaccuuagcgacaggaccucucacaacccuuugggaggggucgccagguaaguucuggaauacuacaauagcgguaagcauggcaaacaucuuuagggggaguuaucuggcuggagcagggcuagcauuuuccuugaugaaaucacuagguggaggcagaagggguacgggagcucaaggugaaacauugggggaaaaauggaaacgucaacuaaaucaauuaucaaaaucugaguucaacacauacaaacguaguggaauaauggaagucgauaggucugaggcaaaagaaggacuuaaacgcggggagacaacgaaacaugcaguuucuagagguaccgcuaaacugaggugguucgucgaacguaauuuagugaagccagaaggcaaaguaauugaucucggaugugguagagguggauggaguuacuacugugccggucuaaagaaaguaacggaaguaaaaggauacacaaaggguggaccggggcacgaagaaccgauaccaauggcgacuuacggcuggaauuuaguuaaauuauacucugguaaagacguauuuuucacaccaccagaaaaaugcgacacacuauugugcgauauaggugaaagcagcccuaacccaaccauugaggaaggccgaacucuaaggguacuaaaaaugguagagccuuggcucagaggcaaccaguuuugcauaaagaucuugaacccguauaugccgucggugguggaaacuuuagaacaaaugcaacgaaaacaugggggcauguuagugcgaaaccccuuaagcagaaauucaacacacgagauguauugggucaguugugguacugguaauauuguaucagcggugaauaugacaucaaggaugcuucuaaauagguuuacuauggcacaccgcaaaccaacuuaugaaagggauguagacuugggggcuggaacccgucacguagcggucgaaccagaaguggcaaauuuggacauaauuggacagcguauugaaaacaucaaaaaugaacacaagucaaccuggcauuacgacgaagauaacccuuauaaaacuugggcauaccaugguucauacgaaguaaaaccgucgggauccgcaagcaguaugguaaaugguguuguacgauuacucaccaaaccaugggauguaauaccaaugguuacacaaaucgccaugacagauacaacgccauuuggacaacaaagaguauuuaaagaaaaagucgacacaagaaccccaagggcuaaacggggcacagcccagauaauggaggucacagcaaaguggcuaugggguuuccuuagcagaaauaagaaaccgagaauauguacuagggaagaguucaccaggaaaguacgcuccaaugcugcgauuggcgcuguauuuguggacgaaaaucaguggaacucagcaaaagaagcggucgaagaugagcgauuuugggaccuaguacauagagaaagagaauugcauaaacaggguaagugcgcaacaugcgucuacaauaugauggguaagcgugagaagaaacuaggcgaauuugguaaagccaaaggcucaagagcaauaugguacauguggcuuggggcaagguuccuggaguucgaggcauuaggauuuaugaaugaagaucacugguuuuccagagaaaauagcuucucuggaguagagggugagggccuacauaaauuagguuacauacuaagagauaucaguaaaauacccggaggcaauauguaugcagacgacacugcuggaugggauacaagaauaacagaagaugaccuacaaaaugaagcuaagaucacagacauaauggaacccgaacaugcucuguuagcuacuagcauauucaaacuaacauaccagaacaaaguaguuaggguacagagacccgcgaaaaacgguacagugauggacguaaucucucguagagaucaacgaggcucgggccaagucgguacuuacggacuaaauacauucacaaacauggaaguucaacuuauacgacaaauggaaucagaaggaauuuuucuaccaagugaauuagaaacaccuaaccuagcugaaagaguucucgauugguuagaaaaacacgguaccgagagacugaaaagaauggcaaucucaggggacgauugcguuguuaaaccugucgaugacagguuugccacagcucugaucgcacugaaugauauggguaaagugcguaaggauaucccucagugggaaccuagcaaaggauggaacgacuggcagcaaguuccuuucugcucucaucauuuucaccaauuaauuaugaaagauggaagagagauaguggucccauguagaaaucaagacgaauuagucggacgagcgcgugugagccaaggugccgguuggucacuuagagaaaccgcuugucuaggaaaaucauaugcccaaauguggcaacugauguacuuucacagaagagaccuacgccuagcagcaaaugccauauguucugccguucccguugauuggguuccuacaaguagaaccaccuggucuauacaugcacaccaccaauggaugacuacggaggacaugcugagcguguggaaccgcguuuggauagaagaaaauccauggauggaagauaaaacucaugugaguuccugggaagaagugccguaccuaggaaaacgggaagaccaauggugcggcagucuaauaggccuuacugcaagggcaacaugggcaacaaauauacaaguugcuauaaaucaggugagaagauuaauaggcaaugaaaacuauuuggacuacaugacaucgaugaagcgcuuuaaaaacgaaagcgacccugaaggagcauuaugguag

SEQ ID NO: 21391 - RNA, 9879 nt, Artificial Sequence
  derived and/or modified CDS sequence (opt6) from DENV-1__FJ547087__SS-prME
ucagugacuauguuacuuauguugcuucccacugcuuuggcauuccaucuuaccacucgaggaggggaaccucauaugaucgucucuaaacaagaaagagggaaaaguuuacuguuuaaaacaagcgcgggugugaacauguguacuuuaauugcaauggaucuaggugaacuuugcgaggauacaaugacguacaaaugcccucgaaucacggaggcggagccggaugauguagauuguugguguaacgcaacugauacaugggucacauacggaacguguagucaaacaggugagcauagaagagauaaaaggaguguugcacuagcuccccaugucggucuaggacuugagacuagaacggagacauggaugucaucugaaggagcauggaaacaaauucaaaaaguggaaacgugggcacugagacauccuggauuuacgguuaucgcacuuuuucuugcucaugcaaucgguaccuccauuacgcaaaaaggaauuauauuuauacuccucaugcuagugacaccuucaauggcuaugcgguguguagggauuggaaacagagacuuuguagagggauuaucuggagccacguggguagauguuguacuagagcauggaucauguguaacgaccauggccaaaaauaaaccaacacucgauauugaacuacuuaaaacagaaguaacgaauccagccguguuacguaaacuaugcauagaagcuaaaauaagcaacacuacaacagauaguagguguccgacgcaaggagaggcuacauuggucgaagaacaagaugcaaacuuuguuugucguaggacauuuguugaucgaggauggggaaauggaugcggauuauucggaaaagguagccuuuuaacuugugcgaaauucaaauguguuacaaaauuagaaggaaaaauuguacaauacgaaaaccugaaauacagugugaucgucacaguccacacgggugaucaacaucaagucggaaaugaaaccacagaacauggaaccauagcuaccauaacgccccaggcuccuacuagcgaaauucaacugacagacuauggggccuugacuuuagacugcuccccaagaacuggucuugauuucaacgaaauggucuuguuaaccaugaaggagaaaaguugguugguccauaaacagugguuuuuggacuugccguuaccuuggacuucuggugcaucaacgagucaagaaacuuggaaucgccaagauuugcuuguaacauuuaagacagcacaugccaagaaacaagagguaguaguauugggaucacaggagggcgcaaugcacacagccuuaacaggugcaacggaaauacaaacaaguggaacaacaacuauuuucgcagggcauuuaaaaugucgacuaaaaauggauaaacugacacucaaaggcauguccuacgucaugugcaccgggucuuuuaaguuagaaaaggaagucgcagagacucagcauggaaccguuuuagugcaagugaaguaugagggcacugaugccccuuguaaaauaccuuuuuccacucaggacgaaaaaggagugacccaaaauggaaggcuaauaaccgcuaacccaauaguuacugacaaggaaaaaccuguaaauauugaaacagaaccaccuuuuggcgaaaguuauauuaugguuggcgcaggggagaaagccuuaaagcuaucaugguucaaaaaggggucaucaauugggaaaauguucgaagcuaccgcaagaggugcaagacggauggcuauauugggagauacagcuugggacuuugggucuaucggcggaguguuuacaagugucgggaaauugguacaucagguauuuggcaccgcauaugggguauuauuuucgggagugucauggaccaugaaaauaggaauaggaaucuuauugacuuggcuaggauugaacagccgaagugcuucauuaucaaugacauguauugcggucgggaugguaacauuauacuuaggugucaugguacaagcagauuccggauguguaauaaauuggaagggccgcgaauuaaagugcggaaguggaauauucgugaccaacgaaguacacacuuggaccgaacaauauaaauuucaggcagacucuccuaaacguuuaucggccgcgauuggaaaggcaugggaggaggguguuuguggaauacggucagcaacacgcuuagagaauauaauguggaaacagauaucaaacgaacuuaaucauauauuauuagaaaacgauaugaaauucaccguaguggugggcgaugcaaauggaauauuagcacaaggcaagaaaaugauuagaccacagccuauggaacauaaauauagcuggaaaucaugggguaaagcaaaaauuaucggugcggauauccaaaacacuacguuuaucauugaugguccugacacgccagagugcccagaugaccaacgugcguggaauauaugggagguagaggacuauggauucgguaucuuuacuacaaauauuugguuaaaguuaagggauaguuacacacaaaugugugaccauaggcuaaugagugccgccauaaaagacucuaaagcaguucacgcagauauggguuacuggauagaauccgagaaaaaugaaacuuggaaacuggcaagagcuaguuuuauugaaguaaaaacgugcauuuggccaaaaagccauacucuauggagcaauggcguauuagagucagaaaugaucauacccaaaauauacggaggaccuaucagccaacauaauuaucgucccggauauuucacacaaacagccgguccauggcaccuaggcaaauuagaauuagauuucgacuuaugugaaggaacaacgguagugguagaugaacacuguggaaaucgugggccaucacuuagaacgacuacagugacaggaaaaauuauacaugaauggugcuguagaucguguacauuaccuccauuacguuucagaggggaagauggaugcugguacgguauggaaauaagaccaguaaaagaaaaggaagaaaaccugguaaggagcaugguaucugcgggaucgggggaagucgauucuuucucacuagguauucuuugcgucaguauaaugauugaagaaguaaugcgcucaagguggucgagaaaaaugcucaugaccgguacccuagcaguauuuuuauugcuaauaauggggcaacucacuuggaaugaucuuauuagauuguguauaauggucggugcaaaugcaucagacaggauggguaugggcaccacauauuuagcguugauggcaaccuucaaaaugagaccaauguucgcugugggauuacucuuccgacgauuaacaucaagagaaguucuuuuauuaacaauuggauuaagccuagucgccucuguugagcugcccaacagcuuagaagaauugggagacggccuugccaugggcauaaugaugcuaaaacuucuuacggaauuucagccucaucaacucuggacuacauuauuaucauugacauucauaaaaacuacacuaucguuagauuacgcauggaagacaauggcaaugguauugucaauugucagcuuauuccccuugugccuuagcacuacaucacagaaaacuacauggcuuccuguucuccuaggaaguuuuggcugcaaaccauuaacgauguuccugauaaccgagaauaaaaucugggggagaaaaaguuggccccugaaugagggaauaauggcaaucggaauuguaagcauacugcuuagcucccuauuaaagaacgauguaccgcuagcagggcccuugauagcaggaggaauguuaauagccugcuauguuauaaguggaucaagugcagaucuaucauuagaaaaagcagcugaaguaucaugggaagaagaagcggaacacucaggaacgucccauaauauccucguagagguucaagaugauggaaccaugaaaaucaaggacgaagaacgagaugauacucuaaccauacuacuuaaagcuacccucuuagcugucagcggaguauauccaaugucuauaccggccacucucuuugugugguauuucuggcagaagaagaaacagagaucaggagucuugugggauacaccuagcccgccggaaguagaacgugcaguucuugaugacggaaucuaucggaucuuacaaagggggcucuuaggucgaagccagguaggcgugggaguauuucaggacgguguauuucacacgauguggcauguaacccggggugcuguguugauguaccaagggaaaagauuagaaccaucaugggcaagugugaagaaagauuugauaaguuauggaggaggguggagauuucaaggaucauggaauaccggugaggaaguccaaguuauagcggucgagccaggcaaaaaccccaaaaacgugcaaacgaccccgggaacauucaaaacccccgaaggggaaguaggagcaaucgcauuggauuuuaaaccugguacuuccggaucuccuauagugaauagagagggaaaaauaguuggcuuauacgguaacgguguaguaacaacgucagguacuuauguuagugcaauugcacaagccaaagcaagucaagauggaccacuaccugaaauugaagacgagguuuucaagaaaaggaaccuaacgauaauggaucugcaccccggaucagguaaaacacgccguuaccuaccugccauaguccgcgaggccaucaagaggaaauuaagaacccuaauuuuggcuccaacaaggguagucgcuagcgaaauggccgaagcacuaaagggaaugccgauccguuaucaaacaaccgcagugaaaucagaacacacggggcgugaaauagucgaccuuaugugccacgcuacuuucaccaugagauuguuaucaccaguaagaguuccgaacuauaacaugauuauuauggaugaagcucauuucacugaucccgccagcauugccgcucguggauauauuaguacuaggguagguaugggagaagcugcagcuauauucaugacagcaacaccuccugguucaguagaggccuuuccacagucaaacgcagugauucaagaugaagagagagacauucccgaacgcucauggaacucagguuacgauuggaucaccgacuuuccagguaaaacaguaugguuuguaccguccauaaaaucuggaaaugacauagcuaacugccuaaggaagaacggcaagagaguaauacaauugucacgaaaaacuuuugacaccgaguaccagaaaacuaaaaacaaugacugggauuaugucgugacgacugacaucucggagaugggagcaaacuuuagagcagauagagucauagauccacgaagguguuuaaaaccuguaauucuaaaagauggacccgagagaguaauucuugcgggaccuaugccgguuacaguugcgagcgcggcacaaagacgcgguagaaucggaaggaaucagaacaaggaaggcgaucaguauguauacaugggucaaccucuuaacaaugaugaagaucacgcucauuggacugaggcgaagaugcucuuagacaacauuaauaccccagaaggcauuauccccgcgcuguucgaaccugagcgggagaaaucagcagccauagauggugaauacagacuacggggugaagcgagaaaaacuuuuguggaacuaaugagaagaggcgauuuaccagugugguugucauauaaaguggcauccgaaggauuucaauauucagauaggcgaugguguuuugacggagaaagaaauaaccaaguacuugaagaaaacauggauguugaaauuuggacaaaagaaggcgaaaggaagaaacuaagaccacguugguuagaugcccggacauacagugauccgcuugcccucagggaguuuaaagaauuugcagcaggacguagaucugucagcggugauuuaauacuagaaauaggaaaauuaccacagcaucuaaccauucgagcacaaaacgcguuggauaaccucguuaugcuccacaacuccgaacaaggugguaaagcauaucggcaugcuauggaagaguuaccggauacaaucgaaacucuaauguuguuagcucuuauugcaguuuugacuggaggcgucacauuauucuuuuuaagcggaaaaggcuuagggaaaacuucaauugggcuacugugcgucauggccucgucagcucuauuauggauggccucgguugaaccccacuggauagccgccagcauuauuuuagaauuuuucuuaaugguacuguuaauuccagaaccagacagacaaagaacgccacaagauaaucagcuagcauacguuguaauuggacuacuauuuaugauuuuaaccguagcagcuaacgagaugggucuucuagaaacgacgaaaaaggaucuuggaaucggccauguggcagcagaaaaccaucaccacgcuacaauguuagaugucgaucuaagaccagcuagugccuggacuuuguaugcgguagcuacgacugucauuacaccuaugaugcgccauacuauagagaauacaacagccaauaucucauuaacagcaauagccaaccaggcagcuaucuugaugggguuagacaaaggauggccgauuaguaaaauggacauugguguucccuuauuagcacuaggcuguuacagccaagucaacccacuuacguuaaccgcagcgguauuaauguuagucgcccauuaugcuauuauaggaccagguuuacaagcgaaagcaacucgugaggcgcagaaacggacggccgcugggauuaugaagaacccuacaguugauggcauaguagcaauugaucucgacccagucguauacgaugcgaaauuugagaaacaacuaggucaaauaauguuacuuauacuuuguaccucucaaauuuuacugaugagaacuacgugggcauugugugaaaguauaacguuggcuacaggaccucuaacaacucuaugggaaggauccccagggaaguuuuggaacacaacaauagcaguuucuauggcgaacauauucaggggauccuaccuugcaggagcaggacuagccuucagucuuaugaagucguuggguggagggcgccgaggaacaggagcacaaggagaaacauugggagaaaaguggaaacgccaacugaaucaacuaagcaaaucagaauuuaauacuuauaaaagaagcggcaucauggagguagaucgcagugaagcaaaagagggccuaaaaagaggggaaaccacaaaacacgcaguuucaagaggaaccgcaaaacuacggugguuuguugagagaaaucuuguaaaaccagagggaaaagucauagaccucggauguggucgcgguggauggucuuauuauugugcagggcuaaagaaagucacggaaguuaaagguuauacaaaggguggcccaggucaugaagaaccaaucccaauggcuacuuacggguggaacuuaguaaaauugcacagcggaaaagauguauucuuuacgcccccugaaaaaugcgauacguuauugugcgauaucggagagagcucaccuaauccgaccauagaagaaggaagaacuuuaaggguacuuaaaauggucgaaccaugguuaagaggaaaucaauucuguaucaaaauucucaauccguauaugccaucugugguagaaacccuagaacaaaugcagagaaaacacggcgguauguugguaagaaauccauuauccaggaauagcacacaugaaauguauuggguaaguuguggaacaggcaacauaguaagcgcaguaaauaugacaagccgaaugcuuuuaaauagauucacuauggcacaucggaagccaaccuaugagcgugauguagauuuaggggcggguacgagacacguugcuguugaaccagaagucgcuaauuuagacaucauagggcaacggaucgagaauaucaaaaacgaacacaaaaguacuuggcauuaugacgaagauaaucccuauaagacaugggcguaucaugggaguuaugaagugaaaccaucagguucggcuaguagcauggugaaugguguaguaagauuacuuacgaaaccaugggauguaauaccgaugguaacccaaaucgcuaugacugacaccacaccauuuggucagcaaagaguauucaaggaaaagguagacacccguacaccacgugcuaaacggggaacugcacagauaauggaaguaacugcaaaauggcuaugggguuuucugucgcgcaacaagaagccucguaucuguacuagggaagaguuuaccagaaagguaaggucaaaugcggccauaggggccguguuuguagaugaaaaucaauggaacucugcaaaggaagcgguugaagaugagagguucugggacuuaguacacagagaacgugaacuacauaaacaaggaaaaugcgccacuugcguguacaacaugaugggaaagagagagaagaaacuaggggaguucggcaaagcuaaaggcucacgugccauaugguauaugugguuaggugcuagauuccuugaguucgaggcuuuaggauuuaugaaugaagaucauugguuuucucgugaaaacucccuuucugguguagaaggagagggucuccacaagcugggauauauacucagagauauuucaaaaauaccaggugguaauauguaugccgacgauacugcggggugggauacuagaaucaccgaagaugacuuacagaacgaggccaaaaucacagauauuauggagccugagcaugcgcuacucgcgaccuccauuuuuaaguuaacuuaccagaacaaaguagucagagugcaaagaccugcuaaaaacggaacaguaauggauguaauauccagacgagaucaacgaggauccggacaagugggaaccuacggacugaauacauuuaccaauauggaaguacaauugauaaggcagauggaaucagaagguauauucuugccaugugaguuagaaacgccgaaucuagcggaaagaguuuuagacuggcucgagaaacacggugcugaaaggcuuaaaagaauggccauuuccggagaugauugcguugucaaaccgauagaugauagguuugccacugcauuaauagcauuaaacgacauggggaaagugagaaaggacauaccgcaaugggagccaucuaaaggauggaacgauuggcaacaaguaccauuuugcucacaccauuuccaccaauugaucaugaaagacggaagggagaucguaguuccaugucgaaaucaagacgaacugguaggcagagcuagagugagucaaggagcgggguggucacugagagaaacagcaugccuuggaaaaucauaugcacaaauguggcaauuaauguauuuucauagaagagaccuaagacuagccgcaaaugcuaucuguagcgcuguaccaguagacugggucccgacaucuagaacaacuuggaguauacacgcacaucaucaauggaugacaaccgaagauaugcugagcguauggaaucgaguauggauagaagaaaauccauggauggaggacaaaacacauguaagcaguugggaagaagugccuuacuuggguaaaagagaggaucaauggugcggcagcuuaauuggauuaacugcacgggcgaccugggcuacaaauauccaaguugcaauaaaucaaguacggcgacuaaucgguaaugaaaacuauuuagauuacaugacaucaaugaaaagauucaagaaugagagugauccggaaggggcguugugguag

SEQ ID NO: 21392 - RNA, 9879 nt, Artificial Sequence
  derived and/or modified CDS sequence (opt6) from DENV-1__FJ410186__SS-prME
aguguuacuauguuauuaauguuauuaccuacagccuuagcguuucaucucaccacgcgcggcggcgaaccacauaugauuguaucaaaacaagaaaggggcaaaucccuucuauucaaaacguccgccggcguuaacaugugcacauuaauagcaauggauuuaggcgaacuuugcgaagauaccaugacuuauaaguguccacgaauuacggaaguugaacccgacgauguugacugcugguguaaugcaaccgauaccuggguaacuuauggaacaugcucucaaacaggggaacaccgacgagauaaaaggaguguggcuuuagcuccacacguuggacuggguuuggaaacacgaaccgaaacguggauguccucagaaggagcuuggaagcaaauccaaaaggucgaaacaugggcacuccgucauccugguuucaccguaauagcauucuuucuugcccacgcuauagguacaucaauaacacaaaaaggaaucauauucauacugcuaauguuaguuacgccuucuauggcaaugagaugcguaggaaucggaaauagagacuucguugaaggucuaucgggagcaacuugggucgauguagucuuggaacacggaucguguguaacuacaauggcuaaaaacaagccaacuuuagacauagaacuacugaaaacggaaguaacaaaucccgcuguuuugcguaaacuauguaucgaagcaaagauuaguaacaccacaacugauagucgaugcccgacccaaggugaagccacccuaguugaggagcaagacgcuaauuucgucugccgucgcacauuuguagacagaggguggggaaauggaugcggcuuguuuggaaagggcucacugcugacaugugcaaaauuuaaaugcguuacuaaacuagaagguaaaauuguacaguaugaaaacuuaaaauacagugugauaguuaccguacauaccggugaccagcaccaggucggaaaugaaacaacagaacaugguacaaucgcaacaaucacaccacaagcacccacuucagagauacaacuuaccgauuacggcgcuuuaacacuugauugcucaccgaggacaggccuagauuucaacgagauggucuuacuaacgaugaaggagaaguccugguuaguucauaaacaaugguuucuagaucuaccuuuacccuggacaucaggugcgucaacaucccaagagacauggaaucgucaagaccugcuuguaacauuuaaaacagcucaugccaagaagcaggagguggucguucuagggucacaggaaggugcaaugcauacagcucuuacgggggccacagaaauacaaacaaguggaaccacgaccaucuuugcggggcaucucaaauguagacucaaaauggauaaauuaaccuuaaaggggaugagcuacgucauguguacugguucuuuuaaacuugagaaagaagucgccgaaacacagcaugguaccguguuaguacaagugaaauacgaaggaaccgacgcuccguguaaaauaccauuuaguacucaagacgaaaaagguguaacucaaaauggacgacuuaucacagcaaauccaauuguaacggacaaagagaaaccgguuaauaucgagacggaaccuccguucggggaaucauauauuauagucggcgccggugagaaagcacucaaacuuuccugguucaaaaaggggucauccaucgguaagauguuugaagcuacugcgaggggcgcuaggcguauggcgauauuaggcgacaccgcuugggauuuuggcucuauagguggaguauucacuucuguuggaaaauuaguucaccagguauucgggacugccuauggggugcucuuuaguggcgucaguuggacgaugaaaauaggaauaggaauauuauuaacuuggcuuggacugaacucacgaucagccucacucucaaugacauguauugcuguagguauggugacucuguauuuaggcguuaugguacaggccgauucaggaugcguuauuaacuggaaaggucgggaauuaaaaugugggagcgguauauuuguaacaaacgagguccacacauggacugaacaauacaaguuucaagcugacaguccuaaaagacugucugcugccauagggaaggcuugggaagaagguguuugugguauacguucugcaacuaggcuagaaaauauuauguggaagcagauuagcaacgaauuaaaccacauacuacuagaaaaugauaugaaauuuacaguagucgugggagacgcuaaugggauacuugcccaaggaaagaaaaugauucgcccccagccgauggaacauaaguauaguuggaaaaguugggguaaagcaaaaauaaucggugcagacauacaaaauacuacguuuauaauagacggacccgacacaccggaguguccugaugaccagagagcuuggaacauaugggagguagaagauuauggguucggcauuuuuacaaccaauauuuggcuuaaacucagggacaguuacacucaaaugugugaucauagguugaugucugcagccauaaaagacucaaaagcuguucacgcagauauggguuacuggauugaaucagagaaaaaugagaccuggaaauuagcacgagcuucuuucauugaaguaaaaacauguauauggccuaaaagucacacucucuggucuaaugggguacucgaaucagaaaugauuaucccaaagaucuacggcgguccuacgucacaacacaauuauagaccaggcuauuuuacacagacugcuggaccuuggcaucuaggaaaguuagaauuagauuuugaucuuugcgaaggaaccacaguagucguagacgaacauugcgguaauagagguccuucacuccgcacaacuacaguuaccggaaagaucauucaugaauggugcugucguucgugcaccuuacccccauuacguuuuagaggagaagacggauguugguacgggauggaaaucaggccagugaaagagaaagaagagaaucugguuaggucaaugguaagcgccggaucuggagagguugacucauucucuuugggaauuuuguguguaagcauaaugauugaagaaguuaugcgaaguagauggagccgaaaaauguuaaugacaggaacacuugcaguuuucuuacucuuaauaaugggccaacuaacuuggaaugaccuaauuagacuuuguauaaugguaggagcgaacgcaucggaucguauggggaugggcacaaccuacuuagcauuaauggcaacauucaaaaugcgccccauguucgcagucggucuuuuauuucgcagauuaacuucgagggaaguacuucuuuuaacaauaggacuaucacuuguugccaguguagaguuacccaacucauuagaggaacuaggugauggauuggcuaugggaauuaugauguugaaauuauuaacagaauuucaaccccaccagcuauggacuacguuauugagccuuacauucaucaaaacaacauuaucuuuggacuacgcauggaagacuauggcaaugguauuaucgauaguaucccuguucccccuaugucuaucgacaacuucucagaaaacaacauggcuccccguccuccugggcaguuuuggauguaaaccucuuacuauguucuugaucacagaaaauaagaucuggggccguaaaagcuggccauugaacgaaggaauaauggcgauaggcauaguauccauacuauuaagcucacuacucaagaacgauguacccuuagcuggaccguugauagcuggcggcauguuaauagcauguuaugugauuucaggauccucggcggaccuaagccuagaaaaagcggcagaaguaucgugggaagaagaggcggaacacucaggaaccucgcacaauauucugguggaaguucaggaugacggcacuaugaagaucaaggaugaggaacgagacgacacauuaacuauauuauuaaaggcaaccuuacuggcggugucaggagucuauccaaugucaauuccagccacguuauucgucugguacuuuuggcaaaagaagaaacaacgaucagggguucuaugggacaccccguccccaccagaaguagagagagcaguauuagacgaugggaucuauagaauauugcaacguggauuacuagguagaagucaaguuggugugggcguuuuucaagauggaguguuucacacuauguggcauguaacccguggcgccguauuaauguaucaggggaaaaggcuagaaccaucaugggccuccguuaagaaagauuuaauauccuacggaggaggauggagauuucaaggauuauggaacacaggagaggaaguccaagucauugcaguagaaccugguaagaacccuaaaaauguacagacaacgccggguacauuuaaaacacccgagggagaaguuggagcaauugcucuggacuuuaaaccgggaaccucagguucaccgauugugaauagggagggaaagauugugggucucuauggaaacggaguaguuacaacgucuggaacuuacguaucugcaauugcucaagcuaaagcaagccaagaggguccucuaccagaaauagaagacgaagucuucaaaaagcggaacuuaacuauaauggaucuucauccugguagcggcaagacgagacguuaccugccugcaaucguaagggaagcaauuaaaagaaaauuaagaacauugauacuggcuccgacacgaguaguggccuccgaaauggcagaagcacugaaagggaugccuauaagauaucaaacuacggcgguuaagucagagcauacuggacgcgaaauaguugaucuaaugugccacgcaacauucacaaugagacuauuaucuccaguuagggugccaaacuauaauaugauaauaauggaugaggcacacuucacagauccagccagcauagccgcgagaggcuauauauccacuaggguagguaugggugaagcugcugccauauuuaugacagcgaccccaccuggaucgguagaggcuuuuccccaaucaaacgcgguaauacaagaugaagaaagagacauaccggaacguaguuggaacucugguuaugacuggauuacggauuucccagguaaaacugucugguucguaccaagcauuaaaucagguaaugauauagcaaauugucugagaaagaaugguaaaagagucauacaauugucacgcaagacguuugacacagaauaucagaaaacaaagaauaaugacugggacuaugucgucacaacggacaucucugaaaugggggccaacuuuagagcagacagaguuauagauccuagaagaugucuuaagccaguuauuuuaaaagauggaccugagagagucauuuuagcugguccuaugccaguaacgguagcgucagcugcucaacgaagaggaagaauaggucgaaaccagaacaaagaaggagaucaauacguuuauaugggacaaccucuuaauaacgaugaagaucacgcucauuggaccgaagcaaaaauguuauuagauaauauuaacacccccgaggguaucauaccugccuuauucgaaccagagcgcgaaaaaucagcagccauugauggggaauauagacuaagaggagaggcacgaaagacauuuguagagcuaaugcgucguggggauuugccggucugguuaagcuauaaaguggcaagcgaagguuuccaauacuccgaucgacgaugguguuucgauggcgaacguaacaaucaaguucuggaggaaaauauggacguggagauuuggacaaaagagggagaacgcaagaaacucagaccacgauggcuugacgcacgcacguauagugauccauuagcucuacgcgaauuuaaagaguuugcagccggcagaagaaguguaucaggcgaccuaauuuuggaaauaggaaaauuaccucaacaucugacguuaagagcacaaaaugcgcuugacaauuuaguuauguuacacaauagugagcaaggaggcaaggcuuaucgccaugccauggaagaauuaccggauacaauugagacacuuaugcugcuagcacugauagcuguccuuaccggaggaguuacacuguucuuucuaagcggaaaaggauugggaaaaacgucuauuggacugcuaugugucauggcguccucugcauuacuguggauggcaagcguugagccucauuggauagcagcuaguaucauucuagaguucuucuuaaugguacuccuuauaccagagccggauagacaacgaacuccgcaagacaaucaauuagcauaugucguaauaggucuucuauuuaugauuuugacagucgccgcaaaugaaaugggacuacuagaaacuacuaaaaaggaucuggggauaggacacguugcagcugaaaaccaccaccaugcaaccaugcucgacguagauuugaggccagcaucagcuuggaccuuauacgccgucgcuacgacagucauuacaccuaugaugaggcacacuauagagaauaccacggcgaacauaucuuuaacagccaucgccaaucaggccgcaauauuaauggguuuggauaaaggguggccuaucucuaaaauggacauuggaguaccauugcuugccuuaggcuguuacagccaaguaaacccguuaacacucaccgcugcuguauugauguugguagcucacuacgcgauuaucggucccggguuacaagccagagcuacgagagaagcacagaaacguaccgcugcuggaauaaugaaaaaucccacagucgauggaauaguagcgauugaucuagaucccgucguuuaugaugccaaauuugagaagcaacuuggacaaauaaugcucuuaauauuauguacaucacaaauccuacuuaugcgaacaacuugggcacuuugugaaaguauuacgcuugcaacaggaccguugacaacguugugggaagggucaccagggaaauuuuggaauacuacaaucgcaguaucuauggcaaauauauuuagaggaaguuaucuugccggugcaggguuagcauucucacugaugaaaaguuuagguggagguagacguggaacaggagcacaaggagaaacguugggagaaaaauggaaacgacagcugaaucaacugagcaaauccgaauuuaauacauauaaaagauccggcauaauggaaguugaucgcucugaggccaaagaaggacugaaaagaggggaaacuacaaaacaugcagugucucgcggcacugccaaacugagaugguucguggaaagaaaucuuguaaaaccugaaggaaaaguaauagaucuuggauguggaagaggaggauggucuuacuacugugccggauuaaagaagguaacagaaguaaagggauauacgaaaggagggccgggacacgaagaaccgauaccaauggcuacauaugguuggaaucucguaaaacuacauucgggaaaagacguauucuuuacucccccggagaaaugcgacacccuucugugugauauuggcgaguccucaccaaauccaacuauagaagaaggaaggaccuuaaggguauuaaaaaugguagagccguggcuucgaggaaaccaauucugcauaaaaaucuugaaucccuacaugccaucaguaguugaaacauuggaacaaaugcaaaggaagcauggcggcaugcuaguaagaaauccuuuaucaagaaauaguacccaugaaauguauuggguuucauguggcacugguaauaucguaagcgcagugaauaugacaagucgcauguuacuaaauagauuuacaauggcgcauaggaaaccuacauacgaacgugauguagacuuaggagcuggaacuagacauguugcagucgaaccagagguggcaaacuuggacauuauaggacaacgcauugagaauaucaagaacgaacacaaaucaacguggcauuacgaugaagacaacccauauaaaacgugggccuaucaugggucguaugaaguaaaaccgagcgggucagcuucgagcaugguaaauggggucguaaggcuucuaacgaagccgugggauguaauaccgaugguuacacaaauagcgaugaccgacacaacgccauuuggucaacagagaguuuucaaggaaaaggucgauaccagaacacccagagccaagcgcgguacggcacaaauaauggaaguaaccgcgaaguggcuaugggguuuucuaucaagaaacaagaaaccgcgaauauguacaagagaggaauuuacacguaaaguuagaucaaacgcggcuaucggagcuguauucgucgaugaaaaucaauggaacucggcgaaagaagcaguggaagaugaacgguucugggaucuaguucgccgugaacgagaacuacacaagcaggggaaaugugcaacuugcguguauaacaugauggggaagagagaaaagaaacuaggcgaauuuggaaaggcaaagggaagcagagcgauuugguacauguggcugggggcaagauucuuggaguucgaagcacuaggcuuuaugaaugaagaccacugguucucucgagaaaauucauuaucaggcguagaaggugaaggacuacacaaguugggguauauacuaagagauauuagcaagaucccaggcggcaacauguacgcagacgacacagccgguugggauacccgaauuacagaagacgaccuacaaaaugaagcaaaaauaacagauauaauggagccagaacaugccuuacuagcaacgaguauauucaaguuaacauaccagaacaaaguuguaaggguacagaggccagcgaaaaauggaacaguuauggauguuauuagucguagagaccaaagagguaguggccaaguugguacuuauggauugaauacauucacaaacauggaaguucaauuaauucgucaaauggaaucugaaggaauauuuuuaccauccgagcuugaaacgcccaaucuagccgaaagggucuuggacuggcuggaaaaacauggagccgaacgacuaaaacgaauggccauaucaggugaugauugcguaguaaagccaguugaugacagauucgcaacagcucuaaucgcauuaaaugauaugggaaaaguacgaaaagacauaccacaaugggaacccucuaaaggcuggaacgauuggcaacaagucccauucugcucgcaucacuuccaucaacuaauaaugaaggauggccgggaaauaguuguuccgugucguaaucaagaugagcuaguaggaagggcacgggugagucaaggcgcuggguggucucuuagagaaacagcauguuuaggaaaauccuacgcacagauguggcaguuaauguauuuucaucgacgcgaccuaagauuggcagccaaugccauaugcucagcagaccccguagauuggguacccacguccagaacaacuuggagcauccacgcacaccaccaauggaugaccaccgaagacaugcuuaguguguggaauagaguuuggauugaggaaaaccccuggauggaggacaaaacacacguaagcucgugggaggaaguacccuaucuaggaaaaagagaagaccaauggugugguuccuugauaggccuuaccgcgcgugcaacuugggcgacaaauauacaaguggccauuaaucaagucagaagacugauaggaaaugaaaacuauuuggacuacaugauaucgaugaagcgauucaaaaacgaaucagauccagaaggagcacuuugguaa

SEQ ID NO: 21393 - RNA, 9879 nt, Artificial Sequence
  derived and/or modified CDS sequence (opt6) from DENV-1__FJ410187__SS-prME
ucuguaacuauguuauuaauguuacugccuacggcacuagccuuccauuugacuacuagagggggagagccacacaugauagugucuaaacaagaacgaggaaaaucccuucucuuuaaaacaagcgccggaauaaauauguguacucucauagcaauggaucucggagaauuaugcgaagacacuaugaccuauaaauguccuagaauuaccgaagcggaaccagacgacguagacuguugguguaacgcaacagauacauggguaacauauggaacuugcagccaaacaggggagcauagaagagacaaaagaagcguagcauuagcgccacauguuggucucggccuugaaacuaggacugaaacuuggaugucaucugaaggugcuuggaaacaaauacaaaaaguugagacgugggcacuaagacauccgggcuucacuguaacagccuuguuucuggcacacgcgauagguacuucuauuacacaaaaagguauuauauuuauuuuauugaugcugguaaccccuucaauggcaaugcgaugcguaggaaucggaaauagagacuucgucgaagggcuaucgggagcgaccuggguugacgucguauuggaacacggaagcugcguaacuacuauggcaaaagauaaaccaacacuagauauagaauuauuaaaaacugaaguaacaaacccugcaguauugcgcaaacucugcauagaagcgaaaauuuccaacacaaccacugauucaagauguccuacucagggggaggcgacgcuagucgaagaacaagauucaaauuuuguuugcagacgcacuuucguggauagaggauggggcaacgggugcggucuauucgguaaagggucacuauuaacuugugcaaaauucaaaugcguaacaaaauuggaaggcaaaauuguacaauaugaaaaucuuaaauauaguguaauuguaacugugcacaccggagaccagcaucagguaggaaaugagacaacagaacaugggacaauugcaacuauaaccccacaggcgccuacuucugaaauacaacuaacggauuauggggcuuugacccuugauugcucaccaagaacaggccuagacuucaaugagauggugcuuuuaacgaugaaagaaaaauccuggcuaguucauaagcaaugguuccuagacuuaccuuuacccuggacaucgggcgcgucgacuucacaagaaacauggaaccggcaggauuugcugguuaccuuuaagacugcacaugccaagaaacaagaggucguaguauuagggucucaagagggugcaaugcacacugcauuaaccggggccacugagauucaaacuucagggacaacaacuauauucgccggucaccuaaaaugucgccucaaaauggacaaacuuacacucaaaggaaugucauaugugauguguacuggaaguuuuaaacuggaaaaagagguugcagaaacccaacacggaacugucuuaguucaaguuaaauacgaaggaacugaugcgccaugcaaaauuccuuucagugcccaagacgagaaaggaguaacucaaaacgguagauuaauaacggccaauccaauuguaacugacaaagagaaaccgguaaacauagagacagaaccacccuucggcgaaucguacauugucguuggagcaggcgagaaagccuugaaacuaagcugguuuaagaaaggaucgaguauaggcaaaauguucgaggcuacugcuaggggugcucgucggauggcaauauuaggggacacugcuugggauuuugguucaauaggagggguuuuuacaagcguugguaaguuaguacaucagguguuuggagcugcguacggcguucuauuuucagguguuucauggacgaugaaaauuggcauagguauuuugcuaacuuggcugggccuaaacucaaggaguacuuccuuguccaugacguguauagcugugggaaugguuacacucuaccuugguguaauggugcaggccgacagcgggugcguaauuaauuggaaaggcagagaguuaaagugugguucaggaauauuugucaccaacgagguccauacuuggaccgaacaauacaaauuccaagcagacucucccaaacgguuaagugcugccaucggaaaggcuugggaagaaggaguuugugguauacggagugcuacuagguuagaaaauauaauguggaaacaaauuagcaaugaauuaaaucauauauugcucgaaaaugacaugaaguuuacagugguugugggugacgccaauggaauauuagcgcaagggaagaaaaugauccgaccucagccuauggaacauagauauucuuggaaaucauggggaaaagcuaaaauuauaggagcagauauucaaaacucaacguuuaucauugauggaccggauacaccugaaugcccggaugaucagcgggcauggaauauaugggaaguagaagacuacggauucgguauuuuuacaacuaacauauggcucaaacuaagggauucuuacacacaaaugugugaucaucgccuaaugagugcagcaauaaaagauaguaaagcuguccacgcggauaugggauacuggauugaaucagaaaagaaugaaacuuggaagcuagcaagagcguccuuuauagaaguuaaaaccuguauauggccuaagagucauacccuuuggagcaacggaguacuggaaucagaaaugauaaucccgaagaucuauggcggaccgauaagucaacauaauuaucguccuggauauuuuacucaaacugcaggaccuuggcaucuaggaaaauuggaguuagauuuugauuuaugugaggggacuacuguuguuguugaugaacauuguggaaauagagguccgagucuccguacuacgacaguaacugggaagauaauacaugaaugguguugccguaguuguacguugccaccacuuagauucagaggugaggaugguugcugguauggaauggaaauucggccaguaaaagagaaggaagaaaaucuuguacgaucgaugguuucagcaggaucaggcgaaguugauucuuucucauuagguaucuugugcguuucuauuaugauagaggaaguuaugagaucgagguggaguagaaaaauguuaaugaccgguacauuagcuguauuccuauuacucauaaugggacaacuaacauggaacgauuuaauccggcucuguauaauggucggggccaacgcaucagauagaauggggauggguacuacuuaccuagccuuaauggcaacguucaaaaugaggccaauguucgccgucggguugcuauuuaggcguuugacgaguagggaaguccuguuacucacaauaggucuaucauugguugcaaguguugaacuaccuaauagcuuggaagaauugggagaugguuuggcuauggggauaaugauguuaaaacuucuaacagaauuucaaccacaucaauuguggacaacacuacuuagucuaaccuuuauaaaaacaacacuuagcuuggacuaugcguggcgaacaauggccauggucuugaguauaguuucucuguucccacugugucuuaguacuacuucccagaaaacuacauggcuaccgguguuacucgguucauuugguugcaaaccacuuaccauguuuuuaaucacagaaaacaaaauuuggggucgcaagucuuggccauugaacgaaggaauuauggcgauaggaauagugaguauauuguugaguagcuuacuaaagaaugaugucccacuagccggcccauuaaucgcuggagguauguuaaucgcaugcuacguuauauccgggucgucagcagauuuaagccuggaaaaagccgcggaaguaagcugggaggaagaagccgaacacucugggacuucacauaauauauuaguugaaguccaagacgaugguacaaugaaaauaaaagaugaggaacgcgacgauacuuugacgauucuauuaaaagccacucucuuagcaguuagcggaguuuaucccaugucuauuccagcgacacuauuuguaugguacuuuuggcagaagaagaaacagagaagcgguguacuaugggauacacccucaccaccugaaguagaaagggcaguacuggaugauggaauauacagaauauuacagcguggucugcuggggcguagucaaguagguguggguguuuuucaagacggaguguuucauacuauguggcacguaacgagaggagcaguguugauguaucagggcaaaagauuagagccuucuugggcaagcguuaagaaagaccuaaucaguuaugguggcgguuggagguuucaagguaguuggaacacaggagaagaaguacaaguuauugcuguagaaccuggcaaaaaucccaaaaacgugcaaacgacaccgggaacuuuuaaaacgccagaaggggaaguaggugcaauagccuuggacuuuaaacccgggaccucaggaucuccuauaguaaaucgagaggggaaaauuguaggucucuacgguaacggcguaguaacaacaucaggaaccuacgucuccgcgauugcucaagccaaaacaagucaagagggaccauugccugagauagaagaagaaguauuuaagaaaagaaauuuaacaauuauggaccuacaucccggcagugguaaaacucgucguuaucuaccugcaauuguaagagaagcuaucaagaggaaauuaaggacauugauccuggcacccacacggguagucgcuucugaaauggcggaagcgcugaaagggaugccaauacgguaucaaacuaccgcaguaaaaagcgagcauacgggaagagaaauagucgacuuaaugugucacgcaaccuucaccaugagacuuuuaaguccugugagggugccaaacuauaacaugauaauaauggaugaagcacauuucacugaccccgcuucuauagcugcacgaggauauauuucaacaagaguagguaugggagaagccgccgccaucuuuaugacggcaaccccgccugggagcguggaagcauuuccacaaucgaacgcggucauucaagaugaagagagagacauaccagaaaggagcuggaacucaggauacgacuggauuacugacuucccagguaaaacaguuugguuugugccaucaauuaaaucggggaacgacauagcuaauugucuuagaaagaacggaaaacgaguaauacaguugagcagaaagaccuucgauaccgaguaucagaaaaccaggaacaaugauugggacuacgucguaacuacagacauaucugaaaugggagcaaacuuucgugcggauagaguuauagacccuagaagaugccucaaaccagucauacucaaagauggucccgaaaggguuauuuuagcggguccuaugccuguaacugucgcuagcgcugcacagcggcgagggcgcaucgggcgcaaccaaaacaaagagggagaccaauacguuuacaugggucaaccgcucaacaacgacgaagaccaugcacauuggacugaagcaaaaaugcuuuuagauaacauaaauaccccagaagguauuaucccugcuuuauuugaaccggaaagagaaaagucugcggcaaucgauggagaauaucgacuucguggagaagccagaaaaacauucguagaacugaugcggagaggugauuuacccgucugguuaagcuauaaaguggcuucugaaggauuucaauauuccgaucguaggugguguuuugauggugagaggaacaaccaaguucuggaagaaaacauggauguagaaauauggacgaaagaaggugaaaggaagaaauuacgaccucguugguuagaugcccgcacguauagugauccucucgcgcuaagagaguuuaaagaguucgcggcuggcaggagguccguaaguggagauuugauacuugaaauaggaaaauuaccucaacaucuaacacuaagagcacaaaacgcccucgauaaucuaguuaugcuucauaacucugaacaagguggcaaagcguauaggcacgccauggaagaauuaccugauaccauugaaacauuaauguuacucgcacuaaucgcgguuuuaacaggggguguaacucuauucuuucucucaggaaaaggacuagguaagacaagcauaggauuacuaugugucauggccaguucugcucucuuauggauggcuaacguggaaccacacuggauagcugcauccauaauucuugaguucuuucuaaugguucuccuaauaccagaaccagacagacaaaggacaccgcaagauaaucaauuagcguauguugugauaggguuauuauucaugaucuuaaccguugccgcuaaugaaaugggccuacuagaaaccacuaagaaagaccucggcauuggacauguagcagcggaaaaccaacaucaugcgacaauguuagauguagauuuacguccggccagugcguggacuuuauaugccguugcuacaacugugaucacaccuaugaugagacauaccauugaaaacacaacagcgaauaucucccugacggcuauagcaaaucaagcagccauauugaugggccucgauaaaggcuggccaauaaguaagauggacauagggguuccguuauuagcuuugggauguuauucacaaguuaauccgcuuaccuuaacagcugcuguucugaugcugguagcucacuaugcuauuauuggcccaggucuacaggcaaaagccaccagagaagcacagaaaagaacagcagcuggaauaaugaagaauccuacuguggaugguauagucgcaauagaucuagacccaguaguauaugaugcaaaauuugaaaaacaauuaggacaaauuauguuauuaauccuuugcacuucucagauacuucucaugcgaacaaccugggcacuaugcgaauccauaacccuggcaaccgggccauuaacgacauuaugggaggggucaccggguaaauucuggaacacaacaauagcuguuaguauggccaauauuuuuagaggaucuuaccuggccggugcaggauuagcuuucucucugaugaaauccuuggguggcgguagaaggggaacgggagcacaaggcgagacccucggggagaaguggaaacgccagcucaaucaacuuagcaaaagcgaauuuaacacauauaaacgaagcggcauuauggaaguagaccgauccgaggccaaagagggcuuaaagcgaggcgaaaccacaaagcaugcgguaagucguggaacugcgaaauuacggugguuuguggagcguaauuuaguaaaaccggaagguaagguuauugauuuaggguguggacgaggagggugguccuauuacugugcgggucuuaagaaagugacugagguuaaaggauauacgaagggcggaccaggacaugaagaaccuauaccaauggcaacauauggguggaaccuaguaaaacuguauagcggaaaagacguauucuucaccccuccagagaaaugugauacauuacuuugugacauuggggagagcagcccuaauccaacaaucgaagaggggagaacauuacgaguucuuaaaaugguagagcccuggcuccguggaaaccaauuuugcauaaaaauucugaauccguauaugccaucaguugucgaaacgcuugaacaaaugcaaagaaaacacggcggaauguuaguaagaaauccgcuaucaagaaauucaacucaugaaauguauuggguaucaugcgggacuggaaauauaguuucagcugucaacaugacauccagaaugcuauugaaucgauucacaaugacucauaggaaacccacuuaugagagagacguagaucuaggggccggcacacgacauguggccgucgaacccgaagucgcgaacuuggacauaauaggacaacgaauugaaaauaucaaaaaugagcauaaauccacuuggcacuaugacgaagauaaucccuauaaaacuugggcauaucacgggagcuaugagguaaaaccauccggaucagcaagcaguaugguaaacggaguuguccgauuguuaacgaaaccgugggacguuauuccgauggucacccaaaucgcaaugacagacacuacucccuuuggucaacaaaggguauucaaggaaaagguggauacucgaaccccaagggcgaaaagaggaacugcccaaaucauggagguuacggcaaaaugguuauggggauucuugucaagaaauaagaaaccgcggauauguacuagagaagaguucacacgcaaaguaagaucuaacgcagcgauuggugcgguuuucguugacgaaaaucaauggaauagugcaaaggaagcuguugaagacgaacgauuuugggaccuagugcauagagaacgagaauuacauaaacaagguaaaugcgccacgugcguauacaacaugauggguaaaagggagaagaaacuaggagaguuuggaaaagccaaaggcucacgagcaauuugguacauguggcuaggggcaagguucuuagaauuugaagcacuaggcuuuaugaaugaagaucacugguuuaguagagaaaauagcuucagugggguagagggcgaaggauuacauaaacuuggauauauacuuagggauauaucaaaaauuccuggugguaacauguacgcagacgauacugcaggaugggauacgaggauuaccgaagacgaucuacagaacgaagcuaaaauuacggacauuauggaaccggagcaugcauuguuagcuaccucaaucuuuaagcugacuuaucaaaauaaaguuguucgaguacagcgaccugccaaaaaugguacgguaauggauguuaucucuagaagagaccaacgugguagcggacaagucgguaccuacggacuaaacacauucacgaauauggaaguacaauuaauuaggcagauggaaucugaaggaauauuucuccccagcgaguuggaaacuccaaaucuugcagaaagaguauuagacugguuggaaaaacacggaacagaaaggcuaaaacgaauggcaauaucuggugaugauugugugguaaagcccguugaugacagguuugcuacagcacuaauugccuuaaacgauaugggaaaaguucgaaaagacauaccucaaugggagccaagcaaagguuggaacgauuggcaacaaguuccguuuuguucacaucacuuucaucaguuaauuaugaaagauggcagggaaauaguagugccuugcagaaaucaagaugaacucguugguagagcuagagugagucagggagcuggauggucuuuacgagaaacagcuugcuuaggaaagucauacgcacaaauguggcaauuaauguauuuccaccgaagagacuuacgacuugccgcaaacgcuauaugcucugcugucccgguagacugggugccgacaucaagaacaacauggaguauucaugcgcaccaucaauggaugacuaccgaagauaugcuuucugucuggaaucguguauggauugaggaaaauccuuggauggaagauaagacucauguuaguaguugggaagaagugccauaccucggaaagagagaagaccagugguguggaagucucaucggguuaaccgcacgggccacgugggcuacuaacauacaaguggcgauaaaccaaguccgacgacuaauagguaacgaaaauuaucuugauuacaugacaucgaugaaaagauucaaaaaugaaagugauccagaaggagcauuaugguaa

SEQ ID NO: 21394 - RNA, 9879 nt, Artificial Sequence
  derived and/or modified CDS sequence (opt6) from DENV-1__FJ478457__SS-prME
agcguaaccaugcugcucaugcuauuacccacagcacucgcuuuucacuuaacaacuagaggaggugaaccacauaugauaguaagcaaacaagaaagagguaaaucccuucuauucaaaacaucugcgggagugaauaugugcacccucauugcaauggauuugggcgaauuaugugaagauaccaugacauauaaaugucccagaauaacggaagcagaaccugacgaugucgacugcuggugcaaugcaacugauacuuggguaacuuaugguacaugcagucaaacuggggaacaucgaagagauaaaagguccguagcacuugcaccacaugugggauuaggucuagaaacgcgaacugaaacuuggaugaguucagagggugcuuggaaacaaauacaaaaaguagagacaugggcacuucggcaucccggguucacaguaauugcgcuuuuucuggcgcaugcuauagguacauccaucacgcaaaaaggaauaauauuuaucuuauugaugcucgucacaccauccauggcaaugagauguguaggaauagggaauagggauuuuguugaggguuugucuggugcaacauggguggauguuguccuagaacauggaucuugcgugacaacaauggccaaaaauaaaccaacacuagacauagagcuucucaaaacugaaguuacaaacccagcuguauugagaaaacucuguauagaagcaaaaauuagcaauacuacgacggauuccagaugcccaacacaaggugaagcaacgcuaguagaagaacaagaugcaaauuuuguaugcagacguacguuuguagaccguggcuggggaaaugguuguggacuauucggaaaagguagcuuacugacuugcgcaaaauuuaaaugugugacaaaacuggaaggcaaaauaguacaacaugagaacuuaaaauauucagugauaguuacgguacauacaggugaccagcaucagguagguaaugagacgacagaacaugguacgauagccacaauaacaccccaggcaccaacauccgaaauucagcuaacagauuauggugcccuuacucuugacuguucaccacguacuggucuggacuucaaugaaauggucuuacuuacuaugaaagaaaaaucauggcuaguacacaaacaaugguuuuuagacuuaccucuacccuggacuagcggugcaucaaccagucaggaaacuuggaaucgacaggaccuauuagucaccuucaaaacagcacacgccaagaaacaagaaguugucguccuugguagucaggaaggggcuaugcauaccgcucugacgggugcuacagaaauccagacaaguggaacuaccacaauauuugcaggacauuugaaauguagacucaaaauggacaaacuaacacucaaaggaaugucguauguaaugugcacugguucguuuaaauuggaaaaagaaguagccgaaacgcagcacggaacuguacuuguucaagucaaguacgaaggcacugacgcucccugcaaaaucccguuuaguacccaagaugaaaaaggaguuacacaaaacggacggcucauaaccgccaaccccauaguuacggauaaagagaagccuguaaacaucgaaacagaaccuccuuuuggugaaaguuacaucgucguaggcgccggggagaaagccuugaaacucaguugguuuaagaagggcucauccauuggcaaaauguucgaagcaacagcaagaggagcucgaagaauggcaauacuuggugacacagcuugggacuuugguagcauaggcggaauguucacaagcguagguaaauuagugcaccaaguuuuuggcacagcauacgguguccuauuuucaggugugucguggacgaugaagaucgggauaggaaucuuauuaacauggcuagguuuaaacagucgcagcacaucucucuccaugacguguauagcaguuggaaugguaacacucuaccuugguguaaugguacaagcugauuccggaugugugauaaacuggaagggucgugaauugaaauguggaucuggaauauuuguaacuaacgagguucauacauggacagaacaguauaaauuucaagcggacaguccuaaacgcuugucugccgccauagggaaagccugggaagaaggcgugugcggaauuaggucagcgacaagauuagaaaauauuauguggaaacaaaucucgaaugaacuaaaucauauacuucuugaaaacgauaugaaauucacaguaguuguuggagacgcgucgggaauuuuagcgcaaggcaagaaaaugauaagaccucaaccaauggaacauaaauauucauggaaaaguuggggaaaagcuaagauaauaggcgccgacauccagaacaccaccuuuauaauugauggaccagauacgccagaguguucagaugaucaacgagcauggaacauaugggaaguugaagacuaugguuuugggauuuuuaccacuaauauauggcugaaacuacgagauucuuacacucagaugugcgaucacagguuaaugagugcagcaauaaaagauucaaaagcuguucaugcugacaugggauauuggauagaaagugagaagaaugaaacauggaaguuggcgcgagccagcuuuauagaagucaaaacuuguauauggccuaaaagccauaccuuauggucaaauggaguucuagagucagaaaugauaaucccaaaaauauauggggguccaaucucacaacacaauuaccggccaggguauuucacccaaacagcggggccauggcaccuugguaaacuugaacuggacuucgaucuuugugagggaacgaccguuaucguagaugagcauuguggcaaccgcggacccagucuccgaacuacgacugugacaggaaaaauaauacaugaaugguguugcagaucaugcacacuacccccguuacguuuccgaggugaagacgguugcugguacggaauggaaauaaggccagugaaggaaaaggaagagaacuuaguacgaaguaugguuucagcggggucgggugaagucgauucguuuucucuaggcaucuuauguguaucuauaaugauagaggagguaaugaggucgagauggagucgaaaaauguuaaugacagguacgcuagcugucuucuuacuauugauuaugggacaacuaacguggaacgauuuaauaagguuauguauaauggucggagccaaugccucagaccguauggguaugggaacaacauaucuggcguuaauggcaacauucaaaaugcggccuauguuugcaguuggguuauuauuccgccgacuaacgucuagagaagugcuacuauuaacaauaggucuuagucuggucgcuuccguugaacuaccaaacaguuuggaagaacuuggugacggucuagcgauggggauuaugauguuaaaauuacuaacggaguuccaaccucaucaauuauggacaacauuauugagccuuacguuuauuaaaacgaccuugucauuggauuaugcauggaaaacuauggcuauggcucucaguauuguuucacuauuuccauuauguuuaagcacaacuucacagaaaacuacgugguugccgguauuacuggguagcuucggcuguaaaccauuaacaauguuucucaucacugagaauaagauauggggacgaaaguccuggccauuaaaugagggcaucauggccauaggcauuguaucaauccugcuuucuucauuauugaaaaacgaugucccacuagcuggaccauuaauugccggaggaaugcuaauagcaugcuacguaauaucagguaguucugcagacuugucacuugaaaaggcagcagaaguaucuugggaagaagaagcggagcauucggggacaucacauaacaugcuugucgagguucaagacgauggaacuaugaaaauuaaagacgaagaacgugaugauacuuuaacaauucuauuaaaagcaacccuucuagcaguaagcgguguauacccaaugucaaucccagcaacucuuuuugucugguacuuuuggcaaaagaagaaacaaaggaguggcguauuaugggauaccccaaguccaccagaaguugaacgggcggugcuagacgaugggauauacagaauacugcagcgaggcuuacuaggccguucacaagucggaguuggaguauuucaagacgguguauuccauacaauguggcacgugacacgaggagcgguguugauguaccaaggaaaaaggcuugaaccaaguugggcaucgguuaagaaagauuuaauaaguuaugggggaggauggagauuccaagguaguuggaacacaggcgaagaaguacaaguaauugccguagaaccaggcaaaaauccuaagaacguccaaacuacuccugggacauucaaaacuccagaaggugaggugggagcuauugccuuagauuuuaaaccaggcacuagcgguaguccgauagugaaccgagaaggcaagauugugggauuauacggaaacggcguagucacuacgucgggaacauacguuucggcaauugcucaagcaaaggcuucgcaagaagguccccugccugaaauagaagacgaagucuuuagaaagagaaaccucacaaucauggaucuccauccugguagcggaaaaacgaggcgguauuugccugcuauaguacgcgaagcgauaaaaagaaaguugaggaccuugauuuuagcaccuacucguguuguagcuuccgaaauggcugaggcuuugaaagggaugccuauucgauaucaaaccacugcuguaaagagcgagcacacggggagagaaauaguggaucugaugugucaugccacuuuuacaaugagauuauuaucuccagugagagucccuaacuauaauaugauaauaauggaugaagcucauuuuacagacccagcauccauugcggcacgaggauauauuagcacgcgaguaggaaugggggaagcagcggcaauuuucaugacugcaaccccacccgggagcguagaggcuuuuccucaaaguaaugcagucauccaagacgaagaaagagacauaccugaacguuccuggaacucgggguaugacuggauuaccgauuucccagggaaaacaguuugguucguaccaucaauuaaauccggaaaugauaucgcuaauugucuaaggaaaaacgggaaaagagugauacaauuaaguagaaaaacauuugacacugaguaucagaagacaaagaauaaugauugggauuauguaguuacgacugauauaucugaaaugggcgccaauuuucgcgcugaccgagugauagauccaagacgaugccuuaagcccguaauacuaaaagauggaccggaacggguaauccuagcaggaccaaugccagugaccguugccucggcagcacaacguaggggaagaaucggucgaaaccagaacaaggaaggcgaucaguauguuuauaugggucagccauugaauaaugaugaagaucaugcgcacuggaccgaagcaaaaaugcuccuggacaacauaaacaccccugagggcauuauaccagcccuguucgaaccagaaagagaaaaaucugcugcuauugauggcgaauauagguuaaggggugaggcucgcaaaacauuugucgaauugaugagacgcggagaucugccaguauggcuuucauauaaggucgccucagaagguuuucaauauucggacagaagauggugcuucgauggcgaaaggaauaaucaaguauuagaagaaaauauggauguagaaauuuggacaaaagaaggcgaaaggaagaaauuaagaccaagaugguuagacgcucgaacauacucggauccacuagcacuuagagaauuuaaagaguucgcagcugguagaagaagcgugucaggugacuuaauucuggaaauaggaaaacuuccacaacaccuaacacucagagcccaaaacgcucuagacaaucugguaauguuacauaauagcgaacaagggggaaaagccuacagacaugcgauggaagaacuuccagauacaauagaaacacuuaugcuauuagcauuaauagcuguacucaccgggggaguuacuuuauuuuuccucucggggaaaggcuuagguaaaacuucaauagguuuacuaugugucauggcgucaucagcuuuacucuggauggccagcguugaaccucacuggauugcagcgucgauuaucuuggaguucuuccuaauggugcuacuaauacccgaaccagauaggcaaagaacuccacaagauaaucagcuggcguauguugugaucggacuacuuuuuaugauacucacagucgcagccaacgaaaugggacuucuggaaacaaccaagaaagaucuaggaauaggccauguagccgcagaaaaucaucaccaugcaacaaugcucgaugucgaccugcgaccagcaagugcuuggacguuguaugccguagcaacaacuguuauuacuccuaugaugagacauaccaucgaaaauaccacugcaaauauaucauuaacagcaaucgcuaaccaagcugcuauuuuaaugggacuagauaaagguuggccaauuaguaaaauggacauaggaguaccgcuauuagcucugggaugcuauucccagguuaauccacuaacuuuaacggccgcaguauugaugcucguugcucauuacgcgauaauugguccaggccuacaagcuaaagcgacgagggaagcccagaaaagaacggcggccgguaucaugaaaaaccccaccguugauggaauaguagcaauugaucuagacccagucguauacgacgcaaaguucgaaaaacaacugggccaaaucaugcuauugauucuaugcacaagucaaauuuuauuaaugcgaaccacaugggcacuaugcgagucaauaacguuagcaacaggaccgcuuaccacauugugggaaggaagucccgguaaguuuuggaauacaacaauagccguaaguauggcgaacauauuuagggguucuuauuuagcuggggcuggauuagcuuuuucgcuaaugaaaucacucggcgguggacguagggggacuggugcacagggugagacgcuuggagaaaaguggaaaagacaacuuaaucaauuaagcaaaagcgaguuuaauaccuauaaacggagugguauuauggaggucgaccgaucagaggcuaaagagggucuaaaacguggagaaacuacuaaacaugcagugucaaggggaacugccaagcuccgcugguuuguagaacggaaucuuguuaaacccgagggaaagguaauagaucuagguugcggacgagguggguggucguacuacugcgcagguuuaaagaaaguaacugaggugaaggguuacaccaaaggaggacccgggcacgaagaacccauaccgauggcaacauacggcuggaauuuggugaaacuucauucaggaaaggaugucuuuuucacacccccggaaaaaugugacacccuauuaugcgauauaggcgaaucaagucccaaccccacaaucgaagaagguagaacccuacguguacuaaaaaugguagaacccugguuacgcggaaaucaauucuguauuaagauuuuaaacccauacaugccgagcgucguagaaacauuagaacaaaugcagcguaaacauggcggcaugcuuguaaggaacccauuaucgcgcaauucaacccaugagauguacuggguuaguugugggacagguaauauagucucugcaguuaauaugacuucacggauguuauuaaaucgauuuacuauggcccauagaaagcccacauacgagcgagauguugacuuaggagcgggcacuagacauguugcaguugaaccggaaguugcaaaucuagauaucauuggccagaggauagaaaacauaaagaaugaacauaaguccaccuggcauuacgacgaggacaauccauauaagacaugggcauaucaugguucauaugaagugaaacccagcggcagugccaguucaauggucaauggagucguacgacuucuuacgaaaccgugggaugugauaccaaugguaacucaaauagcuaugacagauacaacuccauuugggcaacaaagagucuuuaaagaaaaaguagauacuagaacaccacgggcaaagagagggacugcgcaaguuauggaaguaacagcuaaauggcuguggggcuuccucuccagaaauaagaagccucgaauuugcacacgugaagaguucacgagaaaaguucgaucaaaugcagccaucggagccgucuucguugacgaaaaucaguggaacucggccaaagaagcgguggaagaugagaaauucugggacuuaguccaccgugagcgagaacuucauaaacaagguaaaugugcgacaugugucuauaauaugaugggaaaacgagagaagaaacuuggugaauuuggaaaggcuaagggaucgagagcaauuugguauauguggcuaggagcacgguuccuagaauuugaagcucuuggauucaugaacgaagaucacugguuuucgcgugaaaacaguuugagcggcguugagggagaaggcuugcacaaacuuggauauauauugcgagacaucaguaaaauuccaggaggaaauauguaugcggacgauacugcagguugggauacuagaauaacagaagaugaccuacaaaaugaggcuaagauaacugacauuauggaaccugagcacgcccuacuagcuacauccauauucaaacucacauaccaaaauaaaguuguaagagugcaacgcccagcuaagaaugggacgguuauggauguaauuagcaggagagaucagcgagggucuggacaaguuggaacuuauggucucaauacuuuuaccaauauggaaguacaguuaauucgucaaauggaaagcgaaggaauuuuccuuccaagcgaacuagaaacgccaaaucucgcugaaagaguucuagacuggcuugaaaaacauggaacggaacgucuuaaacgaauggcgaucaguggugacgacugugucguaaaacccauugaugauagauuugcuacagccuuaauagcuuuaaaugacaugggaaaggugcgaaaagacaucccucaaugggaaccaucaaaaggauggaacgaauggcaacaaguuccauucuguucucaucauuuucaucaauugauaaugaaggaugguagagaaauuguuguaccaugucguaaccaagacgaauuaguagguagggcaagaguaucacaaggagcgggcuggagucucagagaaacagcguguuuaggaaagucuuacgcccagauguggcagcucauguacuuccauagaagagaucugagacuugcugcgaaugcuauauguucagcugugccaguagacuggguacccacaucucguacaacauggucuauucaugcacaccaucaguggaugacaacugaagauaugcugaguguguggaaucgagucuggauagaagagaauccguggauggaagauaagacacauguuaguagcugggaggaaguaccuuaucuuggaaaacgcgaggaucaauggugcgggucccuaauuggauuaacagcaagagcaacaugggcaaccaauauucaaguagcuauuaaccaggugagaagauuaauaggaaaugaaaauuaucuagacuauaugaccagcaugaaacgauuuaaaaacgagagugauccggagggggcauuaugguaa

SEQ ID NO: 21395 - RNA, 9879 nt, Artificial Sequence
  derived and/or modified CDS sequence (opt6) from DENV-1__FJ410188__SS-prME
ucugucacaauguuauugaugcucuugccaacaguacuggcauuccauuuaacuacuagagggggugaaccucacaugauaguuucuaaacaagaacgaggaaagagcuuacuauucaaaacuagcgcuggggucaacauguguacauuaaucgcaauggacuuaggugaauugugugaagacacuaugacauauaaaugcccgagaauaacggaagcagaacccgaugaugucgauuguugguguaacgccacugauacuuggguuacuuacgguacgugcagucagacgggugaacaucguagagauaagagaagugucgcauuagcuccacacguuggguuaggacuagaaacccgaacggaaaccuggaugagcagugaaggugccuggaaacaaauccaaaaagucgaaacaugggcacuacgacauccuggguucacagucauagcuuuauuucuagcucaugcuauagggacaaguaucacucaaaaaggaaucauauuuauauuacuaauguuagugacaccuaguauggcaaugagauguguaggaaucggcaaccgggacuucguggaaggacucaguggcgcgacgugggucgaugucguacuugaacaugguaguugugucacaaccauggcgaaaaacaaaccuacauuggacauagaacuccuaaaaacggaaguuaccaaccccgcuguauuaagaaaauuguguaucgaagcaaagauuaguaacacuacgacagacucgcgaugucccacucaaggggaagcaacacuuguagaagaacaagacgcaaauuuuguuugcagacggacuuuuguagacagagggugggguaaugguugcggccuauuugggaaggguuccuuacucacaugugcaaaauuuaaauguguuaccaaauuagaagguaaaaucguacaacacgaaaauuugaaauauaguguaauuguuacuguacacacaggugaucaacaccaaguagguaacgaaaccacagagcaugguacaauugcaacaauaacaccucaagcaccaacaucagaaauacaacuuacagauuacggggcauuaacacuugauuguucaccaagaacaggccuugacuuuaaugaaaugguacuauugacaaugaaggagaaaaguugguuaguacauaaacagugguucuuagauuuaccuuuaccauggacaucgggggcuuccacaagucaagagacauggaaccgacaagacuugcuagugacuuuuaagacagcacacgcuaagaaacaagaaguugucguuuugggcagccaagagggugcgaugcacacugcacuaacaggugcgacagaaauccaaaccaguggaaccaccacaauauuugcaggacaucuuaaauguagacucaaaauggacaaauugacuuuaaaaggaaugucguaugucauguguacagguaguuucaaacuggaaaaggaaguagcagaaacacagcauggcaccguauuagugcagguuaaauacgagggaacagaugcgccgugcaagaucccauuuuccacccaagacgaaaaagguguuacucaaaauggaaggcugaucacagcuaacccaaucguuaccgacaaagaaaaaccaguaaauauagaaacagaacccccguuuggagaaucauauauagucgugggagccggagaaaaagcauuaaaguuaucuugguucaagaaaggaucuaguauugggaagauguuugaagcaaccgccagaggggcucgccgcauggcaauuuugggugacacggcaugggauuuuggaagcauuggagggauguucacgagugucgggaaacuuguucaucaggucuucgggacggcauacgguguucuauuuaguggagugaguuggacuaugaagauagguauaggaauauuacuaacgugguugggcuuaaacucaagaagcacaucuuuaucaaugacguguauagccguaggaaugguuacccuuuaucucggcguuaugguacaagcagacucuggauguguuaucaacuggaaaggacgugaacugaaaugcggaagcggcaucuuuguaaccaacgaaguucacacguggacagaacaauacaaguuccaagccgacaguccaaaaagauuaucggcagcgauaggaaaagcaugggaagaagguguaugcggaauuaggucagccacacgacucgagaauauaauguggaaacaaaucagcaacgaauuaaaucauauucucuuagaaaaugacaugaaauucacaguugucgugggcgaugccaguggcaucuuagcacaaggcaagaaaaugauaagaccucaaccaauggaacauaaauauaguuggaaaucaugggguaaggcuaaaaucauaggugcagauauccaaaauacuaccuucauaauagacgggccagauacgccagaauguucagaugaccaaagagcauggaauauaugggaggucgaagauuauggauuuggcaucuuuacaacaaacauauggcucaagcuaagggauaguuacacgcaaaugugugaucacagauugaugagcgcugcuauuaaggacuccaaagcaguacaugcggacaugggauauuggauagaaagugagaaaaaugaaacauggaaauuagcacgagcuucauucaucgagguaaaaacauguauauggccuaaaucccacacgcucuggucaaacggaguguuagaaagugaaaugauuauaccaaaaauauauggagguccaauuucgcagcacaacuauagaccaggcuauuucacgcagacagcuggaccuuggcacuuaggcaagcuagaauuagauuucgaccuaugcgagggaaccacagugauaguugaugaacauugugggaacagaggaccaucccuuagaacgacaacaguuaccgggaaaaucauacaugaaugguguuguagaagcugcacccugcccccgcuaagauucagaggugaggacgguugcugguaugggauggaaauaaggccagucaaagaaaaagaagagaaucuaguacgcucaauggucagcgcaggaucgggcgaaguugauucguuuagccuaggaauauuauguguuucaaucaugauagaagaaguaaugcgaagccgauggucaagaaaaaugcuaaugacagguacauuagcgguauuucuauuacuaauaaugggacaauuaacauggaacgaccuaauuagacuuuguauaaugguaggagcgaaugcuucagauaggaugggaauggggaccacguauuuagcucugauggcuacauuuaagaugagaccaauguucgcaguaggacuacuauuccguagguugacuuccagggagguuuugcuuuuaacaaucggucuaucauugguugcaucuguagaacuuccuaauucauuagaagaacugggagauggucucgcaaugggaauuaugaugcuaaaacuuuuaacugaauuucaaccacaucaacuauggacgacacuacucagucuuacauucauaaaaacaacacucucuuuagacuaugcuuggaaaacaauggcaauggccuugaguauagugagcuuauucccauuaugcuuaucuacuacgagucagaagacuacaugguugcccguuuuauuaggcaguuucgguuguaagccucugacuauguucuuaauuacagaaaacaagauauggggcaggaaauccuggccucucaacgaaggaauaauggcaauagguauugucucgauucuuuugaguucacuuuuaaagaaugacguaccacucgcugggcccuuaauagccgguggaaugcuaauugcguguuacgugauaucagggaguucagcugaccuauccuuagaaaaagcagcagaaguaaguugggaagaagaggcggaacauucaggaaccucacauaauaugcuuguagaaguucaagaugacggaacuaugaagauuaaagacgaagaacgcgaugacacgcuaacgauucuauugaaagcuacuuuacuggcaguuucugggguuuauccaaugucgauaccagccacucuuuuugugugguacuuuuggcagaagaagaaacaaaggagcggcguguuaugggauacuccaucuccgccggaagucgaaagagcuguacuagaugacggcaucuacagaauacuacagaggggccuauuaggaaggucccaggucggggucgggguauuccaagacgguguauuucacacuauguggcacgugacaaggggugcaguacuaauguaccagggaaaacgccuagagccaucaugggcuaguguuaagaaagaccuaauaucuuauggaggaggguggcguuuucagggaaguuggaauacgggcgaggaaguccagguaauagcgguugaaccaggcaaaaauccuaaaaauguccaaaccacuccaggcacuuucaaaacuccagaaggagaaguuggugcgauugccuuggacuucaaaccuggaacaucugguucaccgauaguaaauagggaaggaaaaauuguaggguuauauggaaauggaguaguaacaacgucagguacauauguaucggccauagcccaagccaaagcgucacaggaaggaccguuaccggagaucgaggaugagguguuucggaaaagaaauuugacuauaauggaucuacacccugguaguggcaaaacccgaagauauuuaccagcaaucgugagagaagcaauaaaaagaaagcuacgcacccuuauacuagcaccaacgagaguuguagccucugaaauggccgaagcgcucaaaggcaugccuauacgauaccaaaccacugcuguaaaaagcgagcauacaggccgcgaaaucguugacuuaaugugccacgcaacguucacuaugaggcuacuuucgccaguacgaguaccgaacuacaacaugauuauuauggaugaagcccauuuuacagauccugcuucgaucgcugcacgaggauauauuucaaccagagugggaaugggcgaagcagcagcgaucuuuaugacagcaacaccuccuggaagcguagaagcguuuccccaauccaaugcgguuauacaagaugaagaacgagacaucccugagagguccuggaacucuggguacgacuggaucacagacuuuccgggaaagacaguaugguuuguuccgaguaucaaaaguggcaaugauaucgccaauugcuuaaggaaaaaugguaagagaguuauucaacuauccagaaagaccuucgauacggaauaccagaaaaccaaaaauaacgauugggauuaugucguuaccacugauauaucagagaugggagcaaauuuuagagccgaccguguuauugacccgagacgaugccucaaaccagugauauuaaaagauggaccagagcgcguaauauuagccgggcccaugccugucacuguagcaucggcugcacagagaagaggucgcauuggaaggaaucagaacaaagagggugaucaauaugucuauaugggacaaccauuaaauaaugaugaagaccacgcgcauuggacugaagcaaaaauguuauuggacaauauaaacacaccagaaggaauaauaccagcguuauuugagccagaaagagaaaaaucugcggcuauugauggagaauaucgcuuaagaggcgaagcaagaaagacauuuguugagcucaugagaagaggugaccuacccgugugguugucguauaaaguggcaagugaaggcuuucaauacucagauagaagaugguguuuugauggggagcgaaauaaccagguauuggaagagaacauggauguagaaauuuggacaaaagaaggagagcgaaagaaacuacgaccgcgaugguuggacgcaaggacauauagugacccacuugcauugagagaauuuaaagaguuugccgcagguagacgcucgguuuccggagaccuaauccuugaaauuggaaaauugccucaacaccucacacuacgcgcccaaaacgcccuagauaaucuagugauguuacauaauuccgaacaaggugguaaagcguacagacaugcaauggaagaacucccagauacgauagaaacuuuaauguuauuggcacuaauagcaguacuaacaggcgggguuacuuuguucuuccuuucagguaagggcuuaggaaagacaaguauuggacuucuuugcguaauggcuucaucugcauuacuguggauggcaucuguggagccacacuggauagccgccuccauaauauuagaguucuuucuuaugguacuguuaauaccugagccagauaggcaaagaacuccacaagauaaccaacuagccuacgugguaauuggacuauuauucaugauucugaccguggcagccaaugaaaugggcuuguuggaaacgacuaagaaagauuuggggauugggcacguagcagccgagaaucaccaccaugcuacgaugcuagauguagaucucagacccgcuucugcuuggacauuauacgccguagcuaccacgguuauaacgccuaugaugagacauacaaucgagaauacuaccgcaaacaucucucucacagcaauagcuaaccaagccgcaauacuaaugggucuagacaaaggauggccuauaucaaaaauggauauuggagugccacuacuugcgcugggauguuacagccaaguaaauccguuaacauuaaccgcugcaguuuuaaugcuuguugcucacuacgcuaucaucggcccuggucuacaagcuaaagcaaccagggaagcacaaaagcguacugccgcugggauaaugaaaaacccuacgguugacgguauugucgcuauagacuuggauccaguggucuaugacgcaaaauuugaaaagcaguuagggcaaaucauguugcuuauauuaugcaccagccaaauauuauuaaugcgaacaacuugggcgcuuugugaaucuauuacauuagcaacaggaccacuaacaacuuuaugggaagguucaccugguaaauuuuggaauacaacuaucgcaguaucuauggcaaauaucuuuaggggcucauauuuagccggugccggacuggcauuuagucuaaugaaaucacuugguggaggccgacgagggacaggcgcacaaggugagacgcuuggagagaaauggaaaagacaacucaaccaacugagcaaaucagaauuuaauacauacaaaaggagcgggauaauggagguggaccgaucagaggcuaaagaaggauuaaaaagaggugaaacaacaaagcaugcgguaaguaggggaacagccaaacuccguugguuuguugagagaaaucuggugaaaccagagggaaaaguaauagauuuagggugugguaggggaggauggucguacuauugugcggguuugaagaaaguuacugagguaaaaggcuauacaaaaggaggaccagggcaugaagaaccaauuccaauggccaccuauggauggaaucucguaaaauugcacucuggaaaagauguauuuuucacaccaccagaaaagugcgauacacuucucugcgacaucggagaauccucaccaaauccaaccaucgaagaaggaaggacauugagaguuuuaaagaugguagaaccuugguuaagagguaaucaguuuugcauuaaaauucuuaaccccuauaugcccucaguagucgaaacauuagaacaaaugcagagaaaacauggagggauguuaguucgcaauccuuuaagcaggaacagcacucaugaaauguacugggugaguugugguacuggcaacauuguuagcgcuguaaauaugacuagccguauguuacucaaccgguucaccauggcucaucguaaaccaacauaugaacgcgaugucgauuugggggcuggaacaagacauguagccgucgaacccgaaguugcuaaccuugauauuauagggcaacguaucgaaaauaucaaaaaugaacauaaaucaacuuggcauuacgacgaagauaacccuuacaaaacaugggcguaucaugguaguuaugaaguaaagccaaguggauccgcaaguaguaugguaaacggcgugguacgccuacuaacgaaaccuugggauguaauacccauggugacacagauugcgaugacagauaccacaccauucggucaacaacguguguucaaagagaaaguagacacgaggacgccaagagcaaaaagaggaacugcucaagugauggagguaacugccaaauggcucuggggcuuccugagccgcaacaagaaaccaagaauauguacuagggaagaauuuacaaggaaaguaagaaguaaugccgcaauuggcgcgguauuugucgaugagaaccaauggaacuccgcaaaagaagcuguagaagacgagaaauucugggacuuaguccaucgugaaagagaacuacacaaacaagguaaaugugccacauguguuuauaauaugaugggaaagcgugagaagaaacuaggagaguucggaaaagcuaaagggucuagagcuauaugguauauguggcuuggugcacgcuucuuggaguucgaagcgcucggauuuaugaaugaagaucauugguucucgcgagaaaauucacucucgggagucgaaggcgaagggcugcauaaacuaggauacauauugagagauauuucaaaaauaccgggugggaauauguacgcugaugauacagcaggcugggauacacguauaacagaggaugauuuacaaaaugaagcuaaaauaacagacauuauggaaccggaacaugcuuuacucgcaaccucgaucuuuaaacuuaccuaucagaauaaaguaguuagaguucagagaccagccaaaaacgguacuguaauggaugucauaucacgcagagaccaacgugguaguggucaagugggaacuuauggauuaaauacguucacgaacauggagguacaauuaauccgucaaauggagucugaaggaauauucuuaccaucagaacuagaaacaccaaauuuagcugagcgaguauuagauuggcuagagaaacacgguaccgagagacuaaaaagaauggcaauaucgggggaugauuguguugucaaacccauagaugacagguuugccacagcuuuaaucgcacugaacgauaugggaaaaguaagaaaagauauaccccagugggaaccaaguaaagguuggaacgaauggcaacaaguuccguucuguucucaucauuuccaccaacuuauuaugaaagacgguagagaaauaguaguaccuugccggaaccaagaugagcuagugggucgugcaagaguaucucaaggugccggcuggucucugcgugagacggcgugucuaggaaaaaguuacgcgcaaauguggcaacuaauguauuuucaccgacgcgaccuacgacuagcggcaaacgcaauaugcuccgcaguaccagucgauuggguaccgacuucacgaacaaccuggucaauccacgcacaucaccaguggaugacuacagaagauaugcuaucgguauggaaccgaguauggauagaagaaaaucccuggauggaagauaaaacacaugugucaucuugggaagaaguaccuuaucugggaaagagggaagaccaauggugcgguucguuaaucggacuuacagcuagagcuacaugggcgacuaauauucaagucgcaauaaaucaaguuagaagguuaaucgggaacgaaaauuaccuugacuauaugacaaguaugaaacgcuuuaaaaacgagucugauccugaaggagccuugugguaa

SEQ ID NO: 21396 - RNA, 9879 nt, Artificial Sequence
  derived and/or modified CDS sequence (opt6) from DENV-1__FJ478458__SS-prME
agcguaacuaugcuguuaauguuauuaccaacggcucuagcauuucaccuuacgacccgaggaggagaaccacauaugauaguuucuaaacaagaaagaggaaaaucacuauuauuuaaaacuucggcagguauaaauauguguacuuuaauugcuauggaucuuggagaacuaugugaagacacuaugacuuacaaauguccaaggaucacagaagcagaaccugaugacguagauuguugguguaaugcaacugacacauggguaaccuacgggacgugcagccaaacaggggaacaccggagagacaaaagaagcguagcacucgcaccacauguaggguugggauuagaaacacgaaccgaaaccuggaugaguagugaaggugcguggaaacaaauccaaaaaguagaaacgugggcauugaggcaccccggguuuaccguaacugcauuguuccuggcucaugcuauuggaacgaguauaacacaaaaagguauaauauucauuuugcugaugcuagucacacccucuauggccaugagaugcguuggaauagguaauagggacuuuguugaaggccucaguggugcgacauggguagacgugguguuagaacauggaagcugugugacuacuauggcaaaagauaaacccacacuggacauugaacuauuaaaaacggaaguaacaaauccagcuauacuacgaaaacuuugcauugaagcuaaaauauccaauacaacuaccgacucucgaugcccuacucaaggugaagcaacacugguugaagaacaggauucuaauuucguaugccguagaacuuuugucgaucgaggaugggguaacggauguggguuguuugguaaagggucguuacuaacgugugcuaaauuuaaguguguaacgaaguuggaagggaagauaguacaauacgaaaaucugaaguauuccgugauuguuacagugcacacuggggaccaacaucaagucgguaaugaaaccacagaacaugguacuauagcgacuauuacaccccaagcuccaaccucggaaauucagcuuaccgauuauggagcauugacauuagauuguuccccacgaacgggucuugauuuuaaugaaaugguacucuuaacuaugaaggagaaaaguugguugguucauaaacagugguuuuuagaucuaccacuuccuuggacuucuggagccuccacgagccaagaaacauggaauagacaagauuuguuaguaaccuucaaaacagcgcacgcgaagaaacaggaaguagugguacuagguucgcaagagggagcaaugcauacagcccuaacaggcgcuacagaaauacaaacguccggaacaaccacaauuuuugcuggccaucuaaaauguagacuaaagauggauaaacugacacugaaaggcaugucauacguuaugugcacaggaaguuucaaacuagagaaagaggucgcggaaacacagcauggaacaguacuuguccagguuaaauaugaaggaacagaugcaccaugcaaaaucccuuucagcgcacaagacgagaaaggcgugacacaaaauggcagacuaauaacagcuaauccuauaguaacagauaaagaaaaaccaguuaacauugagacagaacccccuuuuggagaaucuuauauaguuguaggagcuggugagaaagcauuaaaacuaucaugguuuaaaaaggguaguucaauaggaaaaauguucgaggcuacagcucguggggcuaggcgaauggcaauauugggugauaccgccugggacuuuggaaguauagguggaguuuucacgucaguaggcaaauuaguucaucaaguuuucggugcggccuaugguguauuauuuucugggguuaguuggacuaugaagauugguauuggaauauugcuuacgugguuggguuuaaauagccgcucuaccucauugucaaugacaugcauagcgguggguaugguuacuuuguauuuagguguuaugguacaagcggacuccgguugugucauaaauuggaagggccgcgaacuaaaaugugguucugguauuuucguuacgaaugaagugcauacauggaccgaacaguauaaguuccaggcagacucacccaagagacuaucagcagcaaucgguaaggcuugggaggaaggaguuuguggaauaaggagugcgacaagguuggaaaacauuauguggaaacaaauuucgaaugaguuaaaucauauacugcucgagaaugauaugaaguuuacuguaguggucggcgaugcuaauggcauucuggcgcaaggaaagaaaaugauacggccucagccaauggaacauagauacucguggaaaucauggggcaaagcuaaaauuauaggcgccgacauacaaaacacuaccuuuaucaucgauggaccagauacucccgaguguccagacgaucaaagggcguggaacauaugggagguugaagauuauggauuuggcauauuuacaacaaacauuugguuaaaacuuagagacucauauacacagaugugugaucauagauugaugucagcugcaauuaaagacucaaaagcuguucaugcugauaugggauacuggaucgagucggagaaaaaugaaacauggaaacuugcgagggcuucauuuaucgaaguaaagacuuguauuuggccgaaaucccacacacuguggucuaacggggugcuagaaagcgagaugauaauaccaaaaauuuaugggggacccauuagucagcauaacuauagaccaggauauuuuacccagacagcgggaccauggcaucuaggaaaacuugaacuugacuuugauuugugugaaggcaccaccguaguaguagaugaacauugugguaauagagguccgucucuuagaacuacgacaguaacggggaaaauaauucaugaaugguguuguaggagcuguaccuuaccaccccuacgauuccgaggcgaggauggguguugguaugggauggaaauucgaccagucaaagaaaaagaagaaaaucuaguacgauccaugguuuccgcagggagcggagaaguggauucauuuaguuugggaauacucugcguaaguaucaugaucgaagaaguuaugagaucucgcugguccagaaaaauguuaaugacagggaccuuagcuguauucuuauugcugauuaugggucagcuuacauggaacgaucuaauucgccuuugcauuauggucggcgcuaacgcaucagauaggaugggaauggggacgacguaccucgcauuaauggcaacauuuaaaaugcgaccaauguuugcuguaggauuacuauuucguagacuaacaagccgagagguuuuacugcuaacaaucggauuaaguuuggucgcuucagucgaguuaccaaacucuuuagaagaguuaggagacggacuagcaaugggcaucaugauguuaaaauuauuaacugaguuucaaccccaucaacuauggacgacuuuacugucacucacuuuuauaaaaaccacguugucacuagacuaugcauggagaacaauggcuaugguauugucuaucgcaagucuauucccccuaugcuuaaguacaacaagucaaaagacaacgugguuaccaguacuacuugguucauucgguugcaaaccucuaacuauguuuuuaauaacagagaauaagauaugggggcgaaaaucguggccacuaaacgaggguauaauggcgauuggcauaguuaguaucuuacucaguucgcuuuugaaaaaugaugugccgcuagcaggcccacuaauugcaggaggaaugcuaauagcauguuacguaauaagcgguucuucagcggauuugagucuagaaaaggcugcugaagugaguugggaagaagaagcugagcacucaggcacaagucauaauauuuugguagaaguacaagaugacggaacuaugaaaauaaaagacgaagaaagggaugauacgcugacaauuuuacuaaaggcuacauuacuagcaguaucugguguauacccuaugaguauaccggcaacacuuuuuguaugguacuucuggcagaaaaagaagcaacgaucaggaguacugugggacacgccuucaccacccgaagucgaaagagcuguuuuggacgaugguauuuacagaaucuuacaacguggacuuuuagguagaagucagguaggugucgguguuuuccaagaugguguauuucauacaauguggcauguaacaaggggagcgguguuaauguaccaaggaaagcgguuggaaccaucaugggcguccguuaagaaagaucuuauauccuacggugguggauggagauuccaggguucuuggaauacaggagaggaagugcaaguaauugcaguggaaccugggaagaauccaaagaauguucaaaccacaccuggcacauucaagacgccggaaggagaaguaggagcuaucgcucuugauuuuaaacccggaacgagcggaagcccuauaguaaaucgagaaggaaaaauuguuggucuauacgguaauggaguggugacaacgucagggacauauguuucagcuaucgcacaggcuaaaacaucacaggaggggccgcuuccugaaauugaagaagaaguauuuaagaaaagaaaccuuacaaucauggaucuccauccugguuccggaaaaacccgucgguaucuaccugcaaucguaagagaggcuauuaaaagaaaauuaagaacacuaauuuuggcuccuacuagaguugucgcuucugaaauggcagaagcucuaaaaggcaugccuauaagauaucagacuacggcggugaagucagaacauacggggagggaaauaguggaccuaaugugucacgcgacauuuacgaugcgauuacuaucaccagugagaguuccaaauuacaacaugauuauaauggacgaagcgcauuucacugauccagccagcauagcggcuagagguuacauuucaacucgaguggguaugggagaagcggccgcgauauuuaugacagcuaccccuccugguucgguggaagcauuuccacagaguaaugcaguuauccaggacgaagaaagagacauaccagaacgaucuuggaacucgggguaugacuggauuacagacuuuccuggcaagacuguaugguuuguaccaucaaucaaaucaggaaacgacauagcgaauugcuugaggaaaaauggaaaacgaguuauacagcuaucaagaaagacauuugauacagaguaucagaaaaccaaaaacaacgauugggacuacguugugaccacagauauaucagaaaugggugcaaacuucagagcugaccgagugaucgacccuagaagaugccuaaaacccguaauacuaaaagacgguccagaaaggguaaucuuggcuggcccaaugccgguaacaguugcaagcgccgcucaaaggcgaggacguauaggccgaaaucagaacaaagaaggcgaccaguacguauacaugggacaaccucuaaacaaugaugaagaucaugcccauuggacagaagcaaaaaugcuucuagauaauaucaauacgccggaaggaauaaucccagccuuauucgagccagaacgagaaaagucugcagcuauugauggugaauacaggcuucgcggagaagcgcgaaaaacuuuuguagaauugaugcggcgaggagaucugcccguuugguuaaguuauaaagucgcuagugaaggguuucaauacucggauagacgauggugcuucgauggagaaagaaacaaucagguucucgaggaaaauauggacguugaaauauggacuaaggagggagaaagaaagaaacuacgacccagaugguuagaugcacgaacuuacucagauccguuggcauuaagagaauuuaaagaauuugcugccggaagacgaucgguuagcggugacuuaauucuagagaucgguaaauugccacagcacuuaacauuaagagcucagaacgcucucgauaaccuaguaaugcuccauaacagcgaacaaggagggaaagcauacagacaugcuauggaggaauuaccugauacaaucgaaacgcucaugcuccuggcguugauugcaguacuuacgggcggcguaacguuguuuuuccugucagguaaaggauugggcaaaacgucuauaggucucuuaugcguaauggcaucaucagcucuauuguggauggcgaacguagaaccucauuggauugccgcaagcauuauccuggaguuuuuccuuaugguauuauugauucccgagccagacagacaaagaacuccacaagacaaccaacucgcauaugucguaauaggauuauuguucaugauccucacuguugccgcgaaugaaaugggguuguuagaaacuacuaagaaagacuuaggaauaggccauguugcugcugagaaccaacaucaugcuacgauguuagauguagauuuaagaccagcaucagcauggacguuauaugcugucgcuaccacuguaauaacuccaaugaugagacacacgauagagaacacuacugccaauauuucacuaacagcaauagcaaaccaagccgccauauuaauggguuuggacaaagguuggccgauaucaaaaauggauauaggggucccacucuuagcacuagguugcuauucacaaguaaauccacucacccuaacugcagcaguuuuaauguuaguggcgcauuaugcuauaauuggaccaggauugcaagcgaaagcuacucgugaagcacaaaaacgaacugccgcaggcauaaugaaaaauccgacaguagaugggauaguagcuauagauuuggauccuguaguuuacgaugcgaaauucgaaaaacaauugggccaaauaauguuauugauauuguguacaucucaaauacuguuaaugagaacaacgugggcacuaugcgaaucgauuacguuagcaacggguccuuuaaccacacuaugggaagguucgccgggcaaauucuggaauacaacuauugcagucucaauggcaaauauauucagagggaguuaucuagccggugcaggauuggcauuuucuuuaaugaaaucacuaggcggaggaagacgaggcacuggggcucagggugagacauugggugagaaauggaagagacaacuaaaccagcuaucuaagucggaguuuaacacauacaaaagauccggcauuauggagguagauagaucggaagcuaaagaaggacucaaacgcggagaaacaacgaaacaugcagucagcaggggaacugccaaacugagaugguuugucgaacgcaaucuaguaaaaccagaagggaagguaauagacuugggaugugggagaggaggauggagcuacuacugcgccggacucaagaaaguuacggaagucaaaggauauacuaaaggagggccuggucaugaagaaccaauaccuauggcaacguaugguuggaacuuaguaaaauuauauaguggaaaagacguauucuuuacaccaccggaaaaaugcgacacucuccuuugugauauaggagaauccuccccaaauccaacgauugaagaaggacgcacccuuagggucuuaaaaauggucgaaccuuggcucaggggcaaucaauucuguaucaaaauacuaaauccguauaugccauccguaguugaaacuuuagaacaaaugcaacggaagcacgguggaauguugguaagaaaccccuuaucucgaaauucgacacacgaaauguauugggucucguguggaacagguaauauaguaagcgcaguaaauaugacaucaagaauguuauugaaucguuucacaaugacacaucggaaacccacguaugaaagagauguugaccuaggggccgggacaagacacguagccguugagcccgaaguugccaaucucgacaucaucggucaacguauugaaaauaucaaaaaugaacauaaguccacuuggcauuaugacgaagauaauccguauaaaacaugggcuuaccauggaucguaugaagucaaaccaucagguucugccaguucaauggugaaugguguagugcguuuauugacuaaaccaugggauguaauacccaugguuacucaaauugcaaugacggauaccacuccuuuugggcaacaacgaguuuucaaagaaaaaguagauacccggacaccaagagcuaaaaggggaaccgcucaaauaauggaagugacggcaaagugguuauggggguuucucucaagaaauaagaaaccacggaucugcacaagggaggaguucacuagaaagguccgaucuaacgcagcuauaggagcuguauucguagaugaaaaucaguggaacucugcuaaggaagcaguagaagacgaaagguuuugggaccuaguacauagagaaagggaacugcacaaacaaggaaaaugcgccacguguguauauaauaugauggguaaaagagagaagaaauuaggagaguucgguaaggcaaagggaaguagggccaucugguauaugugguuaggcgcccgcuuucuugaauuugaagcucuuggguuuaugaacgaagaucauugguuuucgagagaaaacaguuuuucagggguugaaggugaaggacuucauaaauuaggauauauacuaagagauauaucuaagauaccgggaggcaauauguaugcggaugauacggcaggcugggauacgcguauaacggaagaugauuuacagaaugaggcgaaaauuacugauauaauggaaccagaacaugcucuauuggcuaccaguauauuuaaacuuacauaucaaaauaaaguuguccgcguucaaagaccagccaaaaaugggacaguuauggacguaaucaguaggcgagaucaacgcgggucuggacaagugggaacauacggccuaaauacauucacgaauauggaaguacaacuaauccgucaaauggagagcgaaggaaucuuuuuaccgucagaauuggagacaccaaaucuggccgagagaguauuagacugguuagagaaacauggaacugaaaggcuaaaaagaauggcuauauccggugaugauuguguuguuaaaccuguagaugaucgguuugcaacagcuuuaauagcauuaaaugauaugggaaaaguuagaaaggauauuccucaaugggaaccaagcaaagguuggaaugacuggcagcaaguacccuucuguucacaccauuuucaccaacuaauaaugaaggauggucgggaaauaguagucccguguaggaaccaagacgaacucguaggucgugcaagaguaucacaaggagcugguuggucucuacgggagaccgccugccucgguaaauccuacgcacagauguggcaacuuauguauuuccaccguagagauuuacggcuggcugcuaaugcaauaugcucugcagugcccguugauuggguuccaaccagcagaacuaccuggagcauacaugcacaucaccaauggaugaccacagaagauaugcuauccguuuggaauagagucuggaucgaggaaaaucccuggauggaagacaaaacacauguaucgucgugggaagaaguuccauauuuggguaaaagggaggaucaaugguguggaagucuaauaggcuuaacagcccgugcaacuugggcaacaaacauacaaguagcuauuaaccaaguaagacgccuuauagggaacgagaacuaccucgacuauaugacuucaaugaaacguuucaagaacgaaucagauccagaaggggcguuaugguaa

SEQ ID NO: 21397 - RNA, 9879 nt, Artificial Sequence
  derived and/or modified CDS sequence (opt6) from DENV-1__FJ410190__SS-prME
uccgucacuauguuguuaauguuauugccgacggcguuagcguuucaucuuaccaccagaggaggagaaccgcacaugaucgucucgaaacaagaaagaggcaaaagucuccuuuuuaaaacaaguguagguauuaacaugugcacacuaauagcuauggaucuaggcgaacucugcgaagauacaaugaccuacaaaugcccuagaauuacggaagcagaaccggaugacguggacuguugguguaacgcaacugauacauggguaacguauggaacauguucccaaacuggugaacacagaagagauaaacguucaguagcauuggcaccacaugucggucugggccuugaaacaagaacagagacauggaugagcagugaaggagcauggaaacaaauucaaaaaguugaaacgugggcauugagacacccaggauuuacaguuauugcgcuguucuuggcgcaugcaauagguacaaguauuacacagaaaggaauuauauucauacuacuaaugcuagucacaccaaguauggccaugcguugcguuggaauagggaaccgcgacuuuguagaaggacuaaguggagcuacuuggguagauguagugcuugaacaugguucgugcgucacgacaauggccaaagacaaaccaacauuagauauugaauugcuaaaaacugagguuacuaaucccgccguauuaagaaaacuauguauugaggccaaaaucucaaauaccacaaccgauaguagauguccaacccaaggugaagcaacccuuguugaagaacaggauaguaauuuuguuugucggcguacguuuguggacagaggauggggcaacgguuguggauuguuuggcaaagggagucuacugacaugcgccaaauuuaaauguguaaccaaauuagaagguaaaauaguucaauaugaaaaucuaaaauacuccguaauaguaacaguccauacaggcgaccagcaucaaguuggaaaugaaacaacagaacacggaacgaucgcaacaauuacaccccaagcacccacaagugaaauccaauuaacugauuauggcgcacugacacuggauuguucuccacgaacaggucuugauuucaaugaaauggucuuacugacaaugaaagagaaaucuugguuaguccauaaacaaugguuucuagaucuaccccuaccauggacuucgggagcauccacaucacaagaaacguggaacaggcaagacuugcuaguaacauuuaaaacagcucacgccaagaaacaagaaguagucguccuagguucacaagaaggugccaugcauaccgcacuaacaggagcaacagagauacaaacuagcggaacaacaaccauauuugcuggacauuugaaaugucgccuaaaaauggacaaacuaacguuaaaagggaugaguuauguaaugugcacaggaaguuucaaauuagaaaaagaaguugcagaaacccagcacggaacgguguuaguccaaguaaaauacgaaggcaccgaugcucccuguaaaauaccauuuucugcccaagaugaaaaaggaguaacacagaaugggagauuaauuacagccaacccuauugugacggacaaagaaaaacccgucaacauugagacagaaccuccauuuggagaaucauacauaguaauaggagcaggagaaaaagcucuaaaacuuuccugguuuaagaaaggaaguucaauugguaaaauguucgaagcuacagcucgaggagcuagacguauggccauuuuaggcgacaccgcaugggauuuuggaucuauugguggagucuuuacaucuguugggaaauuaguacaccagguauuuggugcugcguacgggguacuauuuucagguguuagcuggacaaugaaaauaggcaucgguauuuuguuaacguggcuaggcuuaaauagucgaaguaccucauuaaguaugacuuguauagccgugggcauggucacgcuguaccuagguguaaugguucaggcagauucagguuguguaauuaacuggaaaggccgggagcuuaagugcgggagcggaauuuucguuacaaacgagguccauacguggacagaacaauauaaauuccaagccgauaguccuaagcggcucucugcagcaauaggaaaggcuugggaagaaggaguaugugguauuagaagcgcaacuagacuugaaaauauaauguggaaacaaauaaguaacgaacuuaaucauauccugcuugaaaaugauaugaaauuuacgguuguuguuggagacgcuaauggaauacuugcucaaggcaagaaaaugauuagaccacaaccaauggaacaccgguacaguuggaaaaguugggggaaagcuaagauaauaggcgccgauauucaaaauacaaccuuuauaauagacggaccagauacucccgaauguccagaugaucaaagagcuuggaauauaugggagguagaggauuacggcuuuggcauauucaccacgaacaucugguuaaaguuacgugacuccuacacccagaugugugaccaucggcugaugucagcggcuaucaaagacucaaaggccguacaugcugauaugggauauuggauagagucagaaaagaaugagacauggaaauuagcucgggccucuuucauagaggugaaaacauguauuuggccaaaaucccauacauuauggaguaaugggguccuagaaagcgaaaugaucaucccgaaaauuuauggcggaccuauuagucaacauaacuaccgaccaggauacuucacacagaccgcagguccuuggcaccugggaaagcuagaacuugacuucgaccuaugugaaggaacuaccguggugguugaugaacacugugggaacagggggccuucauuacgaacuacgacaguuaccgguaaaauuauacacgagugguguugccguucuuguacacuaccgccauuacguuuuaggggagaagacgguuguugguauggaauggaaauucgaccagugaaagaaaaagaagaaaaucuaguaaggucaauggucagugcugguucaggagaagucgacagcuucucacuaggaauauuaugcgugaguauuaugaucgaagaagucaugcgaagccgauggucccgaaagaugcuuaugacagggacauuagccgucuuucuacuguuaauuaugggucaacuaacuuggaacgaucucauccgucuauguauaauggucggugcaaaugcaucagauagaaugggcaugggaacaacuuauuuggcauugauggcgacuuuuaagaugagaccuauguuugcuguuggccugcuauuccgaagacuaacuucgagggagguguuguuguuaacuaucggccuaucauuaguggccucuguggaacuaccuaacucauuagaggaguuaggugauggacuugcuaugggaauuaugaugcuuaaguugcuaacagaauuucaaccucaucaauuguggacuacauugcuaucauuaacguucauaaaaaccacccuaaguuuggauuacgccuggcgcacaauggcgauggugcucucgaucguuucgcuauucccguuaugucuuaguacuacaagucagaaaacaacauggcugccagugcuacuaggaaguuucggguguaagcccuuaacuauguuuuuaaucacagaaaacaaaauauggggaagaaagucguggccucucaaugaagguauaauggcaauugguauugucucaauccucuuaagcagucuacuaaagaacgauguaccacuggcugggcccuuaauugccggugguauguuaauugcguguuacguuaucucagguucaucagcagaucugucccuagaaaaggccgcagagguaucuugggaagaagaagccgaacacagugguacaucucacaacauccugguugaaguucaagacgacggcacaaugaaaauuaaagaugaagaacgugaugauacguuaaccauauuacucaaagcaaccuuacuagcagugucgggaguguacccgaugaguauuccagcaacccuauuuguaugguauuuuuggcagaagaagaaacaaaggucugguguucuuugggacacaccauccccacccgaaguagaaagagcaguucuugaugauggcauauauaggauuuuacaaagaggauuacuaggucgcucccagguuggaguagguguuuuucaagacggugucuuucacaccauguggcauguaaccagaggagcaguauugauguaccaaggaaaaagguuagaaccaagcugggccucaguuaagaaagaucuaauaucguauggagggggcuggcgauuccaaggcaguuggaauacaggggaagaaguucaagucaucgcaguagagccgggcaaaaaucccaagaacguacaaacuacgcccggaacauuuaaaacacccgaaggagaagucggugcaauugcuuuagacuuuaaaccgggcacaucaggaucuccaauaguuaaucgugaagaaaagauaguuggacuuuacgguaaugguguuguuacgacaucgggaacuuauguuuccgcaauagcucaagccaagaccucgcaagaaggcccgcuaccagaaauagaagaugaaguauuuaagaaacgaaaucucacuauaauggaccugcaucccggcucugguaaaacucgucgguaccuccccgcuauuguuagagaagcaaucaaaaggaaauuaagaacguuaauauuagccccgacucgaguaguggcuucugaaauggccgaggcuuugaaggggaugccgauuagauaccaaacaaccgcagugaagucagaacauacuggaagagaaauaguugaucugaugugccacgcuacuuucacuaugcgauuacuuucaccugugagaguaccaaauuauaacaugauaaucauggaugaggcucauuucacugauccugcgaguauugcagcccguggguauauaaguacaagaguuggcaugggagaagcagcugcaaucuucaugacugcgacaccaccaggaucagucgaagcguucccucagagcaaugcuguuauucaggacgaagagagagauauuccagagcgaaguuggaauagcgguuaugauuggauaacagauuuuccaggaaaaacaguaugguuuguaccaucaauaaaaucagguaacgauauagccaauugcuuacgaaagaacggcaagagaguaauccaauuaucaagaaagacauuugacacagaguaucagaaaacgaaaaauaaugacugggauuacgugguaacaaccgauaucagugaaaugggugcuaauuucagagcagauagaguuauagaucccagacguuguuuaaaaccuguuauccucaaagauggaccagaacggguaauucuugcugguccuaugccugucacuguagcuagcgcugcacagcgacguggcaggaucggaagaaaucaaaacaaagaaggagaucaauauguauacaugggccaaccgcucaauaacgaugaagaucaugcccauuggacagaggcgaagauguuacuggauaauauaaacacaccagagggcauaauuccagcacuauucgaaccggaacgcgaaaaaucagcggcuauagacggcgaauauagauugagaggagaagccagaaaaacauuuguagaauuaaugcggcguggcgaucugcccguuuggcuaaguuauaaggucgcauccgaaggguuccaauauagcgacagacgcugguguuuugauggagagagaaauaaucaagucuuagaggagaacauggacguagaaauauggacuaaggaaggggaacgcaaaaagcuaaggccuagguggcuagacgcucguacuuauucugacccguuagcucuacgagaguucaaagaguucgcagcgggcaggagauccguguccggcgaucuuauucuagagauuggaaaauuaccucaacaccuuacgcuuagagcccaaaacgcauuggacaauuuagucaugcuacauaacucggagcagggagggaaagccuaucgccacgcaauggaagaacuccccgacacaaucgaaacacuuauguuacuagcauuaauugcuguccucacaggaggaguuacucuauuuuucuuaaguggcaaaggacuugggaaaacaaguauuggauugcuaugcguuauggccaguucagcacuucucuggauggcgaacguagagccacauuggauugcggcuagcauuauucuagaguucuuucuuaugguacugcucauccccgagccagaccggcaaagaacaccacaggacaaccaacuugcuuauguaguaauaggcuuauuguucaugauacuaaccguggcagcuaacgagauggguuuguuagaaaccacuaagaaagaccuaggaaucggccacguggcagcagagaaucagcaacacgccacuauguuggauguugaucuaagaccagccagcgcuuggaccuuauaugcagucgcaacaacuguuauaacacccaugaugcgccauacaauagaaaauacaaccgcaaauauaucucugacagcgauagcaaaucaagcugcaauauugauggggcuugacaaaggauggccaaucuccaagauggauaucgguguuccguuacuggcauuaggauguuacagccaaguaaauccccuaacuuuaacggcugcagugcugauguuaguagcucauuaugcgauuaucggacccggauuacaggcuaaagcuaccagagaagcacagaaacguacagcagcagguauaaugaaaaacccgacggucgauggaauaguagcaauagaucuagacccugugguguaugaugccaaauucgagaaacaacucgggcaaauaaugcuucugauucuauguacaucgcaaauacuccuuaugaggacgacaugggcacuuugcgaaucuaucacucucgcaacgggaccacugacuacauuaugggaagguucuccaggcaaauuuuggaauaccacuauagcgguauccauggcaaauauauuuagaggaagcuaccuagcaggggcaggguuggcguucucauuaaugaaaagucuugguggagggcgaagagggacuggcgcccaaggugaaacacuaggagaaaaauggaagaggcaauugaaccaacuaagcaaauccgaguucaacacauauaagagaucugggauaauggaaguugauagaucggaagcaaaagaaggucuaaagcguggagaaaccaccaaacaugcaguauccagaggaacggcaaaauuaagaugguuuguugaacguaacuuaguaaaaccggaaggaaaaguuauagaccucgguugugggagaggcggcugguccuauuacugugcuggacuaaagaaaguuacugaagugaaagguuacacuaaaggaggacccggccacgaagaaccaaucccaauggcgacauauggguggaaccuggucaaauuauauucagggaaagacguauuuuucacaccgcccgagaaaugugauacacuacuuugugacauaggugaaucuucgccaaauccuacuauagaagaaggccggacgcucagagucuuaaagaugguugaacccuggcuaagaggaaaccaauucuguauuaaaauacuaaauccuuacaugccaaguguaguugaaacguuagaacaaaugcaaagaaaacauggcgguauguuaguuagaaauccgcuuagccguaacaguacacaugaaauguauugggucucuugugguacuggaaauauagucucagccguaaauaugacaagccggaugcucuugaaccguuucaccauggcgcauagaaagccaacguaugagagagacguugaucuuggagccggaacaagacacguagcgguagaaccagagguagcaaaccucgacauuauaggacaacgcaucgaaaacauaaagaacgagcacaagucaacauggcacuaugaugaagacaauccuuauaagaccugggccuaccacgguucuuacgaaguuaaaccaucugguagugcgucaaguaugguaaacgguguaguaagacuacuaacgaaaccuugggacgucauuccaauggucacgcaaauagccaugacggacaccacaccauucggucaacaacgaguauucaaagaaaaaguugauacgcgaaccccuagggcuaaaagaggcacagcucaaauaauggaggugacagcgaaguggcuuuggggauuucuaucgagaaacaagaaaccgaggauauguacgcgcgaagaauuuacgaggaaggugcguucuaaugcagcaauuggcgcaguuuuuguugacgaaaaucaauggaacuccgcuaaagaagcuguugaagacgagagauucugggauuuaguacaucgugaacgcgagcuccauaagcaagguaagugcgcaacauguguguacaacaugaugggcaagcgagagaagaaguugggugaauuuggaaaggccaaagguuccagagcaauuugguauauguggcucggcgcucgauucuuggaauuugaggcauuaggcuuuaugaaugaagaccauugguucagccgggagaacuccuucucaggaguugaaggugaagguuuacauaagcuagguuacauauuacgugacauuucuaaaauaccuggaggcaauauguaugcagacgacacugccggcugggacacacgaaucacagaagaugauuuacaaaaugaagcaaagauaaccgauauuauggagccugaacaugcacuucuagcuacuucuauauucaaauugacguaccaaaauaaaguaguacgagugcaaaggccagccaaaaauggaaccguuauggauguaauaagucguagagaucaaaggggcucuggacaaguaggaacauaugggcuuaauaccuuuacgaacauggaagugcaacugauuaggcaaauggagagugaaggcauuuuccuaccaucugagcuugagacaccaaacuuggcagaacguguguuagauugguuggaaaaacaugggacugagcggcuaaaaaggauggcuauuucuggggaugacugcguagucaaaccuguugacgaccguuuugcaacagcuuuaauagcucuuaaugauaugggaaagguuagaaaggauauaccucaaugggaaccaucaaaaggauggaaugacuggcaacagguuccauuuugcagucaucauuuucaucaauugaucaugaaagacggacgggaaauaguugugccaugcagaaaucaggaugaauuagucggcagagcgagggugagucagggugcaggauggagccuccgagagacagcauguuuagggaaaucuuaugcucaaauguggcaacuuauguauuuccaccgucgugacuuaagacuugcggcaaacgcaauuuguucagccgucccuguugauuggguuccuacaucgcggacaacuuggaguauacaugcucaucaucaauggaugacaaccgaagauauguuaucaguuuggaacagagucuggauagaagagaauccauggauggaagauaaaacacauguaagcucuugggaagaaguuccauaucuaggaaagcgagaagaucaauggugcgguucacuaauaggcuuaacagcgagagcaaccugggcaacgaauauucaaguugcaaucaaccaagucaggagacuaaucggcaacgaaaauuauuuagacuacaugacaucuaugaaaagauuuaaaaacgaaagugacccagaaggcgcacugugguag

SEQ ID NO: 21398 - RNA, 9879 nt, Artificial Sequence
  derived and/or modified CDS sequence (opt6) from DENV-1__EU482591__SS-prME
aguguaacaaugcuacuaauguuacuuccuacagcuuuagcauuucaccuuacuacuagggguggugaaccacacaugauagugucgaaacaagaaagaggaaaaucucugcuuuuuaaaacaucagcagggguaaauauguguacuuuaauagcaauggaucuuggugaauuaugugaagauacaaugacauacaaauguccuagaauuacagaagcugaacccgaugacguugauugcugguguaacgcgacagauacauggguaacguauggaacaugcucccaaaccggggaacacaggcgcgagaaaaggagcguggcacuagcaccacauguagguuugggacuugagacaaggacagaaaccuggaugucaagcgaaggcgcauggaaacagauucaacguguagaaacaugggcgcuaagacaucccggcuuuacuguuauagcauucuuucuagcccaugccauagggaccaguauaacacaaaaaggaauaauuuucauauuacuaauguuaguaacgccaaguauggcuaugcgguguguuggaauuggaaaucgggacuuuguggaaggauuaagcggagccacguggguagauguuguacuugagcacggaaguuguguaacgaccauggccaaaaauaaaccuacacuggacauugaacuuuugaaaacggaggucacuaacccagcuguacuccgaaaguuauguaucgaagccaaaaucucuaacacaacaacagauucaagaugccccacacaaggcgaagcaacacucgucgaagaacaagaugcuaacuuuguauguaggaggacguuuguagauaggggguggggaaaugguuguggauuguucgguaaaggaucauugcuaacaugcgcaaaguuuaaaugcguaacaaaauuagaggguaaaauaguacaauaugaaaaucuaaaguauaguguuauaguuacuguucacacuggagaucagcaucaaguaggaaacgagacuacugagcacggcacaauagcgacaauaacgccacaggcacccacuuccgagauccaacuaacugacuauggcgcauuaacgcuugacuguucaccaagaacuggacuugauuuuaacgaaauggucuuacugacgaugaaagagaagucuuggcucguucacaaacagugguuucuagauuuaccauuaccauggacaucaggggcgucuacaucucaggagaccuggaauagacaagaucuccuggugacuuucaaaacagcccaugcgaagaaacaagaaguaguaguauugggaagucaggaaggggcgaugcauacugcacuaacgggagcgaccgagauccagacuagcggaacuacaacuauauuugcuggacauuuaaagugccguuuaaaaauggauaaauugacauugaaaggaauguccuacgugaugugcacagggaguuuuaaauuagaaaaggaagucgcugaaacucagcauggaacaguacucguacaaguuaaguaugagggaacagacgcaccgugcaaaauucccuuuucaacacaagacgaaaaggguguaacucaaaacggaaggcuaauaaccgcuaauccgauugugaccgauaaagagaaaccaguaaauaucgaaacugagccuccauuuggugaaucguauauuguuguuggagcaggggagaaggcacuuaaacucucgugguuuaagagagguagcucaauagggaaaauguuugaagcuaccgcuagaggggcaagacgaauggcaauauugggcgauacagcaugggacuucgguucaauagggggaguauucacaucaguaggaaaacucguccaccaaguauucggcacagcuuauggaguauuauuuucggguguuaguuggacuaugaagaucggaauuggaauacuucugacuugguuaggacuaaacucacguucaacaucccuuaguaugacuuguauagccgucggaauggucacguuauacuuagggguaaugguucaagcggacaguggaugcguaauuaacuggaagggcagggagcucaaguguggcucagggauauuugugacaaaugaaguucacacauggacugaacaauacaaauuccaggcggauucaccuaaaaggcuaucagcagcgaucggaaaagcaugggaagagggcguauguggcauuagaagugcuacacguuuggaaaauauaauguggaaacaaauauccaacgaacuaaaucauauacuauuggaaaacgauaugaaguucacagucguaguaggugacgcaaauggcauuuuagcccaaggcaagaaaaugauacgaccacagccaauggaacacaaauauagcuggaaauccugggguaaagcgaaaauaauuggugcagauauacaaaauacaacguucaucaucgacggaccggacaccccggaguguccagacggacagcgugcauggaauaucugggaaguggaagauuacggauuuggcguuuucacaacuaauauauggcucaagcugcgagacucuuauacucaaaugugcgaucaccgcuugaugucugcugccauaaaggauucgaaagcaguacaugccgauaugggcuacuggaucgagagcgagaaaaaugaaacuuggaagcuagcgagggcuucuuuuauagagguuaaaacauguacauggccaaaaagucauacuuuauggucaaauggaguguuagagagugagaugauaauaccuaaaaucuauggagguccgauaagucaacacaauuacagaccuggauauuuuacacaaacggcgggcccguggcacuuaggaaaacucgaacuggauuuugacuuaugugaaggaacuacuguaguugucgaugaacauuguggcaaucgggguccuucacuucgaacgacaacagugaccggaaaaauuauacaugaaugguguugccguucuuguaccuuaccuccucucagauucaggggagaagacggaugcugguaugguauggaaauacgcccaguaaaagaaaaagaagaaaauuuaguaagaaguaugguaucagcuggaucuggugaggucgacucauuuagucuugguauuuugugcgucucaaucaugauugaagaaguaaugagaucaagauggucaagaaaaaugcuaaugacaggaaccuuagccguguuuuuauuguuaauaaugggacaauugacauggaaugaccuaauucgauuaugcauuaugguuggagcaaaugcgucagacaggaugggcaugggcaccacauaucucgcccuaauggccacuuuuaaaaugaggccgauguucgcaguaggauuacuauucagaaggcuaaccuccagagaaguuuuauuauugacgauaggucuuucucuaguagcaucaguggaauuaccaaauucccuagaagaauuaggagacgggcuggcaaugggaaucaugaugcucaaauugcuaacagaguuucagccucaucaacuauggacaacauuacucagcuugacuuucguaaagacaacgcuaagucucgauuacgcuuggaaaacuacugccauggcccuuuccauagugagcuuauucccuuuaugccuauccacaacgucucagaaaacaacuuggcuaccugugcuucuggguucguuuggcuguaaaccuuugacaauguucuugauuacggaaaauaaaauuugggggagaaaaucauggccacuaaaugagggaauaauggcuaucgguauaguaaguauacuucuaucaagucuccucaaaaaugacgugcccuuggcaggaccucugauagcgggagguaugcuaauagccuguuauguuauaucuggcagcucagccgaucuuucucucgaaaaagcugccgaaguaaguugggaacaagaggcggaacacucgggagcaucacauaguauauuagucgagguucaagacgacgguacgaugaagauaaaagacgaagaacgagacgacacacuaaccauuuuacuaaaagcuacucuccuagcaguaagugguguauacccuaugucaauacccgcaacguuauuuguaugguacuucuggcagaagaagaaacaaagaucugguguacuuugggauacaccuucgccacccgaaguagagcgugcuguguuagauaacggaauauacagaauccuucaacgcggguuacuagggagaagucaaguuggaguugggguauuucaggaugggguguuccacacuauguggcacgugacucgaggggcaguauugauguaccaaggaaaaagacuagaacccagcugggcgucugucaagaaagaucuaaucucauauggcgguggcuggcguuuucaaggcucuuggaauacaggagaagaaguacaagucauagcaguagaaccgggcaaaaaccccaaaaacguacagacaacgccagguacauucaagacaccugagggagaagucggcgcgauagcauuagauuucaaaccaggaaccagcggcucaccuaucgucaacagagagggaaaaauuguuggacuauauggaaaugggguaguaaccacaucugguacauacguauccgccaucgcacaagcaaaagccagccaggagggaccgcuccccgagauugaagacgaaguuuuuaaaaagaggaaccuuacgauaauggacuuacacccugguucagguaagacuagaagauaccucccagccaucguacgagaggcuauuaaaagaaaacugagaacacugauauuagcucccacuagaguaguugcaucugaaauggcugaagcucuuaaaggaaugccuauaagguaucaaacgacagcgguaaagagugagcauacuggcagagaaauaguggaccuuaugugccaugcaaccuuuacuaugcggcuucucuccccuguaagaguccccaauuacaacaugauaauaauggaugaagcccacuucaccgauccugccagcaucgcagcacgaggguauauaagcacuagaguugguaugggagaggccgcugcaaucuucaugacugcuacacccccugguucaguugaagcauucccccaauccaaugcgguuauacaagacgaagaacgugauauaccagagagaaguuggaauagugguuaugacuggauaacggauuuuccaggaaaaacaguaugguuugugccaucgauaaagucaggaaaugacauagcaaauuguuugcggaaaaauggcaaaaggguaauacagcuaucaagaaaaacguucgacacugaauaccaaaagaccaagaauaaugauugggacuauguugugacaacagauauuucugaaaugggagcuaacuuccgugcagaccggguaauagacccaagacgauguuuaaaaccuguaauauuaaaagaugguccagaaagaguaauccuugcaggaccgaugccuguuacaguagccagcgcagcgcaaagaagggggcguauagggcggaaucaaaacaaagagggcgaccaguaugucuauaugggacagccauugaauaaugacgaggaccaugcacauuggaccgaggcuaagauguuauuggauaacauaaacacuccugaaggaauuauucccgcacuauuugaaccugagcgugagaaaucagcugcaauugauggagaauaccgguuacgcggcgaagcucggaaaaccuucgucgaguugaugcgaaggggugaccuacccgucuggcucucauacaagguagcauccgaagguuuccaguauucugaucgccgaugguguuucgauggugaaaggaacaaucaaguucuagaggaaaacauggacguugaaauauggacaaaagaaggcgaacgcaagaaacugcgaccaagaugguuagaugccagaacuuacagugaucccuuagcccugagagaguuuaaagaguuugcagccggcagacguagcguaucuggggaccuaauucuggaaaucggaaaacuaccacaacaccuuacacuuagagcucagaaugcauuagauaauuuaguaaugcuacacaacucugagcaaggugguaaggcauauaggcacgccauggaggaauuaccagauacaauugagacgcugauguugcucgcuuuaauugcgguucugacgggagguguaacacuguucuuuuugagcgguaaaggacuaggcaaaaccucaauuggacuauuaugcgucacggccaguucugcauuacuauggauggcauccguagagccacauuggauagcagcauccauaauauuggaauuuuuccuaaugguccuuuuaauacccgaaccagaucgucagcgaacgccucaggacaaucaauuagcauaugucgugauaggauuacuuuuuaugauuuugaccgucgcagcgaacgagaugggauuauuagagaccaccaagaaagaccuaggcauuggauauguagcggcugagaaucaccaacaugcaacaauguuggauguggacuugcaccccgcuucggcauggacuuuauacgcgguugcaacgacuguaauaacacccaugaugaggcacaccauugaaaacacaacagcaaauaucagccuaacagcaauugcaaaccaggcugcuauuuuaaugggauuagauaaagguuggccuauaucaaagauggauauagggguaccccugcucgcguugggauguuacucacaaguuaacccuuuaacguugacagcagcaguacuuaugcuaguugcacacuaugcuauaauugggcccggcuuacaagcaaaggcuaccagggaagcacagaaaaggacagcggcagguauaaugaagaauccaacaguggacggcaucguggcuauagaccuagaucccgugguauacgaugcuaaguuugagaaacaacuaggccaaauaaugcuauugauauugugcacaucucaaauauuacuuaugcguacaacaugggcuuuaugcgaaucaauaacacucgccacgggacccuuaacaacgcuaugggagggguccccaggaaaauucuggaacacuacaauugcagugucaauggcaaacauuuuccgcgguaguuauuuagcuggugcaggacuugccuuuucucugaugaaaucgcucgguggagguagaagaggcacgggcgcacaaggggaaacucuaggagaaaaauggaaaagacaacuuaaucaacuaucgaaaagcgaauuuaauacuuauaaaagaucaggaauuauggagguagaucgguccgaagcgaaagaggggcugaaaagaggagaaacaacaaaacaugcuguuucucgggguacugcaaaacugcguugguucgucgagcgcaacuuagucaaacccgaaggaaaagucauugaucucgguugcggaagaggaggcuggucauacuauugugcaggccuaaagaaagugacugaaguuaaaggauauacgaaaggaggcccuggacacgaagaaccaaucccaauggcaacuuacggauggaaucuugucaaacuacacucagggaaggauguuuucuucaugccaccagaaaaaugugacacccuauugugugauauuggugaguccucaccaaaucccacuauagaagagggucgaacccuacgaguacugaaaaugguagaaccauggcuuaggggaaaucaauucugcauaaagauucuuaacccuuauaugccuucugugguagaaacauuggaacggaugcaacgcaaacacgggggcauguuaguucgaaacccgcuguccagaaauucaacucaugagauguauugggucucaugcggaacuggaaacauuguauccgcaguuaauaugacuucgaggaugcuacuuaacagauucacaauggcgcauaggaaaccuaccuacgaaagagauguagaucugggggcuggaacuagacauguagcgguagaaccagagguggcaaaccucgacauuauaggucaaagaaucgaaaauaucaaaaacgaacacaaaucuacuuggcauuacgaugaagauaauccuuauaaaacuugggcauaccaugguagcuacgaaguuaaaccaucaggguccgcgucaagcaugguaaacggagugguuagacuacuaacuaaaccaugggauguaauaccgaugguuacucaaaucgcuaugacagauacuaccccuuucggacaacaaagaguauuuaaggaaaaagucgauacgcguacaccuagggcaaagagaggaacgacacagauuauggaagucacugcuaaaugguugugggguuuucuaucaaggaauaagaaaccaagaauaugcacaagagaagaauuuacccggaaagugaggucgaacgccgcaauaggugcuguauuuguagacgagaaccaauggaacuccgcaaaagaagcaguugaagaugaaagguucugggaucugguacaccgugagagggagcuucauaagcaaggaaaaugcgcuacaugcguuuauaauaugauggggaaaagggagaagaaacuaggcgaguucggaaaagcaaaaggcaguagggcaauuugguacauguggcuuggugcgcguuuccuagaauuugaagcccucggcuucaugaaugaagaucauugguuuagcagagagaacuccuuaaguggaguagaaggagaaggacuucacaaacuuggauacaucuuaagagauauaaguaaaauaccgggaggcaacauguacgcagaugauacggcggguugggacacacgaauaacggaagaugaccuccagaaugaagccaaaauaacagauauaauggagccagaacacgcacuucuugcaaccucaauuuuuaaacuaacuuaucaaaacaaaguaguucgaguacaacgacccgcuaaaaauggaacaguaauggauguaauaaguagaagggaucaaaggggaagugggcaaguugguaccuacgggcugaacacuuuuacaaacauggagguacaguuaauucgccaaauggaaagcgaggguauauuucuccccagugagcuagaaacuccgaauuuggcagagagggcccucgauuggcucgaaaaacauggugcagaaagguuaaaacguauggcaauuaguggugacgauugcguuguuaaacccauugaugaucgauuugcgacggcuuuaaccgcgcuaaacgacaugggaaaggugcgaaaggacauuccgcaaugggagccaagcaaaggauggaaugauuggcagcagguaccauuuuguucucaucacuuucaccaacuaauaaugaaagaugguagggaaauuguagucccgugucgaaaucaggaugaacuggucggaagggcgagagucagucaaggggcgggauggucgcugagagaaacagcaugcuugggaaaaucguacgcucagauguggcaguuaauguauuuccauagaagagaucuuagacuggcagccaaugcuaucugcucagccguaccuguugauuggguaccgacaaguagaacaacuuggucuauucacgcacaucaccaauggaugacuacggaagauauguuauccguauggaaccgaguguggauagaggaaaacccguggauggaagacaaaacccaugucaguaguugggaagaagucccauaucuagguaaacgggaagaucaauggugugggucccucauagguuuaacggcgagagcaacaugggcaacuaauauucaaguugcgaucaaucaagugaggagauuaauaggaaaugaaaacuaccuggacuauaugacuucgaugaaacgauucaaaaacgaaucagacucagaaggagcauuaugguaa

SEQ ID NO: 21399 - RNA, 9879 nt, Artificial Sequence
  derived and/or modified CDS sequence (opt6) from DENV-1__EU482592__SS-prME
ucuguaacuauguuauuaauguuauuaccaacggcauuagccuuucauuuaacuacuagaggaggggaaccacauaugauuguaucuaaacaagagagagggaaaagccuucuuuucaaaacaucggccgguaucaauauguguacgcuuauugcaauggauuuaggggaauugugugaagauaccaugaccuauaaguguccuaggauaacagaagcugaaccagacgacguagacugcugguguaaugcaacagacacauggguuaccuaugguaccuguucucaaacaggugaacauagaagggauaaaagaaguguggcccuagcuccacacguaggauugggacuagaaacgagaacggaaacauggaugaguagugagggugcauggaaacaaauacaaaaaguagaaaccugggcccuacgacauccagguuucacagucacugcucuauuuuuagcgcacgccauagggacgucaauuacacagaaaggaauuauauuuauacuuuugaugcuuguaacuccaucuauggcuaugcgcugcguugguauaggaaauagagauuuuguugaaggucuaaguggggccaccugggucgacgugguacucgaacacggaucaugcgucacgacaauggcaaaagauaaaccuacguuagacauugaauuauuaaaaaccgaaguaacgaacccggcuguauuaagaaaacucugcaucgaagcaaaaauaucgaauaccacaaccgacaguagguguccuacgcaaggugaagccacucuaguugaggaacaagauaguaauuucgucugcagacgaaccuuuguggauagagguuggggaaacggcugcggauuguucgggaaaggaucacucuugacaugcgcuaaauucaaauguguaacgaaacuugaagguaagauaguccaauaugaaaaucuaaaauacuccguaauaguuaccgugcauaccggagaccagcaccagguaggaaaugaaacgacugaacacggaaccauagccacgauuaccccacaggccccuacaagugagauccaacuaacugauuauggcgcgcuaacacuagacugcucuccuagaacggggcuagauuuuaaugaaaugguucuguuaacaaugaaagagaaaucauggcuuguacacaaacagugguuucuagaucugccgcugccauggacaaguggggcuucaacaucacaagagacguggaauagacaggaucuguugguaacauucaaaaccgcacaugccaagaaacaagaaguugugguccuggguagucaagaaggugccaugcauacagcacuuacuggugcuacugaaauccaaacgagcgguacuaccacaauauucgcaggacacuuaaaauguagacuaaaaauggauaagcuaacccuaaagggaaugucauauguuaugugcacaggaucauuuaaacuagagaaagaaguugcugaaacccagcacgggacaguauuaguccagguaaaauaugaaggcacagaugcaccauguaaaauaccuuuuuccgcacaagaugagaagggaguuacacagaauggcagauuaauaaccgcaaauccgauuguaaccgauaaggaaaaaccgguaaacaucgaaaccgagccgccauuuggcgagucuuauaucgucguuggcgccggagaaaaggcauuaaaacucagcugguucaaaaaggggucgucaauaggaaagauguucgaggcuacagcacguggagcucgacguauggcaauccuaggagacacagcuugggacuuuggcagcauagguggugucuucacaucuguuggcaaacuuguucaucagguguuuggggcggccuaugggguucuauuuagugggguaucguggacuaugaaaauaggaauaggaauccuacuuacuuggcucggucuaaauucaagguccacgagucugagcaugacuuguauagccguugguaugguaacccuuuaucuuggaguuaugguccaggccgauaguggguguguaauaaacuggaagggacgugaauuaaagugugguuccggcauauuuguaacaaaugaagugcacacguggacagaacaauacaaauuccaagccgacucgccuaaaaggcuaagcgcggcuauaggcaaagccugggaagaaggcguaugugguauucgaagcgcuacaaggcuugagaauauuauguggaagcagauaucuaaugaauuaaaucauauucuguuagaaaacgauaugaaguucacaguagucguaggagaugccaaugguauacuagcacaagguaagaaaaugauccgcccacaacccauggaacauagguauucauggaagucauggggaaaggcaaaaauaauaggggccgacauccaaaauaguacauucauuaucgacggcccugauacaccagaauguccagacgaucaaagagcauggaauauaugggaaguggaagauuauggauuuggaaucuuuaccacgaauauauggcuaaaauuaagagauucuuauacucaaaugugugaucaccggcuaaugucugcagcuauaaaagauucuaaagcagugcacgcagauaugggcuacuggauagagagcgaaaagaaugaaacguggaaguuagcacgagcaucguuuauagaggugaagacaugcauuuggccaaaaagucauacauuauggagcaauggaguauuggaaucagaaaugaucauacccaagauuuaugguggaccuauaagucaacacaacuaucgaccuggauauuucacacagacagcuggaccguggcaccuaggcaaauuagagcuggacuucgaucuaugugagggaacaacaguaguaguagacgaacauugugguaauagaggaccuaguuuaagaaccaccacaguuacagguaaaauuauacaugaauggugcugcaggucaugcacucuacccccgcuaagauuuagaggcgaagacggauguugguacgggauggagaucagaccuguaaaagaaaaagaggaaaauuuagugagaucaaugguuucggcuggauccggggaaguugacucuuuuucacuugguauuuuauguguuuccauaaugaucgaagaagugaugagaagcagauggucacgaaaaauguugaugacagggacuuuagcuguuuuucuauuacucauaaugggacaguuaacauggaaugaccuaauuagauugugcauuauggugggagcaaacgcauccgaccguaugggaaugggcacuacauaccuagcauugauggccacauucaaaaugagaccuauguucgcggugggauuacucuuuagaaggcuuacuucuagggaagugcuauuacugacgauagggcugaguuuaguagcauccguugaguugccuaacagucucgaagaacugggugauggcuuagcaauggguauuaugauguuaaaguuguuaacagaguuucaaccgcaucaauuauggacaacucuacucagcuuaacuuucaucaaaacuaccuuaucacucgacuacgcauggcgaacgauggcgaugguacugucaauagugagccuauuuccauuaugcuuaucaacuaccagucagaaaacgacaugguugccuguauugcuagguucguucggcuguaaaccauuaacaauguuuuugaucacugaaaauaaaauuuggggacgcaaaucauggccguugaaugagggaauaauggcaauuggaauaguaucaauuuuauugucauccuuauuaaagaaugauguuccauuagcuggaccuuuaauagccgguggaauguugauagcuuguuaugucauuaguggauccucagcagaccucucuuuagaaaaagcagcagaagucucaugggaagaagaagcggagcauucaggaaccucgcacaauauauuaguagaagugcaagacgacggcaccaugaaaauuaaagaugaagaacgagacgacacucugacaauucuacuaaaggcuacucuucuugcuguaaguggugucuauccaaugucaauaccagcaaccuuguuuguaugguauuucuggcagaagaagaaacagcgcucuggaguacuuugggacacucccucaccgcccgaggucgaaagagcgguacuugaugacgguauuuaucgaauacuacaaagaggacucuuagggcggagccagguugguguugguguguuccaggacgguguauuucauaccauguggcaugucacuagaggagcgguauuaauguaccagggaaagcguuuagaaccaucaugggcaagugugaagaaagauuuaauuucguacggaggaggguggcgguuucaagguucguggaacaccggggaagaaguacaaguaauugcaguugaaccgggcaaaaauccgaaaaacguacaaaccacaccggguaccuuuaaaaccccagaaggugaagucggugcuauagcccuugauuucaaaccaggaacgagcggcuccccuaucgucaacagagaaggaaaaauaguaggccuguaugggaacggaguaguaacaacaucagguaccuauguaucugcgauagcacaagcuaaaaccucccaggaggggcccuugcccgaaauugaggaggaaguuuuuaagaaacgaaacuugaccauaauggaccuacacccagguucugggaaaacgaggagauaccuaccugcaauaguaagagaggcaauaaaaagaaaacuccgcacuuuaauucucgcaccaacccgugugguggccuccgagauggcagaagcauuaaagggaaugccaauacgcuaccagacgacggcaguaaaaucugaacauacgggacgagaaauugucgaccucaugugccaugccacuuuuacgaugagguuauuaagcccaguacgaguaccuaauuauaacaugauaauuauggacgaggcccacuuuaccgauccagcgagcauugcggcaagaggauauauaagcacacgaguuggcaugggggaggcugcugccaucuucaugacagcaacaccuccagguaguguagaagcauucccacaaucuaaugcggugauucaagaugaagaacgagauauaccugaaagaucuuggaacucugguuaugauuggaucacugauuucccugggaaaacaguuugguucguaccuucuaucaagaguggaaaugauauugcaaauugucuacguaagaacgggaagagggucauccagcuguccagaaaaacguucgacacagaguaucagaaaacccgcaauaacgauugggacuacguagucacaaccgauauaucggaaaugggggcaaacuuuagggcagaccggguuauugaucccagacgaugucuaaaacccgucauauuaaaagauggacccgagagagucauacucgcggguccgaugccaguuacaguagcgagcgcagcacagagaagagguagaauaggcagaaaucaaaacaaagagggagaucaguauguauauaugggccaaccucuaaacaacgaugaggaucacgcucacuggacugaagcgaaaaugcuacucgauaauaucaauacuccagaaggcaucaucccugcacucuuugaaccagaaagggaaaaaucugcagcaauagacggagaauauagauuaagaggugaagcucgaaagacauucguugagcuaaugcgaagaggcgauuuaccugugugguuaaguuauaaagucgcaagugaagguuuucaauauucugacagacgguggugcuucgacggugaacguaacaaucagguguuagaagaaaauauggauguugagauuuggacaaaagagggugaaagaaagaaacuuaggccacguugguuagacgcuagaacauauucugauccuuuggcucuaagagaguucaaagaguucgcagcuggcagacgaucugucucaggagauuuaauacuagaaauugguaagcuaccacaacauuuaacuuuaagagcacagaacgcuuuagacaaucuugugauguuacacaauagugaacaagggggaaaagcauacaggcaugcaauggaagaacuaccugauacaauugagacucucauguuacucgcauuaauagccgugcuuacagguggaguaacuuuauuuuuccuaucaggaaagggguuaggaaaaacaaguauaggacuuuuguguguuauggcuucaucggcccuauuguggauggcuaaugucgaaccacauuggauugcugcaucaaucauccuggaauuuuucuugaugguuuuacugauacccgaaccggaucgucaaagaacaccucaagauaaucaauuagccuacguaguuauuggacuucucuuuaugauuuuaacuguugcagcuaacgaaauggguuuacuagaaacaacuaaaaaggacuugggcauaggguacgucgccgcugagaaccagcaccacgcuacaaugcucgauguagaucuaaggccagcuagugcguggacacuuuaugcagucgcgacuacuguuaucacacccaugaugcgucauacaaucgaaaauacgacagcaaacaucucgcuaacugcgaucgcuaaccaagcugccauacuuauggggcucgacaaaggcuggccgauaagcaaaauggauaucggagugccacuacucgcucuagguugcuacagucaagugaauccuuuaacguuaacagcagcaguacuuaugcucguggcacacuacgcaauaaucgguccuggauuacaagcuaaagcuaccagggaagcacaaaaacgaaccgcagcuggaauuaugaaaaauccaacaguagaugguauuguagcuauagacuuggaucccgugguauaugacgcgaaauucgaaaaacagcuaggucaaauaaugcuguugauacucugcacaagucaaauacuuuuaaugcgcacaacuugggcccuaugcgaauccauaacgcuagcaacaggaccccuuacuacgcucugggaagguaguccaggaaaguucuggaauacuacaaucgccguaaguauggcgaauauauuuagagggaguuaucuugcgggggcagggcuagcauucucuuuaaugaaaucuuugggagggggcagaagagguacaggugcacaaggagaaacuuuaggcgagaaguggaaacgacaacugaaucaacucagcaaaagugaauuuaacacauauaaaagaucggggauuauggaaguugauagaagugaagcaaaagaggguuuaaagagaggcgaaaccacuaaacacgcaguaucaagaggcacggccaaacuucgcugguuuguagagagaaacuuagugaaaccugaaggcaagguuauagaucuaggcugcggaagagguggcuggaguuacuauugugcuggauuaaagaaaguuacugagguaaaaggguacacuaaaggggguccaggacaugaagaaccuauacccauggcaaccuacggcuggaaccuagucaaauuguauuccggaaaagacguauucuucacaccgccagaaaagugcgauacacuauuaugugacaucggcgaaucuucuccaaauccaacaauagaggaagggagaacacuacgaguccuaaagauggucgaaccgugguuaaggggcaaccaguucuguauaaaaauccuuaauccauauaugccaaguguaguagaaacuuuagagcaaaugcaacgaaaacaugggggaauguugguacgaaauccauuauccagaaacuccacacaugaaauguacuggguuucaugcggaacaggaaauauugugagugcagugaauaugacaucccgcaugcuauugaauagguucacaaugacacacagaaagccaacguaugaaagagaugucgauuugggcgcaggaacgcgacauguagcaguggaaccggaaguagccaaccuagacaucauaggucaaagaauagaaaauaucaagaaugaacacaaauccacuugguauuaugaugaagauaauccauauaaaacaugggcuuaccacgguuccuaugaaguaaaacccagugguuccgccucaucaauggucaauggaguugugcgucuuuuaaccaaaccaugggacguaaucccaauggugacucaaaucgccaugaccgauacaacccccuucgggcaacaacggguauucaaagaaaaggucgacacacggacgccucgugcaaagagagggacggcacaaaucauggaaguuaccgccaaauggcucuggggauuucuaucucgcaacaagaaaccaagaaucugcaccagggaagaguucacuagaaagguaagauccaacgcagcaaucggagccgucuuuguagacgaaaaccaauggaacagugccaaggaagcuguugaagacgaacgauuuugggaucuaguucauagagaaagagaauuacauaaacaagggaagugugcaacauguguuuacaacaugauggggaaaagagagaagaaauuaggagaguuuggaaaggcgaaagguucgagggcgauuugguauaugugguuaggggcuagauucuuggaguucgaagcauugggcuuuaugaaugaagaccauugguucagcagagaaaacuccuuuucaggagucgaaggagaaggguugcacaaauuagguuacauuuuacgcgauauaucgaaaauaccaggaggcaacauguacgcugaugauaccgcaggaugggacacucgaauaaccgaagaugaucuccagaaugaagcgaaaauuacagauauuauggaaccagaacacgcauuauuggcaacaucgauauuuaaacuuacuuaccaaaauaaaguugugaggguacagcgcccagcuaaaaauggaacaguuauggacguaauaucacggagggaccagcgugggagcgggcaagugggaacuuauggauuaaauacauuuacaaauauggaagugcaguuaauccgacaaauggagagcgagggaaucuuucuaccuucugaauuagagacgccaaauuuagccgagagaguccuaaacugguuagaaaaacacggaacugaacgauugaaacgaauggcuauaucuggugacgacuguguaguuaaaccaguagaugauagguucgcuacugcauuaauagcguuaaacgacaugggcaaaguaagaaaagacauaccccaaugggaaccaucaaaaggcuggaacgauuggcaacaaguacccuuuugcucacaccacuuccaucaguuaauaaugaaagacggacgcgaaauugucguaccaugucgaaaucaagacgaacuuguagggcgggcccgcgugucgcaaggagcaggauggucauugagagaaacagcauguuuaggcaaauccuacgcacagauguggcaacuuauguacuuccacagacgcgaucuacgacuagcagcaaacgcgauauguucugcagucccaguugauuggguacccacaucucgaacuaccuggagcauucaugcacaccaccaauggaugacuacggaggacauguuauccguauggaaccggguguggauugaagaaaauccuuggauggaagacaaaacucacguuucaucgugggaagaaguaccuuaucuaggaaaaagagaggaucaauggugcgguucucugauuggccucacugcgcgagcaacuugggccacaaauauacaaguagcaauuaaccaaguuagacggcugauagguaaugagaauuaucuagacuacaugacaucgaugaaacgcuucaagaaugagagcgauccggaaggugcccugugguag

SEQ ID NO: 21400 - RNA, 9879 nt, Artificial Sequence
  derived and/or modified CDS sequence (opt6) from DENV-1__EU482609__SS-prME
uccguaacaaugcuauuaaugcuucuaccuacagcgcuagcauuucaucuaacuacucgcggaggggaaccgcacaugauaguuuccaaacaagaacggggaaaaucauuauuauucaaaacaagugcaggaguaaacauguguacauuaauagcaauggacuuaggggaacuaugugaagacaccaugacuuauaaaugcccacguauaaccgaggcggagccggacgaugucgauugcuggugcaacgcaacugauacgugggugacuuacggaacauguucacaaacaggagagcauagaagggauaaaagaagcgucgcacucgcuccccauguagggcuaggccuagaaacaagaacagaaacauggaugagcucagaaggugcguggaaacagauacaacgaguagagacuugggcacuacgacaucccggauucacagugauagcacuauuuuuggcacacgcaauugguacuuccauuacgcaaaaagguaucauauuuauauuacuuauguugguaacaccgagcauggcaaugagauguguagguauuggaaaccgugacuuuguagaaggacuaagcggagcaaccuggguggaugugguauuagaacacgguagcugcguaacaacaauggccaaaaauaaaccaacucuagauauugaacucuugaaaacagaaguaacaaauccugcuguuuugagaaaauuauguauagaagcaaaaaucucuaacaccacuacagauucccguuguccaacgcaaggggaagcgacuuugguagaagaacaagaugcaaauuuuguguguagaagaaccuucguugaucguggaugggggaauggcugugguuuguuuggcaaagggucguuauugacgugugcaaaauuuaaauguguuacaaaacuagaaggaaaaauaguccaauacgaaaauuugaaauauucgguuauaguaacaguucauacaggcgaccaacaccaaguuggaaaugaaacgaccgaacacggaacaauugcgacgauuacgccacaagcacccaccuccgagauccaguuaacagacuacggugcacucacgcuagacugcucgccacguacugguuuagauuuuaaugaaaugguauugcuaacaaugaaagaaaaaucuugguuaguucauaaacaaugguuucuagauuuaccauugcccuggaccucuggugcuuccaccucacaggaaaccuggaaucgacaggaucuccuagugacauuuaaaacagcacaugccaagaaacaggaaguuguaguacuaggaucgcaagaaggagcgaugcauacggcauuaacaggagcaacagaaauucaaaccucuggcacuacaacgauauucgcaggccaccuaaaauguagguuaaaaauggauaaacucacccucaaaggcaugaguuaugucauguguacugguucauucaaacuugaaaaagagguugcggaaacacaacauggaacuguauugguacaagucaaauaugaggguacagacgcaccuuguaaaauaccauuuucuacgcaagacgaaaaaggggucacacaaaacgggcguuuaaucacagcuaacccuauagugacugacaaagaaaaaccggugaauauagagacggaacccccauuuggagaaagcuauauaguugugggugcgggagagaaggcauuaaaacuaucuugguucaagaaagguuccaguauuggcaaaauguuugaagccacggcccgaggcgcuagacguauggcgaucuugggagauacagcaugggauuuugguagcauugguggagucuuuaccaguguagguaaauuggugcaccaaguuuuuggaacagccuacggcguccuauuuucuggaguaaguuggacaaugaaaauagguauagguaucuugcuuaccugguugggccuaaacucgagaucaacgagucuaucgaugacaugcauagcuguagguaugguuaccuuguaccucggggugauggugcaagcagauucaggcugcgugauaaauuggaaaggaagagaguuaaaauguggaucagguauuuuugugacuaaugagguacauacauggaccgagcaauauaaauuucaagccgacucaccgaaaagacuaucagcugcaauuggaaaagcaugggaagaggguguaugcggaauuagaagugcaacccggcuggaaaauaucauguggaaacaaaucuccaacgaacuuaaucauauacuauuagagaaugacaugaaguucacaguaguagugggggaugcuaauggcauucuggcacaaggcaagaaaaugauaaggccacaaccuauggaacauaaauauucauggaaaagcuggggaaaagcaaagauuauaggagcugauauacaaaauacuacauuuaucauagacggacccgauacaccggaaugccccgacggccaaagagcuuggaauauaugggaaguagaagauuacggguucggaauauucacaacaaacauauggcuaaagcuaagagauucauacacacaaaugugugaucacagacuaaugucagccgcaauuaaagacaguaaagcuguccaugcugacaugggcuauuggauagaaucugagaaaaaugaaacauggaaacuugcuagagccagcuuuauagaaguuaaaacauguacauggccaaaaucacacacacuuuggagcaacggcguucucgaaagcgaaaugaucaucccaaaaauauauggagguccaauuucacaacauaauuauagaccagguuauuuuacacaaaccgccggaccauggcauuuagggaaguuagagcuagacuucgauuuaugcgaggguacaaccguaguagucgaugagcauugugggaaccgcgguccgaguuuaagaacaacuacggugacgggaaagauuauacacgaauggugcugcaggucaugcacacugccaccguuacgauucagaggagaagacggcugcugguauggcauggaaauacgaccugugaaagaaaaagaagagaaccugguuaggagcaugguaagugcuggaaguggagaaguagauucauucagucuagguauacuaugcguaaguaucaugauugaagaagucaugagguccagauggagcagaaaaauguuaaugacgggaacucuagccgucuuccuucugcuuauuaugggacaauuaacauggaaugaccuaauacggcuuugcaucauggugggagcaaaugcgagcgauagaaugggaaugggaacaacauacuuagccuuaauggcuacauucaaaaugcguccuauguucgccguaggcuuauuauucagaagauuaacaucaagggaaguauuacuacugacuauaggucuaucccugguugccuccguggaacuaccaaauucccuagaagaacucggugacggucucgcuauggggauuaugaugcuaaaguuacuuaccgaauuucaaccucaucaacuauggacaacacuccucucucugacauuuguaaaaacaacucucucuuuagauuaugcguggaagacaacagcgaugguacuaucgauaguaucacucuucccacuauguuuaagcacuacgagccagaaaacuaccuggcuuccaguucugcuuggauccuucggauguaagccuuuaacuauguuuuugauuaccgaaaauaagauauggggccggaaaucauggccauugaaugaagguauuauggcgauagggauuguaucuauacuucuuaguucucuguuaaagaaugauguacccuuggccgguccauuaauagcggguggaauguuaauagcauguuauguuauaagcgggucaucugcagacuuaagucuagaaaaagcagcagaagugucuugggaacaagaagcagaacauaguggagcaucacacaacauacuuguugaagugcaagacgauggaacgaugaaaauaaaagaugaggaacgagacgacaccuuaacuauccuacuaaaggccacgcuuuuggcaguaucuggcguuuauccgaugucuaucccagcaacguuauuugugugguacuuuuggcagaagaagaaacagagaagugguguccuaugggauacaccgucgccaccagaaguggaacgagcggucuuggacgacgguauauaucgcauauuacagagagggcuguugggccgaucacaaguaggagugggaguauuccaagauggaguuuuucacacaauguggcauguuacgagaggugcaguauugauguaucaaggcaaaagacuagaaccaucuugggcaagugugaaaaaggauuuaauaagcuacggcggaggguggcguuuucaagggagcuggaauacuggggaagaaguccaggucaucgcaguugagccaggcaaaaaucccaaaaauguacaaacaacaccuggaacuuuuaaaacuccggagggcgaaguaggagcaauagcacuagauuuuaaacccgguaccucaggcucaccuauaguuaauagagaagguaaaauaguuggacuuuauggaaacgguguaguuacuaccagugggacauaugucagcgcaauugcucaggcuagagcuucacaagagggaccccuaccagaaaucgaagaugaaguguuuaagaaaagaaauuugacgauaauggaucuucauccaggcucugggaaaacaagaagauauuuaccagcgauuguucgugaagcaauuaagagaaaauuaagaacucugauucucgcacccacaagggucgucgcaucagaaauggcagaggcacuaaaaggaaugccgauaagauaucaaaccacugcugugaaauccgaacacacaggcagagagaucguagaucuuaugugucacgcuacauuuacuaugagacucuuaucuccugugagaguaccgaauuauaauaugauaauaauggacgaggcucacuucacugaucccgcaaguauagcggcacguggauauaucucuacgagaguaggaaugggagaagcggccgccauauuuaugaccgccacaccacccgggagcguugaagcguucccccaaagcaacgcugugauacaggaugaagaaagagauauucccgagagaaguuggaauagugguuacgacuggauaacugauuuuccuggaaaaaccguaugguuuguaccuaguaucaaaucagggaaugauauugcaaauugcuugagaaagaacggcaaaaggguaauacaacuaagccgaaagacauucgauacugaauaucagaaaacuaaaaauaaugacugggauuauguuguaaccacagacauaucugaaaugggcgcaaauuuucgugccgaccguguuauagacccaagaagaugccuaaaaccuguaauacuaaaagacggaccagagagggugaucuuggcaggcccaaugcccgucacagucgcuuccgcggcucagaggcguggacgaauuggacguaaccagaauaaagaaggugaucaauauguauauaugggucaaccauuaaacaaugacgaagaccaugcacacuggacugaggccaaaauguuauuagacaauauaaauacaccagaaggcaucaucccagcauuauucgagcccgaaagagaaaagucugcugcuauugauggcgaauauaggcuaaggggcgaagcccguaaaacauucguagaauuaaugagacgcggcgaucuaccgguguggcuaagcuacaaaguagcgucugaaggauuucaauacagcgaucguaggugguguuucgacggggaaagaaacaaucaaguacuugaagaaaauauggauguggagauauggacaaaagaaggggagaggaagaaauuacguccaagauggcucgacgcacguacauauagcgauccgcuggccuugagagaauuuaaagaauuugcugccggacgccguucgguuagcggggauuuaauucuugaaaucggaaagcuaccacaacacuuaacccucagggcacagaacgccuuggacaaucuugucaugcugcauaacagugagcagggaggcaaagcauaucgccaugcgauggaagaacuucccgacacaauugaaacucuuaugcuacuagcuuuaauagcaguacuaacgggaggcguuacguuguuuuuccuaaguggaaaaggauuaggaaagaccucaauaggucuccuaugcguaaccgcgucuucugcuuugcuauggauggcaaguguugaaccgcacuggaucgcggcuuccauaauacuugaguucuuucuaaugguccuccuaaucccggaaccagaccgucagagaacaccacaagacaaucaauuagccuaugucgucauuggccuuuuguuuaugauucucacuguagcugcuaacgaaauggggcucuuagaaacgacgaagaaagaccucgguauuggauauguggccgcugagaaucaccaacacgcaacuaugcuagauguagacuuaagaccagcaagcgcguggaccuuguacgcgguagcgaccacaguuauuacgccaaugaugcgacacaccauagaaaauacaaccgcaaacauuagccuaacagccauugcaaaccaggccgcaauauuaaugggacuggauaaaggauggccaauuaguaaaauggauauugguguaccuuuauuggcgcuaggcuguuauagucaaguaaaccccuuaacauugacagcugcuguacuaaugcuuguggcacacuacgcaauaauaggaccaggccuccaagcaaaagcaacacgugaggcgcaaaagcgaaccgcggcaggaauaaugaaaaauccaaccguagacggcauuguugccauugaucucgauccugucgucuaugacgcuaaauuugaaaaacaacucggacaaauuauguuacucauauuaugcacaagucagauccuccucaugcgaacuacaugggcauuaugugaaucuauaacauuggcuacagggccacucacaaccuuaugggaagguagcccuggaaaauuuuggaauacaacaauugcaguauccauggcaaacauauuuaggggcucguacuuagcuggcgcuggucuugcguuuagucuuaugaaaucauugggugguggcagaaggggcacaggcgcucaaggagaaacauuaggagaaaaguggaaacggcaacucaaccaacuaaguaaaucagaguucaacaccuacaaacggucuggcauaauggaaguggaucgaagcgaagcgaaggaaggucuuaaacgaggugaaacaacgaagcacgcgguuaguagagguacggcgaaacuacgaugguuuguggaacgaaaucuaguaaaaccugaaggcaaaguuauagacuuaggauguggacgaggcggauggucguacuacugugcaggccuuaagaaagugacugaaguaaagggauacacaaaaggaggaccuggccacgaagaaccaauccccauggccacuuacggcuggaaccucgugaaauugcauucggguaaagauguauucuuuaugcccccagaaaaaugcgauacacuacuaugugacauaggagaauccucccccaauccgacaauagaagaagggcgcacgcuaagaguauuaaagaugguugaaccuuggcugaaaggaaaucaauucuguauaaaaauuuuaaauccauacaugcccuccgucguggaaacccuagaacaaaugcagaggaaacauggggguaugcuuguacgcaacccauuaaguagaaauuccacacacgaaauguauuggguaucgugcggcacagggaacaucguuucggccguuaauaugacaucaagaaugcugcucaaccgauuuacaauggcucauagaaaaccaacguaugaaagggacguagauuuaggugcaggaacaagacauguggcaguugaaccugaaguggccaaucuggauauaauaggacaaagaauugaaaacauuaagaaugaacacaagucaacauggcauuacgaugaagacaacccuuacaagacuugggcauaucacggaaguuacgaaguuaaaccauccgggagcgcaucuaguaugguaaacggcguagugagacuccuuacaaaaccaugggauguaauuccuaugguaacccagauagcaaugaccgauacaacaccauucggacaacagagaguuuucaaggaaaaaguagacacaagaacuccucgagcaaaaagggguacuacgcaaaucauggaaguaacagccagguggcuuuggggguuuuugucaagaaacaagaaaccacgcaucuguacccgcgaagaauuuacacgaaaaguacgaagcaacgccgcgauaggagcgguauucguugaugagaaccaguggaacucugcaaaagaagcgguagaggaugaacguuucugggaucuaguacauagagaaagagaauuacauaaacaggggaagugcgcaaccugcguauauaacaugaugggaaaaagagagaagaaacuaggagaauuugguaaagccaagggcucacgugcgaucugguacauguggcuuggagcucgguucuuagaauuugaagcacucgguuuuaugaaugaggaccacugguucagucgugaaaauucgcuuucagguguagaaggagaagguuuacauaaauuaggcuacaucuuacgggacauuucaaaaauuccaggaggcaauauguaugcugaugacacagcugggugggacaccagaauaacagaagacgacuugcaaaacgaggccaagauaacagacauaauggaaccagaacacgcacuguuggccacaucaauauuuaagcuaacuuaucagaacaagguaguacgaguacagcgccccgccaaaaacggaacgguuauggauguaauuucgcgaagagaucaaagaggcagcggacaaguagguacauacggccucaauacauucacaaacauggaaguacagcuuauccgacaaauggaaucagaagggauuuucucaccgucagaguuagaaacaccgaacuuagccgaacgcguauuggauugguuagaaaagcacggugcagaacgucuaaagcgcauggcaauaucgggagaugauuguguuguaaagccaauagaugaccgcuuugcuacugcuuugacugcgcucaaugauaugggcaaaguccgaaaagacauuccccaaugggagcccagcaaaggguggaaugauuggcagcaagucccguucugcagccaucacuuccaccaacuaauaaugaaggauggcagagaaauaguaguaccuugucgcaaucaggacgaauuggucggccgagcuagaguuucgcaaggagcuggcuggaguuuaagagaaacggcuugucuaggaaaaucguaugcacaaauguggcaauuaauguauuuccaccgucgagacuugagauuagcagcaaaugcaauaugcagcgccguaccggucgauuggguacccacuucuagaacaaccuggagcauacaugcucaucaccaauggaugacaacggaagauauguuaaguguguggaaucgugucuggaucgaagaaaauccauggauggaggauaaaacacacgucucaaguugggaagaaguuccguacuuaggaaaacgugaagaccaauggugcggaucgcuuaucggccuuacagcaagagcaacgugggcuaccaacauacagguagcaauaaaucaaguaagaagauuaaucgguaacgaaaacuaucuugacuauaugacaagcaugaaaagauuuaaaaaugagucagacccagaaggagcacuaugguag

SEQ ID NO: 21401 - RNA, 9879 nt, Artificial Sequence
  derived and/or modified CDS sequence (opt6) from DENV-1__EU482610__SS-prME
ucaguaacuaugcuacuuaugcuucuuccaaccgcucuggcuuuucaucugaccacgaggggaggagaaccacauaugauaguaaguaaacaagaacggggaaaaaguuuacucuucaaaacuucugccggugugaauauguguacucucauagcuauggacuugggagaauuaugugaagauacgaugacuuauaaauguccacgaauaacugaagcugaaccagaugacguagauuguuggugcaaugcaaccgacacuuggguaaccuauggaacuuguucacaaacuggagagcauagacgcgagaaaagguccguagcacuugcaccgcacguuggucuaggacuugaaacaagaacugagacauggaugagcucggaaggugcauggaaacaaauucaacgaguagaaacauggguauuacgacauccggguuuuaccgucauagcauuuuuccuggcgcacgcaauaggaacaaguauuacucaaaaaggaauaaucuuuauacuacuaaugcucguaacaccaucaauggcaaugcgauguguaggcaucgggaacagagauuucguagaaggccugaguggggcuacuuggguugacguaguacuggaacaugguuccugcguaacaacuauggccaaaaauaaaccaaccuuggacauugaauuacucaaaacggaaguaacuaaccccgcugucuuaaggaaacucugcauagaagcaaaaauaaguaauacgacaacagauucacgaugcccaacucaaggcgaagcaacacugguggaggaacaagaugcaaacuucguuugcaggcguacauucguggauagagguugggggaacggaugcgggcuauuuggcaaaggcagccugcucacaugugcaaaauucaaaugcguaacaaagcuagaaggaaaaauugugcaauacgaaaaucuuaaauauaguguaauaguuacgguccacacuggagaucaacaucaaguuggaaaugagacaaccgagcauggaacgauagcuacaauaacaccucaagcgccaacaagugaaauacaguugacugacuauggagcauugacauuggacuguaguccaagaacaggacuagacuuuaaugaaaugguucuuuuaacuaugaaagagaaauccuggcuaguacacaaacaaugguuucucgacuugccucucccauggacaaguggggcuuccaccagccaagagacuuggaacaggcaagauuuauuaguaaccuuuaaaacugcucacgccaagaaacaagaggucguaguuuuaggaagucaggagggugcaaugcauacugcacugacuggggcuacagagauacaaacaagugguacaacaacaauuuuugcuggccaucugaaaugcagacuuaaaauggauaaacuaacacuuaaagguaugucuuaugugauguguacgggaucguuuaaauuagaaaaagagguagcggaaacccaacacgggacaguacuggugcaaguaaaauacgaaggaacagacgcaccaugcaaaauuccguuuucaacgcaagacgaaaaaggcguaacacaaaacggucgacugauuacagcaaaucccauugucaccgauaaagagaaaccaguuaauaucgaaacggagccuccauucggagaaucuuauauaguaguaggagcaggggaaaaagcgcugaaauugucaugguucaaaagaggcaguuccauugguaaaauguuugaggccacagcaaggggugcaagaagaauggcaaucuuaggggauacagcaugggauuuugguucaauugguggaguauucacaaguguuggaaaacuuguucaccaaguauuuggaaccgcuuauggugugcuauucucagguguuagcuggaccaugaaaauuggaauuggcauucuccuuacauggcucggacugaauagucguaguacauccuugucgaugacaugcauagcgguuggaaugguuacacuuuauuugggaguaaugguucaagcagauucaggaugugucaucaauuggaaaggacgagaacuaaaauguggaagcggaaucuucguaacuaacgaaguccacacuuggacagaacaauauaaguuucaagcugauucaccgaaaagauuaucggcggcaaucggaaaggcuugggaggagggcguguguggaaucagaucagcaacaagacuugaaaacauuauguggaagcagauaucaaacgaauuaaaucacauacuuuuggagaacgauaugaaauugacagugguagugggugaugcaaacgggauauuagcacaaggcaagaaaaugauccgaccacaaccaauggaacacaaauacucuuggaaaagcugggguaaggcgaaaauaaucggcgcagacauccaaaacacaacuuucauaauagaugguccagauacucccgaauguccagacgggcagcgagccuggaacauuugggaaguugaagauuauggcuucggaguguucacuacaaacauuugguuaaaguuaagggauucuuauacucaaaugugcgaccaccgucuaaugagugcagcaauaaaagauaguaaagcaguacacgcagauaugggcuacuggauagaauccgagaaaaaugaaaccuggaaguuagcacgugcaaguuucaucgaaguaaaaacguguacauggccaaaaucccauacccucuggucuaacggaguacuagagucugagaugauuauaccaaaaauuuauggaggaccaauuucucaacacaauuaccguccugguuacuuuacccaaacugcuggaccguggcaccuuggaaaauuggaguuagacuuugacuugugugaagggacgacagucguaguggacgaacauuguggaaacagaggcccaagccucagaaccacgacaguuacggguaaaauaauacacgaauggugcugcagaucauguacucuuccaccauuaagguucagaggcgaagaugguugcugguaugggauggaaauaagaccaguuaaagaaaaggaagaaaaccucguacgauccaugguuagugcgggaucgggggaaguagauagcuuuuccuuagggauccuaugcgucucuauaaugauugaagagguaaugcgaucucgauggucucgaaaaauguugaugacagguacuuuggcgguguuccuccuguuaauaaugggccaauuaacguggaaugaccucauacgacucugcauuauggucggagcgaaugcuucagauagaaugggaaugggaacgacauaccucgcccuaauggcuacauuuaaaaugcggccaauguuugcaguuggucuucuuuuucgucgccuuacaagcagggaaguacuuuuguuaacgauaggacucucacugguagcuucaguugaauuaccuaacucccuagaagaacucggagauggccuugccaugggaauaaugaugcuuaaacuauugacugaauuucaaccccaucaauuguggaccacacuauuaucuuugacauuuguaaagacaacccuuagcuuagauuacgcuuggaaaacaaccgcaaugguacucucuaucguaucucuuuuuccgcuauguuuaucaacgacaucgcaaaagaccacaugguugccaguacuccuaggcagcuuuggguguaagccacuuacuauguuuuuaauaacagaaaacaaaauuuggggacguaaaucauggccgcucaaugaaggaauuauggcgaucgggauuguauccauauuacuuucgucucuucugaaaaaugaugucccucuagcuggacccuuaaucgcugguggaauguugauagccuguuacgugauuucugggaguucugcugaucuuuccuuggaaaaagcagcagaagugucaugggaacaagaagccgaacauucgggggcuagccauaacauauuaguggaaguacaagaugacggaacaaugaaaauaaaagacgaagaacgagacgacacccuaacuauacuacucaaagcgacuuuacuggcagucucgggaguguaucccaugucuauuccagcaacuuuauuuguuugguacuuuuggcagaagaagaaacaaagaagcggaguuuugugggauaccccaucaccaccggaaguugagcgagcaguauuggacgauggaauauacaggauucuacagagaggccugcuaggacguucacaaguaggaguuggcguauuucaggauggcguguuucacacaauguggcauguuacgagaggggcuguacuaauguaccaaggaaaaagacuagaaccaucgugggcaucagucaagaaagaucuaauuucauauggaggugguuggagauuucaggguaguuggaauacuggggaagagguucaaguuauagcaguggaaccuggaaagaauccuaagaauguacaaaccacuccaggaacuuucaagacuccagaaggagaaguaggagcaaucgcauuggauuuuaaaccugguaccaguggaagcccaauaguaaaucgugaaggaaagauuguaggauuauacggaaacgggguugucacaacaagugguaccuauguaucggcaaucgcacaagcaaaagcaucucaggaaggacccuuacccgaaauagaagaugagguuuuuaagaaacguaaccucaccauaauggaucuccauccaggcagcggaaaaacaagacguuaccucccugcaauaguacgugaagcaauuaagcgaaaacuacgaaccuuaauucucgcaccgacgcgcguuguagcaagugaaauggcugaggcucucaagggaaugccuauuagauaccagacuacagccguaaaaucagaacacacgggacgagaaauaguugaucugaugugccacgcuaccuuuacaaugcgauuguugucaccaguaagaguaccuaacuauaauaugaucauuauggacgaagcacacuuuacagauccagcgaguauagcugcccgagguuauauaucaacaaggguggggaugggcgaagcagcugcgauauuuaugacagcuacacccccaggaucuguugaagcauuuccgcaaucaaaugcuguuauacaagaugaagaaagagacauccccgaacgaucguggaauaguggauaugauuggauaacugauuuccccggaaaaacuguuugguuugugccgucaauaaaauccgguaaugacauagcuaauugucuaaggaaaaauggcaaacgugucauacaguuaucaagaaaaacauuugauacagaauaccagaaaacgaaaaacaacgauugggauuaugugguaacaacugauauuucagagaugggagcaaauuuucgagcugauagaguaauagaucccagacguugccuuaagccaguaauauuaaaagaugguccugaacgcgucauucucgcaggaccaaugcccguaacgguagccucagcugcgcaaagacgaggcagaauugguaggaaccagaauaaggaaggggaucaguacgucuacaugggacaaccauuaaauaacgaugaagaucaugcccacuggaccgaagcgaagaugcuauuggauaauauuaacacgcccgaagguauaauuccagcguuguuugaacccgaacgagagaaaagugccgcgauagauggagaguaucgucuacgaggagaagcacguaaaacauuuguagaauuaaugcgaagaggugauuuaccgguaugguugagcuacaaaguugcaucggagggauuccaauacucugauagaaggugguguuucgauggugaaagaaacaaucaaguauuagaagaaaauauggauguagagauuuggacaaaagagggcgagcgaaagaaauugaggccaaggugguuggaugcaaggaccuauucugacccacuagcuuuacgugaauuuaaagaauuugcggccgggagacgguccguaaguggugaucucauacuagaaauaggaaaauugccccaacaccucacgcuaagagcgcagaaugcucuagauaaucuagucaugcuccacaacagugaacaagggggcaaagcguacagacaugcaauggaggaacugccagauacgauagagacguuaauguuacuggcuuugauagcgguucuuaccgggggaguuacacuauuuuuccugucuggaaaaggauuggggaaaacaaguauaggguuacuuugcgugacagccucuagcgcacucuuguggauggcuaguguugagccacauuggauagccgcgagcauaauauuagaguucuuuuuaaugguacuucuaauuccagaaccagauagacaaagaacaccacaagauaaccaguuagccuaugucguuauaggucuccuguucaugauuuuaacggucgcagcaaaugaaaugggucugcuagaaacaacuaagaaagaucuagggauugguuauguagccgccgaaaaccaccaacacgcaaccauguuagacgucgacuuacaucccgcauccgcauggacgcuuuaugcuguagcgacuacgguaaucacaccaaugaugagacacacuaucgagaacacaacugcgaacauaucacucacagccauagcgaaucaagcggcaauacugaugggacuagauaaaggauggccaauaucgaaaauggacaucggaguaccacuauuggcauuaggauguuauucucaaguaaauccuuuaaccuuaacugcugcuguucuuaugcugguugcucauuaugcaaucauaggaccaggccuacaagccaaagccacacgcgaggcucaaaaacgcacagcagcagggauaaugaaaaauccaacagucgacggcauaguagcgaucgaccuagauccuguaguauaugacgccaaguucgaaaaacaacugggacagauaauguuacuaauucuauguacaucccaaauuuuacuuaugcgaacaacuugggcauuaugcgaaucaaucacacuagcuaccggcccucuaacaacauuaugggaagguucaccagggaaauucuggaacacaacaauagcugucucaauggcuaacauauucagagguaguuauuuagccggagcaggacuggcuuuuagccugaugaaguccuuaggaggaggacgaagaggaacgggugcucaaggcgaaacguuaggagaaaaauggaaacgucagcucaaucaacuuucgaaaagcgaguucaauacuuauaaacggucagggauuauggaaguggacagguccgaagcuaaagaagggcuuaagagaggagaaacaaccaaacacgcggugucccgaggaacagccaaacuaagaugguucguggaaagaaacuuggucaaaccagaggggaaagugauugauuuaggaugugggagagggggauggaguuauuauugcgcgggacucaagaaaguaacagaaguuaaagguuacacaaaaggggguccaggccaugaagaaccuauuccaauggcaacuuauggauggaauuuaguaaaacuacacucaggaaaagauguauucuuuaugccuccagaaaagugugauacuuuauuaugcgauauuggagaaagcaguccaaauccaacaauagaggagggucgaaccuuaagagugcuaaagaugguggaaccgugguuacgcggaaaccaauuuuguauuaagauauuaaaucccuacaugccaagcguaguagaaacucuggaacaaaugcaaagaaaacauggaggaauguuaguacgaaaucccuuaaguaggaacucgacacaugaaauguauugggucagcugcggaacaggaaauauaguaucugcaguuaauaugacaaguaggaugcuauuaaacagauuuacuauggcgcaccgaaaaccaacauaugaaagagacguagaccugggagcaggaacaaggcacguagcuguugagccugaagucgcaaaucuugauauaauuggccaaaggaucgagaacaucaaaaaugaacacaaaagcaccuggcacuacgaugaagauaacccguauaaaacaugggcauaucauggaagcuacgaagugaagccuucgggaagugcgaguucuaugguuaacggcgugguccgacuacuaacuaaaccaugggauguaauaccgaugguaacccaaauagccaugaccgacacuacacccuucggacaacaaagggucuucaaagaaaaagucgauaccaggaccccucgugcaaaaagaggcacgacacagaucauggaagucacagcuaaaugguuauggggauuuuuaucaaggaauaagaaaccgcgcauauguacuagagaagaguuuacgcggaaagugcgaucaaaugcugcaauuggugcgguuuuugucgaugagaaucaguggaauagcgcaaaagaagcaguggaagaugagagauuuugggaucucguucaucgggaacgagaguuacacaaacaggguaaaugugcaacauguguauauaauaugauggguaaacgagagaagaaacucggggaauuuggcaaagcuaaagggaguagggcgauuugguacauguggcuaggagccagguucuuagaguucgaagcauugggcuuuaugaaugaggaucauugguuuagcagagaaaacucuuugucaggagucgaaggggaaggauuacacaaacucggcuacauauuaagggauauaaguaaaauaccaggcgguaacauguacgcagacgauacugcgggaugggacacgcggauuaccgaagacgaucuacaaaaugaggcgaaaauaaccgacaucauggagccagaacaugcacuucuagcuacgucaauauuuaaguuaacuuaccaaaacaaaguaguaagaguccaacgacccgccaaaaacgggacagucauggacgucaucaguagacgagaucagagagggucgggccaaguagggacuuacggacugaauacauuuacgaauauggaaguacaacuuauccggcaaauggaaagugagggaaucuuucuucccucugagcucgagacgccaaaccuggcagaaagagcauuagacuggcuggaaaaacacggagcagagcggcuuaaacgaauggcaauuucuggcgaugacuguguaguaaaaccgauagacgacagauuugccacugcauuaacagcccucaacgacaugggaaaggucaggaaggauaucccacaaugggaaccgaguaaagguuggaaugauuggcaacaaguaccuuuuuguucacaucauuuucaucagcugauaaugaaagauggaagagaaauaguagugccgugcagaaaucaagaugaacugguuggucgugccagaguuucgcaaggcgcuggguggaguuuacgggagaccgcuugccuuggcaaaaguuaugcucaaauguggcaguuaauguauuuccaccgccgagaucuacgauuggcugcaaacgcaaucugcucagcggucccaguagauuggguaccaacaagucgaacaacauggucuauccaugcgcaucaccaauggaugacaacagaagauaugcuguccguauggaauagaguguggauagaggaaaacccauggauggaagacaaaacacacgugaguagcugggaagaagugccauauuuagguaaaagggaagaucaauggugugggaguuuaaucggccucacagcucgagccaccugggcaacuaacauccagguagccauuaaccaaguaagacgauuaauuggaaaugagaauuacuuagacuauaugacauccaugaagagauuuaaaaaugaaucugaucccgaaggugcucuaugguaa

SEQ ID NO: 21402 - RNA, 9879 nt, Artificial Sequence
  derived and/or modified CDS sequence (opt6) from DENV-1__EU482611__SS-prME
agcguaaccauguuauuaauguuauuaccaaccgcauuggcauuucacuuaaccacuagaggaggagaaccacauaugauaguuucuaagcaagaaagaggaaaaagccuauuauuuaaaacaagcgcuggggucaauaugugcacauugauugcgauggacuuaggcgaacucugcgaagauacuaugacauacaaauguccgagaauaacagaagcagaaccagacgauguggauuguugguguaacgccacagacacauggguaacauacggaacaugcucacaaacaggcgaacaucgacgagaaaaacggucaguagcacuagcaccacaugucgggcuuggccucgaaacuagaacggaaaccuggaugucaucugaaggcgcuuggaaacaaauacagcgaguagaaacaugggcuuuaagacaucccggauuuacaguaauugcguucuuucuugcacacgcaauaggaacgucuauaacucaaaaaggcauaauauuuauccuccuaaugcuaguuacaccaaguauggcaaugagauguguuggcaucggaaauagagauuuuguggaagggcuaagcggggcuacuuggguagacguaguguuagaacacgguaguuguguuacuacuauggccaaaaauaaacccacucuagacaucgaauuauugaaaacugaagugacaaauccugcgguucuccguaaacuuuguauugaagcaaaaauaucuaacaccaccacugacaguagguguccaacgcagggagaagcuacacugguugaagaacaagaugcaaacuuuguguguagaagaacauucguggauagaggauggggcaauggaugcggacuauucggaaaaggaagucucuuaacaugcgcaaaguucaaguguguaacuaaauuagaaggaaagauaguucaauacgaaaaucugaaguauucaguaaucgucacaguacauacgggagaccaacaucaaguagggaacgagaccacagaacaugguacgauagcaacaauaaccccacaagcccccaccagugaaauucaacuaacagacuauggagccuugacucuugacuguucgccacgaacaggccuagauuucaaugaaaugguuuuacuuacaaugaaagagaaaagcuggcuagugcacaaacaaugguuucuagauuuaccacuaccauggacaucgggagcuucaacaagccaggaaacuuggaaccgccaggaucuauuagugacguuuaaaacggcacaugccaagaaacaagaagugguaguccuggguagccaagaaggcgcuaugcacacggcacucacgggcgcaacggagauacagacaucgggaacgaccacaauuuucgcgggucaucuaaaaugccgauuaaaaauggacaaacugacccuaaaggguaugucguauguuauguguaccgguucauucaagcucgagaaagaaguugcagagacccaacacgguacaguuuuaguucagguaaaauaugaaggaaccgacgcgccaugcaagaucccuuuuucaacgcaggacgaaaaagguguuacacaaaacggcagacuaauuaccgccaaucccauaguaaccgauaaagaaaaaccagucaauauugagaccgagccgccauucggggaaucauauauugucgugggagccggugagaaagcacuaaagcucucgugguuuaaacgagggucaucaauuggaaaaauguuugaagcaacagcaaggggagcgcgacgaauggcaauauugggagacacagcaugggauuucgguucaauaggcggcguuuuuacgaguguaggcaaauuaguucaucaaguauuugguacagccuaugggguccuauuuucuggugucucauggacuaugaaaauaggaauaggaaucuuacuaaccuggcuuggucucaauucaagaucaacauccuugucgaugacaugcaucgcagugggcaugguuacgcuauaccuaggaguaaugguccaagccgacucaggaugcguaauaaauuggaagggacgagaacuuaaaugugggagcgguauuuuugucacuaacgaaguacacaccuggacugagcaguacaaauuucaagccgauuccccaaaacgguuaucagccgcuauaggaaaagcaugggaggaaggaguuugugggauacguucggcuacaagauuagaaaauauaauguggaaacagauaagcaaugaauuaaaucauauccuacuagaaaacgauaugaaacugacuguaguaguaggggaugcuaacgguauucuggcacagggaaagaaaaugauaagaccucagccuauggagcauaaguauucauggaaaucguggggaaaagccaaaauuauuggagcggauauccaaaacacaacuuucauaaucgacgguccagauacuccagaaugcccagacggacaaagagccuggaauauuugggaaguugaagauuaugguuucgggguauuuacaaccaacaucuggcuaaaauuacgagauucauauacacaaaugugugaucacagauuaaugucugcugcuaucaaagacaguaaggcgguacacgcagacaugggauauuggauugaaagcgaaaagaaugaaacguggaaacucgcuagagcaucauucauagaaguaaagacuugcacauggccaaagucucauacucuauggaguaauggcgucuuagagucugaaaugauaauaccaaagaucuauggcggccccauaucacagcacaauuaucgaccaggcuacuuuacacaaaccgcuggucccuggcauuugggaaaauuagaguuagauuucgaccugugugaaggaacaacgguaguagucgaugaacauuguggaaaucgagguccaucucuccgcacaacaaccguaacuggcaaaaucauacaugaguggugcugcagaaguuguacacuaccgccucucagauuuagaggugaagauggauguugguacggaauggaaauaagaccgguaaaagagaaagaagaaaaucuggucagaaguaugguauccgccggaagcggagaaguagauaguuuuaguuuagguauucuuuguguaagcauuaugauagaggaaguaaugagaucccgauggagucgaaagaugcuaaugacgggaacacuagcaguguuccuauuguuaauuaugggucaauugacauggaacgaccuaauccgacugugcauaaugguaggugcaaaugcaagugaccguauggguauggguacaacguauuuggcauugauggcuacauuuaagaugcgaccuauguuugccguaggacucuuauucaggcgcuuaacuucacgcgaaguacuuuugcuuacaauaggucuuagcuugguggcaaguguugagcuaccaaauucucucgaagaauuaggagauggacuagcgaugggcauuaugaugcuaaagcuccuaacagaauuucaaccacaccagcuguggacaacacucuuaucacuaacuuucgucaaaaccacauuaagccuagauuaugcauggaaaacgacagcuaugguauuaaguauagugucauuauucccguuguguuuaucaacaacgagccagaaaacuaccuggcuuccaguauuacucggaucauucggguguaaaccucuaacuauguuuuugauaacagaaaacaagauaugggguagaaaaucguggccucuaaaugagggcauaauggcgauaggaauuguuaguauauuguuauccaguuugcucaaaaaugauguaccguuagccgguccauuaauagcuggagguauguugauagcaugcuacgucauaucagggucauccgcugauuuaucucucgagaaagcggccgaaguaaguugggaacaagaagcugaacacaguggcgcaucgcauaacauucuaguagaagugcaagacgacggaacgaugaaaauaaaagaugaagaaagagaugauacacuaacaauuuuacuaaaagccacacuacucgcuguaucgggcguauauccuaugucuaucccagccacacuauucguaugguauuuuuggcagaaaaagaaacagagaagugggguucuaugggacaccccaagucccccagaaguugagcgugcuguacuagaugauggaauauauaggauucugcagaggggguuauuagguagaucccaaguuggugugggaguauuucaagacgggguauuucauacuauguggcaugucacacggggugcggugcugauguaccaggggaaacguuuagaaccauccugggcaucaguaaagaaggauuuaauauccuacggcggaggauggagguuucagggauccuggaauacaggugaagaaguccagguaauugccguagaaccagguaagaaccccaaaaacguucagacaacaccgggaacauuuaaaacuccugaaggugaaguaggugccauugcucuugacuucaaaccugguacaagcgguagucccauaguuaauagagaaggaaagauagugggucuuuauggaaaugggguaguaacuacuuccgguacuuacguauccgcuaucgcucaagcaaaagccagucaagaaggaccucucccugaaauugaagaugagguguuuaagaaaagaaaccuaaccauuauggacuuacauccggggucaggcaaaacaaggcgauaccuaccagcuaucguuagagaggcaaucaaaagaaaacucagaacgcugauacucgcuccaacccguguuguagcaagcgaaauggcagaagcccuaaaaggaaugccaauacgcuaucagacaacggcugugaaauccgaacauacgggucgagaaauuguugauuuaaugugccaugcuacauuuacgaugagacuauuaucaccaguacgcgugccaaacuacaauaugauaauaauggaugaagcacauuuuacagauccugcgagcauugcggcaaggggguauauuaguacaagaguagggaugggggaagcagccgcgaucuucaugacugcaacaccaccagggagugucgaagccuucccgcagucuaacgcugugauacaggaugaggagcgcgacauaccagaacguagcuggaacucaggauaugacuggauaacagacuucccugguaaaacugugugguuuguuccgucaauuaagucagguaaugacauagccaacuguuugcguaaaaacgggaaaaggguuauacaauuauccagaaaaacauucgauacagaauaucaaaagacgaaaaauaaugauugggauuaugucguuacaacggacauaagcgaaaugggagccaacuucagagcagauagagugauugacccuagacguuguuuaaaaccuguaaucuuaaaggaugggcccgagcgaguuauuuuagcgggaccuaugcccgucaccgucgcuucugcagcgcagagaaggggacgaauaggacgaaaccaaaauaaggaaggagaccaguacguauacaugggacagcccuuaaauaacgacgaggaccaugcgcauuggacagaggcaaaaaugcuauuagacaauauaaauacaccggaaggaaucauaccagcucuuuucgagccugaacgugagaagucagcagcaaucgacggcgaguaucgucuaaggggagaagcucgaaaaacauuuguugaacuaaugcgaagaggggacuuaccaguaugguuguccuauaagguagcuucagaaggauuccaauacucugacaggagguggugcuucgauggagaaagaaauaaccaagucuuagaagaaaauauggauguagaaaucuggacuaaagaaggugaaagaaagaaauuacggccacgcugguuagacgcuagaacauacucagacccucuggcccuucgagaguuuaaagaguucgcugcugggcgacguagcguaucuggugauuuaaucuuggagauugguaaguuaccucagcauuugaccuuacgugcucaaaacgcauuagauaaucugguuaugcuacacaacucagaacaaggagggaaggcauauagacacgcaauggaggaacucccagacacgauagagacauuaaugcuccucgcccuuauugcgguccuaacuggaggagucacucuuuucuuccuuaguggaaagggacuaggcaaaacuuccauuggguuacuuuguguuacagccucuucugcuuuauuauggauggcaagcguugaaccacauuggauugcagcaagcauaauacuagaguucuuucuaaugguacuacuaauuccggaaccugaucgucaacgaacaccacaggacaaccaacuagcguauguuguaaucggucuccuauucaugauacuuacugucgcggcgaacgaaaugggucugcucgaaaccacuaagaaagauuuaggcauaggguaugucgcggcugaaaaucaucaacaugcuacuauguuagauguagauuuacacccggcgucagcauggacacuuuaugccguggcuacaacaguaauaacuccuaugaugagacauacaauugaaaauacgacugcgaauauauccuuaacugcaaucgcaaaucaagcagcuauacuaaugggauuggauaaggguuggcccauaaguaaaauggacaucggugucccauuauuagcuuuaggauguuauucucaggugaauccuuuaacuuuaacggcagcaguacuuaugcuaguagcgcacuaugcaauaauuggaccuggccuacaagccaaagcgacuagagaagcucagaaaaggacugccgccggaauaaugaaaaauccgacgguagauggcauaguagcaauagaucuugauccaguaguguacgaugcaaaauuugagaaacaacugggacaaauaaugcugcuaauucuaugcaccagucaaauucuuuugaugcggacgacaugggcgcuaugcgagucuauaacccuugcaaccggaccacuaacuacauugugggaaggcucaccugguaaguuuuggaauaccacgauagcaguuuccauggcaaauauauuucgaggcuccuacuuagcaggcgcuggauuagcauuuucauuaaugaagucgcuaggaggcgguagaagaggaacaggcgcccaaggcgaaacgcuaggagagaaauggaaaaggcaacucaaucaauuaucuaagagugaauuuaacaccuacaagcgaagugggaucauggaaguagacagaagcgaagccaaagaaggacuaaaacggggagaaacaaccaagcacgcuguaucccguggcacagccaaauuacggugguucguagaaagaaaccugguuaagccugaaggcaaaguuauugaucuugguuguggaagaggaggauggaguuauuauugcgcaggucuuaaaaaggugaccgaaguaaagggauauacaaagggaggaccaggccacgaagaaccuauaccuauggcuacauauggcuggaauuugguaaaacuacacagugguaaagauguauucuuuaugccacccgaaaagugcgauaccuuacucugugauauaggggaauccucgccaaauccuacgauugaagaaggccgaacgcuucguguucuuaaaaugguugaaccauggcuacgcgggaaucaauucugcaucaaaauacuaaauccuuauaugccgucaguaguagaaacacuggaacaaaugcaacggaagcaugggggaaugcuagugcgaaacccacuaucaagaaacagcacucacgaaauguacuggguaucuugugggacuggaaauaucguaucggcugucaauaugaccucacgcauguuauugaauagauucacuauggcccauagaaagccuacauacgaaagggauguugaucuaggggcaggaacacgacacguggcgguagaaccggaaguugcuaacuuagacaucaucggccaaagaauugaaaacaucaaaaacgaacacaagaguacauggcauuaugaugaagauaauccauauaaaacgugggccuaucacggaagcuacgaggugaaaccaucaggaucagcgucuagcauggucaacgggguggugagauuacuaacuaaaccgugggaugugauuccaaugguuacccaaauagccaugacggacacuacaccuuuugggcaacagagaguguuuaaagagaagguagacacacggaccccucgagcaaaacgcggaacaacucagauuauggagguuacggcaaaauggcuguggggauuccugucaagaaacaaaaagccucguauauguacuagggaggaguucacacgaaaaguucgaaguaacgcugcaauaggugcuguguuuguggacgaaaaucaauggaacuccgcaaaagaagccguugaggaugaacgauuuugggacuuaguacaucgagaacgcgaacuccauaagcaaggaaagugcgcaaccuguguauauaacaugaugggaaaaagagagaagaaauuaggcgaguucgggaaagcaaagggcucucgagcgauaugguauauguggcucggcgcucgcuuucuagaguucgaggcuuuaggguucaugaaugaggaccacugguuuucacgcgagaauaguuuaucuggcguugaaggugaaggauugcauaaacuuggauauauucuaagggauauaucuaaaaucccgggugguaacauguaugccgacgacacagcagggugggauacuagaauaacugaggaugauuuacaaaaugaagcuaagaucacugacauaauggaaccugaacacgcacuuuuagcuaccaguauauuuaaacuuacuuaucaaaauaaaguagugcguguucaacgaccugcgaagaaugggacuguaauggauguuauuucuagacgggaucaaaggggauccggacaaguaggaacuuacggccuuaauacuuucacaaauauggagguucagcuaauuagacaaauggaaucagaaggcauauuucuccccucggaauuagaaacuccaaacuuagcugagcgugcucuagacuggcuagaaaaacauggagccgaacgacugaaaagaauggccauauccggugaugacugcguagucaaaccaaucgaugaucguuuugcaacagcauugaccgcacucaaugauauggguaaagugagaaaagacauuccucagugggaaccaagcaaaggauggaaugacuggcaacaaguaccauuuugcucacaucacuuccaucaacucaucaugaaagacggaagagaaauagucguacccugcaggaaucaagaugaacuuguaggcagagcgcgaguaagccaaggagcgggauggucgcuucgugaaaccgcaugucugggaaaaaguuacgcccaaauguggcagcuuauguacuuucaucgcagagaucuccgccuugcagcuaaugcuauuugcucggcaguuccuguagauuggguaccgacaagccgaaccacauggucaauacaugcccaucaccaauggaugacaacugaagacaugcugucugucuggaacagaguauggauagaagaaaauccguggauggaagacaaaacacacguaucaucuugggaagaagugccauaucugggaaaaagagaggaucaaugguguggaucauuaauaggccugacugcaagagcuaccugggcaacaaacauccaaguugcaauuaaucagguacguagguugauuggcaacgaaaauuauuuagauuauaugacgucuaugaaacgauuuaaaaaugaaagugaccccgaaggggcucuuugguga

SEQ ID NO: 21403 - RNA, 9879 nt, Artificial Sequence
  derived and/or modified CDS sequence (opt6) from DENV-1__FJ639735__SS-prME
agcgugacgauguuauuaaugcuuuuaccaacagcccuggcauuccaucucacgacucggggaggagaaccacauaugauagucucaaaacaagaacgaggcaaaagccuacucuuuaaaacaagugccggggucaauauguguacccuaauugcaauggaucuuggcgaauugugcgaagacacgaugacuuacaaaugcccucgaauuacugaagcagaacccgacgauguagauugcugguguaaugcaacugauacuuggguuacguauggcacaugcucgcaaacgggugaacauagacgugauaaacgaagcguugcuuuagcuccucacguaggucuuggauuagaaaccagaacggaaaccuggauguccuccgaaggagcauggaaacaaauacaacgggucgaaacuugggccuugagacauccggguuuuacgguaacugcuuuguuccuggcccaugcaauagguacgucgauuacccaaaaaggaaucauuuuuauucugcuaauguuaguaacuccaucuauggcaaugaggugugucgggauaggaaaccgggacuuuguagaaggcuugucaggggcgacguggguugauguaguacuggaacaugguucaugcguaacuacuauggcgaaaaauaaacccacccuagacauugaacuacuuaaaacagaaguuacuaacccagcagugcucagaaaacuuugcauugaagccaaaauaucaaacacgacaaccgauagucgaugcccuacacagggugaagcgaccuugguugaagaacaggaugcgaacuucgucugccgucguaccuucgucgaccgaggauggggaaauggcuguggacuuuuuggcaaaggaucauuacucacaugugcaaaauucaaaugugugaccaaauuggaaggaaaaauugugcaauaugaaaaccucaaauacucaguuauagucacaguacacacgggagaucaacaccaaguugggaacgaaacaaccgaacacggaacaauugcaacaauuaccccacaagcuccaaccucugaaauucaacucaccgauuauggagcucuuacauuagacugcaguccgagaacuggcuuagacuuuaaugaaaugguccuccugacuaugaaagaaaagucuuggcuaguucauaaacagugguuucuugaucuuccauuaccguggacaucuggagcaucuacaagccaagaaaccuggaaucggcaggauuuauuaguaacauuuaaaacugcucaugcgaagaaacaggaaguugugguucuaggaagccaagaaggcgccaugcauaccgcucuaaccggggcuaccgaaauucaaacaagugguacaacuacaauuuuugcuggucacuuaaaaugccggcuaaagauggacaaauuaacauugaaaggcacgaguuacgucaugugcacaggcagcuucaaauuagaaaaggaaguugcugaaacacagcaugguaccguguuaguacaaguaaaauacgaaggcacggaugcacccuguaaaauacccuuuucaacacaagaugaaaagggaguaacucaaaauggacgauuaaucacagccaacccaauuguaaccgauaaagaaaaaccgguuaauauagaaacagaaccgccauuuggagaaucuuauauuguugucggagcgggugagaaggcuuuaaaacucucuugguuuaagaaagguuccuccaucgggaagauguucgaagcaacagcuagaggcgcucgccgaauggcaauucugggagacacagcaugggacuuuggauccauaggugguguauucacaagugucgguaaauuaguacaucaaguuuuugguacagcguaugggguccuauucucaggugugucauggacaaugaagauugguauugggauacuauuaacaugguugggccuaaauuccagauccaccucuuuauccaugacaugcauagccguagguaugguaacacuauaucuaggaguuauggugcaagccgacucaggaugugugauaaacuggaaagguagagagcugaaauguggcagcgguauuuuugugacaaaugaaguacacacauggacugagcaauauaaguuucaagcggacucgccaaaacgccuaagugcugcuauagguaaggcuugggaagagggagugugugguauaagaagugcaacacggcucgaaaauaucauguggaagcagauuucgaaugaauuaaaucauauuuuauuagaaaaugauaugaaauucacagucguggugggggaugcuaacggcauucuagcucaggguaagaagaugauuagaccacaaccgauggaacauaaauauaguuggaagucaugggggaaagcaaaaauaaucggugcagauauacaaaauaccacauuuauuauugacggaccugauaccccugaauguccagacgaucaaagagccuggaauaucugggaagucgaagauuacggcuucggaaucuucacuacuaauauuugguuaaaacuuagagauagcuauacacaaaugugcgaucaccgucuaaugagcgcugcgauaaaagacuccaaagcgguacacgccgauaugggauacuggauugagagcgagaaaaaugaaacguggaaauuggcaagagcaucauucaucgaaguuaaaacuugcacguggccgaaaagucacacauuguggaguaacggaguauuagagagugagaugauuauaccuaagauuuacggaggcccuauuagucaacacaauuaccgaccaggguauuuuacacagacagcaggcccauggcaccugggcaaacuggagcucgauuuuaauuuaugugaaggaacgacugucguagucgaugaacacugcgguaacagggggcccucauuacgaacuacaacuguaacuggcaaaauaauacacgaaugguguugcagaaguugcacauuaccaccgcuuagguuccggggcgaagacgguugcugguaugguauggagauaaggccaguaaaagagaaagaagaaaaucucguacgaucuaugguuucagccgguaguggggaagucgauuccuuuagucuuggaauuuuauguguaucaaucaugaucgaggaaguuaugaggagccguuggucacgcaagaugcugaugaccgggacgcucgccguuuucuuacugcucauuaugggacagcugacauggaaugauuuaauucguuuauguauuaugguaggugcaaaugcaagugaucgcauggggaugggcacaacguaucuagcuuuaauggccacguucaaaaugagaccuauguucgccguaggacuccucuucagacgacugacaucacgagaaguacuacuacuaaccauagggcugagcuuagucgcaucaguagaacucccaaacaguuuagaagaauugggcgauggacucgccauggggauuaugaugcuaaaauuauuaacggaguuccaaccgcaucaacuauggacaaccuugcuuucacuaacauucauuaaaacaacucuaaguuuagauuaugcuuggaaaacuacugcaauggcacucucuauaguaucacuauuuccuuuauguuuaucaacgacuagccaaaagacuacguggcuuccaguauuguuagguuccuucgggugcaaaccccugacaauguuccugauaacugaaaauaaaauauggggacgaaaaucguggccacuaaacgagggcauuauggcuauagggauugugucaauucuguuaaguucgcuauugaaaaacgacguaccgcuagcagguccucuaauagccggcggaaugcuaauugcauguuaugugauaucaggaucaagcgccgaucucucguuagagaaagcugcagaaguaaguugggaacaagaagcugagcauuccggcacuucucauaauauacucguggagguucaagaugaugguaccaugaaaauuaaggacgaggagaaggaugauacguuaacgauccuacuaaaagcuacacuuuuagcugucucaggugucuaccccaugaguauaccugccacauuauucguaugguacuuuuggcagaaaaagaaacaaaggagcggagugcuuugggauacaccgucucccccagaaguggaaagggcuguacuggaugacgggauauaucggaucuugcaaagaggccucuuaggcaggagccaaguuggagucgguguauuccaagauggaguauuucacacaauguggcacgucacaaggggugcuguccuuauguaccagggaaaaagauuagaacccucuugggcaaguguaaagaaagacuuaauaagcuauggaggagguuggcguuuccaaggcucuuggaauacaggagaagaaguacaaguuauagccgucgaaccgggcaagaacccgaagaacguucagaccacuccuggaacauucaagaccccugagggagaggucggagcuaucgcucuagacuuuaagccaggcacuucaggaucaccaauaguuaauagggaaggaaaaauuguuggacuauacggaaaugggguaguaacaacauccggaacuuacguaucagcuauugcacaggcaaaagcuagucaagaaggaccacugccagaaaucgaagaugaaguguuuaaaaagagaaaccuaaccaucauggaucuacacccugguagcggaaaaacucggagguaccucccagcuauaguacgagaggcgauaaaaaggaaauuaaggacccugauccuggcaccaacaagaguaguagcaucagagauggccgaggcuuugaaaggcaugccaauaagauaccaaacgacagcaguuaaaucagagcauaccggacgugaaauuguagaccuaaugugccacgccacauucacaaugagauuacuaagcccagugagagucccgaauuauaauaugaucguuauggacgaagcacacuuuacagacccagcgagcaucgcagcuagaggauauauaaguacacgaguaggcaugggcgaggcagcagcaauuuucaugacggcuaccccaccaggaucggucgaggcuuuuccucaaaguaaugcuguaauacaagacgaagaacgcgacauaccugaacgaucuuggaacucggguuaugacuggauaacagauuuucccggcaaaacggugugguucguuccaaguauuaaaucagguaacgacauagccaauuguuuaaggaaaaaugguaaaagagugauacaacuaagucguaaaacauuugacacagaauaccagaaaacaaagaacaaugacugggauuauguaguaacgaccgauauauccgaaaugggagccaacuucagggcagauagagucauagauccaagaagaugcuuaaagcccguaaucuuaaaagauggcccugaacgggugauucuagcuggacccaugcccgucaccguagcaucagccgcacaaaggagaggacguauagguagaaaucaaaacaaagagggcgaucaauauguauauaugggacaaccauuaaacaaugaugaggaucacgcacacuggacagaggcaaagauguuauuagauaacauaaacacuccugaggggaucauacccgcguuauucgaaccagagcgagagaagagugcagcaauagauggggaauacaggcuuagaggagaagccagaaaaacauucguagagcuuaugagacguggagauuugccaguaugguuaucguacaaaguagccagcgaaggcuuccaauauucagaucggaggugguguuuugacggugaacgaaauaaucagguacuggaagagaacauggauguugaaauuuggacuaaggaaggcgagaggaagaaauuacgaccacggugguuagaugcuagaacauauucugacccacuagcauugagagaauuuaaagaguucgcugccggucgucgaucaguuucuggugaucuuauuuuagaaaucgggaaacuaccacaacacuuaacacuacgugcacaaaacgccuuagacaaucuaguaauguuacauaauuccgaacaaggggguaaagccuauaggcaugcaauggaggaacugcccgauacuauagagacucuaaugcuauuagcccugauugcaguccugaccgggggaguaacuuuauucuuucuuucggguaaaggacuugguaagacaagcaucggucuacuaugugugaccgcaaguucagcucuauuauggauggcgucgguggagccacauuggauugcugcaagcauaauauuggaguuuuucuuaauggugcugcucauccccgaaccggauaggcaaagaaccccgcaggauaaucaauuagcuuacguaguuaucggucuguuauuuaugauauuaaccguagcagcaaaugaaaugggauuauuggaaacgacaaaaagggacuuggguauuggccauguggcugcugagaaucaccaacaugcaacuauguuagacguugaucuaaggcccgcuagcgcauggacacuuuaugcugucgcuacaacgguuauaacaccaaugaugagacauacaauagaaaauacuacugccaacauaucucuuacagcgauagcaaaccaggcagcgauucucaugggacuagacaaaggauggccaauaaguaaaauggauauugggguuccucuucuugcauuaggcuguuacucgcaaguaaauccauuaacguuaacugccgccguucuaaugcugguagcucauuacgcaauuauuggaccaggguuacaggcaaaggcaacuagagaagcacaaaagagaacugcagcgggaauaaugaaaaaucccaccgucgaugguaucguagcuauagacuuagauccuguaguuuacgaugcaaaauuugaaaaacaauugggccagauuaugcuucugauauuauguacuucacagauucuuuugaugagaacaacaugggccuugugcgaauccaucacguuggccacaggaccguuaacuacguugugggaagguucuccaggaaaauucuggaacacaacuaucgcgguaagcauggcgaauauauuucguggcaguuaucuggcgggagcagguuuagcguucagucuaaugaaaucuuuagguggaggaaggcggggaacaggugcucaaggugaaacucucggcgagaaguggaaaagacaauuaaaccaguugucuaagucugaguucaacaccuauaaaaggagcggaauaauggaaguagaucguucagaagcaaaggaaggcuuaaaaaggggugaaacuacaaaacacgccguuagccgcggaaccgccaagcuaaggugguucgucgaacgaaaucucgugaaaccugaagguaaagucaucgaccuaggcuguggcaggggagguuggucguauuauugugcagggcuaaagaaagucacugaaguuaaaggauauacaaaaggaggaccaggccaugaagaaccaauuccaauggcaacauaugguuggaaucuugucaaauuacauagugggaaagauguguucuucaugccaccugaaaagugcgauacuuuauugugcgauauaggggaaucaucucccaacccgacaauagaagaagggagaacacuacguguacugaaaaugguagagccuuggcuuaggggaaaucaauucuguauaaaaauacucaauccuuacaugccgucaguaguagagacacuagagcagaugcaacguaaacauggcgguaugcuuguaagaaacccacuaaguagaaauuccacucacgaaauguacuggguuagcuguggaacagggaauaucguuagugcuguaaauaugacuagcagaauguuauuaaauagauucaccauggcacaucggaaaccuacauaugagagagauguagaccuaggagcggguacgcggcaugucgcaguagaacccgaaguagcaaaucuagauauuaucggucaacgcauagagaacaucaaaaaugagcacaaaagcacguggcacuaugacgaagauaauccauauaaaaccugggcguaucacggaucuuacgaagucaagcccagcggcagugccaguucaaugguaaauggaguaguacgccucuuaacaaaacccugggacguaauaccuaugguaacacaaaucgccaugacagacacaacacccuuuggacagcaacguguguuuaaggaaaagguagauaccaggaccccgagagccaaacgaggaacaacacaaauuauggaagugacagcaaagugguuauggggcuuuuugucccgaaauaagaaacccagaauauguacaagagaggaauuuacacggaaagugcggucaaaugcggcaauuggcgcaguuuucguggacgaaaaucaauggaacucugcaaaagaagcaguugaagacgaaagauuuugggaccuaguacauagagaaagggagcuacauaaacagggaaagugugccacgugcguauacaauaugaugggcaaaagagagaagaaauugggggaguucgguaaggcuaaagguucaagagcgauaugguauaugugguugggugcucguuuucuggaauuugaggcacuagguuucaugaaugaagaccauugguucucucgagaaaacucuuugucgggaguagagggugaaggucuccauaaacuagguuacauuuugagagacauauccaagauuccuggcgguaauauguacgccgaugauacagcgggaugggauacuagaauaacugaagaugaccuccaaaaugaagcuaaaauaacugacauaauggaaccagaacacgcauuauuagcaacauccauauucaaacuaacguaucagaauaaaguggucaggguacaacguccggccaaaaaugggacagucauggauguaauaagucgccgagaccagaggggaaguggacagguagggacuuauggauuaaauacuuuuaccaauauggagguacaacuuauuaggcagauggaaucugaggguauuuuucuacccagcgaauuggaaacaccaaaucuagcagaaagaguucucgacugguuagaaaaacacggugccgaacgauugaaacgaauggccauuucuggugaugacugcgucgugaagccaauagacgaucguuucgcaacagcucuuacugcacucaacgauaugggaaaaguuagaaaagacauaccgcaaugggagccuuccaaaggcuggaaugauuggcaacaggucccuuuuuguagucaucauuuucaucaacuaaucaugaaagauggucgggaaaucguaguaccuuguagaaaccaagacgaacuuguuggaagggcucguguaucucaaggcgcaggauggagucuacgagaaacagcauguuuagggaaaucguacgcucagauguggcaacugauguauuuucacaggcgcgaccuuagauuggcagcaaaugcaauuuguagugcagugccaguagacuggguuccuacaucgaggacuaccuggucaauacacgcccaccaccaauggaugacuacagaagacauguuaucaguauggaauaggguuuggaucgaagaaaaccccuggauggaagauaaaacucauguaucgucaugggaagaaguaccuuauuuaggaaagcgugaagaucaaugguguggcagcuuaauaggacugacugcaagagcuacaugggcaacgaauauacaagucgcuauaaaucaagucaggcgacuaauagguaacgagaauuaucuugacuacaugaccaguaugaaacgauucaaaaacgaaagcgacccugaaggggcauugugguag

SEQ ID NO: 21404 - RNA, 9879 nt, Artificial Sequence
  derived and/or modified CDS sequence (opt6) from DENV-1__FJ639740__SS-prME
aguguuacgaugcuuuugauguuauuaccgaccgcucuggcguuccaccucaccacacgggguggcgaaccccauaugaucguaaguaaacaagaaagagggaaaagccuuuuauucaaaacauccgcaggagucaacaugugcacguugauugcuauggauuuaggagaacucugugaagauaccaugacuuauaaauguccucggaucacggaagcagaaccagaugauguagauugcugguguaacgcgacagacacaugggucacauauggcaccuguucacaaaccggugaacacaggcgggauaagcgcucuguagcccucgcaccgcacguuggacuagguuuagaaacucggacggaaaccuggaugaguagcgaaggagcuuggaaacaaauacaacguguagagacgugggcguugagacauccuggcuucacuguuauugcuuuauuuuuagcucaugcuauaggaacaucaaucacacaaaaaggaauaaucuucauccugcuaauguuaguaacacccuccauggcaaugcgauguguaggcaucgguaacagagacuuugucgaaggguugucaggcgcuacuuggguagacgugguauuggaacauggcucgugugucacaacaauggccaaaaauaaaccuacacuggacauugaguuacuuaaaaccgaagucacgaacccggcaguacuucguaaacuguguauugaagcaaaaauaucaaacaccacaacagacucacgcuguccaacgcaaggugaagcaacucugguugaagaacaagaugcuaauuucguuugccgaagaaccuugguugauagagguuggggaaauggaugcggacuguuugguaaagguucuuuacugacaugcgcaaaauucaaauguguaaccaaauuggagggaaaaauaguacaauaugaaaauuuaaaauacucaguaauagugacuguccauacuggagaccaacaccaaguugggaaugaaacuaccgaacauggaacuauagcgacuauaacgccccaagcaccuacaucagagauucaguugacugauuauggagcacuaacacuagauuguucaccaagaacgggccucgacuuuaacgaaauggugcuguugacaaugaaagaaaaauccuggcuuguccauaagcaaugguuuuuggauuugccacuuccauggaccuccggagcaagcacuucccaagagacuuggaaccgucaggaucuuuuagucacauucaaaacugcucacgccaagaaacaagaaguaguugucuuaggaucccaagaaggugcgaugcauaccgcacuaacuggagcgacugagauucaaacaucugggacaacgacaauauuugcagggcaucuaaagugccgucuaaaaauggacaaauugacacuuaagggcaugagcuaugucauguguacagggucguucaaguuagaaaaggaaguugccgaaacccaacauggaacuguuuuagugcaaguaaaauacgagggaacggaugcaccuuguaagaucccauucgcaacacaagaugaaaaaggagucacccaaaacggacgacucauuacagccaacccgaucguuacggacaaagagaaacccguaaacauagaaacggaaccaccuuuuggagagagcuacauuguggugggagcgggcgagaaggcauuaaagcucaguugguucaagaaggguucaaguauaggaaaaauguuugaggcaacagcacgaggcgccaggagaauggcgauucugggcgacacugcgugggauuuuggauccauaggaggaguauuuacgucagucgguaaauugguacaccaaguuuucggcacugccuacggagucuuauuuaguggaguuuccuggacaaugaaaaucgguaucggaauuuugcugacgugguugggguugaauagcagaucaacaucacuauccaugacgugcauugcgguggguaugguaacucucuauuuagggguaauggugcaagcagacucgggaugcguaauuaauuggaaagggcgcgaacucaaguguggcucagggauauucguaacaaacgaaguacauacuuggacugaacaauacaaguuccaagccgacaguccuaaacgccucucugcugcuauuggaaaagcaugggaagaaggaguaugcgguauaagaagcgcaacaagauuagaaaauaucauguggaagcagaucucaaaugaacugaaucauauacuacuggaaaaugauaugaaauuuacugucguuguaggcgaugcuaauggaauacuagcacaaggcaagaaaaugauccgaccgcagccuauggagcacaaauacucauggaaaagcugggggaaagcaaagauaaucggugcagauauccagaauacuacuuucauuauagaugggccagacacgccggaguguccagauggucaaagagcguggaauauuugggaaguagaggacuauggauucgguauuuucacuacgaauaucugguuaaaauuaagagauagcuauacucaaaugugugaucacagacuaaugagugccgcuauaaaagauaguaaagcaguucaugcugauauggguuacuggaucgaaagugagaaaaacgaaacguggaaauuagcucgagcgagcuucaucgaagucaaaacauguacauggccaaaaucacacacauuguggucaaaugggguucuugaauccgagaugauaauaccuaaaauuuacggcggaccgauaucacagcauaauuaccguccggguuauuuuacacaaacggcugguccauggcaccucgguaaguuagaguuggacuucgauuugugcgagggaacuacuguaguugucgaugagcauuguggcaaccggggaccaaguuuaaggacuaccacaguaacgggcaaaauaauccacgaaugguguuguagaucuugcacauuaccaccacuaagauuccgaggugaagacggauguugguauggaauggaaaucagaccgguaaaagaaaaagaagaaaacuuaguacguucaauggucucggcugguucaggagagguagauucauuuagcuuaggaauuuuguguguauccauuaugauugaggagguuaugagaucaagauggucaaggaaaaugcuuaugacuggaacauuagcuguauuucuuuuacuaaucaugggucaguuaacuuggaacgauuugauacgacucuguauuaugguaggggcuaacgccucagacaggauggggauggggacuacauaccucgcccuuauggcuacguuuaaaaugagaccaauguuugcuguaggguugcuauuuaggagacucacuucuagagagguucugcuauugaccauugguuugagccugguagcaucuguugaacugccuaacucucuagaggaauuaggugauggguuagcaaugggaauaaugaugcucaaguuauuaacagaguuccaaccccaccaguuauggacuacucugcuaagucuaacauuuguaaaaacuacacugucguuagacuaugcauggaaaacgacugccaugguauuaaguaucguuucccuuuuuccgcuuugccugucuacuacaucucagaaaacuaccugguuaccuguguuguuaggaaguuucgguuguaaaccucuuacgauguucuugauaacggaaaauaaaauauggggucgaaagucauggccgcuuaacgaaggaauuauggcaauuggaauaguuucaauauugcuuuccucccuacucaaaaaugaugugccacuggcggguccauuaauagcuggaggcauguuaaucgcauguuacguaauaucugguucuucugcugauuuaucacuagaaaaggcagcugaagucaguugggaacaggaagcggaacauucaggggccagccauaauauuuuaguagaagugcaagaugaugggacaaugaaaauuaaagacgaagaacgagaugacacauuaacaauacuucuuaaagcgacccuuuuagcuguaucagguguguaucccaugucaauaccagcaacuuuauuugugugguauuucuggcagaagaagaaacagagaagcgguguauuaugggacaccccaagcccaccagaaguagaaagagcgguauuggacgaugguauuuauaggauuuuacaaagagguuuacuaggaagaucacaaguuggaguugguguauuccaggaugguguguuccacacaauguggcaugucacgagaggggcuguacuuauguaucaagguaaacguuuggaaccaucgugggcgucaguaaagaaagacuugauuucguacggcgguggauggagauuccaagguaguuggaauacuggugaagaaguccaaguaauagcaguugaaccugggaaaaauccuaaaaauguacaaacaacaccaggaaccuucaaaacgcccgaaggagaaguaggagccaucgcacuagauuucaaaccugguacguccggcucucccaucgucaacagagaggguaaaaucguaggguuauauggaaaugguguaguaaccacaucaggcacauacguaucugcaaucgcucaagcaaaggcaagucaagagggaccguugcccgaaaucgaagacgaaguauucaagaaacguaacuuaacaauuauggaccugcauccugggucugguaaaacuaggagauaucuaccugcuauaguccgugaagcuaucaaacgaaaacuaagaacuuuaauucuagcucccacaagggucgucgcuagcgaaauggcugaggcauugaaagguaugcccauaagauaccaaacuaccgccgugaaaucagaacauacaggacgcgaaauaguagauuuaaugugccacgcgacauuuaccaugagacuauuaagcccggugcgaguuccuaacuacaauaugauaauuauggacgaagcucacuuuacagauccagcgucaauagcagcuagagguuauaucucgacgcgcguagguaugggugaggcagcugcuaucuuuaugaccgcaaccccuccaggaaguguagaggcguucccacaaucaaacgcuguuauucaagaugaagagagagacaucccugaacgcaguuggaacucgggcuaugauuggauaacagacuuccccgggaaaacagucugguuuguuccaagcauaaaaagcggaaacgauauagcaaacugccucagaaagaacggaaaaagaguaauucaauuaucaaggaagacauuugacacggaguaucagaaaacgaagaauaacgacugggacuacguagucacuacggacauuucagagaugggagcaaauuuuagagcagacaggguaaucgauccuagaagaugucuaaagccuguaauuuugaaagacggcccggaacguguaauacuagcagguccaaugccuguaacuguggcgagugcggcacaacggagaggaaggaucggccgaaaucaaaauaaagaaggagaccaauauguauauaugggacaaccucuaaauaaugacgaagaucaugcucauuggaccgaagccaaaauguuauuagauaauauaaacacacccgaggguauuauacccgcauuauuugaaccagagcgagaaaaaucugcugcuauagauggagaauaucgcuugcgaggugaggcccgcaaaacguuuguggaacuuaugagaagaggagacuuaccaguuugguuaucauacaaagucgcaagugagggguuucaauauucagaucgacgguggugcuuugauggugaaaggaauaaccaaguacuagaagagaauauggauguugaaauauggacaaaggaaggugaaaggaagaaauuacgaccaagauggcuagaugcucgaacuuauucagauccucuugccuuaagagaauuuaaagaauuugcagcugguagaagaucuguguccggggaucuuaucuuagaaauagggaaacuuccacagcauuuaacacuacgagcacagaaugcucuggacaauuuaguaauguuacacaacucagagcagggugggaaggccuacagacaugcaauggaggaauuaccugacacaauagaaaccuuaaugcuacuggcccucaucgcaguauuaacuggcgguguaacacuauuuuuccuaucagggaaaggucucggaaaaacaaguauaggauuauuauguguaacggcaucgucugcucuauuauggauggccucaguagagccccacuggauugcagcaaguauuaucuuggaguucuuuuugaugguucuauuaauccccgagccggaucgacaaaggacaccacaagacaaucaacuagcauauguaguaauaggacugcuauucaugauauuaacaguagcagcaaaugagaugggauuauuggagacaaccaagaaagacuuaggaauaggauacguugccgcggaaaaucaccaacacgcuacaauguuagaugucgacuuaagaccagcuagcgccuggacucuuuaugcaguagccacaacuguaaucacaccuaugaugagacauacaauagaaaauacaaccgcuaauauaagccuaacugcaauagccaaccaagcagcuauccucaugggauuagauaaagguuggccaaucucuaaaauggauauaggcguuccuuugcuugccuuggguugcuauucccaggucaauccguuaacauugacagcagcggugcucauguugguagcacauuacgcuauuauugggcccggccuucaagccaaagcaacucgggaggcacaaaagagaaccgcugcuggaauuaugaagaauccaacaguggauggaaucguugcaaucgaucuggacccaguuguauaugaugcuaaauuugaaaaacaacuaggacaaauaauguuacuuauauuaugcacuagccaaauuuuacugaugcguaccacgugggcucuaugugaaaguaucacauuggcgacaggaccauuaacgacuuuaugggaagguaguccugguaaauucuggaauaccacaauagccguaaguauggcaaauaucuucagaggauccuauuuagcgggagcagggcuggcauuuagcuugaugaaaucacuagguggcggacgucggggaacgggagcccagggcgaaacccuaggagaaaaauggaagcgccagcuuaaucaguuaucaaaaucugaguuuaauacuuauaaacgaaguggaaucauggaagucgaccgaagugaagcaaaggagggucucaaaagaggagagaccacaaaacaugcagugagccgagguacugcaaaacuucgaugguuuguagaacgcaaccuagugaagccugagggaaaagucaucgaucuagggugcggcagagggggauggucauacuauugugcagggcuaaagaaagugacagagguuaaagguuauacaaaaggcgguccgggacaugaagaaccaaucccuauggcaacuuaugguuggaacuuaguaaaauugcauucuggcaaagauguuuucuucaugccacccgaaaaaugugauacccuacugugcgacauaggugaaucgucacccaaucccacaauagaagaagguagaacgcugcgaguucuaaaaaugguugaaccauggcugcgcggcaaucaauuuuguauuaaaaucuuaaaucccuacaugccaucagucgucgaaacauuagaacagaugcaaagaaagcacggcggaaugcuagugaggaacccuuuaucucguaauagcacacacgaaauguacuggguauccuguggcacgggaaauauaguaucagcagucaauaugacaucacgaaugcuucuaaaucguuuuacuauggcucauaggaagccuacauacgagagggauguggaccugggagcuggcacaagacauguagccguagagccagaagaggccaaucuugauaucauaggacagcguauagaaaauauaaagaacgaacauaagucuacauggcacuaugaugaagacaacccguauaagacuugggcauaccacggaagcuaugaagucaaaccuucagggucugcuagcaguaugguaaacgguguaguacgacuccuaacgaagccaugggauguaauacccauggugacucaaauagcaaugacagacacuaccccuuuuggucaacaaaggguuuuuaaagaaaaaguagauacucgaacaccccgggcaaaacgaggaaccacccagauuauggaagugacagcaaaauggcucugggguuucuuaucucguaauaagaaaccuaggauaugcacacgagaggaguucacccguaaaguacgaaguaaugccgcaauaggugcgguuuuuguagaugaaaaccaauggaacucagccaaagaggcaguagaagaugaacguuuuugggaccuaguucauagagagcgagaauuacauaaacaaggcaaaugugcgacaugcguuuacaauaugauggguaaaagagagaagaaauuaggugaguuuggaaaagcuaaaggcagucgagccauuugguauauguggcucggagcuagauuucuagaauuugaggcuuugggauucaugaaugaggaucacugguuuucgagagagaauaguuuaucggguguggaaggugaaggucuacacaaacuuggguauaucuuaagggacauaucaaaaauuccaggagggaauauguaugcugaugacaccgcuggaugggacacuagaaucacagaggaugauuuacaaaaugaagcuaagauuacugauauaauggagccagaacaugcccuguuagcaacaagcaucuuuaaacuuacuuaucaaaacaaagucgucagaguccaaagaccagccaagaaugggacugucauggaugucauaucgcgccgggaucaaagaggaucaggacaaguugguaccuaugguuuaaacacguuuacuaacauggaaguacaacuaaucaggcaaauggaauccgagggaauauuuuuaccgucagagcuggaaacaccgaauuuagcagaaagaguauuagauuggcuagagaagcacggagcagaaagauuaaaaagaauggcuauuucuggagaugacugugugguaaagcccauagaugaucgguuugcuacggccuuaacagcucuuaacgauaugggaaaaguaagaaaagacauuccucaaugggaaccuucaaaaggauggaaugauuggcagcaaguaccauuuugcucacaucauuuccaccaguuaauuaugaaggauggccgagaaauuguagugccgugccggaaccaagaugagcuaguugguagagcacgggugagccagggcgcaggguggucccuucgcgaaaccgcuugccuaggaaagaguuaugcacaaauguggcaacuaauguauuuucaucgccgugaccugcgauuggcggcaaacgcaauauguagcgccguaccagucgauuggguaccuaccucuagaaccaccuggucgauacaugcccaucaccaguggaugaccaccgaggacauguuauccguuuggaacagaguauggauagaagaaaauccauggauggaagacaaaacacacguaucuagcugggaagagguacccuacuuagguaaaagagaagaccaauggugugguucuuuaauugguuuaaccgcuagagcaaccugggccacgaacauucaaguggcaauaaaucagguaaggcgacuuauagggaaugagaacuauuuagauuacaugacaucuaugaaacgauucaaaaacgaaucugaccccgaaggcgcauuaugguag

SEQ ID NO: 21405 - RNA, 9879 nt, Artificial Sequence
  derived and/or modified CDS sequence (opt6) from DENV-1__FJ639741__SS-prME
ucgguaacuaucuugcuaaugcuacuaccuacugcgcuggcuuuccaccugacaacucgagggggugaaccacauaugaucguaagcaaacaggaacgcggaaaaucucucuuauuuaaaacgucagcaggcguaaauauguguacauuaauugcuauggauuuaggugagcuaugugaagauacaaugacguacaaauguccgcggauuacagaagcugaaccugaugacguugacugcuggugcaacgcaacagauacauggguuacauacgggacaugcagucaaacaggcgagcauagacgagacaaacgaaguguggcguuagcgccccacguaggguugggauuagaaacccgaaccgagacuuggaugagcucagaaggggccuggaaacaaauacaaaggguggaaaccugggccuugaggcaucccgguuuuacgguaaucgcgcuuuuccuagcacaugcuauaggaacuucuauuacacaaaaagggauuauuuucauucuuuugaugcuagugacacccucuauggcgaugagaugcgucggaauaggcaacagagacuucguugaaggacuuucaggagcuacauggguugacguugugcucgaacauggauccugugucaccacaauggccaaaaacaaaccaacccuagauauagaacuacugaaaacggaggucaccaaucccgcaguucugaggaaauuguguauugaggcuaaaauuucuaauaccaccacugauucacgauguccgacgcaaggagaagcuacccugguggaagaacaagaugcuaacuucguuugucguaggacauuuguggacagaggauggggaaauggauguggccuguucgguaaaggauccuuacuuacaugugcaaaauuuaaauguguaacaaaauuagagggaaaaauaguccaguaugaaaaucuuaaauauucaguuauaguuacgguacauacaggcgaucaacaccaaguggguaaugagacgaccgagcauggaacuauagcaacaauaacaccccaagcuccaacuagcgaaauacaacuaaccgauuacggggcuuuaacauuggacuguaguccucgcacaggauuagacuuuaacgagaugguucucuuaacaaugaaagaaaaaucguggcugguucacaaacaaugguuuuuagauuuacccuugcccuggacuagcggcacaucuaccagucaagaaacauggaaucgacaggaccucuuagugacauuuaaaacggcccacgcuaagaaacaagaaguaguaguauugggaagucaagaaggcgcaaugcacacagcacuuacaggggccacagaaauacagacgucugguaccacuacaauauuugcuggucaccuaaaaugccgauuaaaaauggacaaacuuacacucaaaggaacaucauaugucauguguacugggaguuuuaagcucgaaaaagaaguagcagagacucaacauggaacaguccuaguucaaguaaaguacgaagggacggacgcgccaugcaaaauaccuuucucgacacaggaugaaaaaggggugacgcaaaauggcagacucauaacagcaaacccaauaguuacugacaaagagaagcccguaaacauagagacagagccacccuuuggggagucauacauaguaguuggugcuggagaaaaagcucuuaaacuaucaugguucaagaaaggcucgucaauaggaaagauguuugaagccaccgcucggggagcccgccggauggcaauccuaggagacaccgcgugggacuuugggucaauuggcgggguauucacaagugucggcaaauugguacaucaaguuuuuggcaccgcauauggugucuuguuuucgggaguaucguggacgaugaaaauuggaauaggaauauugcuaacguggcuaggacuaaauucaagaagcacaucccugagcaugaccuguauugccgucggaaugguaacacuuuaucucggaguaaugguacaagcugacagugggugcguuauaaauuggaaaggcagggaacugaaaugcggcagugggauuuucgugacaaaugaagugcacacauggacugaacaguauaaauuucaagcugauagucccaaacgucucucggcugcaauaggaaaggcuugggaagaaggcguauguggaauacgaucagccacgagacuggagaacauaauguggaaacaaauaucuaacgagcuaaaucacauauuacuugagaaugacaugaaauuuaccguaguaguaggcgaugccaauggaauauuagcgcaaggcaagaaaaugauaaggccucaaccuauggagcacaaauauaguuggaaaagcugggggaaggcaaagauuaucggugcagauauacaaaauacaacauuuauuauugaugguccagacacaccagaauguccagaugaccaaagagcauggaauauaugggaaguugaagauuacgguuucggaauauuuacuacgaauauaugguugaaacuacgcgauucuuauacucagaugugugaucaccgauuaauguccgcagcaauuaaggauaguaaagccguacacgcggacaugggauacuggaucgagucggagaaaaaugaaacguggaaauuagcaaaagccucuuuuaucgagguaaagaccuguauauggccaaagucucacacucuaugguccaacggaguucuagaaucagagaugauaauuccaaaaauauauggagggcccauuagucaacacaauuacaggccaggauauuucacacaaacugcggggcccuggcaccugggaaagcuggaguuagauuuugaccuuugcgaaggcacgaccguaguaguugacgaacauuguggaaaucgcgggccaucucuaagaacuacaacggucacaggaaaaauuauacaugaauggugcugucggucauguacguuaccuccucuacgcuuucguggagaggacggaugcugguacggaauggaaauuagaccuguuaaagaaaaggaggagaauuuagugagauccauggugucagcuggcagcggggaaguagauucuuuuaguuuaggaauccuuugcguuaguauaaugauagaagagguuaugcgaucaagauggucuaggaaaauguugaugacaggaacacucgcaguauuuuuguuacuaauaaugggacagcucacuuggaacgacuugauaagacugugcaucaugguaggggccaaugcaucugauaggauggguauggguaccacauaucuagcucuaauggcgacauuuaaaaugagaccgauguucgcugugggccuucuauucagaagauugacgucccgagaagugcucuuauugacaauuggcuugucucuaguggcaucgguugaacuccccaacucucuagaagaacuuggagauggacuggcgaugggcauaaugauguuaaagcuauuaacugaauuucaaccccaccaacuauggacaacauugcucucauuaacauucauaaaaaccaccuuaucccucgauuaugccuggaaaacgacagcaaugguacuaaguaucguuucuuuauucccccucugucucaguaccacgagucagaagacgacaugguuaccugucuuauuagguucauuugggugcaaaccauugacaauguucuugaucacagaaaacaagauuuggggacgaaaaucauggccguugaaugaaggcauuauggcgauaggaaucguguccauacuccuuaguucauuguugaaaaacgauguaccucuagcaggaccccuaauagcgggaggaauguuaauagcuugcuauguaauaucuggcaguucagcugacuugagccuugaaaaagcagcagagguaaguugggaacaagaagcugaacacucuggcacgucacacaauauauuaguagaaguucaagacgauggaacgaugaaaauuaaggaugaggaaagggaugacaccuuaacgauccuauuaaaagcaacauuacuagcugucucuggaguuuauccuaugucgauacccgcgacccucuuuguuugguauuuuuggcagaagaagaaacagaggucggguguguuaugggauacaccuucaccuccagaaguagaaagagcagugcuugaugacgguauuuaucguauccuacaacgcggauuguuaggacggucccaggucgggguagguguauuucaagacggcguguuccauacaauguggcauguaacaagaggcgcaguacuaauguaucaagggaaaagacuugaaccaucaugggcuagugucaagaaagauuuaaucucauaugguggcggguggagguuucaggguaguuggaauacgggcgaagagguacaaguaaucgcaguagaaccaggcaaaaaccccaaaaacguacaaacgacuccuggaacuuuuaagaccccagagggcgaggucggagccauugcucuugauuuuaaaccagggacaucggguagcccaauaguuaaucgugagggcaagaucguaggcuuauacgggaacgggguaguaacaacuagcgguacguacgugucugccauagcccaggcgaaggcgagccaagaaggcccucucccugagaucgaggaugagguauuuaaaaagagaaaccuaacgauaauggauuugcaucccggcaguggcaaaacgcggagauaccuuccagcgauagucagggaggccauaaagcgaaaacuucgcacacuaauacuagcacccacucgagucguggcuagcgaaauggcagaggcacuuaaagggaugccuaucagauaucaaaccacagcaguaaaaagugaacauacuggacgggaaauaguggauuuaaugugccacgccaccuuuacaaugagguugcuaaguccgguaaggguucccaauuauaauaugauaauaauggacgaagcucauuuuacggacccagcaucaaucgcagcuagagguuauauuuccacacggguugguaugggagaagcagccgcuaucuucaugacugccacacccccuggaucgguugaagcauuuccucagaguaaugcagugauacaagaugaagaacgagacauuccagaaagaucauggaauaguggcuaugacuggauaacagacuuuccagguaaaacaguaugguuuguuccgucaauuaaaucaggaaaugauauugcaaacuguuuaagaaagaaugggaaaaggguuauucaauuaagucguaagacuuuugauacagaguaccaaaagaccaaaaacaaugauugggacuauguaguuacuacagauauaagugagaugggcgcgaacuucagagcugauagaguuauagauccacgaagaugucucaaaccuguaauucucaaagacggcccagaaagagugauauuagcuggaccuaugccuguuaccguugcaagugcugcucaaaggcgggguaggauagggcgaaaucagaauaaagagggugaucaguauguauauauggggcaaccacucaacaaugaugaagaucacgcucauuggaccgaagcaaaaauguugcuggauaauauaaauacaccagaaggaauaauaccugcauuguuugaaccugaacgagagaaaagugccgccauagacggagaguacagauuaagaggcgaagcaagaaagacauuugucgaacuaaugcgaagaggugaccuaccaguuuggcuuucauacaaagucgccagugaaggcuuucaauacagugacagaagauggugcuucgacggugaaaggaauaaccaaguccuugaagaaaauauggacguugaaauauggacaaaagaaggagaacgaaagaaauuacgaccccgaugguuagaugcacgaacauauucggauccccucgcacuaagggaauuuaaagaauuugcagcagggaggcgaagcguuucuggagauuugauacuagaaauaggcaaauuaccacaacaucugacacugagagcucaaaaugcccuagauaauuugguaaugcugcauaauucagaacaaggagguaaagcguauaggcaugccauggaagaguuaccagauacgauugagacacuaaugcucuuagcacuuaucgcuguacuaacggguggaguaacgcuauucuuucucaguggaaaaggucuagggaaaacaucuauuggauuauuaugcguuacagcuaguagcgcacucuuauggauggcaagcgucgaaccucauuggaucgcugcaucuauaauacucgaguucuuuuuaaugguguuacuaauaccugaaccggacagacagagaacuccucaggacaaucaacucgcguauguagugaucggguuacuauucaugauauuaacuguagcugcuaaugaaaugggauuauuagaaacaacgaagaaagacuuaggaauuggacaugucgcagcugaaaaccaccaacaugcgacgauguuagauguggaucuacgaccagccagugcauggacacuguacgcuguggccacaacuguaauaacaccaaugaugagacacaccaucgaaaauacaaccgcaaauaucucauuaacggcaauagcuaaccaagcagcaauacuuaugggacucgacaaaggguggccaauaucuaaaauggacauagguguuccacuauuggcuuuaggaugcuacucccaagucaauccgcuuacacuaaccgcagcaguccuaaugcuuguagcccauuacgcaauuauaggcccaggauuacaggcaaaagccacaagagaagcacaaaagagaacagcagccggaaucaugaaaaauccuacaguagaugguauaguugcuauagauuuagaucccguuguauaugacgccaaauucgagaaacaauuaggccaaaucauguuauuaauacuuuguacaucgcaaauccuacuaaugagaacaacaugggcgcucugcgagucaauaaccuuagcuaccggaccauuaacaacuuuaugggagggcagccccggcaaauucuggaacacaaccaucgccguuucgauggcuaacauauuucgcggcuccuaucuagcuggggcgggauuagcuuuuucacucaugaagucuuugggaggggguaggaggggcacaggugcucaaggggaaacucucggcgaaaaauggaaaagacagcugaaucaguuaagcaaaucugaguucaauacguauaaacgaaguggcauaauggaaguugaucgaagugaagcaaaagaaggucuaaaaagaggagaaaccacuaaacacgcagugagucguggcaccgcaaaacugagaugguucgucgagcgaaaccuaguuaagcccgaggggaaaguaauagaccuaggaugugguagaggaggauggucuuauuauugcgcugggcuuaagaaaguaacagaaguaaagggcuauacuaagggcggccuaggacaugaagaaccaaucccaauggcuaccuauggguggaacuugguaaaauugcacagugguaaggacguauucuucaugccaccagaaaaaugugacacacuucugugugacauuggggaaucuucgccuaauccaacuauugaggagggaaggacacuccgaguacugaaaaugguugagccuugguuaagagggaaccaauuuugcauaaagauacuuaaccccuauaugcccucggugguagaaacauuagaacaaaugcaaagaaaacaugggggcauguuaguuagaaacccacuaucccggaacucaacacacgaaauguauuggguuucaugugguaccggaaacauaguuagugcaguuaacaugacgaguagaauguuauuaaauagguuuaccauggcucaucguaaacccacauacgaacgugacguagauuuaggagcagggacacgccauguagcgguggagccagaaguugcaaauuuagauauuauaggccagaggauagaaaacauuaaaaacgaacacaaaucaacauggcacuacgacgaagauaaucccuacaaaacuugggccuaucauggcaguuaugaagucaaacccagugguucggccaguaguauggugaauggcguaguaaaauuauuaaccaaaccgugggauguaauuccgaugguaacccaaauagcuaugacagauacaacgccauucggucagcaacguguauuuaaagaaaaaguagacacgagaaccccgcgagcgaagcgugguaccacucaaaucauggaggucacugcuaaauggcuaugggguuuccuuucccguaacaagaaaccaagaaucugcacccgcgaggaauuuacgcguaaaguaaggagcaacgcagcuauuggagccguauuuguagaugaaaaucaauggaacagugcaaaagaagcaguugaagaugaaagauucuggaauuuaguacacagggaaagagaacuucauaaacaggggaaaugugcgacaugugucuacaauaugaugggaaaaagggagaagaaauuaggugaguucggaaaggccaaaggcucucgugcaauaugguauaugugguuaggagcgagauuuuuagaauuugaagcucugggauuuaugaacgaagaccauugguucaguagagaaaacucucuuaguggagucgaaggagagggccuucacaaacucggauacauccucagagauaucucuaaaauacccgggggaaacauguaugcugacgacaccgcagggugggauacacgcauaacagaagacgaucuacaaaaugaagcaaaaauaacugauauuauggaacccgagcacgcguuacuagcuacaagcauauuuaaguugacauaccaaaauaaaguaguucgaguacaaagaccugcuaaaaacgggacgguaauggauguuauaucucgacgugaucagagaggcagugggcaaguaggcacuuaugggcuuaacacuuucacuaacauggaaguccaacuuauaaggcaaauggaaagugaaggaauauucuugccgucugaacuugaaacuccaaaccuagcagaacguguucuagacuggcuugaaaagcauggggcagaaaggcuaaaaagaauggccauaaguggagaugauuguguagucaagccuauagaugaccgcuucgcuacugcgcuaacugcuuuaaaugacaugggaaaagugaggaaagacauaccccagugggaaccuucaaaaggguggaaugauuggcaacaaguuccauuuuguucccaucauuuucaccaauuaauuaugaaggauggccgcgaaauaguaguaccauguagaaaccaagacgagcuaguuggcagagcccggguaagccaaggagcuggauggucauuacgugagacagcuugucucgggaaaaguuaugcucaaauguggcaguugauguauuuucaccgccgagaccuaagauuagcggcuaacgcgauuugcucagcuguuccaguugauuggguucccacuagcaggacgacauggagcauccaugcacaccaucaauggaugacaacugaagacaugcucuccguauggaaucgaguauggauugaagaaaacccauggauggaggauaaaacgcaugugucaucgugggaagaagucccuuaucugggcaaaagagaagaccaguggugcgguucacucauaggcuugacugcuagagcgacgugggcaacgaacauucaaguugccauaaaucaaguacggagacuuauaggaaaugaaaauuaucuagacuauaugacuucaaugaagcgcuucaaaaaugaaucggaucccgaaggagcccuaugguaa

SEQ ID NO: 21406 - RNA, 9879 nt, Artificial Sequence
  derived and/or modified CDS sequence (opt6) from DENV-1__FJ639743__SS-prME
ucaguuacaaugcuacuaauguuacugccgacagcauuagcauuccaucuuacaacacgcgguggggaaccacacaugaucguaucaaaacaagaaagagggaaaucuuuguuauucaaaacaucagcuggugugaauaugugcacacuaaucgcaauggaucuaggggaacuuugugaggauaccaugacguacaaaugcccgcgaauaacagaagccgaaccugaugaugucgauugcuggugcaaugcgaccgacacauggguaaccuacgggacuugcucacaaaccggugaacaucgacgcgacaaaagaaguguugcacuagcaccccacguuggacuugggcuagaaacuagaaccgaaacauggaugucaucagagggagcauggaaacaaauacaaagagucgaaacgugggcacuaaggcacccaggauuuacaguaauggcucuuuuucucgcucaugcaauaggcacgaguauuacucaaaaaggcaucauuuucauucucuuaauguuagugaccccuucuauggcuaugcguugcguaggcauaggaaacagggacuuuguagagggacucucaggggcgacgugggucgauguuguacucgagcacggcagcugcgucacaacaauggcuaaaaauaaacccacauuggacaucgaacuacuaaaaaccgaagugacgaacccggccguauuaaggaaauuauguauugaagcgaaaauuucaaauacaacaacagauucacgaugcccgacgcaaggggaagcaacgcucguagaagaacaagaugcaaacuuuguuugcagaagaacuuuugucgaucgcggaugggggaauggguguggauuguuuggaaagggcucacuuuuaacaugugcuaaauucaaaugcgucacaaaacucgaaggaaaaauaguacaauaugaaaacuugaaauacagcguaauagugacugugcauacuggcgaucaacaucagguaggaaaugaaacaacagagcaugguacgauagcaacuauaacaccccaggccccaacaagugagauucagcuaacugauuacggagcacuaacguuagauuguuccccucgcacaggcuuggacuucaacgaaauggugcuuuuaacaaugaaagagaaaucuuggcugguacacaaacagugguuccuagaccugccacuaccuuggacauccggagcaucaacaagccaagaaacguggaacaggcaagaccuuuuaguuacuuuuaaaaccgcucacgcaaagaaacaagaaguugucgucuuaggcucucaagaaggugcuaugcacaccgcucugacuggugcaacagagauucaaacgucuggaaccacgacgauuuucgcaggucauuuaaaaugucguuuaaaaauggauaaacuuacuuuaaaagggaugaguuauguuauguguacugguucuuuuaaacuugagaaagaaguugccgaaacucagcaugggacgguacuuguacagguacgauaugaggggaccgaugcgcccugcaaaauuccauuuagcacacaggacgagaaagguguuacccaaaaugggcgacugaucaccgcuaacccuauuguaacagacaaagaaaaaccuguaaauaucgaaacagaaccaccauuuggcgaaucguauauuguaguuggagcaggagaaaaagcucuuaaauuaagcugguucaagaaaggaaguaguaucggaaaaauguuugaggcuacugcgagaggagcucgaaggauggcuauuuuaggggacaccgcuugggacuucgggagcauagguggcguuuuuacaaguguaggaaagcuaguucaccaaguauucgguacugcuuaugguguguuguucagcgguguaaguuggacaaugaaaauagguauaggaauacuauuaaccuggcuagguuuaaacaguagaagcacuagcuuaucaaugacaugcaucgcugugggaaugguuacauuguaccuggguguaaugguacaagccgacucuggcugcguaauuaauuggaaaggaagagaacugaaaugugguucgggaauauucguaacaaaugaaguccauacauggacugagcaauacaaauuccaagcugauuccccaaagaggcucucagcagcaaucgggaaagcaugggaggaaggcgucugugggauucgaucugcaacgcgauuggaaaacaucauguggaaacaaaucucaaaugaguuaaaccacauccuacuagaaaaugacaugaaauucacgguaguuguuggagaugcaaauggaauccuugcacaaggcaagaaaaugauucgaccucaaccgauggagcauaaauauucauggaaaagcugggguaaggcaaaaguaauaggagcagauauacagaauaccacuuuuaucaucgauggaccagauacaccagaauguccugauggacaacgagccuggaacauuugggaggucgaggacuauggauuuggaauuuuuacuacaaauauaugguugaaacugagagauuccuauacacaaaugugugaucacagauuaaugagugcggcgauuaaggauucuaaagcgguacaugcggauauggguuacuggauagaaucagagaagaaugaaacauggaaauuggcuagagcuucauuuauugaaguaaaaacgugcaccuggccuaagagucacaccuuaugguccaacggagucuuggaaagcgagaugaucauaccgaagauauacggcgguccaauaucacaacauaauuauaggccaggauauuuuacacaaacugccggcccuuggcaccuaggaaagcuggaauuggauuucgacuuaugugaagggacaacuguuguuguagacgaacacuguggcaaccgaggaccuagucuuaggacaacaacaguuacagggaaaauaauacaugaaugguguuguagaagcuguacucucccaccacuucguuucagaggcgaagacggauguugguacgggauggagauacgacccguaaaggagaaggaggaaaacuuagucaggaguauggugagugcgggcagcggggaaguggauucauucagccucgguauuuuguguguaucuauaaugauugaagaggugaugagaaguagguggagucguaagaugcuuaugacaggaacguuagccguauuucuucuucucguaaugggucaacucacauggaaugauuuaauacgauuaugcaucaugguaggugccaacgcuucagacaggauggggaugggcacuacauacuuggcacuaauggcgaccuuuaagaugcgcccaauguucgcaguagggcugcuguuccgucgccuuacaucccgggaagucuuauugcuuacaauaggacuaucucuuguugcaucaguggagcugccaaauucuuuagaagaauuaggggaugguuuagcaaugggaauuaugauguugaaauuacugacagaauuucaaccacaucaacuuuggacaacgcuacuaucacucacuuucguuaaaacaacauugagucuugacuaugcauggaaaacaacugcuaugguauuguccauuguaucuuuguucccguuaugcuuaucgacuacuucucaaaagacaaccugguuaccggucuuauuagggucauuuggauguaaaccauuaacaauguuucuaauuacagaaaacaagaucuggggucguaaaaguuggccguuaaaugaggggaucauggcaauugguaucguaucaauacuucuuaguagcuuacucaagaaugacguaccauuagcaggaccucugauagcgggugguaugcuuauugcauguuauguaauuucaggaucuuccgcugaccucaguuuagaaaaagcggcggaggugucgugggaacaagaggcggaacauagcggagcgucucauaacauuuugguugagguacaagacgacggaacgaugaagauuaaagacgaagaaagggacgauacucuaaccauacuuuugaaagcaacgcuauuagcgguauccggugucuauccuaugucaaucccagccaccuuauuuguaugguacuucuggcagaagaagaaacaaagaagcggaguacuaugggacacaccaagucccccggagguugaacgagcaguacuagacgauggaauuuacagaauacuccagagaggacuguuagguagaucucaggucggaguaggcguauuccaagauggaguuuuccacacuauguggcacgucacgcgaggagcgguuuuaauguaucaagggaaaagauuggaacccucaugggcaucuguuaagaaagauuugauuagcuauggugguggauggagauuucaaggaaguuggaauacaggugaagaaguccaggugauugcuguagaaccagguaaaaaucccaagaauguucaaacaacuccgggcacauucaagacaucggaaggggaagugggagcgaucgcacuagauuuuaagccggguacgucaggauccccaauuguaaacagagagggaaaaauuguaggucuauacggaaaugguguagucacaacuucaggaacauauguaucagcaauugcccaagcuaaggcuucucaggagggcccguuaccugaaauagaagaugaaguguucaagaaaagaaacuugacaauaauggauuuacaucccgguagcggcaaaacacggcguuaccuucccgcgauagucagggaagcgauuaaacguaagcuaaggacuuugauucucgcgccaacaagggugguagcaagugaaauggcugaagcauugaagggcaugccaauuagguaucaaacaacggcaguaaaauccgaacacacaggucgugaaauaguagauuuaaugugucacgcuacuuucacgaugagacuacucucuccaguaaggguaccuaacuauaauaugauuauaauggacgaggcacauuuuacagacccggcaaguauagcagcacgcggguacauaucuacaaggguaggaaugggugaagcugcggcaauuuuuaugacagcuacaccaccagggucaguugaggccuuuccccagaguaaugcgguaauucaagaugaagagagagauauuccggaaagaucuuggaacucaggauacgacuggauaacagacuuccccggaagaacuguuugguuuguccccucuauaaaaucggguaaugacaucgcaaacugccugaggaaaaauggcaagcgagucauacaacucaguagaaaaacuuuugauacugaauaucagaaaaccaaaaauaacgauugggauuauguaguaacgacugacauaucagaaaugggugcuaauuuccgugcggaucgaguaauagauccgagaagaugccuuaaaccuguaauauugaaagaugguccugaaaggguaauccuagccggaccaaugccaguuacgguagcuagugcagcacaaagacguggucguauugguaggaaucaaaauaaggaaggagaucaauacguguacauggggcaaccguuaaauaacgacgaagaccacgcacacuggacagaagcaaaaaugcuacucgauaauauuaauacaccagaaggaauaauucccgcacuauuugagccggaaagagagaaaagugcagcaaucgauggagaguauaggcuccguggugaagcuagaaaaacauucguagaacuaaugagaaggggcgauuuaccuguuugguugucuuacaaaguggccagcgaagguuuucaauacuccgaucgacguugguguuucgauggugaaagaaacaaccagguccuagaagaaaacauggacguagagauuuggacaaaagaaggagaacggaagaagcuccgacccagauggcuagaugcuaggacauauucagauccuuuggcacuacgugaguucaaagaguucgccgcgggacgcagaucagucucaggcgauuuaauucuagagauuggaaaacuuccucaacaucucacguuaagagcucaaaaugcccucgauaacuuagucauguuacacaacagugaacaaggagggaaagcguauaggcaugcaauggaagaacuaccagacacaaucgagacucuuaugcuccuagcguuaauagcuguuuuaacgggcggagugacccuguucuuucuaucuggcaagggacuagggaagaccucuauaggguugcugugcgucacagcaucaagcgcacuccuauggauggcaucaguagaaccucauuggaucgcugccucgauaauacuggaauuuuuccuaaugguuuuacuuauuccugagccagacagacaaaggacuccucaagauaaccaacuagcguauguggugauaggucuccuuuuuaugauauuaacuguagcugcuaacgagaugggauuacuggaaacgacaaagaaagaucuagggauuggauauguagcugcggagaaucaucaacacgccacaauguuagacguggaucugcgaccggccucugccuggacucucuacgcugucgcgacgacgguaauaacuccaaugaugagacauacaauugaaaacacuacagcuaauaucucuuuaacugccauagcuaaucaggcugccauacuaaugggucuagauaaaggguggccaauuuccaaaauggauauuggaguuccacucuuagcauugggguguuauucucaggugaauccacuaacauugacagcugcaguccuuaugcuugucgcacacuaugcuauuaucgggccaggguuacaagcaaaagcuacgcgcgaagcacagaaaagaacugcagccggcauaaugaaaaauccaacuguugauggaauagucgcgauagacuuagacccaguagucuaugaugcgaaauuugaaaaacaauuaggacagaucauguuacucaucuugugcacaagucaaauacuuuuaaugagaacuacaugggcguuaugugagucuauaacccuugcuacuggcccguuaacaacacuaugggaagggaguccuggaaaauucuggaauacuacgaucgcugucuccauggcuaauauuuuucgugguucauaucuggccggagccggacuagcauucagucuuaugaagagucuuggaggggguaggagagguacaggagcacagggugagacacuaggggaaaaauggaaaagacaacuaaaucaacuuucuaaaucggaguucaauacauacaaacgaaguggaauaauggaaguagacagguccgaggcaaaagagggccucaaacgaggugaaaccacaaaacaugcaguuucucgugguaccgcaaaguugaggugguuuguagaaagaaauuuaguaaaaccugaaggaaaagugauagaccuaggaugugguagaggaggguggucauacuauugugcggguuuaaagaaagugacagaaguaaaaggauauaccaagggagguccuggacaugaggagccaauacccauggcaaccuacggauggaauuuaguuaagcuccauucagggaaagacguauucuuuauguccccugaaaaaugcgauacacugcuuugugauauuggggaaucgucaccuaauccaacaauagaggaagggaggaccuugagaguuuuaaaaaugguugaaccaugguugcgaggaaaccaauuuugcauaaaaauauuaaaucccuacaugccuucgguaguagagacguuagaacaaaugcagagaaaacacgguggaaugcuuguuaggaauccacuuuccaggaacucuacgcaugaaauguacugggugagcuguggaacaggaaacaucgugucagcaguuaacaugacaagcagaaugcuguuaaauagauucacuauggcucacagaaagccuacauaugagagagauguugauuugggagcugggacccgccauguagcgguagagcccgaagaggccaacuuggauauaauaggccaacgcauugaaaacauacgaaacgaacauaaaaguacguggcauuacgacgaagacaacccguacaaaacuugggcguaccauggcucuuaugaaguaaagccuucgggaagugccucuuccaugguuaauggagugguaagacuucuaacuaaaccaugggacguaaucccuauggugacacaaauagcaaugaccgauacuacuccuuucggacaacagcgaguauucaaagagaaaguugacacacgcacgccccgagccaaacguggaacuacacaaauaauggaagucacugcgaaguggcuuugggguuuucuaucaagaaacaagaaacccagaaucuguacccgugaagaauuuacucgaaaggucagauccaaugcagcuauuggggcaguauuuguggaugagaaucaguggaacagcgccaaagaggcaguggaagacgaacgguuuugggaucuagugcauagagaacgugaacuacacaaacaaggaaaaugcgcaaccugcguauacaauaugauggggaaaagagagaagaaauuaggcgaauuuggaaaagcaaagggaaguagagcaauaugguacauguggcuuggggcacgauuucuagaguuugaggcucucggauucaugaaugaagaccauugguuuucaagggaaaauucacuuuccggcgucgaaggugaaggcuuacauaaauuagguuacauucuacgagauauaaguaaaauaccaggcggaaauauguaugcugaugauaccgcuggcugggacacgaggauuacagaagaugacuuacaaaaugaagcaaaaauaacagacaucauggaaccggaacaugcauugcuagccacaucaaucuuuaagcucacuuaucaaaauaaaguaguaagagugcaacguccagcgaaaaacgguacaguaauggacgugauaagcagaagagaccaacgggguuccggucaaguagguacguacggucucaauaccuuuacgaauauggaaguucaguuaauaagacaaauggaaagcgaaggcauuuuucuacccuccgaauuagagacaccuaaucuggcugaacgaguauuggauuggcuggaaaaacauggugcggaaagauuaaaaagaauggccauaagcggggacgacugcgugguuaaaccgauugacgaccgauuugcuacugcacugaccgcacucaaugauaugggcaagguucguaaagauaucccacaaugggaaccuagcaagggauggaaugauuggcaacaaguaccauuuuguagucaccauuuccaccaauuaauuaugaaagaugguagagaaaucguagugccaugucgaaaucaggacgaauuaguagguagagcucguguuucacaaggagcagguugguccuuaagggaaaccgcuuguuuggguaaaaguuaugcccaaauguggcaguuaauguauuuccacaggcgagaucucagauuagcugcaaacgcaaucuguagcgcagucccaguugauugggucccaacaagccguacgacauggaguauacacgcucaccaucaauggaugacuaccgaagauauguugaguguuuggaauagagucuggauagaagaaaaucccuggauggaggauaaaacacauguaucaucaugggaagaaguucccuaucuagguaaacgcgaagaccaauggugcggaagccucauuggacucacggccagagcuacuugggcuacuaauauucaaguggcaauuaaucaaguacgacguuuaauaggcaaugaaaauuacuuagacuauaugacaaguaugaagagauuuaaaaaugaauccgacccagaaggagcccuaugguag

SEQ ID NO: 21407 - RNA, 9879 nt, Artificial Sequence
  derived and/or modified CDS sequence (opt6) from DENV-1__FJ639794__SS-prME
agcgugacuaugcuuuugaugcuacuucccacggcauuagcuuuccacuuaacuaccagaggaggugaaccucacaugauuguuaguaaacaagaacgcggaaaaucccuacuauucaaaacgagugcuggugucaauauguguacucucauugcaauggaucuuggcgaacuaugugaagacacuaugacguacaaaugcccgaggauaaccgaagcagaaccugacgacgucgacuguuggugcaacgccacugauacguggguaacguaugguacuugcagucaaaccggugaacacaggcgagacaaaagguccguagcuuuggcuccacauguaggacuaggguuagaaacgcgcaccgaaacguggaugucuuccgaaggggcauggaaacaaauucaaaggguagaaacaugggcacuacgacaucccggcuuuacaguaauagcccuauuucuagcacacgcgauuggaacgucuauaacacaaaaagguauaauuuucauuuuauuaaugcucguaaccccaucaauggcaaugcguuguguaggaauagguaaucgagauuuuguggaaggccuuucaggcgccacaugggucgauguaguacuagaacauggauccuguguuaccacaauggccaaaaauaaaccuacucuggauauagaauuguuaaaaacugaaguuacuaauccggcagucuuaagaaaacuaugcauugaagcaaaaauaucuaacacaacuacagauagccgcugcccuacgcaaggugaagcgacucuugucgaagaacaagacgcaaacuucgucugccgccgcacauuuguagauagaggguggggaaauggcuguggauuauucggaaaagguagucuucugacaugugcuaaauucaaauguguaaccaaacucgaaggcaaaauaguccaauacgaaaaucuaaaauacagcguaaucgugaccguacauacgggggaucaacaccaaguuggcaaugaaaccacugaacacgggacuauagcuacuauaaccccacaagcucccacaucagaaauccaacuuacggauuacggagcacuaacuuuagacuguagcccuaggacgggucuagauuucaacgaaaugguacuacuaacuaugaaagaaaaaucaugguuaguccauaaacaaugguuucuagauuuaccauuaccauggacauccggagcgucaacgucacaagaaacuuggaaccgacaagaucuauuaguuacguuuaaaacagcucaugccaagaaacaagaagugguaguuuugggaucgcaagaaggggcuaugcauacggcucuuacgggcgcaacagaaauucaaacaagugggacaacaacuauauucgcuggucauuuaaaaugccguuuaaaaauggauaaacucacacugaaagggaugucuuacguuaugugcacuggcuccuuuaaauuagaaaaagaaguugcggaaacacaacauggcacugugcuuguacaaguaaaauaugagggcacagaugcuccguguaaaauaccauuuucaacgcaagaugaaaaaggagugacacaaaauggccgccuuauaaccgcuaacccuauuguuacggauaaagaaaaacccguuaacauagaaacagaaccacccuuuggcgagucguauaucguagucggugcuggggaaaaagcauugaaacucagcugguuuaaaaagggaucaaguauugguaaaauguuugaagcuacagcgcguggagcacgcagaauggcaauauugggugacacggcuugggacuucggcucgauagguggcguauuuacaaguguugguaaauuagugcaccaaguauuugguacagccuacggcguccuuuucaguggaguuucauggacaaugaaaauugggaucggcauuuugcuuacgugguuaggauugaauagccguucuacgucacuuaguaugacguguauagucguugguaugguaacauuauaucuuggaguaaugguacaggcagauucugguuguguaauaaacuggaaggggagagaacugaagugcggaucaggaaucuucgucacaaaugaaguacacacauggaccgaacaauauaaauuucaggccgacaguccuaaaagauuaagcgcagcaaucgguaaggcuugggaagaaggcguguguggcauuagaucagccacacgacuugaaaacauuauguggaaacaaauaucaaaugaauuaaaucauauacuacucgaaaaugauaugaaauucacaguaguaguaggagaugcuaauggaauacuagcucaagguaaaaagaugauuaggccucagcccauggaacauaaauauaguuggaaaucuugggguaaagcgaaaauaauaggagcagauauacaaaacacgacauuuauaaucgauggcccagacacaccagaauguccagauggacaaagggcauggaacauuugggaagucgaagacuacgguuucggaauauucacaacuaacauauggcuuaaguuaagagacaguuacacacaaaugugugaccauagacuaaugucagccgccauaaaagacucgaaagcaguacacgcagacauggguuauuggauugagagcgagaaaaacgaaacauggaaauuagcuagagcuucauuuauagaagugaaaacguguacuuggccaaagucacauacacuauggaguaaugguguacucgaaucugagaugauaauaccaaaaaucuacggagguccuaucucucaacauaacuaucgaccaggcuauuuuacacaaacugcugggccguggcauuuagggaaacuagagcuggauuuugaucuaugugaaggaacaacggucguaguagacgagcacuguggaaaucggggcccaaguuuacgcacaacuacaguaacaggaaagauaauacaugaguggugcuguagaagcuguacuuuaccaccacuuagauucagaggcgaagaugggugcugguauggaauggagauacgaccaguaaaagaaaaggaggagaaucuaguccgaucgaugguuucagcagguucaggcgaaguagacucauuuaguuuagguauccuuugcguaagcauuaugaucgaagaagucaugcguagucguuggucacguaaaauguuaaugacggguacucucgcgguuuucuugcuuuuaauaaugggacaguugacguggaaugauuuaaucaggcugugcauaaugguaggggcaaaugcaucagauagaauggguauggggacgaccuaucuagcgcuaauggcuacuuuuaaaaugaggccaauguuugcgguuggguuauuauucagacgucucacuucucgugaagugcuacuucuuacaauugguuuaagccucguugcaagcguagaauuaccuaacaguuuagaagaauuaggagacgguuuggcaauggggauaaugaugcuaaaauuacucacugaguuccaaccucaccaguuauggacaacgcuguuaucauuaacuuucguaaaaacaacacuaucucucgauuaugcuuggaaaacuacugcaaugguacuuucaauugucagcuuguucccucuaugccucucaacaaccagucagaaaacuacuugguugccaguacuucuggggucauuugguugcaaaccguuaacuauguuucuaauuacagaaaauaagauuugggguagaaagaguuggccccuuaaugaggguauuauggcaauagggauaguuaguauccuacuaaguucauuacuuaaaaaugauguuccuuuagcaggaccacucaucgccggaggcauguuaauugcuuguuauguuaucaguggguccucugcagaccuaucguuggaaaaggcugccgagguaaguugggagcaagaagcagagcauaguggagccucacauaacauauuaguagagguccaagacgaugggaccaugaaaauuaaagacgaagagagagaugacacauuaacuauacuuuuaaaagcuacucuccuugccgugaguggaguguaucccaugucaauaccugccacacuuuucguuugguacuucuggcagaagaagaaacaaaggucaggaguuuuaugggauacaccaucgccaccugaaguagagcgagcaguacuagacgaugggauauauagaauacugcagagaggguuacuaggaagaucacagguuggaguagguguauuucaagauggaguuuuucauacaauguggcacgugacaaggggugcuguacuaauguaccaaggaaaaagacuagaacccagcugggcuucuguuaagaaggaccuuaucucauauggagggggauggcgauuccaagguaguuggaacacaggugaagaagugcaaguaauugcaguagaaccaggcaaaaaucccaaaaaugugcagaccacaccaggaacauuuaaaacgcccgaaggcgaaguuggggcuauugcgcuggauuuuaaacccggaacaaguggaucaccaauaguaaacagagaggguaaaauugugggcuuguaugguaauggaguugucacaacgucaggaacauacgugagugcuauagcacaggcaaaggcgagccaggaagggccucuaccugaaauugaagaugaaguauucaagaaacguaauuuaacuaucauggaucuucauccaggaucagggaaaacaagaagauaucuaccagccauaguuagagaagcaauuaagagaaaauugagaacacuaauacuagcgccaacuagaguaguagccucugaaauggcagaagcucuaaagggcaugccuaucagauaucagacaaccgcagucaagagcgaacauacuggucgugaaaucguagaucugaugugucaugcaaccuuuaccaugcgauuguugucaccggugcguguaccaaacuauaauaugauaauaauggaugaagcacacuuuacugacccugcaucuauagcggcaaggggauacauaucuacuagaguaggcaugggcgaggcugcagcgauuuuuaugacggcaacgccgccagguucgguagaggcuuuuccacagucaaaugcggugauccaagaugaggaaagagauauaccagaacguucguggaacuuagguuaugauuggauuaccgacuuuccagguaaaaccgugugguuugugcccucaauaaaaucagguaaugauauagcgaauugucugcguaaaaauggcaaaagagucauucaauuaaguagaaagacguuugauacggaauaucagaaaaccaagaauaaugauugggauuacguagugacgacugauauaucagagaugggugcgaacuuucgagcagaucgcgugauagauccuagaagauguuuaaagccaguuauuuuaaaagaugggcccgaacgagugauacucgcggggccaaugccagugacaguugccagcgccgcacaaagaagaggaagaauaggacgcaaucaaaauaaagagggugaccaauacguauauaugggacaacccuuaaacaaugaugaagaucaugcacacuggacggaagcaaagauguuacuagauaauauaaauaccccggagggaauaauccccgcuuuauucgaaccagagagggagaaaucggcugcuauugacggggaguaucggcuacgaggagaggcccguaagacguuuguugaauugaugaggaggggugauuugccuguguggcucucguacaaaguugcaagcgaaggguuucaauacagugaucgaagaugguguuucgauggggaacgaaacaaucaaguacuagaggagaauauggacguugaaauauggacaaaagagggagaacgaaagaaacuaagaccuagaugguuagaugcucguacguauucagauccccuagcacucagggaguucaaggaguuugccgcgggucgaagauccguuucuggcgauuuaauuuuagaaauaggaaaacuaccucagcaucuuaccuuacgagcgcaaaacgcucuagauaauuugguaaugcugcauaacagcgagcaaggggguaaagcauaucgucaugcuauggaagaacucccagauaccauugaaacauuaaugcuacucgcuuuaauugcuguacuaacaggagggguaacacuuuucuuuuuaucugguaaaggccugggaaagacaaguauuggguuauuguguguaacggcgaguagcgcauuacuuuggauggcguccguggaaccacauuggauagccgcuucuaucaucuuagaguucuuucuaaugguuuugcuuauuccagagccugaccggcagcguacgccacaggauaaucaacuagcguacguuguaaucggacuucucuuuaugauccuaacaguugcagcgaaugaaaugggccuauuagaaacgacuaagaaagaucucggaauagguuauguugcagcagagaaucaccagcacgcgacaauguuagacgucgacuugcgaccugcaagugcuuggacauuauaugccguugcgacgaccguuauaacacccaugaugcgccauaccauagagaauacaacggcgaauauaagccucacagcaauagcaaaccaagcagcuauauuaauggguuuagacaaaggguggccuaucagcaagauggauauaggcguaccacuucuagcgcuggguugcuauucgcaaguaaacccucuaaccuugacagccgcuguucuaauguuaguggcgcauuaugccaucauagguccaggguugcaggcuaaggccacaagagaagcccagaaaaggacagcggcuggaauuaugaaaaauccuacaguagacgguaucguggcaauugauuuagacccgguaguauaugaugcgaaauucgagaaacaguuagggcaaauaaugcuguuaauauuauguacaucacaaauccuucuaaugagaacaacgugggcccuaugugagucuauaacccuugcuacuggacccuugaccacacuaugggaaggcucuccaggcaaauucuggaacacuaccauagcagucucuauggcgaacauauucagaggaagcuauuuagcaggagcuggacuugcuuuuagccugaugaaaagucuaggcggcggccgaagaggcacgggggcccagggagagacacucggggaaaaauggaagcgucaacucaaccaacuuucaaaaucagaguucaauacguauaagagaucagguauaauggaaguagacagauccgaagcaaaagaagggcuaaaaagaggagaaacuaccaagcacgcaguuaguagaggcaccgcgaaauugagaugguuuguagaacgaaauuuaguuaaaccugaaggcaaggucaucgaccuaggcugugggcgaggaggauggucuuauuacugugcuggacucaagaaagucacugaaguaaaaggauauacuaagggugguccugggcaugaagaacccauuccaauggcaaccuacggguggaaucuugucaaacuucauucaggaaaagacgucuuuuucaugcccccagaaaaaugcgauacauuacuaugugauauaggcgaaucuuccccaaauccgacaauagaagaagggaggaccuuaaggguauugaaaaugguagaacccuggcucaagggcaaucaauucuguauuaaaauucuaaacccauauaugcccucaguuguugaaacuuuagaacaaaugcaaaggaaacacggcggaaugcucguccgaaauccucucaguaggaacucaacccaugagauguauuggguaaguuguggaacugguaauaucgucagugcagucaacaugacuucucgaauguuacugaaucgauucaccaugguacaccguaagccuacauacgaaagagauguagaucuaggagcaggaacuaggcacgucgcuguugagccggaaguggcgaaccuagauauuauaggacagagaauagaaaacaucaaaaacgaacacaaauccacuuggcauuaugaugaagacaacccauauaaaacgugggcuuaccacgguagcuaugaggugaaaccaucagguucagcuucaucuaugguuaacggugucguaagguuauuaacuaaaccgugggacguuauaccuaugguuacgcagaucgcaaugaccgacacuacaccauuuggccaacaacggguguuuaaagaaaaaguggacacuaggacaccaagagcuaaaagaggaacaacacaaaucauggaaguuaccgcuaaaugguuauggggauuucugucaagaaauaagaaaccgcggauuuguacgagggaagaguucacacgaaaaguacggucaaacgcggcgauuggagcuguauucgucgaugaaaaucaauggaauagcgcaaaagaagcaguugaagacgaaagauucugggaccuaguccaccgagagagagagcuccacaaacagggaaagugugcgacgugugucuauaauaugaugggaaagagagagaagaaauuaggagaguucggaaaagcuaagggaucccgugcuaucugguauauguggcugggggcccgauuuuuagaauuugaagccuuaggauucaugaaugaagaucauugguucagcagagagaauagccucucaggaguugagggggaaggacuucacaaacuagguuacauauugcgagacauaucuaaaauuccuggaggaaacauguacgcugacgauaccgccggcugggauacgagaauaacagaagaugaucuacaaaacgaagcaaaaauuaccgacaucauggagcccgaacaugcccuacuggccacgucgauauuuaaacuaacguaccaaaacaaaguaguaagaguacagagacccgcgaaaaauggaacaguaauggacguaaucucuaggagagaccaacgaggaucuggccaaguagguacuuauggucuaaauaccuucacaaauauggaaguucaacuaauaagacaaauggaaagcgagggaauauuuuugccaucagaacuagaaacuccaaauuuagccgaaagaguccuagacuggcucgaaaaacacggagccgaacgauuaaagagaauggcuaucagcggggaugauugcgucgugaaaccuauagaugaccgguuugcuaccgcguugaccgcacuaaaugacaugggcaaaguaagaaaagauaucccccagugggaaccaucuaagggguggaacgauuggcaacaaguaccuuuuuguagccaucauuuucaccaauugguaaugaaagauggaagagaaauagucguuccuugucguaaucaagaugagcuaguaggacgugcucgagugucacaaggagccggauggucauuaagggaaacggccugucuaggaaagaguuaugcacagauguggcaacucauguauuuccacaggagggauuugcgauuggccgcaaacgcaauuuguagcgcgguaccggucgacuggguaccaacuucaagaacaacuuggaguauucaugcacaccaucaguggaugacuacagaggauauguugucaguuuggaauagagucuggaucgaggaaaacccuuggauggaagacaaaacccacgucaguucuugggaagaaguuccuuauuuagguaaaagagaagaucaauggugcgggagcuuaaucggacucacugcgagggccacuugggcaacaaauauucaggucgcaauuaaucaaguuagacgauuaauagguaaugagaacuaucuggacuacaugacaucaaugaaaagauucaaaaaugagagugauccagagggcgcacucugguag

SEQ ID NO: 21408 - RNA, 9879 nt, Artificial Sequence
  derived and/or modified CDS sequence (opt6) from DENV-1__FJ639796__SS-prME
ucaguuacuauguuacuaaugcuuuugccaacugcgcucgcauuucacuugaccacucgcggaggagaaccucacaugauuguaucaaaacaagaacgaggaaaaucgcuacucuuuaaaacuucugcggggguuaacaugugcacacucauagcaauggaucucggggaauugugcgaagauaccaugaccuacaaauguccucgaauaacugaagcagaaccagaugacguugauuguuggugcaaugcuacugacaccuggguuaccuacggcacauguucccaaacuggagaacaccgucgagauaaacggucuguugcacuugcgccacacgucgguuugggacuagaaacgcguacugaaaccuggaugucaagcgagggagcauggaaacagauacaaagaguagaaacuugggcuuuacgucauccuggauuuacaguuauagcacuauuucuagcucacgcuauagguacgagcauuacacaaaaaggaauaauuuuuauacuuuugaugcuugucaccccuaguauggcuaugaggugugucggaauugguaaucgggacuuuguagagggacuaagcggagcaacuuggguugauguuguauuagaacacgggucgugcgugacuacaauggccaaaaacaaaccuacacuggauauagaauuguuaaaaacggaagucacaaacccagcaguauuacguaaauuaugcauugaagcuaaaauauccaacacaaccacagauucgagaugccccacucaaggcgaagcuacacugguggaagaacaagacgccaacuuuguguguaggaggacuuucguagauaggggaugggguaacggaugugguuuauucgggaaaggaaguuuauugacuugugcaaaauucaaaugugucacuaaacuggaaggaaaaauuguacaauacgaaaaucuaaaauacagcguaauuguaaccguacauaccggcgaccaacaucaaguuggaaaugaaacaacagaacaugggacuauagcgacgauaacaccucaagcuccgacaagugaaauacaauuaacugauuacggagccuuaacauuagacuguuccccgagaacaggacuagauuucaacgagaugguacucuuaacgaugaaagaaaaaucuuggcuaguacauaaacaaugguucuuggaucuuccucuacccuggacaucgggggcaagcaccucacaagaaacguggaauaggcaagaccuauuagugaccuuuaaaacugcgcacgcuaagaaacaagagguuguuguucuggguucccaagaaggagcgaugcacacagccuuaacaggagcuaccgagauucaaacuucagguacaacgacaauauuugcagggcaucuaaaaugucgucuaaaaauggacaaauuaacacugaaaggaauguccuauguuauguguacuggaucuuuuaaauuagaaaaagaggucgcagaaacacaacauggaaccguacucguccaaguuaaauaugaagguacagaugcucccugcaaaauuccauucaguacgcaagaugaaaaagguguaacacaaaacggacguuugauaaccgcgaauccgauuguuacagauaaagaaaaacccgugaauauagaaacugagccaccuuucggggaauccuacauaguaguaggagccggugagaaagcucucaaauuaucaugguuuaagaaaggcagcucaauuggaaaaauguucgaagcuacagccagaggggcgaggaggauggcaauacucggcgauaccgcaugggauuucgguucuauaggugguguuuuuacaucaguuggaaaauuagugcaucaaguguucgguacagcauauggagucuuauuuagcggggucucuuggacgaugaagauugguauagguauauuacucacauggcuagguuugaauaguaggucgacuucguuaucaaugacauguauugcuguaggaaugguaacauuauacuuagguguaaugguccaggcagauagugguuguguaauuaacuggaaaggaagagaacugaaaugcggcucaggaauuuucguuacaaaugaaguacacacuuggaccgagcaguauaaauuccaggcugauucuccuaaacgucuuucagcagccauugggaaggcuugggaagaagguguauguggaauacggucagcaacucguuuagaaaauauuauguggaaacaaauuucuaacgaacuaaaucacauccugcuugagaaugauaugaaauucacgguuguaguaggagacgcaaaugggauucuagcccaagguaagaaaaugauccgcccucaaccgauggaacacaaauacaguuggaaaaguuggggcaaagcgaaaauaaucggagcagauauccaaaauacgacauuuauuauugacggaccagauaccccugaauguccagaugggcaacgagcuuggaauauaugggaaguugaagauuacggauucggcauauucaccacuaauauaugguuaaaguugcgagacucuuacacccagaugugugaccaccguuuaauguccgccgcaauaaaagacagcaaagcgguacaugcggauaugggauauuggauagaaagcgaaaagaaugagacauggaaauuggcuagagccucuuucaucgaaguaaagacgugcacauggccaaaaagccacacucuuuggucuaauggaguacuggaaagugaaaugaucauuccaaaaaucuauggcggcccaauaucccagcacaacuauagaccuggauauuuuacacagacggcaggaccuuggcacuugggaaaauuagagcuagauuuugaucugugugaaggaacuacaguuguuguggacgaacauuguggaaaccgagguccaucacuucguaccacaacugucaccggaaagauaauucaugaaugguguugcagaagcuguacuuugcccccacuacgguuccguggggaagaugguuguugguaugggauggagauucgacccguuaaggaaaaagaggaaaauuuaguaaggucaaugguuucagcagguaguggugaaguugacucuuucagccuagguauauuguguguuagcauaaugauugaagaaguuaugaggucucgauggagccguaaaaugcuuaugaccggcacucucgccguauuucuucuguuaaucaugggccaguugacauggaaugaucucauaagacuauguaucauggugggggccaacgcuucugacaggauggguauggguacuacguacuuggcucuaauggccacguucaagaugcgacccauguuugccguuggacuucuuuuccgaagacuaacuucgagagaaguacuccuacugacaauaggccuaucucugguagcgucuguugaacucccaaauucucucgaagaacuuggugaugggcuagcgaugggaauuaugaugcuaaaacuucuaacagaguuucaaccacaucaauuauggaccacccucuuaagucuuacauucguuaagacgacauuaucacuugacuaugcauggaagacaaccgcuaugguacuaucaauaguuucucuauuuccacuaugcuuaucaacaacaagucagaaaacuacuuggcuaccaguccuauuagggaguuucggguguaaaccauugacaauguuccuuauuacggaaaacaaaauaugggguagaaaauccuggccucugaaugaaggaaucauggccauuggaauagugucuauacucuugucuucucuucuuaaaaacgaugucccauuagccggaccauuaauugcugguggaauguuaauagcauguuauguuauaagugguaguucagcagaucuuucacucgagaaagcugccgaaguuucuugggaacaagaagcugagcauaguggggcaagccacaacauuuuaguggagguucaagaugacgguacaaugaagauuaaagaugaagaacgagaugauacacuuacaauacuauuaaaagccacguuacuagcaguaucgggaguauaucccaugaguauaccugcgacacuuuucguaugguacuuuuggcaaaagaagaaacagagaucugguguauugugggauacaccaagcccaccugagguggaaagagcaguacuagacgauggcauauaccgaauauuacaaaggggacucuuaggaagaucacaaguagguguagggguauuccaagacggaguauuucauacuauguggcacguuacaaggggugcaguucuaauguaccagggcaaacguuuagaaccuucaugggcaucagucaagaaagaccuuauaaguuauggcggcggauggcgcuuucaaggcuccuggaauacaggagaggaagugcagguaauagcaguugagccagguaaaaaucccaaaaauguccaaacaacaccuggaacauuuaaaacgccggaaggagaaguaggagcuaucgcuuuagauuuuaaaccaggaacaaguggaaguccgauuguaaauagggaggguaagauaguaggucuauacgggaauggaguaguuacuacaucgggcaccuauguuagugcaauagcucaagcgaaagccagccaggagggcccccugccugaaauugaagaugaagucuucaagaaacguaaucuuacaaucauggacuuacauccagggagugguaagacucgucgauaucucccagcaauagucagagaagccauuaaaagaaaacuaagaacuuuaauacuggcaccaacuagagugguagccucagaaauggcagaggcuuuaaaggguaugccuauaagauaucaaacuaccgcgguuaaaucagaacauaccggaagagaaaucguagacuuaaugugucacgcgacguuuacuaugcgacuauuaaguccaguaagaguaccgaauuacaauaugaucauaauggacgaagcucauuucacugauccugcauccauugcugcuagaggcuauaucagcacgcgaguagggaugggagaagcagcagcaauauuuaugacagcuacacccccagguucaguugaagcauuuccacaaucgaaugccgugauacaagaugaggagagggauauuccagagagaucauggaauagcggauaugauuggauuacggacuuuccaggaaaaacaguaugguuugugccuaguaucaagucggggaacgacauagcuaauugucucaggaaaaauggaaaaagaguuauccagcucucacggaagacuuuugacacugaauaccagaaaacgaagaauaacgauugggacuacguugucacaacagacaucucugaaaugggugccaauuuccgagcagacagaguaaucgauccaagaagaugucugaagccaguuauucuaaaggacggaccagaacggguaauauuagcugggccaaugccaguuaccguugcaagugcugcccaacgaagaggacgaauuggaaggaaccaaaauaaagaaggagaccaauacguauauaugggucaaccgcuuaacaaugaugaagaccaugcacacuggacagaagcuaagaugcuuuuagauaacauaaauacucccgaagguauaauuccugcuuuauucgaaccagaaagggaaaagucggccgcgauagauggagaauauaggcuacgaggagaagccagaaaaacauuuguugaauuaaugagaaggggcgauuuaccugucuggcuaagcuauaaggucgcgucagaaggauuccaguauuccgaccggagauggugcuuugacggagaacgaaauaaucagguacuagaagaaaacauggauguagaaaucuggacaaaagagggugagagaaagaaacuaagaccacgaugguuggacgcaaggacuuauucagauccauuagcacuuagagaguuuaaagaauuugcugccggucgacguagcgugucuggugacuuaauucuugaaaucggaaaacuaccacaacaccuaacccuacgagcucaaaaugcuuuagacaaccugguaaugcugcacaacagugagcagggcgguaaggcauauagacaugcaauggaagaauuacccgacacgauugaaacauugaugcuccucgccuuaauugccguccuaacgggugguguaacgcuauucuuuuugagugguaagggguuaggcaaaacaucgauaggauuacuaugcguaacagcuucauccgcuuuacuauggauggcgagcgucgaaccacauuggauugcagcuuccauaauucuagaauuuuuccuaaugguauuacucauaccugaaccagaccgucaaaggaccccacaagauaaucagcuugcauauguagucauaggacuucuguuuaugauacuaacaguugcugcgaacgagaugggacucuuagaaaccacaaagaaagacuuaggaauugguuacgucgcagcagaaaaccaucaacaugcgacuaugcuugauguagacuuacguccagccagcgcuuggaccuuauacgcagucgcuacaacggucauaacaccgaugaugagacacacuauagaaaacaccacagcuaauauaagucuuacagcaauagcgaaucaagcugcaauuuuaaugggguuggauaaaggcuggccuauaaguaagauggauauaggaguaccucuauuggcacuaggcuguuauucacaaguaaauccacugacccuaacagcugcuguucuuauguuaguagcgcacuaugcuauaauuggaccuggccugcaagcuaaagcaacaagagaggcacaaaaacgaacugcagcagguauuaugaaaaauccaacagucgacggaauaguagcaauugaccucgaucccgucguuuacgaugcaaaauucgaaaagcaguugggucaaauaauguuacugauccuuuguaccagccagauucuacucaugcguacaacaugggcauuaugcgaaaguauuacucuggccacagguccacuaaccacccuaugggaaggaaguccuggaaaauucuggaauacaacaauagcugucucuauggccaacauauucaggggcuccuaucuagcuggugcaggcuuagcauuuucacuuaugaaaucacuuggcggugguagaagagguacgggagcacaaggggagacacugggugaaaaguggaagagacaacuaaaucaauuaucaaagagugaguucaauacauauaaaagaaguggaauuauggaaguugauaggagugaagcaaaagaagggcugaaaagaggggaaaccacgaaacaugccguaucacguggaaccgccaagcucaggugguuugucgaacgaaaucugguaaaaccugaaggaaagguaauagacuuaggaugcgguaggggcggcuggucuuauuauugcgcgggccuuaaaaagguuacagagguaaaaggauauacaaaagguggacccggacaugaagaaccaauuccgauggccacuuacggauggaaucugguaaaacuacacuccgguaaagaugucuucuuuaugccaccagaaaaaugugacacacuauuaugcgacaucggagaauccucgcccaaccccacgauagaagaaggaaggacacucaggguauuaaaaauggucgagccgugguugaaaggaaaccaauucuguauaaaaauccucaauccauacaugcccucgguagucgaaacgcuggaacagaugcagaggaaacauggcgggaugcucguuagaaacccucucucaagaaacaguacacacgaaauguauuggguauccuguggcaccgguaacauaguguccgcgguaaauaugacuucuaggauguugcuaaaucguuuuacuauggcucacagaaaaccuaccuacgaacgugaugucgauuugggggcaggaacuaggcacgucgcugucgaaccagaagucgcaaacuuggauauaauuggccaaagaauagaaaauaucaaaaacgagcacaaauccacauggcauuaugaugaagacaacccguauaagacaugggccuaccacggaucauacgaagugaaaccaucugggucagccucgucuaugguuaauggagugguccgauuauuaacgaaaccuugggacgugauaccaaugguuacacaaauugcaaugacugauacuacaccauuuggacagcagagggucuuuaaggagaaagucgauacaagaaccccacgggcgaaacgaggaacuacccagauuauggaaguaacagcgaagugguugugggguuuccuuucacgaaacaagaaaccaagaauuuguacuagagaagaauuuacccgcaaaguaagaagcaacgcagcaauaggcgcaguuuucguagaugaaaaucaauggaauagcgccaaggaagcgguugaagaugaaagguuuugggaccuugugcacagagagagagaacuccacaaacagggaaaaugcgcuacauguguuuacaauaugauggguaaaagagagaagaaauuaggggaauuuggaaaagcuaagggaucuagagcuaucugguauauguggcugggagcaagauuuuuagaauuugaagcacugggauuuaugaaugaagaucauugguuuucucgagaaaauucuuuaucggguguugaaggagaaggucuacauaaacuaggguacauucuaagagauaucaguaagauuccaggaggaaauauguaugccgaugacacugcaggaugggauaccagaauuacggaggaugauuuacaaaacgaagcuaagauuacagauauaauggaaccugagcaugcccuauuagcuacuucgauauuuaaacuaacauaccagaauaaaguuguuagaguucaaagacccgccaaaaauggcacuguuauggauguaaucagccggagagaucaaaggggcucgggccaaguaggcacguacgggcuaaacacauucacuaacauggaaguacagcucauaagacaaauggaaucugaaggaauauucuuaccgucagaguuagaaacuccaaaucuagcagaacguguacucgauuggcuugaaaaacacggagcggaaagacuaaaacguauggcgauaucuggagaugacugugugguuaaacccauugaugaucguuucgccacagcauugaccgcccucaacgacauggguaaaguccgaaaagacauuccucagugggaacccucaaaaggauggaacgauuggcaacaagucccauuuuguagccaccauuuccaucaacuaauaaugaaagauggaagagaaauaguaguccccuguagaaaucaggaugaauuagugggucgagcacggguuagccagggugcaggauggucucucagagaaacagcuugucuuggaaaaaguuaugcucaaauguggcaauuaauguauuuccaccgccgagauuuaagauuggcugcaaaugcaaucugcucagcuguucccgucgacuggguaccaacaucacgcacaaccuggaguauacacgcccaccaccaauggaugacaacagaagacaugcuuucugucuggaaucgaguuuggauugaagaaaauccuuggauggaggauaaaacucauguaaguucgugggaggaagucccauaucuuggaaaacgggaagaccaauggugugggucguugauaggacuaacugcgcgugcaacaugggcaacaaacauacaaguugcgaucaaccaaguacgacgauuaauagggaaugaaaacuauuuagauuauaugacaaguaugaaaagauuuaaaaaugagucggauccagagggagcauuaugguaa

SEQ ID NO: 21409 - RNA, 9879 nt, Artificial Sequence
  derived and/or modified CDS sequence (opt6) from DENV-1__FJ639797__SS-prME
ucagucacuaugcuacuaaugcugcuaccaacugcauuagcguuucacuugacaacgagagguggugaaccgcauaugaucguuaguaaacaagaacguggcaaaucauuauuauuuaaaacuucugcaggcguaaauaugugcacguuaauugcaauggacuuaggugaacucugugaagauacgaugacuuauaaauguccacgaauuacagaagcggaaccugaugauguugacugcuggugcaacgcaacggauacaugggugacguaugguacaugcagccaaacgggcgaacaccggagagacaaacguucuguugcucuugcaccacacgugggacuaggccuugaaacgagaacagaaacauggaugucaucugaaggagcauggaaacaaauacaaagagucgaaacaugggccuuacgacaccccggauuuacuguuauagcacuguucuuagcacaugcuauagguacgaguauaacucaaaaagggauuauuuucauuuugcuuauguugguuaccccaucuauggccaugagaugugucgguauagguaauagggacuucgucgaaggauuaucuggugcuacauggguugaugugguuuuagaacauggaucuuguguaacgacaauggcgaaaaauaaaccaacacuagacauagaacuccuaaaaacagaagucacaaacccggcaguauuaagaaaauuauguauugaagcaaaaauaaguaauacgacaacagauucgagauguccaacucaaggcgaagcuaccuuaguagaggaacaagacgcaaauuuugucugucguaggacuuuuguugaucgcgguuggggaaacgguugcggucuauuuggaaaaggaucauuguuaacaugcgcuaaauuuaaaugcguaacaaaacuugaggggaaaaucguucaauacgagaaccuuaaauauucagucauaguaacuguacauacuggcgaccaacaccaaguuggaaaugaaacuacagaacacggcacaauugcuacuauaacuccacaagcgccuaccagcgaaauccaauuaacugacuauggcgcgcucacuuuggauuguucaccuagaacaggacucgauuuuaaugaaaugguacuccuaaccaugaaagaaaagucgugguuagugcacaaacaaugguucuuggaucucccgcucccauggaccucuggcgcaucaacaucucaggagacauggaauagacaagauuuauuaguuacauucaaaacagcacaugccaagaaacaggaaguagugguuuuagguucgcaggaaggagcuaugcauacugcguuaacaggugcuaccgaaauacaaaccucaggaacuacuacgauauucgcgggacacuuaaaaugccguuugaaaauggauaaauugacucugaagggaaugagcuauguuauguguacagggucauucaaguuggagaaggaaguggcggaaacacagcaugguacagucuugguacaaguuaaauaugaaggcacggaugcaccgugcaaaauaccguuuaguacccaggaugaaaaaggggugacacagaauggaagacuuauaacugcgaacccaauagugacggacaaagaaaaaccagugaauauagaaaccgagccacccuucggagaaucauauauuguugucggugcgggugagaaagcucuuaaauuaaguugguuuaaaaaggggucaagcauaggaaaaauguuugaagcgacagcaagaggagcccgaagaauggcaauuuuaggagacacugccugggauuuuggauccauaggcgggguauuuacgucugucggaaaacuuguucaucagguuuuuggaaccgcuuacgguguauuauuuucuggaguuaguuggaccaugaaaauuggaauagguauauugcucaccuggcucggacuaaauagucguucuaccucguuaaguaugacauguauugcagucgguauggugacacucuacuuaggaguaaugguccaagccgacuccggcugcgucaucaauuggaaagguagagaauugaaauguggaucugggauauucguuacaaacgaaguacauacuuggacugagcaauauaaauuucaggcagauaguccuaaaagauuguccgccgcaauaggcagagcgugggaagaaggcguuugcgguauccgcagcgcaacacgauuagagaauauaauguggaaacaaaucucgaaugaacuaaaucauauauuacuggaaaaugacaugaaauuuacuguagucgucggggacgcgaaugggauucuggcucagggaaagaaaaugauucgaccgcaacccauggaacauaaauauaguuggaaaucauggggcaaagcaaaaauuauaggggcugauauacaaaauacaacauucauaaucgauggucccgauacaccggaauguccagauggucagagagcuuggaacaucugggaaguagaagacuacggguuugggauauuuacaacuaacauuuggcugaaauuaagagauaguuacacgcaaaugugugaucacagauuaaugucagcggcaauaaaagauucgaaagccguacacgccgacaugggguauuggauagagagugagaaaaacgaaacuuggaaacuagcuagagcaaguuucauagaagucaagacaugcauauggccaaagucacacacacuauggucaaacgggguauuagaaucggaaaugauuauccccaaaauauacgguggacccauuucgcagcacaacuacagaccaggauauuucacucaaacagcugggccuuggcaucucggaaaguuagaacucgacuucgacuugugugaaggcaccacaguaguaguggacgagcauugcgggaacagggggcccagucugcguacaacuacgguuacgggaaagauaauacaugaaugguguuguagaucuuguacccuaccaccauuacgauuuaggggagaagacggaugcugguaugggauggagauacguccaguaaaagaaaaagaggaaaaccuaguacguucgauggugucagcaggcucuggugaaguagacucuuuuucucuaggaauauuguguguuucgauaaugaucgaagaagucaugagaucucgcuggucgagaaaaauguuaaugacugguacacuagcagucuuuuuacuauuaaucauggggcaauuaacauggaaugacuuaauaagacuuuguaucaugguaggagcaaacgcuucugaccggauggguaugggaacaacuuaucuagcacuuauggcaacauucaagaugagacccauguuugcuguaggguuacuauucaggcggcugacuucaagagaagucuugcuacugacgaucggcuugucacuugucgcaucaguugaguuaccuaacucgcuagaggaguugggagacgguuuagcuaugggaauuaugauguuaaaauugcuaacagaguuucagccgcaccaacuauggacaacuuuacucucauugacauucguuaaaacaacccugagcuuagauuacgcauggaaaaccacagcaaugguucugaguaucguaucgcuauuuccauuaugucuaaguacuacgagucaaaagacuacuugguuaccuguuuuguuggguucauuuggauguaaaccccucacaauguuccugauaacagaaaacaaaauauggggaagaaaaucuuggccauugaaugagggaauaauggcaauaggaauaguaagcauacuucuuaguucauuguuaaagaaugaugucccacuagcgggaccacuaauagcuggagggaugcuuauugcaugcuauguaauaucuggaagcucugcggaccuaagucuagaaaaagcagccgaaguuuccugggaacaggaagcugaacauuccggagcaucucauaauauauugguugaaguacaggacgacgguacaaugaaaauaaaagacgaagagagagaugacaccuuaacgauauuguuaaaagcaacguuacucgcaguaucgggcgucuacccuauguccauuccagccacgcuuuucguaugguauuuuuggcagaagaagaaacaaaggagcggagugcuaugggacacaccuucgccuccagaagucgagcgagcaguacuagacgacggcauuuaccggauucuacaacguggguuauuagggagaucgcaaguuggaguagguguguuccaagauggaguauuccauacgauguggcauguaacacggggagcaguauuaauguaccaaggcaaacgucuggagccaucaugggcuagcguuaagaaagaucuuauuucguauggaggaggguggagguuucagggaagcuggaauacaggugaagagguacaaguaauugcaguggaaccgggcaaaaaccccaaaaauguccagacuacuccaggaacauucaaaacgccggaaggcgaaguaggagcuaucgcguuagauuuuaaaccgggaacaucaggaaguccaaucgucaaccgcgaaggaaaaaucguaggacucuauggaaauggcgugguaacuaccucuggcacuuaugucuccgcgauagcacaggccaaggccagucaagagggaccauuaccagaaauagaagaugaaguauucaaaaagcgaaacuugacaauaauggaccuacacccagguucaggaaaaacgcgacguuauuugccagcaauuguacgugaagcgauaaaaaggaaguuaaggacguuaauccuggcaccaacuagagugguugccagugaaauggcagaagcacugaaaggcaugccaauacgauaucaaaccacugcagucaaaagcgaacacacgggaagagaaaucguagacuuaaugugccaugcaacguuuacaaugcgauuacuaucuccaguucgaguacccaacuauaauaugauaauuauggaugaagcacacuuuacugauccagcaagcauagccgccaggggauauauaucgacgagaguugggaugggcgaagcagcagcaauauuuaugacggcuacacccccgggaucgguagaggccuuuccccaaucgaacgccgucauacaagaugaggaaagggacauuccagaaagaucuuggaauaguggcuaugacuggaucacagauuuuccagguaaaaccguaugguucguaccaagcauaaaaucaggcaacgacauugcaaauuguuuacguaaaaacggcaagagggugauucaacuaucccgaaaaacguucgauacagaauaucagaaaaccaaaaauaacgauugggacuauguagugacuacugauauuagugaaaugggugcuaacuuucgugcugacaggguuauagauccaagacgauguuugaaaccaguaauauugaaagacggccccgaacgaguaauacuagcaggaccuaugcccgugacagucgcuucugcagcccaaaggagagggagaaucggcaggaaucagaacaaagaaggugaccaauacguuuacaugggacaaccauugaacaacgacgaagaccaugcccacuggaccgaagcaaagaugcuccuugauaauauaaacacaccugagggcauaaucccagcacuuuuugaaccagaaagagagaaaucugcagcaauugacggugaguauagacucaggggagaagcaagaaagacauucguugagcucaugagaaggggcgaccuucccguguggcuaucauacaaagucgccucagaaggcuuucaguauagugaucguagaugguguuuugacggugaaagaaauaaucaagugcuagaggaaaacauggaugucgaaaucuggacgaaagaaggggaaaggaagaaauugaggccacgauggcucgaugcaagaacuuauucugacccucuagcguuaagagaauuuaaggaauuugcagcugggcggagaaguguaucuggugaccucauccuggaaauagguaaacuaccacaacaucugacuuuaagggcgcaaaacgcacuagauaacuuaguaauguuacacaacucggaacaaggagggaaagccuaucgucacgccauggaggaacuucccgauacaaucgagacccuaauguuguuagcgcuaauugcuguccuaaccggcggaguaacguuguucuuuuuaagcgguaaaggacuggggaaaacuuccauuggacuucuaugugugacugccagcucagccuuacuuuggauggcuucugucgaaccacauuggaucgcugcuucaaucauccuugaguucuuucuuaugguuuuauuaauuccugaacccgacagacagcggacaccgcaagauaaucagcuugcauacguugucaucggauuacuguuuaugauuuugaccguugcagcaaacgaaaugggccuacuagaaacaaccaagaaagaucuaggaauaggauauguagcagcugaaaaccaucagcacgccacuauguuagauguagaucuucggccagcaagugcuuggaccuuauaugcaguugcgacgaccguaauaacaccaaugaugagacauacuauagaaaauacaacagccaauauaagucuuacggcgauugcuaaucaagcagcuauuuuaaugggguuagauaaagguuggccaauaaguaagauggauauuggggucccucuacuggcguuaggaugcuauucacaaguaaauccgcuaacauuaacugcugcuguucucaugcuagucgcacauuaugccauaauagggccuggauuacaagcgaaagccacaagggaagcacaaaaacgcacagcagcuggcauaaugaaaaauccuacuguagaugguauagucgcaauugaccuugauccaguugucuaugaugcaaaauuugaaaagcaacugggucaaauuaugcugcucauauuauguacaagccaaauauuguuaaugagaacaacuugggcguuaugugaaucaaucacccuagcgacggggccucuuaccacccugugggaagggagcccagguaaauuuuggaacaccacgauagcuguaucaauggcaaauaucuuccgugggagcuauuuagcgggggcugguuuagccuucagucuaaugaaaagccuaggaggcggaaggcgcgggacaggugcacaaggcgaaacauuaggcgaaaaauggaaacgacaguugaaucagcuuucaaaaagugaguucaauacauacaaacguaguggcauuauggagguggaucgaucagaagcaaaagagggcuugaagagaggggaaaccacaaagcaugccguuagcagagguacggcaaaacuacggugguuuguugaaagaaauuuagugaaacccgaaggcaagguaauugauuuagguugugguaggggugggugguccuauuacugcgcaggacucaagaaaguaacagaagugaagggauauacaaaaggugguccaggccaugaggaaccgauaccaauggcaacauaugguuggaauuuagucaaacuucacucaggaaaagauguguucuuuaugccaccggagaaaugugacacacuucuaugugacauuggugaaucuagucccaauccaacuauagaagagggacguacguuacguguucuuaaaaugguggagccaugguuaaagggaaaccaguucugcauaaaaauacucaauccguauaugccgaguguuguggaaacacuagaacagaugcaaaggaaacacggugggauguuagugcgaaauccucuaagucgaaauuccacgcacgaaauguacuggguaagcugugguacaggaaauauuguaagcgccgucaauaugacuucccggaugcuauuaaacagauuuacaauggcucauaggaagccaacauacgagcgagacguugauuuaggagcuggaacaaggcacguggcuguagagccugaaguagcaaaccuugacaucauagggcaacgaauagagaauauuaaaaaugagcacaaaaguacauggcauuacgacgaagauaauccguacaagacaugggcauaccauggauccuacgaagucaagccuucugguucggcaucuaguaugguaaauggaguaguaagacuuuuaacaaaaccgugggauguuaucccgaugguaacacaaauagcaaugacagauacaacuccuuuuggacaacaaaggguauucaaggaaaaaguugauacccgaacaccaagagcuaaacgaggcacuacucaaauuauggaaguaaccgcaaagugguuauggggauuccuaucacgaaacaagaaaccgcguauuugcacccgugaagaauuuacaaggaagguccggaguaacgcagcaauuggugcuguauuugucgacgaaaaccaguggaacagugcgaaggaagccgucgaagacgagagauucugggaccuugugcauagggaaagagaauuacacaaacaaggaaaaugugcaaccugcguauacaacaugauggguaaacgugagaagaaacuaggugaauuuggcaaggccaaaggaucacgagccauaugguauauguggcuaggagcucgauuccuagaauuugaagcccuugguuuuaugaacgaagaccauugguuuucaagagaaaauucauuaagcgguguggagggcgaaggucuucauaaacuagguuauaucuugcgcgacauuucaaaaauccccgguggaaacauguaugcagaugauacggcaggaugggauacgaggauaacagaagaugacuuacaaaaugaagcaaaaauaaccgauauaauggagccggaacacgcgcuauuagcgaccagcauauuuaaauuaacauaccaaaauaaaguaguacguguacaacggccggccaaaaauggcacaguaauggacguuauaucgaggagagaucaacgugggucaggucagguugguacuuacggauugaacacuuuuaccaauauggaagugcaacuuauaaggcaaauggaaucagaaggaaucuuccucccuucugaauuggaaacccccaauuuggcugaaagaguauuagauuggcuagaaaaacauggugccgaacgcuugaaaagaauggcaauuuccggcgacgauuguguagucaaacccauugaugacagauucgcaaccgcccuuaccgcauugaacgacauggggaaaguaagaaaggacauuccgcaaugggaaccaagcaaaggauggaaugacuggcaacaagucccauucugcagccaucauuuccaucaauuaauuaugaaagacgguagggaaauuguagugcccugcaggaaucaggacgagcuaguggguagggcacgcguaagucagggggccggcuggagcuuacgcgaaacggccugucuagguaaaaguuacgcgcaaauguggcaacuuauguacuuucauagacgagauuuaagacucgcggcuaacgcaauauguuccgcugucccaguagauuggguuccgacgucuaggacaacauggagcauccaugcacaucaucaauggaugacuacagaagacauguuguccguauggaaccguguuuggauagaagaaaauccguggauggaggauaaaacacacguaucuuccugggaagaggugccauaccuaggaaaaagagaagaucaguggugcggaucacuuauaggacuaacugcaagagcuacaugggcgacaaauauccaaguagcuauaaaucaaguacgaagauuaauuggcaacgaaaacuacuuagauuauaugacaucaaugaaacguuuuaaaaacgaaagugauccugaaggagcccuaugguag

SEQ ID NO: 21410 - RNA, 9879 nt, Artificial Sequence
  derived and/or modified CDS sequence (opt6) from DENV-1__FJ639802__SS-prME
agcguuacaaugcuuuuaauguuacuuccgacagcauuggcauuccaucugacuacccgugggggagaaccucacaugauaguuucgaaacaagaacgagguaaaaguuugcuguucaaaacgagcgcaggagucaauaugugcacguuaauugcaauggaucuaggagaacuaugcgaagauacaaugacuuacaaauguccacgaauuacggaagcugaaccagacgauguggauuguuggugcaaugcaacggauacauggguaacauauggcacaugcucgcagacuggugaacaucggcgagauaaaagaucgguagcacuagcaccacauguagguuuaggucuugaaacucgcacugaaacguggaugucuagugaaggugcauggaaacaaauacaaagaguugaaacaugggcauugcgucacccaggcuuuacagucauugcauuauuccuagcucacgcuaucgguacaagcauuacacaaaaagguauuauauucauacuccucauguugguaacgccaucuauggcuaugagaugcgucgggauaggaaaccgagacuucgucgaaggcuugucgggcgcuaccuggguugauguuguauuggaacauggaaguugugucacuacaauggccaaaaauaaaccaaccuuagacauugaacugcuuaaaacggaaguaacgaacccugcagucuuacgaaaacuauguauagaagcaaaaauuucaaacacaacaacagauagcagaugccccacacaaggggaagcaacguugguugaggaacaagacgcgaacuucguaugccgcagaaccuucguagaucggggauggggcaaugguuguggucuguuugggaaaggaaguuuauugacuugugcaaaauucaaaugugucaccaaauuagaaggaaaaauuguacaauacgagaaucuuaaauauuccguaauagucacuguacacacgggcgaucaacaccaaguugguaaugaaacgacagaacauggaaccauugcgacuauaaccccucaggccccuaccucggaaauacaacuaacugacuauggugcgcucacucuugacugcucuccacgcacaggcuuggauuuuaacgagaugguuuuauuaacaaugaaagaaaaaucaugguuaguacauaaacaaugguuuuuagacuuaccacuaccauggaccucuggagcaucuacuucacaagaaacuuggaauagacaagaccuauuagucacauuuaaaacggcucacgcaaagaaacaggaaguggugguacuggguucccaagaaggagcaaugcauacagcccucacaggcgcuacugaaauacaaacaaguggaacaacaacaauuuuugcuggccaccucaaauguagguuaaaaauggauaaacuaacacugaaaggcaugagcuauguuauguguacaggaaguuucaaauuggaaaaagaagucgccgaaacgcaacauggaaccguccuaguacaagucaaauaugaaggcacagaugccccauguaaaauacccuucucuacccaggacgagaagggugugacgcaaaacggucgacuaaucaccgccaacccaaucguaaccgauaaggaaaagcccguaaauauagagacggagcccccguucggcgaaucuuauauuguaguaggagcaggagaaaaagcauuaaaauuaucuugguuuaaaaagggcuccucuaucggcaagauguucgaagcuacagcgagaggagcaaggcguauggccauauuaggugacacagccugggacuuugggaguaucggcgggguauucacuagcguugggaaacuuguacaucaaguuuucgguacagcguacggaguacuguuuuccggaguaagcuggacaaugaagauaggaauagguauuuuacuaacauggcucggguuaaauagcagaucaacuagccuaucaaugacauguauagccguaggcaugguuacacuauauuuggguguuaugguacaggccgauaguggguguguaaucaauuggaaaggacgggagcuaaaaugcggaagcggcauauuuguaacaaacgaagugcacacauggacagaacaauaccgcuuucaagcagauagcccaaaaagauuaucugcggcuauuggaaaagcaugggaagagggcguuugugggauuagaagcgcuacaagauuagaaaauauuauguggaaacaaaucagcaaugaacuuaaccauauauuacuugaaaacgauaugaaauuuaccguuguaguuggugacgcuaacggcauauuggcucaaggcaaaaagaugauccguccacaacccauggaacauaaauacucauggaaaagcuggggaaaagcgaagauuauuggagccgauauacaaaacacaacauuuauuaucgacggccccgacacacccgaguguccagauggacaacgggcguggaacauaugggagguagaagauuacgguuucggaaucuuuacgacgaauauaugguugaaguuaagagauaguuacacacagaugugugaucauagacucaugucugcggcaauuaaggacucaaaggcgguccaugcugacauggguuauuggauagaaucugagaagaaugaaacauggaaacuagcccgagccucuuucauagaggugaagaccugcaucuggccaaaaagccauacauuauggagcaaugggguauuagaaucugagaugauuauuccuaaaauauauggaggaccuauaagccaacacaacuaucggccaggauauuuuacgcaaacagcuggaccauggcaucuugguaaacucgaacucgacuuugaucuaugugaggguacgaccguagucgucgaugaacacuguggaaacaggggacccucauuacguacaacaaccguaaccggaaaaauaauucaugaauggugcuguagaagcugcacucucccuccucuccgauuuaggggagaagauggauguugguacggaauggaaauuagaccagugaaagaaaaagaagaaaauuugguuagaaguaugguaagcgcggguucuggggaaguagauuccuuuucauuagguaucuuauguguaucuaucaugauugaagaagucaugcggagucgauggucuaggaaaaugcugaugacugguacacuagcuguguuucuauuacuaauaaugggacaacuaaccuggaaugaccugauaagacuaugcauaaugguaggagcuaacgcgagcgaucgaauggggauggguacuacauauuuagcacuaauggcaaccuuuaaaaugagacccauguucgcggucggacugcucuuucguagguuaacaagcagagagguacuucuacuuacaaucggucuuucucugguugcaaguguugaacuuccuaauucacuagaggaguuaggagauggauuagcaauggguaucaugauguuaaaacuauugacagaguuucaaccccaccaguuauggacaacauuauuaucacuaacauucguuaaaacaacuuuaagccucgacuaugcauggaaaacgacagcaaugguucuuucaauuguuucgcuuuuuccguuguguuuaaguacaacaagccagaaaacgaccuggcuaccgguauugcuagguucauucggauguaagccgcuuacaauguuucucaucacagaaaacaagauuuggggccguaaaucguggcccuuaaaugaggguauaauggcaauuggaauaguaucuauacuucuaagcaguuuacuaaagaaugacguuccacuggcugggccauuaauagcaggaggcaugcucauugcuugcuacgucauuuccgguagcucugcggaucucagcuuagaaaaagccgccgagguuucaugggaacaagaagcugaacacucaggggcaucacauaacauccucguugaaguucaagaugacgguacgaugaagauuaaggacgaagaaagagacgacacacuaacaauucuccuaaaggcaacauuauuggccgucagugggguguauccgaugaguauuccagcaacacucuucgugugguauuuuuggcagaagaagaaacagcggaguggcguacuuugggauacaccaagcccgccugaaguugaacgcgcgguauuagaugacggaauuuaucguauucuacaaagaggauuacuagggaggagucaaguaggaguuggaguauuccaggauggaguuuuucauacuauguggcaugucaccagaggagcaguucugauguaucaaggaaaacgccuagaaccaaguugggcaaguguuaagaaagauuuaauaagcuacggaggcgguuggagguuucaaggaucauggaauacgggagaagaaguacaaguuauugcaguagaaccaggcaaaaaucccaaaaauguccaaacgacaccaggcacguucaagacaccggaaggugaaguuggggccauagcucucgauuuuaaaccggggacaucaggaagccccauuguaaauagggagggcaaaauaguuggucucuacggaaaugguguaguuaccacuuccggcacguauguaucagcgauagcccaagccaaagccucccaagaagggccauuacccgaaauugaagaugagguuuuuaaaaagcgaaaucuuacaaucauggacuuacauccagguagcgggaaaacgagacguuaccuaccagcgauaguuagggaggcuauuaaacgaaaguuacgcacacuuauucuugcuccgacuaggguaguugcaucggagauggcugaagcguuaaagggaaugccaaucagauaucaaacaacggcuguuaaguccgaacauacaggaagagagaucguagaccucaugugucacgccacguuuacaaugagacuauuguccccaguccgaguaccaaacuacaacaugauaauuauggacgaagcucacuuuacagauccagcuucuauugcagcuagaggcuacauaagcacucgagucgguaugggagaagcagcagcuauuuuuaugacugcaacaccuccaggcuccguagaggccuucccgcagagcaacgcaguuauucaagacgaagaacgagauaucccggaaaggucuuggaacuccggauaugacuggauuacagacuucccagggaaaacgguuugguuuguccccaguauaaaaaguggaaaugauauagcaaacuguuugaggaaaaacggcaaacgcgucauucagcugucgcgaaaaaccuucgauacagaauaucaaaagacuaaaaacaacgauugggacuacgucgucacuacagacaucagugagaugggugcaaauuuucgagcggauagaguuauagacccucgacgaugcuuaaaaccaguaauccuuaaagauggaccugaaagaguuauauuagcugggccuaugccuguaacuguggcaucagccgcucaaagaagagggcggauaggcaggaaccagaauaaagaaggcgaucaauacguuuauaugggacaaccacuaaauaaugaugaggaucaugcgcauuggacagaggcuaaaauguuacuagauaauauaaacacaccagaaggaaucauaccagcacuuuuugaaccagaaagagagaaaucagcagccauagauggugaauacagauuacgaggggaagcuagaaaaacauucgucgaauuaaugagacgaggggaucuaccaguaugguuaucuuauaaaguagcuagcgaaggcuuucaauacucugacagacgcugguguuuugauggagaaaggaacaaucaaguacuugaagaaaacauggacguggaaauauggacgaaggaaggggaaaggaagaaauugaggccaagguggcuggacgcaagaacauauagugacccacuagcauuacgagaauuuaaggaguucgccgcaggacgaaggucuguuucgggcgaucuuauacuggagauagguaaacuaccacagcaccuaacgcucagggcacagaaugccuuagacaaccucgugaugcuccacaauucugagcagggagggaaagcauaucgacaugcgauggaagaauuaccagauacaauagagacacuaaugcuacuagcucucaucgcaguccucacuggagguguaacgcuauucuuucuaucugggaaaggacuaggcaaaaccucuauuggucuuuuauguguuacugcuucaucagcauuacuuuggauggcgaguguugagccacauuggaucgcugccucgauaauucucgaguucuuccuaaugguacuccuaauaccagaaccagauagacaacgaacuccucaagacaaccaauuggcguacgugguaauugguuuauuauuuaugauucuuacagucgcugcaaaugaaaugggucuacuugaaaccacuaagaaagauuuaggaauuggauauguugcagcagaaaaccaucagcaugcuacuaugcucgacguggaucuccguccagcaagcgccuggaccuuguacgcagucgcaacaacagugauaacaccaaugaugagacacacgaucgaaaauacuacugccaauaucagcuuaacugcaaucgcgaaccaggccgcuauauuaaugggauuagacaagggcuggccaauaucuaaaauggacauaggggucccacugcuggcguuggggugcuacagucagguuaauccccuuacuuugacugcugcugugcuaauguuaguugcacauuaugcgauaauugguccggggcuucaagcaaaagcaacucgugaagcucaaaagagaacagcagcuggaauaaugaaaaacccaacaguugacggaauaguagcuaucgaucuugacccuguuguauaugacgcuaaauucgagaaacaauuaggucaaaucauguuauugauucucuguacuucgcagauacuguugaugagaacuaccugggcauugugugaaucaaucaccuuggcgacaggaccacuuacuacauuaugggaaggaagccccgggaaguuuuggaauacaaccauugcuguaagcauggcaaauauauucagaggaaguuacuuggcuggugcuggauuagcuuucucauuaaugaaaucucuaggcggaggucguagaggaacuggagcacaaggagaaacacuaggcgagaaauggaaaaggcaguugaaccaauuaaguaaaucugaauuuaacacauacaaacguucugguauaauggaaguugaccgaucagaggcgaaagagggccuuaaacgaggugaaacuacaaaacacgcagugucacgugggacagccaaacuacgaugguuuguagaacguaacuugguuaaaccugaagggaaaguaauagauuuaggaugugggagagggggauggaguuauuacugugccggacucaagaaaguaacagaggugaaaggauauacaaaggguggcccugggcaugaagaaccaauaccaauggcaaccuauggguggaaccuagugaaacuacauucaggaaaagauguguucuuuaugccgccggaaaaaugcgauacacuguuaugugauauuggggaaagcucacccaacccaacuaucgaagaaggacguacucuaagggucuuaaagaugguugagcccuggcuuaaaggaaaucaguucuguauaaaaauacugaacccuuauaugcccucuguagucgagacauuggaacaaaugcagagaaagcacggcggaaugcuaguaaggaaucccuugucaagaaacuccacacaugaaauguacuggguauccugugguacaggcaacauaguuuccgcaguaaauaugacgucucgaaugcuuuuaaacagguuuacaauggcacauagaaaaccaacauaugagcgagaugucgaccucggugcuggaacacgucauguggcuguugaaccagaaguggcaaauuuggauauaaucggacagagaaucgagaacauaaagaaugaacacaaaaguacauggcauuacgaugaagacaauccauauaaaacuugggcuuaucaugggaguuacgaagugaaaccuuccgggagcgcgaguucaaugguaaauggagucguccgauuacuaaccaaaccaugggauguuauuccaaugguaacucaaauagccaugacagauacgacaccauucggacaacagaggguuuucaaggagaaagucgacacuagaaccccgcgggcaaaacgaggaacaacucaaauaauggaaguuacugccaaauggcuguggggauuccuuuccaggaauaagaaaccacgaauuuguacucgggaggaguucacgcgaaaaguacgaaguaaugcggcaauuggugcgguuuuuguagaugaaaaucaauggaacagugcaaaagaggcaguugaagacgagagguucugggacuuaguacacagggaacgagaacuacauaaacaagguaaaugcgcaacaugcguauacaauaugaugggaaaaagagagaagaaacucggugaguucggaaaagcaaaggguagccgugccauuugguauaugugguugggagcacgauuccuagaauuugaagcauuaggauucaugaaugaagaucacugguucucaagagaaaauucacuaagcggaguggaaggcgaaggcuugcacaagcugggauauauccuuagggauauaucgaagauaccgggugguaauauguaugcagacgauaccgcugguugggacaccagaaucacagaagacgaucuacaaaaugaggcuaagauaacugacauaauggaaccugaacacgcacuacuagcaacaucuauuuuuaagcugacuuaccaaaauaagguaguaaggguacagaggccggccaaaaauggaaccgucauggacguaaucagucgucgagaucagcggggguccgggcaagucgggacauacggacugaauacauucacaaacauggaaguacagcuuauucgacagauggaauccgaggguauauuuuuaccaagugagcuugaaaccccaaaccuagcggaacgaguauuagacuggcucgaaaaacauggagcagaacguuuaaagcguauggcuauuagcggggacgacugcguaguaaagccaaucgaugauagauucgcgacagcacuaacugcucucaaugauaugggaaaaguucgaaaagauauuccucagugggaaccaucgaaaggauggaaugauuggcaacagguuccuuuuugcucacaccacuuucaucaauugaucaugaaggacgguagggagauaguugucccauguagaaaucaagacgaauuaguuggcagagcacgcguaucacagggcgcaggauggucacuuagagaaaccgcuugcuuaggaaaaagcuaugcgcaaauguggcaacucauguacuuccaucgaagggauuuacggcuggcugcuaacgcaaucuguucggcugugccugucgacuggguuccaacaucaagaaccacauggucgauucacgcacaccaccaauggaugacuacggaagacaugcugagcguguggaaucgcguauggauagaggagaauccguggauggaggauaaaacccauguuaguucaugggaggaaguucccuaucuaggaaaaagagaagaucaaugguguggcucacuaauugguuuaaccgcaagagccacgugggccacaaauauacagguagcgauuaaccaaguuaggcgacuaauaggaaaugaaaauuauuuagauuauaugaccucaaugaagcguuuuaaaaacgaaagcgauccggaaggugcacuaugguaa

SEQ ID NO: 21411 - RNA, 9879 nt, Artificial Sequence
  derived and/or modified CDS sequence (opt6) from DENV-1__JN819410__SS-prME
aguguaacuaugcuucuuauguuacuaccuacugcccuagcguuucaucuuacgacuaggggaggggaaccgcauaugauagucuccaaacaagaacguggaaaaaguuuacuguuuaaaacaagcgcuggagugaauauguguacacugauugcgauggaucugggagaauuaugcgaagauacaaugacauauaaauguccucguauaacugaagccgaaccggaugaugucgauuguugguguaaugcaacggauacuugggugacauauggaacaugcagucaaacaggcgaacaucgcagagagaaaaggaguguagcacuagcaccccauguagguuuaggcuuggaaacaagaaccgaaacguggaugaguucagaaggcgcuuggaaacaaauacaacgaguggaaacuugggcguuaagacacccaggguuuacagugauagcguuuuucuuagcucaugcgaucggcaccaguaucacucaaaaagguauaauauucauuuugcucauguuagucacaccaaguauggcaaugcguuguguaggaauuggaaaucgagauuuugucgaaggguuguccggggcaacauggguugauguuguuuuagaacaugguaguugcguaacuacgauggccaaaaacaaaccuacacucgacauagaacuuuuaaaaacagaagucacaaaccccgcgguccugaggaaacuauguauagaagcgaaaauaucgaauaccacuaccgacagcagauguccuacucaaggagaagcaacacugguagaggaacaggaugcgaauuucguauguaggcguaccuuaguagaucgaggaugggggaacgguuguggauuguuugguaaaggaaaucuauuaacaugcgcuaaauucaaaugugucaccaaauuagaagguaaaaucgugcaauaugagaaucuaaaauauucugucauaguuacuguucacaccggagaccaacaucaaguuggaaaugaaacuacggaacauggaacaaucgcuaccaucacaccucaggccccuacuucagagauucaauugacugauuauggagcgcuaaccuuagacuguaguccaagaacaggucuagacuuuaacgaaaugguacuuuugacuaugaaagagaaaaguuggcugguucauaaacaaugguuccuagacuuaccacugccuuggacaucuggggcaucuacaucucaagaaacauggaaucgacaagaucucuuaguaaccuuuaaaaccgcccacgcgaagaaacaagaggucgugguucuaggaucacaggagggcgcaaugcacacggcgcuaacaggggcgacggagauccaaacguccggaacgacaaccauuuuugcaggccaccugaaauguagauuaaaaauggauaaacuaacauugaaaggaauguccuacguuaugugcacaggcuccuucaaauuagaaaaagaagucgcagaaacacagcauggaacugugcucgugcagguuaaauacgaaggaacugaugcaccauguaagauaccauuuucaacgcaagaugaaaaagggguaacccagaacggaaggcuuauuaccgccaauccuaucgucacugauaaagaaaagccugugaauauagaaaccgagccuccuuuuggagaaagcuauauuguagugggugccggagagaaagcauugaaacuaucuugguucaaacgcgguucaucaauagguaaaauguuugaagcaacugcgagaggagcgcggagaauggcaauacuaggagacacugcaugggauuucgguucgauuggagggguuuucacaucgguuggaaaacugguccaucaaguuuuuggaacagccuacggaguauuauucucagggguaagcuggacgaugaaaauagggauuggaauuuuacuaacguggcuagguuugaacucaagaucaacaucucuguccaugacauguaucgcaguuggaauggugacucucuacuuaggggucaugguucaggcagauagcggaugcguaauaaauuggaagggaagggaauuaaaguguggcagugggauauucguuacuaacgaaguacacacauggacggagcaauauaaauuucaggcagauagucccaaaagauuaucagccgcuauagguaaagcaugggaagaagggguaugugggauacgaucagcaacaagacuugaaaacauaauguggaaacaaaucuccaaugaauuaaaucauauccuauuggagaaugauaugaaauucacuguggucguaggagacgccaaugggauucuugcacaaggaaagaaaaugauacgaccccagccgauggaacacaaauacagcuggaaaagcuggggaaaagcuaaaauaauaggcgcugacauacaaaacacuacauuuaucaucgauggaccggauacacccgaauguccggacggucaaagggcguggaauaucugggagguagaagauuauggguucggcguauucaccaccaacauauggcuaaaauuaagggauucuuauacacaaaugugugaucacagacuaaugagcgcagccaucaaagacagcaaggcuguacacgcggacaugggcuauuggaucgaaucugagaaaaaugaaacuuggaaauuagcaagagcaaguuuuaucgaagugaagacuuguacauggccuaagucacacacauuauggucaaauggugugcucgaaucugagaugauaauaccuaaaaucuauggugguccuauaucccagcacaacuauagaccaggauacuuuacacaaacugcaggcccauggcauuuggguaagcuagagcuugauuuugauuuaugugaaggaaccacaguuguaguagaugagcauugcggaaaucguggaccguccuuaaggacuacaaccguaacaggcaaaauuauacacgaaugguguugcaggucaugcacauugccaccucuaagauuucgcggugaggacggauguugguauggcauggaaauucgcccuguaaaggagaaagaagaaaaucuuguacguagcaugguaagcgcgggaucuggagaaguggacucauuuucuuuagggauacuuugcgugucaauuaugauugaagaaguaaugagaagucguuggucucggaaaaugcuuaugacaggaacauuagcaguguucuuguuacucauaaugggacaacuaacauggaacgaucuaauaagguuguguauaaugguuggugcuaaugcuagugaucgcaugggcaugggcacaacauauuuagcacuuauggccacuuuuaaaaugaggccuauguucgcuguaggucuacuguuccgacguuugacguccagagaaguucuguuauugacaauaggacugucuuugguugcaagcgucgagcuaccaaauucacuagaagaauugggagacggcuuagcuaugggaaucaugauguuaaaguuauuaacugaauuucaaccucaucagcuguggacaacauuauuaucauugacguuuauaaaaacaacacuuucguuagauuacgcuuggaagacaacggccaugguucuaagcauugucagcuuguucccauugugcuuaagcacgacaucucagaaaacgaccugguuaccaguacuacuaggcucuuucgggugcaaaccauuaacaauguuucugauuacugagaauaagaucuggggccguaagucauggcccuuaaaugaagguauaauggcaauuggcauugucagcauuuugcuguccaguuuacuuaagaacgauguaccacuagcaggaccacuuauagcugguggaaugcuaaucgcuuguuaugugauuagugguucuagugcggaucuuucgcuggaaaaagcugccgaaguuucaugggaacaagaagccgaacauagcggcgccucacauaauaucuugguugaaguccaagaugaugguacuaugaaaaucaaagacgaggaacgugacgauacccugacaauauugcuaaaagcgacgcuucuggcuguaucgggaguauacccgaugucuauaccagcuacccuauuuguaugguacuucuggcaaaagaagaaacaaagaucaggaguuuuaugggauacuccgucaccaccugaaguugaaagagcgguauuagaugauggcauauaccgcauccuacaaagaggacuauuaggccguucgcaaguaggcgugggggucuuucaagauggaguuuuucauacuauguggcacguuacacguggcgcaguuuuaauguaccaagguaaaagauuagagccaucaugggcaagcgucaagaaagauuugauuucuuaugguggaggauggcgauuucaaggcucguggaauaccggagaagagguacaaguaauagcaguagagccagguaaaaauccaaagaaugugcaaacuacaccaggaaccuucaaaacaccggaaggggaagugggcgcuauagcauuggauuuuaagccuggaacgaguggcaguccuaucguuaaccgagagggaaaaauagucgggcucuauggaaauggcguagucacaacaagugguacuuauguuagugcuauugcacaagcuaaagcgucacaagaagggccauugccugaaauagaagaugaaguuuucaagaaacggaacuugacaauaauggacuuacacccggguagcgggaagacgagacguuaucuacccgcaauaguacgugaagcaauaaagcguaaauuaagaacacuuauauuagccccgaccagaguuguggccuccgaaauggcagaggccuugaaaggaaugcccauacgauaccaaaccacagcaguuaaaucugaacauacgggucgugagauaguugaucugaugugucacgcaacauuuacuaugcgacuauuaucuccaguaaggguuccaaauuauaacaugauuauaauggacgaagcucacuuuacugauccugccagcauagcagccagaggcuacaucaguacaaggguaggcaugggggaggcugcagcuauauucaugacagcuacuccuccugggagcgucgaagcauucccacaaaguaacgcugucauccaggaugaagaacgcgauauuccagaaagaagcuggaacucagguuacgauuggaucacagauuuuccaggaaaaacagucugguuugugccaucuauaaaaucaggaaacgauauagcaaauugccugaggaaaaaugguaaaagggugauccagcuaagucgaaaaaccuuugacacagaguaccagaaaaccaaaaauaaugacugggacuaugucguaacgacugauauaucagagaugggugcgaacuucagagcugauaggguaaucgauccaaggagguguuuaaaacccgugauacugaaagacgggccugaacgugucauauuagcggggcccaugcccguuacaguugcgagcgcagcacagagaagagggcggauuggucgaaaucaaaauaaagagggugaucaauacguauacaugggccaaccacuaaacaaugaugaagaccacgcacauuggacagaagcgaaaaugcuguuagauaauauuaauacuccugaaggaauaauaccagcgcuuuucgagccagagagagaaaaaucggcagccaucgauggagaauaccggcuaaggggagaagcccggaaaacuuuuguagaguuaaugagaagaggggaccuccccguauggcuaaguuauaaggucgccagugaggguuuccaauacucagauagacguugguguuucgacggcgaacgaaauaaccaaguguuggaagagaauauggauguagaaauauggacgaaagagggggaaagaaagaaacucagaccuagauggcuagacgcccguacguauuccgacccgcuagcuuuaagagaauuuaaagaguuugcugcgggcagacgaucggugaguggcgaccuuauauuagaaauugguaaacuaccccaacaccucacacucagggcacagaacgcacuggauaacuugguuaugcugcacaauucagaacaaggcggaaaggcuuaucgccacgcaauggaagaauuaccagacacaauagaaacuuuaaugcuguuagcauuaauagcaguacucacagggggcguaacauuguuuuucuuaucagguaaaggacucggaaagacgagcauagguuuauuauguguuaccgcaagcagcgcguuacuauggauggcgaguguagaaccacacuggauugcugcuaguauaauucucgaguucuuucuaaugguucuauuaauuccagaacccgaucgacaaagaacgccucaagauaaucagcuagcauauguagucaucggacuguuguuuaugauauuaacaguagcugcuaacgagauggggcuuuuggaaacuacgaagaaagaccuaggaauaggcuacguagccgcggaaaaccaccaacaugcuacgaugcuggacguagacuuacacccugccucagcauggacgcuguacgcagucgcaacaaccguaauuacuccuaugaugaggcacacuauugaaaauacuacagccaauaucagcuuaacugcgauagccaaucaagcugcuaucuuaauggguuuggacaaagguuggccgaucaguaaaauggauauuggugucccauuauuggcauuaggcuguuacucucaaguaaaucccuuaacuuuaacagcagccgugcuaaugcuagucgcccauuaugcuauaauaggcccuggacuucaggcaaaagcaacacgagaagcacaaaaacgaaccgcagcaggcauuaugaagaaccccacaguagaugguauuguagcuaucgauuuagauccugugguauaugaugcaaaauuugaaaaacagcugggacagauuaugcuauugauccuauguaccucccagaucuuacugaugagaacaacuugggcacuaugugaaagcauuacacuagccaccggaccucucacaacccucugggagggcucgccgggaaaguuuuggaauaccacaauagcggugucuauggcuaauauauuuagggggucguaucuagcuggggcgggguuggcuuucucuuuaaugaagucguuggguggggguaggagaggaacuggagcacagggagaaacgcuuggagaaaaauggaagaggcaacuuaaucaacuaagcaaaucugaauuuaauacguauaaaaggagugguauaauggaaguggacagaucagaagcgaaagagggucuaaaacgcggugaaacaacgaagcacgcagugagccgaggaacagcgaagcuacgaugguuuguggaacgcaaccuuguaaaaccugaaggcaaagugaucgauuuaggaugcggcagaggagggugguccuacuacugcgcagggcuaaagaaaguuacugaaguuaagggauauacaaaaggagggcccggccaugaagaacccauaccaauggcgacauacggauggaacuuagugaaauugcauucaggaaaagacguauucuuuaugccuccugaaaaaugugauacacuauuaugugauauuggagaaagcucaccaaauccuacaauugaagaagggagaacacuucgagucuuaaaaaugguagagccaugguugcgagguaaucaauuuugcauuaaaauuuugaaucccuacaugcccaguguuguugaaaccuuggaacagaugcaacggaaacaugggggcauguugguuagaaacccacuaucuagaaauucaacacaugaaauguauuggguaagcugugguacagggaacauaguuuccgcaguaaauaugacuagcagaauguuguuaaauagguucaccauggcacaccgaaagcccaccuaugaaagagauguugacuugggugcuggaacaagacauguugccguagaaccggaaguugcaaaucuggacauaauaggucagcgaauugaaaacauuaaaaaugagcauaagaguacauggcauuacgaugaagacaacccguauaaaaccugggcauaccaugggucauaugaaguuaagccaucgggaucagcgagcagcaugguaaauggaguuguaagauuacucacaaaaccaugggaugugaucccaauggucacacaaauugcuaugacagauacaacaccuuucgggcaacaaagagucuucaaagaaaaaguugacacacgaacuccacgugcaaaacgaggaacaacgcagauuauggaagucacagcaaagugguuauggggauuucuguccagaaauaagaagccucguauuuguacucgggaagaauuuaccagaaaaguucgaucuaaugcagcaauuggggcaguauuugucgacgaaaaucaauggaacucugccaaagaagccguagaagaugaacguuuuugggaccugguacacagagaaagggaauuacauaaacagggcaaaugcgcgacguguguuuacaauaugauggguaaaagagaaaagaaacugggugaguucggaaaggcaaaaggaucgcgagcaauaugguauauguggcucggugcacgguuucucgaauuugaagcacucggauuuaugaaugaagaucauugguuuagucgcgagaacucgcuuagcggggucgaaggugaaggcuugcacaaguuagguuacauacuacgagacaucucuaagauaccaggcggaaacauguacgcagacgacacagccggaugggauacacgaauaacagaagacgaucugcagaaugaggcuaaaauaacagauauaauggaaccggaacaugcucuuuuagcuacaucuauauuuaaauuaacguaccaaaacaaaguugucagaguacaaagaccggcgaagaaugggacaguaauggaugucauuucacgucgagaccaacgaggaucaggacaagucggaaccuacggucugaacaccuuuaccaauauggaggugcaauugauacgucaaauggagagcgaagguaucuuuuugccuucugaacucgaaacaccgaaccucgcggagagagcguuagacugguuagaaaaacacggagcagaaagguuaaaaaggauggcgaucaguggagaugauuguguagucaaaccuauugaugaucgcuucgcaacagcauugaccgcguuaaacgauaugggaaaaguccgaaaagauauaccacagugggaaccaucaaagggcuggaaugacuggcagcaaguaccuuuuugcagccaccauuuccaucaauugaucaugaaagacggaagagagauagugguaccaugcaggaaccaggaugaauuaguggguagggcucgaguuucacaaggagcaggguggaguuuaagggagacugcaugcuuggguaaaaguuacgcucaaauguggcaauugauguacuuucauaggcgagaucugagacuagcagcaaacgcaauuugcagcgcugucccaguggauugggucccaaccucgcgaaccacauggaguauucaugcacaucaucaguggaugacuacagaagauauguuaaguguuuggaacaggguuuggauagaagagaauccauggauggaagacaaaacacauguuucuaguugggaagaaguaccguauuuaggcaaaagagaggaucaguggugcggcagcuuaaucggucuaaccgcgcgugccacaugggcaaccaauauacaagucgcaauuaaccagguacgacgucuuaucggaaacgaaaacuaucuagacuacaugacaaguaugaaacguuucaagaacgaaucagauccugaaggugcucuaugguaa

SEQ ID NO: 21412 - RNA, 9879 nt, Artificial Sequence
  derived and/or modified CDS sequence (opt6) from DENV-1__FJ639806__SS-prME
ucagugacaaugcuccucaugcuccuaccaacagcacuugcuuuccaccuaacuacucgaggaggggaaccucauaugauagucucuaaacaagaacgaggaaaaucacuccuauuuaaaacgucggcgggugucaauauguguacccugauagcaauggaucuaggagaacugugugaagauacaaugacauacaaauguccgaggauaacggaggcagaaccugaugacguagacugcugguguaaugcaacggacacuuggguuacuuauggaacgugcucucagacuggggaacaccgaagagauaaaagaaguguugcauuggcuccacauguaggauuaggguuagaaacgcgaacugaaacuuggaugucuagcgaaggcgcauggaaacaaauacaaaggguagaaaccugggcucugcgacauccagguuucacgguaauagcauuauucuuggcacacgcgauaggcacaaguauaacacaaaaagggauuauuuucauccugcuaauguuaguuacaccaucuauggcaaugcguugcguaggcaucggcaaccgagauuuuguggaaggacucucaggcgccacguggguugauguaguauuagaacaugguucuugugucacuaccauggcgaaaaacaaaccaacguuagauauugaauuacucaaaacggagguuacuaauccagcaguuuuaaggaaauuauguauugaagcaaaaaucaguaacaccacaaccgauucgagauguccaacacaaggggaagcaacuuuaguagaagaacaagacgcaaauuuuguauguagaagaacauuugucgaccgaggguggggaaacggauguggucuuuuuggaaaaggcaguuuacuaacgugugcgaaauuuaaaugcguuaccaaauuagagggaaaaauuguacaauacgaaaaucugaaauacucugugauuguaacuguccacacuggagaucaacaucaagucggaaacgaaacaacggaacacggcacaaucgcaacuauaacgccacaagccccgacaucugagauucaauugacugauuacggcgcucuaacauuagauuguucuccgagaacuggauuggacuuuaacgaaaugguguuacuaacuaugaaagaaaaaucuuggcuaguucacaaacaaugguuucuugauuuaccacugccguggacaucuggggcaucuacaucucaagagacauggaacagacaagacuuauuaguaacuuuuaaaacugcccaugccaagaaacaagaaguagugguuuuaggaagccaagaaggugccaugcacacagcgcuaacgggagcuacagaaauacaaacgagcgguacgacuacaauuuuugcuggucacuugaagugucgauuaaaaauggauaaacuuacccucaaaggaaugucguacgucauguguacuggaucauuuaaacuagaaaaagaaguagcagaaacccaacacgggacggucuuaguacagguaaaauaugaaggcaccgaugcgccuuguaagaucccauuuucaacacaagacgagaagggaguaacacaaaacggacgucuuauaacggcuaaucccauagucacugauaaggaaaaaccuguaaauaucgaaacggaaccacccuuuggagagaguuauauuguaguaggugcgggggaaaaagccuuaaaauuaucgugguuuaagaaaggaucgagcaucggaaagauguucgaagcuaccgcacgcggagcgcgaagaauggcgauauugggggauacugcaugggauuuugggaguauugggggcgucuuuacaucaguggggaaauuaguucaucaaguauuuggaacagcguacggaguauuauuuuccggggucaguuggacaaugaaaaucgguaucggcauucuacuaacuuggcuuggauuaaauagcagaucaacuucucuuaguaugaccuguauugcagucgggauggucacacuauaucucggaguuauggugcaagcugacagugguugugugauuaacuggaaaggaagagaauugaaaugugguucagggauauuuguaaccaacgaaguacauacuuggacagagcaauacaaguuucaggcggacucuccuaaaagacuaagugccgcuauugggagagcgugggaagaaggcguuugcggcauaagaucugccacgagacuugaaaacauaauguggaagcaaauuuccaaugaauuaaaucacauacuacucgaaaacgacaugaaguucaccgugguuguuggagaugcuaauggaaucuuagcgcagggaaagaaaaugaucagaccccagcccauggaacacaaauauucuuggaagucgugggggaaagcuaaaauuauaggggccgauauucaaaacacaacauucauaauagauggaccugauacgccagaaugucccgacgggcaaagagcguggaauauaugggaaguugaagacuacgguuuuggaauauucacaacaaauauauggcucaagcuaagggauucauacacacaaaugugugaccaccgauugaugucggcagcaauaaaagauucaaaagccguccacgcugauauggguuacuggaucgagucggagaaaaaugaaaccuggaaguuagcacgagcaucuuucaucgaaguuaaaacauguauauggccaaagucucauacuuugugguccaauggaguucucgaaucugagaugauaauaccaaaaauauacggugguccuauaucgcaacauaauuauagaccagguuauuuuacccaaaccgcaggacccuggcaccuagggaaacuggaacuugacuucgaucugugcgaagguaccacuguaguagucgacgaacacugcgguaacagaggaccaagucuaagaacaacaacaguaacaggaaaaauuauucaugaaugguguugcagaucuugcaccuuaccaccauuacgauuucgaggagaagacggauguugguauggaauggagaucagaccaguuaaagaaaaagaagaaaaucuaguacgcucuaugguuagugcaggaucaggagaaguagauaguuuuaguuugggaauacugugcguaucaauuaugauugaagaagugaugcguucaagauggucacgaaaaaugcuuaugacagggacccuagcuguauuuuuacuccugauaauggggcaacugacauggaacgaucuaauucgacuauguauuaugguaggugcaaacgcuagugacagaauggguaugggcacgacuuauuuagcguuaauggcaacauuuaaaaugaggccaauguuugcuguuggacuacucuucagacgccuuaccucuagagaagucuuacuccugaccauagggcugagccugguggcaagcguagaacuaccuaauagucuugaagaacuuggcgacggacuugcaauggguauuaugaugcuaaaacuuuugacagaauuucagccacaccaguuguggaccacacucuuaucacuuaccuuugugaaaaccacacugagucuagacuacgccuggaagacaacagcgaugguacugaguauagucucgcuauuuccccuuugccuuuccaccacaucacagaaaacuacuuggcuucccguauuguuagguucauuuggcuguaagccauugaccauguuucuaauuacugagaauaaaauuuggggaagaaaaaguuggccuuugaaugaagguauuauggcaaucgguauagucagcauacuccuaucuucacuguuaaagaacgacgugccacuugcuggaccauuaaucgcaggaggaaugcuuaucgcgugcuauguaaucucaggcagcagugcugauuuaucacucgaaaaggcagcagaaguaucaugggaacaagaagcggaacauaguggugcaucgcauaacauacuuguggagguccaggacgauggaaccaugaaaauuaaggaugaggaacgugacgauacacuaaccauauugcugaaagcaacauuacucgcagugucagggguguacccuaugucgauuccagcaacccuuuucgugugguauuuuuggcagaagaagaaacaaagaucgggcguauuaugggauacaccgagucccccagaagucgaaagagcuguucuugaugacgguauuuacagaauauugcaacgcggacuuuuagggagaucucagguuggagugggaguuuuucaggacggagucuuucacacaauguggcauguuacuagaggcgcgguacuaauguaucaggguaaaagacucgaacccucuugggcaagugucaagaaagaucucauaucauacggaggaggcuggagauuucaagguagcuggaauaccggugaggagguacaaguaauagcaguggagcccgguaagaaucccaaaaacguucaaacuacucccggaacguucaagaccccagaaggagaaguaggcgccauugcauuagacuucaaaccggguacuucaggcucuccaauaguaaaccgggagggcaaaauaguaggacuuuaugguaauggugucguuacuacgagcggaaccuaugucucugccaucgcacaagcaaaggccucgcaagaagggccgcuaccggaaauagaagacgaaguauuuaaaaagcguaauuuaacuauuauggauuuacaccccggauccggaaaaacucgucgauaucuaccggcgaucgucagagaggcuauuaaacgaaaacuaagaacauuaauuuuggcacccacgcgagucgucgcaagcgaaauggcugaagcucuuaaaggaaugccaauuagauaccagacuacggccgucaagucagaacauacaggcagggaaauuguggaucugaugugucaugccaccuuuaccaugaggcucuuaagcccagucagaguucccaauuacaacaugauuauuauggaugaagcccacuucaccgauccagcuucaaucgcugcaagaggauacauuucaacacgcgucggaaugggggaagcugcggcuauauuuaugacggcaacacccccuggaucuguggaggcauucccacaaucaaacgcaguaauacaagaugaagaaagagauauaccagagagaucuuggaacucagguuaugacuggauaacagauuuuccagguaaaacagucugguuugugcccagcauuaaaagcgguaaugauaucgccaauugccugaggaaaaauggaaaaagagugauccaacuaagcagaaaaacauucgauacugaauaccaaaagaccaaaaauaaugacugggauuauguaguuacuacagauauuucagaaaugggagcgaauuuuagagcggaucgagucauagacccacgaagauguuugaagccagucauccuaaaggaugguccagaacgcgugauccucgcuggaccuaugccaguaaccguagcaucugccgcucaaagacgaggucgaaucggacgcaaucagaacaaggaaggagaucaguauguuuauaugggacaaccacuuaauaaugacgaagaccaugcacauuggacagaagcaaaaauguuauuggacaacauaaauaccccugaaggaauaauacccgcacuauucgagccagagagagagaaaagugcagcaauugauggagaauacagguuacgaggcgaagcacguaaaacauuuguugaacuuaugcggcguggcgaucuacccguaugguuaagcuauaaagucgccucagaagguuuucaauacucugaccguagaugguguuuugauggagagagaaauaaucaaguucuggaagagaauauggacguagaaauauggacaaaagaaggagaaaggaaaaaguuaagaccgcgguggcucgaugcaagaacguacucagacccacucgcgcuucgagaauuuaaagaauuugcugcaggccgaaggucaguuucaggcgaucuaauacuagagauuggaaaauuaccacaacaucucaccuuacgagcacaaaacgcacucgauaaucuaguaaugcuucacaauagugaacaaggaggaaaggcauauagacacgcaauggaagaacugccagacaccauagagacacuaaugcuacuagcgcugauagccguuuuaacuggugguguuacgcuauucuuuuugagugguaaaggucuaggcaagacaaguauuggucuauuaugcguaacggcuuccucugcauuguuguggauggcaaguguugaaccacauuggauagcagcauccauuauauuggaguucuuccugaugguguuacucauuccggaaccggauagacaaaggacgccacaggauaaucaacucgcuuacgucguaauagguuuacuguuuaugauccugacuguugcggcgaacgaaaugggacuucuagaaacuacuaagaaagaucuaggaauugguuauguagcggcugaaaaccaccaacaugcaacgauguuagauguggaucuaagacccgcuucggcauggacacuuuaugcaguagcuacaacgguuauuacaccaaugaugaggcauacaaucgaaaauacaacagcuaacaucuccuugacggcaaucgcaaaucaagcagcgauccuaaugggcuuagauaaaggguggcccauuaguaaaauggacauaggugucccguuauuagcacuagguuguuauucucaagugaacccucuuacgcuuacagcggcgguccuaauguuaguagcucauuacgcaaucauagguccggguuugcaggcaaaagcaacacgugaagcccaaaagaggacugcugcaggaauaaugaagaacccgacggucgacgggauaguggcuauagaccucgacccuguagucuaugacgccaaauuugaaaagcagcugggacaaauaaugcuccuaauucuauguaccucgcaaaucuuacugaugagaacgaccugggcauugugugaaucuauaacauuagcgacagggccauugacuacacuuugggaagguucuccggguaaguucuggaauacaacaauagcgguaaguauggcaaauauuuuucguggaucauauuuggcuggagcugguuuggcuuuuucacucaugaaaucucuggguggugguaggcguggaacgggcgcucaaggugaaacgcucggcgaaaaauggaaaagacaguuaaaucagcuauccaaaagugaguuuaauacauauaaaaggucagguaucauggaagucgaucguagcgaggcaaaagaagggcuaaaaaggggugaaacuacuaaacaugcugucucgcguggaacagcaaaacuaaggugguuugucgaaagaaacuuaguaaaaccagaaggaaagguaaucgacuuaggaugugggagaggcggcuggaguuacuacugugcuggacuaaagaaaguuaccgaaguuaagggguauacaaaaggagggccaggccaugaggaaccuaucccuauggcaaccuacggauggaaucuggucaaguuacacucagggaaagauguauuuuucaugccuccagaaaaaugugauacacugcugugugauauuggugaaucuagcccaaauccgacaauagaagaaggacgaacacuaagagucuuaaaaaugguggaaccgugguuaaaaggaaaucaauuuuguauaaaaauucuaaauccuuauaugccuucuguaguugaaaccuuggaacaaaugcaacguaaacaugggggcaugcuugugcgcaacccacuuucaagaaauucuacacacgaaauguauuggguuucaugcggaacagggaacauagucagcgcuguuaauaugacaucgagaauguuacuuaaccgauuuacaauggcucaucgaaaaccaaccuacgaaagggauguggauuuaggagcagguacgcggcacguggccguugaaccagaaguugcaaaucuugacauaauagggcaacggauugaaaacauuaaaaacgagcacaagaguacauggcacuaugaugaagacaacccuuauaagacaugggcauaucacgguaguuacgaggugaaaccgucgggaucggcaucaagcaugguuaacggaguugucagacuauuaacuaagccaugggauguaauuccaaugguaacacagauagcaaugacggauaccacacccuucggccaacagagagucuucaaggaaaagguugauacaaggaccccgagggcgaaaagggggacaacgcagauaauggagguuacagccaaguggcuuugggguuuucugucuagaaauaagaaacccagaauauguacucgugaagaauuuacacgaaaaguuagaaguaacgccgcgauuggggcuguguuuguagacgaaaaucaauggaacagugcaaaagaagcuguagaagacgaacguuucugggaucuuguccauagagaacgcgaauuacauaagcaagggaagugugcuacaugcguuuauaacaugaugggcaaacgugagaagaaauuaggggaauuuggaaaagcuaaaggcagcagagcaauaugguauauguggcuuggugcgcgcuuccuggaguucgaggcuuuagguuucaugaaugaagaucacugguuuucccgcgaaaauucuuuaagugggguugaaggugaaggucuccauaaauuaggcuacauuuuaagagauauuucaaaaauuccugggggcaauauguacgcugaugacacagcuggaugggauacacgaaucacggaagaugaucuacagaacgaggcuaaaauaacugauauaauggaaccugagcaugcauuguuagcgacaaguauauucaaacugacuuaucaaaacaaggucguaagagugcaaagaccugccaaaaacggcacaguuauggauguaauuaguaggcgagaucagcgcgggaguggacaaguuggaacguacggacuaaauaccuucaccaacauggaaguccaguuaaucaggcagauggaaucagaaggaauuuuucuuccaagcgaauuagaaaccccaaaccuggcggaaaggguauuagacuggcuaaagaaacauggagcugaaagauuaaaacgcauggccauuucaggcgacgacuguguagugaaaccuaucgaugauagauucgcaacggcacuuaccgcacugaacgauauggguaaaguuagaaaagacauuccacaaugggaacccucaaaagguuggaaugauuggcaacaggucccauuuugcucacaccauuuucaccaacuaauuaugaaagauggaagagaaauaguuguaccgugucgcaaucaagacgaguuaguuggccgugcaagaguaucgcaaggcgcaggcuggagccuacgggaaaccgcuugccuugggaaauccuacgcacaaauguggcagcuuauguauuuccacagacgagacuugagacuagccgcgaacgcaauuuguagugcugugccugucgauuggguaccaacaucccgaacaacauggucuauacacgcccaucaccaauggaugacaacagaagacauguuaucaguauggaauagagucuggauagaagaaaauccauggauggaggauaagacccacguuucaucaugggaggagguaccuuaccuagguaaaagagaagaucaaugguguggaaguuugauaggucuuacagcgagagcaacuugggcaacaaauauucaaguagcgauaaaucaaguaagaagacuaauagguaaugagaacuauuuagauuacaugacgucaaugaaaagguuuaagaaugaaucagacccagaaggcgcucuaugguga

SEQ ID NO: 21413 - RNA, 9879 nt, Artificial Sequence
  derived and/or modified CDS sequence (opt6) from DENV-1__JN819411__SS-prME
aguguaacuauguuguuaaugcucuugccuacggcacuugcauuucaucuuacgacacgaggaggugaaccucauaugauagucaguaaacaagaaagagguaaaucacuacucuucaaaacaucugcgggaguuaauauguguaccuuaaucgcaauggaucuuggagaacuaugugaagauacuaugacauauaaaugcccgagaauaacagaagcugaaccagacgauguagauuguuggugcaaugcaacugacacauggguaaccuauggcacgugcucacaaaccggcgaacacagaagagauaaacgaucuguagcucuugcuccgcauguagguuuaggauuagaaacuagaacagaaacauggaugucuagugaaggugcauggaaacaaauucaacgaguagagacgugggcucuuagacacccaggauucacaguaaucgcauuguuccuugcucaugcaauagguacuucuauaacgcagaaagguauaaucuuuauuuuauuaauguuaguuacaccgucuauggcaaugagaugcguaggaauaggcaaccgagauuuuguagaaggcuuauccggggcaacguggguagacguagucuuagagcauggaagcugugucacuacaauggcuaaaaauaaaccaacucuagauauugagcuuuuaaaaacggaaguaacaaauccugcaguauuaaggaaauuauguauugaagcgaaaauuuccaacacuacuaccgacucaagaugcccgacucagggagaagcaacauuaguagaagaacaagaugcgaauuuuguaugucgcagaacuuuuguagaucgcgguuggggaaaugguuguggguuguuuggcaaaggcaguuuauuaacgugcgcaaaauucaaauguguuacuaaauuagagggaaaaauuguacaauaugaaaauuuaaaauauagugucauuguaacaguccacaccggagaccaacaucaaguaggaaaugaaacaacugaacaugguacaauagcaacaauaacaccucaagcaccgaccagcgagauucaacucacggauuauggugcucuuacgcucgacuguucacccaggacgggccuugauuucaaugagaugguacuacucacuaugaaagaaaaaucguggcuuguacauaaacaaugguuuuuggacuuaccuuugccuuggacgaguggagccagcacaagucaggagaccuggaauagacaagauuugcuuguaacuuuuaaaacagcacaugccaagaaacaagagguuguaguucuaggcucacaagagggggcgaugcacacagcuuuaacgggugcuaccgaaauucaaacgaguggaacuaccaccaucuuugcuggacacuuaaaauguagauugaaaauggacaaauuaacacuaaaggggaugucguaugucaugugcacaggaaguuucaaauuggagaaggaaguugcggaaacccagcauggaacaguucuaguccaagugaaauaugagggcaccgaugcaccgugcaaaauuccauucagcacgcaagaugaaaaaggaguaacacaaaauggaagacugauaacagccaacccaauugugacugacaaagaaaaacccgucaacauugaaacagagccuccauuuggggaaucauauaucguaguaggagcuggagagaaagcucugaaauuaucgugguuuaagaaaggcaguuccauagggaaaauguucgaggcuacggcacgcggugcacgucggauggcaauccugggugacacugcaugggauuuugggucaauugggggugucuuuaccaguguugggaaauuaguccaucaaguauucggaacugccuauggaguauuauuuucggguguuucauggacaaugaaaauaggcauuggaauacugcuuacauggcugggacuaaacaguagaucaacaagucugaguaugacgugcauagcuguagggaugguaacauuauauuugggaguaaugguacaggccgauucagguuguguaaucaacuggaaagguagagaacucaaaugugguucagguaucuuuguaacaaacgagguacauacauggacggaacaauauaaguuucaagcagauagcccuaaacgcuuaagcgcagcuauugguaaggcaugggaagaaggaguaugcggcauacgauccgccacuagauuggaaaacauuauguggaagcaaauuagcaaugaacugaaucacauuuuguuagagaaugacaugaaauuuacuguaguaguaggagacgcuaacggaauacuagcacaaggcaagaaaaugauucggccacaaccuauggaacacaaauacaguuggaaaucguggggaaaagcgaaaaucaucggcgcagauauacagaacacuacuuucauaauagauggccccgauacgccugaauguccagacggucaaagagcuuggaauauuugggaaguagaggacuacgguuuuggcauuuuuaccacaaauaucuggcugaaauuacgggacuccuauacacaaaugugugaucacagguuaaugucugcagcuauuaaagauucuaaagccguucacgcugauauggguuacuggauugagucggagaaaaaugaaaccuggaaacuagcuagagcgucguuuauugagguuaagacauguacuuggccgaagagucauacacuuuggaguaaugguguucucgaaagcgaaaugauuauaccaaaaauuuaugggggaccaauuagucaacauaauuauaggccuggcuauuucacacagaccgcgggacccuggcaccuagggaaguuggaguuagauuuugaucugugcgagggaacaacagugguagucgacgagcauugugguaauagaggcccgagucuaagaacaacuaccgucacagguaagauuauacaugaauggugcugcaggucguguaccuuaccuccauugcgauuuaggggcgaggacgguugcugguacggaauggaaauucgaccugucaaagagaaggaagaaaaucuuguaaggaguaugguaucugcaggaucuggagaaguagacuccuuuucauuggguauauugugcguaucuaucaugauagaagaaguuaugcguucacgauggagcaggaaaauguuaaugacagguacacuagccguauucuuauuacuuauaguaggucagcuuaccuggaacgaucuaauaagacuauguauaaugguaggugccaaugcgagugaccgaaugggcauggguacaacauaucuagcucucauggcgaccuuuaaaaugagaccaauguuugcaguaggauugcuguuccgacgacugaccaguagggaaguauuacuccucacuauugggcucagucuaguugccucaguagaacucccaaacagucucgaggaguuaggagauggacuagcaaugggaauaaugaugcugaaauugcuaacugaauuucaaccacaucaauuguggacaacacuacugagucuaacauuuguaaagaccacacuaagccucgauuaugcguggaagacaacagcuauggugcucaguauugugagccuauuuccucuaugucuaaguacuacaagccaaaagacaacauggcuaccaguucuacucggcagcuuugguuguaaaccacuuacuauguuuuuaauaaccgaaaacaagauauggggacgaaaauccuggccucuaaacgaaggaauaauggcaauugguauuguaucgauacuacuuagcaguuuacuaaagaacgaugucccucuugcuggcccacugauagcuggaggaaugcuuaucgcaugcuacgugaucucugguaguuccgcugaucuaaguuuagagaaggccgcagaagucagcugggaacaagaagcagaacauucuggugcaagccauaauauauugguagaagugcaagacgacgggaccaugaaaauuaaagaugaagaacgcgaugauaccuuaacaauauuacuaaaagcaacauugcucgcagugucaggaguguauccaaugucuauuccugccacgcuuuuuguaugguauuuuuggcagaagaagaaacaacgaagugguguacuuugggacacaccgucgccaccggagguagaaagagcaguucuggaugacgguaucuauagaauacuacaaaggggauuacuuggucgaucacaggugggaguagguguauuucaagauggagucuuucauacaauguggcauguuacaagaggagcgguacucauguaucaagggaaaagguuagagccaaguugggcuucagucaagaaagaccuuauaucguacggagguggcuggcgguuucaagguagcuggaauacaggagaagaaguacaggucauagcaguagaaccuggcaaaaaucccaagaauguacaaacuaccccugggacguuuaaaacucccgaaggcgaggucggagccauugcgcuugauuuuaaaccagguacaaguggaucgccaaucguaaacagagaaggaaaaauaguugguuuauaugguaauggcguuguaacgacuuccgguacauaugucuccgcgauagcgcaagcaaaagcaucacaagaaggcccuuuacccgagaucgaggacgaagucuuuaagaaaaggaaccugacuauuauggaccuucacccaggcucaggcaaaacacgacguuaccuaccggcaaucguacgagaggcaauaaaacgcaaguuaagaacgcucaucuuagcucccacuagaguggucgcuagcgaaauggcagaagcguuaaaaggcaugccaauuagauaucaaacaacagcugugaaaucggaacacacugguagagaaaucguggaucuaaugugucaugccaccuucaccaugcggcuccuuucaccggugaggguaccaaacuauaauaugauaauaauggaugaggcucacuucaccgauccggcaucgauugcggcgcgaggauauaucaguacgcggguugggaugggcgaggcagccgcgauuuucaugacugcaacgccgcccggaucgguagaagcguuuccacaaucgaacgcaguuauacaagaugaagagagagacauaccugagcgcucuuggaacucgggguaugacuggauuacugacuuuccggggaaaacagucugguucguucccaguaucaaaagugguaaugacauagcaaauugucuaaggaaaaacggcaaaagaguaauacaacuaaguagaaaaacauucgacacugaauaucagaaaacuaagaacaaugauugggacuauguuguaacaacagauauuagugaaaugggcgcuaauuuuagagcugaccgagucaucgacccaaggcggugccugaaaccagugauccuaaaagauggaccggaacgugucauucuugcaggcccgaugccgguaacagucgcgucagcugcccaaaggagaggcagaauaggaagaaaccaaaacaaagagggugaucaauauguauacauggggcaaccgcuaaauaaugaugaagaucaugcacauuggacggaagcaaaaauguuauuagacaauaucaauacuccagaagggauaaucccggcuuuguucgaacccgaacgugaaaaaucagcggcaauugacggugaauauagguuacguggagaggcaagaaagacauuuguagaguuaaugagaagaggggaccuuccgguauggcucaguuauaaagucgcguccgaagguuuucaauauagcgaucgaagaugguguuucgauggagaaagaaauaaucaaguacuagaggagaauauggauguugaaauauggacaaaagaaggcgaaagaaagaaauuaagaccgagauggcucgacgcacguaccuacucugauccauuagcauuacgcgaguucaaagaguucgccgcaggaaggagauccgucuccggcgaucuaaucuuggaaauugggaaauuaccucagcaucugacucuucgagcucagaacgcuuuggauaaucuugucauguugcacaacucugaacagggcgggaaagcauauagacacgccauggaagaauuaccugauacgauugaaacauugaugcuacuggcacuuauagcaguuuuaacaggcgguguaacucuguucuuucucucaggaaaaggacuagggaaaaccuccauaggacuauuaugcguaaccgccucuucagcucuauuauggauggcaucaguugaaccgcacuggauagcagcuagcauaaucuuagaauuuuuccugauggugcuacuaauuccagaacccgacagacaaagaacuccucaggauaaucagcucgcguauguaguuaucgguuuacuauuuaugauccucacaguagcggccaaugaaaugggguuauuagaaaccaccaaaaaggaccuagggauaggauauguggccgcugaaaaucaucaacaugcaaccaugcuugauguagauuugagaccagcuuccgcauggacuuuauaugcaguugcaaccacgguaauaacuccuaugaugaggcauacuaucgaaaacacgacugcuaauauuagucuuaccgcaauugccaaucaagcugcuauacuaaugggacuugauaaaggauggccaaucuccaagauggauauaggagucccucuguuagcccucggauguuacagccaagugaacccacuaaccuugaccgcugccgucuugaugcuuguagcucauuacgcuauuauaggacccggucuacaagcaaaagccacacgagaagcucagaaaagaacugcggccggaaucaugaagaauccaacuguagaugguauuguagcaauagaccuugacccgguggucuacgacgcaaaguucgaaaaacaacuaggacagauaauguugcuaauuuuauguacaagccaaauucugcuaaugcguacaacaugggcauuaugcgaguccauaacgcuugcaacagggccauuaacuacccucugggaagguucaccgggcaaauuuuggaauaccacaauagcaguauccauggcgaauauuuuuagggguucauacuuagccggugcaggauuggccuucagcuuaaugaaaagucuaggaggaggacgacgggguacuggagcacaaggagaaaccuuaggggaaaaauggaaacgucaacucaaucaauuguccaagucagaauuuaauacauauaaaaggucaggaaucauggagguggacaggucagaagcaaaagagggacuuaaaagaggugaaacgacaaaacaugcuguaucgcgagguacggcaaaacuacgaugguucguagaacguaacuuagugaaacccgaggggaaaguaauugaucucggaugcggacggggcggauggaguuauuauugugccggcuugaagaaaguuacugaaguuaagggauauacuaagggcggacccggucaugaagaaccugugccgauggcuacuuacggguggaaccuuguuaaguugcauucaggaaaggacguuuucuuuaugccacccgaaaagugcgacacucuacucugcgacauaggugaaucaaguccuaaucccacaaucgaagaaggaagaacacuccguguauuaaagaugguugagccauggcucaaagggaaucaauuuugcauuaagauucuuaaucccuauaugccaaguguaguagaaaccuuggaacaaaugcaaagaaaacacggagggaugcuaguuaggaauccuuuauccagaaacagcacacacgaaauguauugggucaguugugguacaggaaauaucgugucagcagugaacaugacaucgcguaugcuucuaaaucgauucacaauggcacauagaaaacccacauacgaacgugaugucgaucuuggagcaggaacaagacacguagccguagagccagaaguugccaauuuggacaucaucggucagcgaauagagaacauaaagaacgagcauaaauuaacuuggcacuaugacgaggacaacccauauaagaccugggcuuaucaugguuccuacgaggugaaaccuaguggcagcgccagcucaaugguaaacggugucgucagauugcuaacaaaaccaugggauguaauaccaauggugacccaaauagcgaugacagauacaaccccauuuggacagcagagagucuuuaaagaaaagguggacacaagaaccccuagggcaaaacgcgguacaacgcaaauaauggaaguaacagcaaaauggcuguggggauuuuuaagucgaaacaagaaaccgagaaucuguacuagagaagaguucacacgaaaaguaaggucuaaugcagcuauuggagccguguuuguagacgaaaaucaauggaacagugcaaaggaagcugucgaggaugaaagauucugggaucucguacacagagaacgugaacuucacaagcaagguaaaugcgccacauguguuuauaacaugaugggcaaacgggagaaaaagcucggagaauuugggaaggcaaaagggagucgggcuauuugguauauguggcugggcgcuagguuucucgaguucgaagcauugggauuuaugaaugaagaucauugguuuagcagggaaaacagccuaaguggagucgaaggagaggguuuacauaaauugggcuauauacuuagagacauaucaaaaauaccagggggaaacauguaugcagaugauacagcaggcugggacacacgcauuacugaagaugauuuacaaaaugaggcaaaaauaaccgauauuauggaaccugaacacgcacuauuagcaacuucgauuuucaaacuuacauaccaaaauaagguggugcgaguacaaaggcccgccaagaauggcacgguuauggauguaauaaguagaagagaccagagaggaucaggacaagugggaaccuaugguuugaauacauuuacaaauauggaaguccaacuaauccgacaaauggaaagugaagguauauuuucaccaucggaauuagaaacaccaaaucuugcagagcguguacuagauuggcuagaaaaacauggggcugaaaggcuuaaacggauggcuaucucaggugaugacuguguuguaaagccaauugacgacagauuugcaacggcacucacggcacuaaaugauaugggaaaagugcgaaaagauauuccacaaugggagccaucaaaaggguggaacgauuggcagcagguaccauuuuguucacaucauuuucaucaauuaauaaugaaagacgggcgagaaauaguuguaccguguagaaaucaagacgaacuuguagguagagcucgcgugucccaaggggcuggauggucucuuagggagaccgcauguuuaggaaaaaguuacgcacagauguggcaauugauguauuuucacagacgagaccuacgacuggcugcgaacgcaauaugcagcgcagucccaguagauuggguucccacgucacgaacgacauggucgauucacgcgcaucaucaauggaugacgaccgaagauaugcucucgguguggaaucggguguggauugaagaaaauccguggauggaagacaaaacacauguauccucaugggaggaaguaccauaucucgggaaacgagaagaucaauggugcgguucauuaauaggguugacagcaagggcuacaugggcuacgaauauacaaguagcuaucaaccagguuaggcgacuaauaggaaaugagaauuaucuagacuacaugacgagcaugaaacgauucaagaaugaaucggauccagaaggagcauugugguaa

SEQ ID NO: 21414 - RNA, 9879 nt, Artificial Sequence
  derived and/or modified CDS sequence (opt6) from DENV-1__FJ639812__SS-prME
agcguuacuaugcuguuaauguuguuaccuaccgcauuagcuuuccacuuaacaaccagagguggagaaccgcacaugauuguguccaaacaagaaagggggaaaucauuacuguucaaaacaagugcuggagucaauauguguacuuuaauagcaauggauuuaggugaacugugugaagauacuaugacauauaaaugccccaggauaaccgaagcagaaccugacgauguagauuguugguguaacgcaacugacacauggguuacauacggaacaugcagucaaaccggugaacaccguagagacaaacggucggucgcucuagcaccucaugucggauuggggcucgaaacaagaacagaaacuuggaugucgagugaaggagcauggaaacaaauucaaaggguagaaacgugggcacuaagacacccgggauucacagugauagcacuauucuuagcacaugccauagguaccagcauaacccaaaaaggaauaauuuucauccuuuuaaugcuuguaacuccuaguauggcaaugaggugcgugggaauaggcaaccgggauuucguagaaggccuauccggggcgacuuggguagacgugguauuagaacauggaaguugcguuacgacuauggcgaaaaacaaaccaacacuggauauugaauuauuaaaaacagaaguuacaaacccagcaguacucagaaaauuaugcauagaagcuaaaauaucuaacacgaccacagauucaagauguccaacacaaggagaagcuacgcuaguagaagaacaggaugcuaacuuuguuuguaggcgaacauuuguugauagggguugggggaacggaugcggcuuauuuggaaaaggcagucuacuuacaugcgcaaaauuuaaaugcguaacuaaacuggaaggcaaaauaguucaauaugagaauuuaaaauauucaguuauugugacuguccacaccggcgaucaacaucaaguagguaacgaaacgacugagcauggaacaaucgcuacgaucacaccacaagcucccacgucagaaauacaacuuacagauuauggugcucucacauuggauuguaguccacgcacuggucuagacuuuaacgaaaugaugcugcuaacaaugaaagaaaaauccuggcuaguucacaagcagugguuccuugacuuaccacugcccuggacaucuggagcuucaacgagccaggaaacuuggaauaggcaagauuuacuuguaacuuucaaaacagcgcacgccaagaaacaagaaguuguuguauugggaagucaagaaggcgcaaugcacacugcucuuacaggagcuaccgaaauucagacuagcgguacaacaacuaucuucgcaggccaucuaaaaugccgauugaaaauggacaaacucacucugaaagggaugucuuauguaaugugcaccgguagcuuuaaguuagaaaaggaaguggccgaaacccagcauggaacgguacuuguucaaguaaaauaugaaggaacggacgcgccauguaaaaucccguucagcacucaagacgagaaaggagucacucagaacggacgauugauuacugccaacccuauaguaacugauaaagagaaaccagugaauauagaaaccgaaccacccuuuggugaaaguuauauaguaguuggagccggugaaaaagcucucaaauugaguugguuuaaaaagggcuccucaauaggaaagauguuugaagcaaccgcgagaggggcgagaagaauggcuauauuaggugauacugcaugggacuucggaagcaucggagggguuuuuacaagugucggaaaacugguucaccaaguguuugggaccgcauacggaguacucuucuccggaguuucuuggacuaugaaaauaggaauugguauuuuacuaacuuggcuaggccuuaacagccguucuacgagucuaucaaugacaugcauagcggucggaaugguaacauuauaucuugguguaauggugcaggcagauucaggauguguaauaaacuggaaaggacgagaacuaaaaugugguaguggaauuuucguaacaaaugagguacauacuuggacggagcaauauaaauuccaagcagauucaccaaaaagacuaucggcggcaauagggaaggcuugggaagagggcgucugcgggauacgaagcgcuacaagguuagaaaacauaauguggaaacaaauaagcaacgaacuaaaccauauacuauuagaaaacgauaugaaauucacggucguaguaggcgacgcgaacggaauuuuggcucaaggcaagaaaaugauaaggccccaacccauggaacauaaauauucguggaaauccuggggaaaagcuaagauuauaggugcagacauacaaaauaccacuuucauuaucgaugguccggauacaccggaguguccagauggacagcgcgcguggaauauuugggaaguggaagauuacgguuuuggaaucuucacuacaaauauauggcuuaagcuccgagauucuuauacgcaaaugugugaucacagacucaugucagcagcaauuaaagacuccaaagcgguacaugccgauauggguuauuggaucgaaagugagaaaaaugaaacuuggaaacuugcgcgggccucguucauagaaguaaaaacgugcacauggccaaaaagucauacacucugguccaauggugucuuagaauccgaaaugaucauucccaaaauuuaugguggaccuaucucgcaacauaauuaccgcccgggauauuuuacacaaacagcugggcccuggcauuugggcaaauuggaacuugauuuugacuuaugcgaagggacaacaguaguaguagacgagcacugugggaauagggguccaucacuaagaacuaccacaguaacgggaaagauuauacacgaaugguguugcagaucgugcacauuaccacccuugcgguuuaggggcgaggauggauguugguauggaauggaaauaaggccagugaaagaaaaagaagaaaaucuaguccgaaguaugguuucagccggaagcggagaaguggauucauuuagucugggaaucuuguguguaucaauuaugauagaggaaguaaugagaucacgguggucacgcaaaaugcuuaugacaggaacucuggcaguuuuccuacuucuaaucauggggcaacuuacguggaaugaucuaaucagguuauguauuaugguaggagcgaaugcaagcgaucguauggggaugggaacaacguacuuggcauuaauggcuacauuuaaaaugagaccaauguucgcuguuggccuguuauuuagaaggcuaacaucuagagaaguacuacuucuaacaauaggacucagcuuagucgccucuguugaauuacccaacuccuuagaagaacuuggcgauggacuagcaaugggcauaaugauguuaaaauuguuaacugaguuccaaccacaucaauuauggacgacguuguuauccuuaacuuucguuaaaaccacacuuagucuagauuaugcuuggaagacgacugccaugguauuaucaauaguuucauuauucccuuuaugcuugaguacgacuagccagaagacuacuugguugccugugcugcuuggguccuucggauguaagccauuaacgauguuuuugauuacggaaaacaaaauauggggaagaaagucuuggccccugaaugaaggcauaauggcaauaggaauagucucaauucugcuaaguucauuauuaaagaacgauguaccuuuagccggaccacuaauagcgggagguaugcuuauagccuguuacguuauaucuggaucaucggcugacuuacuuuuagaaaaagcagcugaaguuagcugggaacaggaggcagaacauaguggagcuucccacaauauucugguugaagugcaggaugauggaacaaugaaaauaaaagaugaggaaagagaugauacccuaacuauauuacuaaaagcaacacugcuagcaguaucaggaguguauccaaugucaauaccugccacguuguuugugugguauuuuuggcagaagaagaaacaaagaucagggguuuuaugggauacaccaagucccccggaaguagaaagggcugucuuagacgauggcauuuaccgaauccuacaacgcggccuauuagguaggagccaagugggagugggaguuuuucaagacgguguguuucacacaauguggcacguaacgagaggcgcuguacucauguaccaagguaaaagacuugagccaagcugggcuagcgugaaaaaggaucuuauauccuacgguggaggcuggagguuucagggcaguuggaauacaggagaggaaguacaagugaucgcaguugagccaggcaaaaacccuaagaauguacaaacuacacccgggacauucaaaacaccagaaggagaaguuggagcuauagcccuggauuuuaaaccagguacaagcggcagcccaauaguaaaccgugaagguaagauuguuggacuguacgguaauggaguuguuaccacauccggaacuuacguaagcgcuaucgcacaagcuaaagccucccaggaggggccauugccagaaauagaagaugaaguuuuuaagaaaaggaaucuaacgauuauggacuuacauccagguucaggaaaaacaagaagauaucugcccgcaauaguucgugaagccauuaagcgaaaacuacguacacucauccucgcaccuaccagaguagucgcgucagaaauggcagaggccuugaaagguaugccaauacguuaccaaacuacggcuguaaaaucagaacauacuggaagggaaaucgucgaucuuaugugucacgccacuuuuacgaugagauuacugaguccugucagagucccuaauuauaacaugauaaucauggacgaagcucacuucacugauccagcgucaauugcagcaagggguuacauaucgacuaggguagguaugggggaagcugcggccauuuuuaugacagcuacuccaccaggaucuguugaagcauuuccacaaagcaacgcugucauucaggaugaagaaagggauauaccugagcgaagcuggaacuccggauaugauuggauaacggauuucccggguaaaacaguaugguuugucccauccauaaaaaguggcaacgacauagccaacugucuaaggaagaaugguaagcgagugauacaauuaaguaggaagacauucgacacagaauaccagaaaacgaaaaauaacgauugggauuauguaguuaccacugauauaucagaaaugggggcuaacuuuagggcggauagaguuauugauccacgccggugucuuaagccuguuauucugaaagauggaccagaaaggguaauacuagccgggccuaugccugugacaguugcuagugcugcacaaagaagagggagaauaggacguaaccaaaauaaagaaggagaucaguaugucuauauggggcagcccuuaaacaacgaugaagaccacgcacauuggacagaagcaaaaauguuacuugacaacaucaauacucccgaaggaaucauuccagcucucuucgagccagaaagggagaaaucggcagccaucgacggugaauaccguuugagaggggaagcacgaaaaacguuuguugaguugaugaggagaggagauuuaccgguaugguuaucuuacaaaguugcgagugaagguuuccaauacuccgaucguagauggugcuuugacggagaacggaauaaucaaguucuagaagaaaauauggacguggagauauggacaaaagagggagaaagaaagaaguuaagaccacgcuggcucgacgcacgaacauauucagacccacucgcccugcgagaauuuaaagaguuugcggcagggagacguucagugucaggagauuuaauacucgagauaggaaaacugccucaacaucugacguuaagagcucaaaaugccuuagauaauuugguaaugcugcacaacucagagcaaggagggaaggcuuaccgacacgcgauggaagaacuuccagacacaauagaaacccuaaugcuauuggcucuuauugcagucuuaacuggcggugucacucuauuuuucuuaucgggaaaggguuuagguaagaccucaauaggucuacuaugcgugacugcuagcucagcguuacuauggauggcaucaguagagccgcauuggauugcugcaagcauaaucuuagaguucuuucucaugguuuuguuaauaccugaaccagauagacaaagaacgccucaagauaaucaacucgcguaugucgucauuggacuacuuuuuaugauccuuacaguugcugcuaacgaaauggguuugcucgagaccaccaagaaagauuuaggaauaggauauguugcagcagaaaaccaucaacacgcaacgaugcucgauguugauuuaaggccugcuagugccuggacauuguaugccguugcaacaacuguaaucacuccaaugaugcgacauaccauugagaacacaacagcaaauaucucccuaacagccauagcuaaccaagcagcuauauuaaugggacuagacaaaggauggccaauaucaaagauggacauuggaguuccauuauuagcacuuggauguuauucucaaguaaacccacuuacgcuaaccgcugcugugcuuaugcuuguagcacacuaugccauaaucggaccuggucuacaggcgaaagcaacucgagaagcucaaaagaggacagcggcgggaauaaugaaaaauccgaccguggaugguauaguagccauugacuuagaucccguggucuacgaugcaaaauucgagaagcagcuaggacaaauuaugcugcucauccuuugcaccagucaaauuuuauuaaugaggacaaccugggcauuaugugaaagcauaacgcucgcaacaggucccuuaacaacgcuuugggaaggaaguccaggaaaauucuggaacacgacgauagcugugucaauggcgaauauauuucgaggcagcuaucuugccggagcuggcuuagcauucucgcucaugaaaucauuaggaggaggacgaagggggacgggagcacaaggcgaaacacugggugaaaaauggaaacgccagcuuaaucaauugaguaaaucugaauuuaacacguauaagagaucagggauuauggaaguagauagaucggaagcgaaggaagguuugaaaaggggcgagaccacaaaacaugcuguuagucgaggaaccgcaaaauugagaugguuuguugagcgaaauuuggugaaaccggaagggaagguaauagacuuagguuguggucgugggggcuggucauauuauugugcaggucuaaagaaagucacagaaguuaaaggauacacaaaaggcggaccaggacaugaggagccaauaccaauggcaacauauggguggaacuuaguuaagcugcauagugguaaagauguauuuuucaugccuccagaaaaaugugauacccuccuaugcgauauaggagagaguagccccaauccaacaauugaagaaggaagaacccuaagggugcugaagaugguugagcccuggcuaaaaggcaaucaauucugcauuaagauauuaaauccguacaugccguccguaguagaaacucuugaacaaaugcaacgaaaacacggugggauguuagugcgaaauccuuuaucuagaaacucaacucaugaaauguauugggucucuuguggaacaggaaacauagucagugcaguaaacaugacuucgagaaugcuauuaaacagguucacgauggcacaucguaaaccaaccuacgaaagagacguggaccuuggggcuggaacuagacacguggcaguugagccagaggucgcuaaucuugacaucauaggacaaaggauagagaauauuaaaaaugaacauaaaaguacauggcauuaugaugaagauaauccauauaaaacuugggcauaucacgguaguuacgaggucaaaccuaguggcagcgcaagcucaaugguaaauggaguaguacgauuacuuacaaagccuugggaugugauuccuauggucacacaaauagcgaugacugauacaaccccguucggucagcagcgaguuuuuaaagagaagguggauacuagaaccccaagagccaagagaggaacuacacaaauaauggaaguuacggcaaaauggcucugggguuuccuaucgcgcaauaagaagccgcggaucuguacuagggaagaguucacaagaaaaguaagaucuaaugcagccauuggugccguauuuguagaugagaaucaauggaauagugcgaaagaagccguggaagacgaacgauucugggauuuaguccaccgagagcgagaacuucacaagcaagggaaaugcgccacauguguuuacaauaugaugggcaaaagagagaagaaacuaggagaauuugguaaagccaagggcucaagggccauaugguauaugugguugggcgcaagauuuuuagaguucgaggcucuuggauuuaugaacgaagaccauugguucagccgggaaaauagucugagugguguagaaggcgaaggcuugcauaaauuaggauacauacuaagagauauaagcaagauaccaggaggaaauauguacgcggaugacacagcgggaugggauacuagaauaacagaagacgauuuacaaaacgaagcgaaaauaaccgacauaauggaaccugagcaugcucuauuagcaacaucuauauuuaagcucacuuaucagaauaagguaguuagaguacagagaccggcgaagaaugguacagucauggacguaauaagucgcagggaccagcgagguagcggccaaguuggcacauacggccuuaauacguuuacaaacauggaggugcagcuuauacgacaaauggaauccgaagguauauuuuugccgucagaacuggaaaccccaaacuuggcagaacggguuuuagauuggcuggaaaaacauggagccgaacgacucaagcgaauggcuauaucaggcgacgauugugugguaaaacccauagaugacagauuugccacagcguuaaccgcauuaaaugacaugggaaagguacgaaaagauauaccacagugggaacccucgaaaggguggaacgacuggcagcagguuccauuuuguucucaccacuuucaucaacucauaaugaaagauggcagagaaaucguagugccaugcagaaaccaagacgaauuagugggucgcgcacgaguuagucagggcgcgggguggaguuugagggaaaccgcuugucuaggaaaaucuuacgcccaaauguggcaacucauguauuuucauagaagagacuuacgucuagcagcuaaugcaauuugcucagcgguaccuguagauuggguaccuacaaguagaacaacauggagcauucaugcccaucaccaauggaugacuaccgaagauauguuaaguguuuggaaccguguauggauugaagaaaaccccuggauggaagauaaaacacauguuaguucgugggaagaagucccuuaucuagggaaacgagaagaccaauggugcgguuccuugauuggacuuacagcaagagcgacaugggccacaaauauccaaguagcaauaaaccaaguaagacgauugauugguaaugagaacuaccuagacuauaugacaaguaugaaacgauuuaagaacgaaagugauccagaaggcgcucugugguga

SEQ ID NO: 21415 - RNA, 9879 nt, Artificial Sequence
  derived and/or modified CDS sequence (opt6) from DENV-1__FJ639813__SS-prME
ucgguuacuaugcuucuuaugcuauuaccaacagcguuagcguuccacuuaaccacucgcggcggugaaccacacaugauagucaguaaacaagagagggguaaaucucuucuauuuaaaacaagcgcuggcguuaacaugugcacccuaaucgcaauggaccucggugaacuaugcgaagauacaaugacauacaaaugccccagaauuacagaagcagaaccugaugauguugauuguuggugcaaugcgacugacaccuggguuacauacggaaccugcucacaaaccggagaacaucgacgggacaaacguuccguggcacuugcgccacaugucgguuuggguuuggagacaagaaccgaaaccuggaugaguagugaaggcgccuggaaacaaauacaaagaguagaaacaugggcauuacgacacccuggauuuacgguaauagcauuauuuuuagcucacgcaaucgguacaucaauuacccaaaaagggauaauuuucauccuucuaaugcuagucacuccaucaauggcaaugagaugcguagguauagggaacagagacuuuguugaaggucuguccggagcuacauggguugacguaguacuagaacauggaaguugugugaccacaauggccaaaaauaaaccaacccuggauauagaauugcuaaaaacggaggucaugaacccggcagugcugcgcaaauuauguaucgaggcgaaaauaaguaauacuacuacagacaguagauguccaacgcaaggugaagcaacguuagucgaagaacaagaugcaaacuucgugugcaggcggacuuuugucgacagagguugggggaauggcuguggcuuguucggcaaaggcagccuauuaacaugcgcaaaauuuaaaugcguaacuaaacuagaaggcaaaauagugcaguaugaaaacuuaaaauacagcgucauuguuaccguccacacuggcgaucagcaucaagucgguaacgaaacgacggaacaugggacuauugccaccauuacgccacaggcgccaacauccgaaauacaauuaaccgacuacggugcauuaacguuagacuguucaccuagaacaggucuggauuuuaaugaaaugguuuugcugacaaugaaagagaaaaguugguugguacauaaacaaugguuucucgaccuaccauuaccauggacaucuggggcguccacuucccaagagacauggaaucgacaggaccucuuagugacauucaaaacugcgcaugccaagaaacaagaagucguaguguuaggcagucaagaaggagcaaugcacaccgcucucaccggagcuacggaaauacaaacuagcgguacgaccaccauauuugccggucacuuaaaaugucgacuaaaaauggacaaauuaacacuaaaaggaaugagcuacgucaugugcacaggauccuuuaaauuagaaaaagaaguagcagaaacucaacauggcacagugcuaguacaaguaaaauacgaaggaacggaugcuccauguaaaaucccauucucgacacaggaugagaaggggguaacucagaacgggagacuuaucaccgcaaauccaauaguaacggauaaagaaaaaccagucaacauagaaacugagccgccauuuggagaaucuuauauagucguaggggccggugaaaaagcacuuaaacuuaguugguucaagaaaggaagcucaauuggaaaaauguucgaggcaaccgccagaggggcuagacgcauggcuauauuaggggauacugcgugggacuucgguagcauaggaggaguauucacuagcguuggaaaacucguccaccaaguauuugguacggcguauggugucuuauuuucuggagucucuuggacuaugaaaaucggaaucggaauacuacucacuugguuaggcuugaauaguagaucaacauccuucagcaugacauguauagcggugggaaugguaaccuuauaccuuggaguaauggugcaggcagauagcggaugcgugauaaauuggaaaggucgagagcucaaaugcggaucagggauuuuuguaacuaaugaaguucauacauggaccgaacaguauaaguuucaggcugauucgccaaaacgguuauccgcugcaaucgggaaagcgugggaagagggggucugcggaauccgaucagccaccagacuggaaaauaucauguggaaacaaauaucuaacgaguuaaaucauaucuuacuggaaaaugacaugaaauuuacgguuguagugggagaugcaaauggaauacuggcacaagguaagaaaaugauuagaccacagccuauggagcauaaguacaguuggaaaucauggggaaaagccaaaauaauaggugcugauauccaaaauacuacauuuaucauagaugggccugauacucccgaguguccggauggacaaagagcauggaacauuugggaaguugaagauuauggcuucggcaucuuuacaaccaauauauggcuaaaauuaagagauucauauacccaaaugugugaucacagauugaugagcgcugcgaucaaggacucuaaagcuguacaugcagauaugggguacuggauagagagcgagaaaaaugaaacauggaaauuagcgcgggcuucuuucauagaagucaaaacauguacauggcccaaaucacacacacucuggucaaauggaguucucgaaucggagaugauaauaccgaaaauauauggcgggccuaucagccaacacaauuacaggccagguuauuuuacgcaaacugcaggucccuggcaccuagggaaauuagagcuugauuuugaucucugcgaaggaacgacaguaguuguagaugaacauugcgguaauagaggcccuagccuacggacaacgacggucaccggcaaaaucauucaugaaugguguugccgauccugcacacugccuccuuugcgauuuagaggggaagacggauguugguaugguauggaaauuagaccggugaaagagaaggaagaaaaucuggugagauccaugguaagcgcugguucgggagaaguagacaguuuuucuuuagggauauuauguguaucaauaaugauagaagaaguuaugcgaucacgauggucaagaaagaugcuuaugacgggcacuuuagcuguauuccuauugcuaauuauggggcaguugacuuggaaugaucuuauucgauuauguaucaugguaggugcaaaugcgagcgaucguauggggaugggaaccaccuaucuggcacugauggcgacguuuaaaaugaggccaauguucgcaguagguuuacuuuuucguagauugaccuccagagaaguacuccuucuuacaauaggacuaucucuaguugcguccguggaacuaccuaacagucuagaagaacugggggacggguuggcuaugggaauuaugaugcucaaauuauuaacugaguuccagccacaucaauuauggacuacucuucugucauuaacuuuuguaaaaaccacacuaagccuugauuaugcauggaagacuacugcaaugguucuaucuaucgucagcuuauuuccccucugucugucuacuaccucacagaaaacuacaugguuacccgugcuucuggguagcuucgguuguaaaccacuuacgauguuccuaaucacugagaacaaaaucuggggcagaaagagcuggccucugaacgaggguauaauggcuauuggaaucguauccauacucuugucaucacuacucaaaaacgauguaccauuggcaggaccauuaaucgccgguggaaugcuaauagcauguuauguaauaucugggucaagcgcagaccuaucacucgaaaaggcagccgaaguuaguugggaacaagaagcggagcacaguggcgcaucucauaacauccuaguagaaguacaagacgacggcacuaugaaaaucaaggaugaagaaagggaugacacccuaacaauauuauuaaaagcaacacuacuagccguaaguggcguguacccaaugagcauacccgcuacgcuauuuguuugguauuuuuggcaaaagaagaaacaacguagcggugucuugugggacacaccuucaccaccagagguagagagagcaguucuagacgauggaauauauagaauauuacaacguggguugcugggccguucucaagugggcgucggaguauuccaagacgguguuuuucauaccauguggcacguaaccagaggugccguacuuauguaucaaggcaaaagacuggaaccuucaugggccagugucaaaaaggauuuaaucucguauggaggcgguuggcgcuuucaggggucauggaacacaggagaggaaguccaaguaauugcuguggaaccaggcaaaaacccuaaaaauguacaaacaacuccaggaacuuuuaagacuccggaaggagaaguaggggcaaucgcgcuagauuuuaaacccggcaccucaggcuccccaauugugaauagagaaggaaaaaucguaggguuauauggaaaugguguaguuacuacaucaggaacauacguuucagcaauugcucaagcaaaggcuucacaagagggcccacuaccugaaauagaagacgaaguuuucaagaagaggaauuugacaauaauggauuuacauccuggauccgggaagacuaggcgauauuuaccugccauugugagggaagcaauuaaaaggaaauugagaacauuaauacuagcuccuacacgaguaguugcgucugaaauggcugaagcacuuaaaggcaugcccauacgauaccagacaacagccgucaagucagaacauacagggagagaaauaguagaucuaaugugucaugcuacuuuuacaaugagacuuuugucuccaguucguguaccuaauuacaauaugauuauuauggaugaagcacacuuuacagacccagccaguauagccgcacgaggcuacauaagcacgcgugucggaaugggcgaagcagcagcaauauuuaugacugcgacacccccugguucuguugaggcuuuuccacaauccaaugcaguaauucaagacgaagaaagagacauuccggaacgcucguggaacagugguuaugacuggauuacagauuucccagguaaaacagucugguuuguaccaucgaucaaauccggaaaugacaucgcaaauugucuuagaaagaacggcaagagaguaauucaguuaagcaggaaaacauucgacacugaauaucagaaaacuaaaaauaaugacugggauuaugucguaacgaccgacauaagcgagaugggagcaaauuuuagagcagacagagugauagauccucgcagaugcuuaaaaccaguaauacugaaagaugguccagaacgaguuauacuggcaggaccaaugccugucaccguagcgagcgcugcgcagaggagaggacgcauuggacguaaucaaaacaaggaaggagaccaguauguuuauaugggccaaccacuaaauaaugaugaagaccacgcccauuggacagaagcaaaaauguuacuggauaauauuaauacuccugaaggaauaauaccagcacuguuugaaccugaaagagagaaaagcgcugccauagauggagaauacagacuaagaggggaagccagaaaaacauuugucgaauuaaugcgucgaggcgaccuucccguaugguuaucauacaaagucgcaucugagggauuccaauacucagacaggagauggugcuuugauggugaaaggaauaaucaaguauuagaagagaauauggacguugaaaucuggacgaaagaaggagaaagaaagaaacuucgccccaggugguuagaugcgagaacguauucugauccauuagcacuaagagaguucaaggaauuugcagcgggucgcagguccguuucuggcgauuuaauauuagagauagguaagcuaccacaacaccuuacucuucgcgcccaaaaugcuuuagauaauuugguaaugcuacacaacucugagcaagggggaaaggccuauagacacgcgauggaagaguuaccagacacaauagagacguuaaugcugcucgcucuuauagcuguacuaacaggagguguuacucuauucuuuuuaucuggcaagggauuaggcaagacaaguauaggcuuauuaugcguuacagcaucaucagcauuauuauggauggccucaguagaaccucauuggauagcagcaucaauuauacuugaguucuuucuuaugguacuucuaaucccagaaccggauagacagcgaaccccucaagauaaccaauuagcuuaugucguuauuggucuucucuuuaugauucugacaguugcugcuaaugagaugggcuuguuggaaacuaccaagaaagaucuagggauaggauauguugcagcagagaaucaucaacacgccacaauguuagauguagaccugagaccagccucagcguggacauuauaugcgguagccaccacgguuaucacacccaugaugaggcauacuauagaaaauacuacugcaaauauaagccuaacggcuauugcaaaccaagcggcgauucuuaugggucuagauaaaggcuggccaauaaguaaaauggauaucggugugccucuuuuggcucuagguuguuauagccagguaaauccacucacucuuacugcugccguauuaaugcugguagcgcacuaugcaauuauuggaccgggucuucaggcuaaggcaacacgcgaagcucaaaagcgaacagccgcggggauuaugaaaaauccgacuguggaugguauaguagcaauagaccuugauccgguaguauacgaugccaaauucgaaaaacaacuuggccaaauaauguuacucauauuaugcacuucgcagauacuguuaaugcgaacaacuugggcauuaugugaaagcauuacacuugcuacaggaccucugacuacuuuaugggagggaucaccugguaaguuuuggaauacuacaauagcaguuaguauggcaaacaucuuccgcggaucuuauuuagcaggagcaggccuugcuuucucguuaaugaaaagccucggagggggaagacgugguacgggcgcccaaggagaaacauuaggugaaaaauggaaaagacagcuuaaucaacugucaaaauccgaauuuaauacguacaaaagauccggaauuauggaagucgaccgaucagaagcgaaagaaggacuaaaacgcggugagacaacaaaacacgccguuagccgcggaacagcaaaauuacgcugguuugucgagcgcaauuuagucaaacccgaagggaaaguuauagaucuuggauguggacgagggggauggagcuauuacugcgcuggucuuaagaaaguaacugaaguaaaagguuauacuaaagguggucccggacaugaagaaccaaugccuauggcgacguaugguuggaacuuaguaaaacugcauucugguaaagaugucuucuucaugccaccggaaaaaugugacacguuauuaugcgauaucggugaaaguaguccgaauccgacuauugaagaaggucguacacugcgagugcuuaagaugguggaaccuuggcugaaaggaaaccaauucugcauaaaaauacuaaauccuuauaugccuucuguagucgaaacacuagagcagaugcaacgaaaacauggagguaugcuagugcgcaauccucucucaagaaauuccacacacgaaauguauuggguaucuugcggaacgggaaacauaguauccgcuguuaauaugacaucuagaauguuacuuaaucgauuuacuauggcccauaggaagccgacuuaugaacgggacgucgaucuaggggccggaacacgacacguugcagucgaaccagaaguggcaaaucuagauauuauuggccaaagaauagagaacauaaagaaugaacauaaaucgacauggcauuacgaugaagauaauccguacaaaaccugggcuuaucaugguuccuaugaaguaaaaccguccggaucggccagcucgauggugaacgguguaguucgacucuugacaaaacccugggacgugauccccaugguaacacaaaucgcgaugacugauaccacacccuuuggucaacaaaggguauuuaaggaaaagguugacacuagaaccccacgagcaaaacggggaacaacacaaauaauggaaguaacagcgaaaugguuauggggauucuuaagucguaauaagaaaccuagaaucugcacaagagaagaauuuacgcgaaaaguuagaucaaauuccgcuauuggugcuguguucguagaugaaaaccaauggaacucagcaaaagaagccguagaggacgaaagauucugggaccucguacauagggaaagggaacugcauaaacaagguaaaugugcaacaugcguauacaacaugaugggcaaacgagaaaagaaacuuggagaguucggaaaagcaaaaggcaguagagcaaucugguauauguggcuuggggcaagguuucuugaguuugaagcguuaggcuuuaugaaugaagaccauugguuuucaagagaaaauagccuaaguggaguagaaggugaaggauuacacaaacugggauacauuuuaagggauaucuccaaaauaccaggaggaaacauguaugcggacgauacugcgggcugggacacaagaauaacagaagacgaucuccaaaacgaagcaaaaauaaccgacauuauggaaccugaacacgcuuuauuagcaacuucaaucuuuaagcucaccuaucaaaacaaagucguucgaguccaaagacccgcaaagaauggaacaguuauggauguuauaucaagacgagaucagcgagguucaggccaggucgggacauauggcuuaaauacauuuacgaauauggaaguucaacuaauucgucaaauggaaucagaaggcauuuuuagcccauccgaacuagaaacuccuaauuuggcagaaaggguguuagauugguuggaaaaacauggagccgaacgacuuaaacgaauggcuauaagcggggacgauugcguuguaaaaccaauagaugaccguuucgcuacagcgcugacugcauugaaugauaugggaaaaguuagaaaggauauuccucagugggagccgaguaaaggauggaacgacuggcaacaaguaccguucuguucgcaccacuuccaccaguugauaaugaaagacggaagagagauaguuguaccaugucguaaucaagacgaauuaguagggagagccaggguuagucaaggcgcggguuggucgcuccgugaaacagcuuguuuaggcaaaagcuaugcacagauguggcaacuuauguauuuucacagaagagacuuacggcuagcagcaaaugcaauuuguucagcaguaccuguagacuggguuccgacuucuagaacuacauggucaauucaugcucaucaccaauggaugacgaccgaagauauguuaaguguauggaauagggucuggaucgaagagaauccguggauggaggauaagacccauguaaguaguugggaagagguaccuuauuuaggaaaacgggaagaucaauggugcggaucucuaauaggcuugaccgcgagagcgacaugggcaacuaauauacagguggcgauuaaccagguuagacgucuuauugguaaugaaaauuaccuagacuauaugacaucgaugaagagguuuaaaaaugaaucagauccagaaggcgcuuugugguaa

SEQ ID NO: 21416 - RNA, 9879 nt, Artificial Sequence
  derived and/or modified CDS sequence (opt6) from DENV-1__JN819412__SS-prME
ucaguaacuauguuacuuaugcuauugccgacagcauuagcguuucauuuaacgacacgagggggagaaccccauaugauaguaucgaaacaagaaagaggcaaaagucuucuauucaaaacgagugcugggguuaacaugugcacgcuaauagcaauggaucuuggagaauugugugaagacaccaugaccuauaaauguccucguauaacugaagcggaaccggaugauguagauuguugguguaacgcaacugauacauggguaacauauggcacaugcagccaaaccggagaacaucggcgggacaaaagaucaguagcacuugcaccacaugucggucuaggacucgaaacucguacagaaacauggaugucuucagaaggcgcauggaaacaaauacaacgaguugaaacuugggcauuacggcauccagguuuuacagucauugcacuauuuuuggcacaugcgauaggaacaucaauaacccaaaaagguauuauuuucauccuauuaaugcugguuaccccuagcauggcaaugagguguguaggaaucggcaaucgugauuucgucgaaggcuugaguggcgcaacgugggucgacguugugcuagaacacggaucaugcguuacuacaauggcgaaaaacaaaccaacgcuagacauagaauugcucaaaacugaaguuacaaauccagcaguguugaggaaauuaugcaucgaggcaaaaaucagcaacacgaccacugauucuagaugcccaacucagggagaagcaacgcugguugaagaacaagaugcuaacuuugucugucgacgcacguucguugaucgaggcuggggaaauggguguggauuauuugggaaaggcaguuugcuaacgugugccaaauuuaaauguguuacaaaacuagaaggaaaaauuguacaauaugaaaauuuaaaguauucaguaauaguuacaguacauacuggagaucaacaucaagugggaaacgagacuacugaacaugguacaauagcaacgauaacaccccaagcuccaacuucugagauacaacugacugacuacggugcccuuacauuagauuguucaccacguacagggcuugauuuuaaugaaaugguucuuuuaacgaugaaagagaaaaguuggcuuguacauaaacaaugguuucuugauuuaccauuaccguggacgaguggugcgucaacuucacaagagacuuggaaucggcaagaccuucuagucacuuucaaaacagcacacgcgaagaaacaagagguuguagugcuaggaucacaagaaggagcuaugcacacagcucuuacgggggcaacugagauucagacaucuggaaccacuacgauauucgcgggucauuugaagugccgccuaaagauggauaaguuaacuuugaaaggaaugagcuacguaauguguacgggaucauucaaauuagaaaaagaaguugcagaaacccagcaugggacaguauugguucaaguuaaauaugagggaacagacgccccgugcaaaauucccuuuucaacccaggacgaaaagggggugacgcaaaacggcagacucauuacagcaaauccaauaguaacagauaaagagaaaccuguaaacauagaaacagaaccaccauuuggugaaagcuauauagucguaggcgcuggagaaaaggccuuaaaguuaagcugguucaagaaaggaagcagcauugguaagauguucgaagccacugcccgaggagcaagacgaauggcgauccuuggcgauacggcaugggauuucgguaguauaggaggaguauucacaagcguuggcaaacuuguucaucaaguauuuggaacagcauauggagugcuauuuagcggagugaguuggaccaugaaaaucgggaucgggauucucuuaacguggcuuggucuaaauucaaggucuacaucauugaguaugacgugcaucgcggucggaaugguuacccuauaucuaggagucaugguucaagcagauucaggcuguguuauuaacuggaaagggagagaguuaaaaugugggucagggauauuuguaacaaacgaaguucacacauggacugaacaauacaaauuccaagcagauuccccgaagagauuaucagcagcaaucggcaaagccugggaagagggcgugugugguauacggucagccacccguuuagaaaauauaauguggaagcaaauaaguaaugaacuuaaucacaucuuacuagaaaacgacaugaaauuuacugugguagucggagaugccaaugguauucuggcucaagggaagaaaaugauaaggccacaaccaauggaacauaaauauucuuggaaaagcugggggaaggcuaaaaucauaggggcugauauccaaaacacaacauuuauuauagacggaccggauacucccgaaugcccagauggacaacgugcauggaauauuugggaaguagaggauuauggcuuuggaauauuuacuacaaauaucuggcuuaaacucagagauaguuauacacaaaugugugaucaucgacuaauguccgcggcaauuaaagauagcaaagcuguucacgcggauaugggcuauuggauagaaucggagaaaaaugaaacauggaaauuagcaagagcaucauucauagagguuaaaacguguacauggccaaagagucauacccuuuggagcaacggagucuuagaaagcgaaaugauaauaccaaaaauuuaugguggaccaauaucgcaacauaacuauagaccggguuacuuuacucaaacggcugggccauggcaucuugguaagcuagaauuagauuucgaucugugcgaaggaacgacgguaguaguagacgaacacuguggaaaccgagguccuucucucagaaccacaaccguuaccgguaagauuauucaugagugguguugccgcuccuguacucuaccuccguuacgauuccguggcgaagacgguugcugguaugggauggaaauaaggccagugaaggaaaaggaagaaaacuuagugcgcucgauggucucugcaggaucuggagaaguagacucauuuagccuagguauuuuauguguaaguauaaugauugaagaggucaugaggucaagauggucaagaaaaaugcuuaugacaggcacauuagccguauucuuacugcugauaaugggccaguuaaccuggaaugauuuaauccgucuauguauaaugguaggggcuaaugcuagcgaucggaugggcauggguacuacuuaucucgccuuaauggcgacauucaagaugagaccgauguuugcaguaggguuguuauuccgaagacucacgagucgcgaaguuuugcuauugacaaucggacuuucauuaguagcaagugucgaacuaccgaauagucuugaagaacuaggugaugguuuagcaauggguauuaugaugcuaaaacugcuuacagaauuucaaccucaucaauuguggacaacucuguuaagccuaacuuucguaaagaccacuuuauccuuagauuacgcauggaagacuacggcaaugguccuaucaauaguaagccucuuuccucugugccuaaguacaacuagccagaagacgacaugguuaccagucuugcuagguucuuucggcugcaagccccucacaauguucuuaauuacggagaauaagauuuggggaaggaaaagcuggccacuaaaugagggaauaauggcuauuggcauuguuucaauucugcuuucuucguuacuaaagaaugauguacccuuggcaggaccacucauugcaggcgggauguugauagcaugcuauguuaucucggguagcucggccgaccuccuauuagaaaaggccgccgaaguuagcugggaacaagaagccgagcacuccggagcaucacauaauaucuugguagaaguacaagacgauggaacaaugaagaucaaagacgaagaaagagacgauacauuaaccauauuguugaaagcuacauuauuagcaguaagcggaguuuacccgaugaguauuccggcuacuuuauucgugugguacuuuuggcagaagaagaaacagagauccggaguguuaugggacacgcccuccccaccagagguagagagagccguuuuagaugacggaauuuacaggauacuccaacgcgguuugcuuggccggucccaaguuggagugggcguuuuucaagacgggguuuuucacacaauguggcauguaacacgaggagcuguauugauguaccaaggcaaaagguuagaaccuucuugggcaagugucaagaaagacuuaauauccuacggaggugguuggcgcuuccaagguucuuggaacacaggagaagaggugcagguaauagcaguagaaccuggcaaaaauccuaagaauguacaaacaacgccaggaacauuuaaaacaccggagggcgagguuggagccauugcacuugauuucaagccagggacaucaggaucuccgauuguuaacagagagggaaagauuguaggauuauacgguaacggcgucguaaccacaucuggcacauacguaucugcgauagcgcaagcaaaagccucacaagaagggccauuaccugagauugaagacgaaguauuuaagaaaaggaaucuaaccaucauggaucuacauccaggcucagguaagacacgacgguauuuaccagcuauaguuagggaagcaaucaagagaaaauuaaggacuuugaucuuagcaccaacacgagugguggccagugaaauggcagaggcacuaaaaggcaugcccauucgguaucagaccacugcaguuaaaucggaacauacugguagggaaaucguagauuuaaugugccaugcuacuuuuacaaugcgacuacugaguccaguaagaguuccuaauuauaauaugauaauuauggaugaggcccacuuuacggacccagccaguauagcggcucggggauauauaucuacgagagucgguaugggugaagcagcggccauauucaugacugcaacaccaccugguucuguagaagcauucccucaaucuaaugcuguaauucaagaugaagaacgugauauuccagagagauccuggaacucagguuacgauuggaucacugacuucccuggaaagacugugugguucguaccuaguaucaaaucuggaaaugauauugcaaauuguuuaagaaagaaugguaaaagaguaauacagcucaguagaaaaacauuugauacagaguaccaaaagaccaaaaacaacgauugggauuauguagucacgaccgauauuucugaaaugggagcaaacuuuagagcugacaggguaauugauccuagaagaugucuuaaaccuguaauauuaaaagauggaccagaaaggguaauacuagccggaccaaugccaguaacuguugcaucagcugcacagcgccgcgggcgcauaggacggaaucaaaauaaagaaggagaccaauaugucuauaugggacaaccgcuaaauaacgaugaagaucacgcccacuggacugaagcaaagauguugcucgauaacaucaauacaccagaaggaauaaucccggccuuguuugagccggaaagagaaaaaucagcagcgauugacggcgaguauagguugcgcggugaagcaagaaagacuuuuguagaacuaaugagacgaggugauuugcccgugugguuaaguuauaaaguggcgagugaaggcuuccaguauucagauaggagaugguguuucgauggagaacggaauaaucagguucuugaggagaauauggacguugaaauauggacaaaagaaggcgaaagaaagaaauuacgaccuagaugguuagacgcgaggacuuauucagacccacuagcauuaagagaguucaaagaauuugcagcaggucgccgcucggucucaggggauuugauucuggaaaucgguaaauuaccacaacacuugacacuucgagcacaaaacgcucuagacaaucuaguaauguuacauaacagugaacaagguggaaaggccuauagacaugcuauggaggaacuaccugauacaauagagacuuuaaugcuacuggcucuuaucgcaguccugacagguggaguaacauuauucuuuuugucagguaaaggauuagggaaaacgucaauugguuuauuaugugucacagccucgagugcuuuauuguggauggcuucaguagaaccgcauuggauagccgcuucuauaaucuuggaguucuuuuuaauggucuuacuaauaccagaaccagaucgacaaagaacaccucaagauaaccaauuagccuaugugguaauaggauuauuauuuaugauucuaacgguagccgcuaacgaaaugggucucuuagaaacgacuaagaaagaucuugggauagguuauguagcugccgaaaaucaucaacacgcaacaaugcuagauguugauuugaggccagcuucggcguggacacuauacgcuguagcuacaaccguaaucacaccaaugaugaggcauaccauugaaaauacaacagcgaauaucagcuuaacugcgauagcaaaucaagcugcaauauuaaugggccuagauaaagguuggccgauuucaaaaauggacaucggaguuccauuauuggcacuaggaugcuauucccagguuaacccacuaacgcucacggcagcaguacuuauguuaguugcgcacuacgcuaucauuggaccuggacuacaagcaaaggcaacuagagaagcgcagaagcgaacugcagcuggaauaaugaaaaauccgaccguagauggcaucguagcaaucgauuuagauccggucguauacgaugcuaaauuugaaaaacaauuaggccaaaucauguuauugaucuuaugcaccagccagauacuuuugaugagaaccacgugggcauuaugcgaaaguauaacacuugcaacuggaccacuaacaacucucugggaaggaagcccagguaaguuuuggaauacaacaauugcugugaguauggccaacauauuuagggguagcuaucucgcuggcgcagguuuggcguuuucucugaugaaaucauugggaggagggagaagagguacgggagcacaaggagagacuuuaggagaaaaguggaagaggcaacucaaccaauuaagcaagucugaguucaacacauauaaaagauccgguauaauggaaguagauaggagcgaggcuaaagagggguugaaaagaggugaaacgacuaaacaugcugucagcagaggaaccgccaagcuccguugguucguagagagaaacuuagucaaaccagaaggcaaaguaaucgauuugggaugugggagaggaggcuggaguuauuacugugcgggccucaagaaagugacugaaguuaaaggauauacaaaagguggacccggacaugaagaacccaucccaauggcgacauauggcuggaaucuuguaaaauugcacucaggaaaagaugucuuuuucaugccaccagaaaaaugcgacacguuauugugugacauaggagaguccaguccgaacccuacgauugaagagggucggacccuccgagucuuaaaaaugguugaaccuugguugaaagguaaccaguucugcauaaaaauuuuaaauccauauaugccaaguguuguugagacauuagaacaaaugcaaagaaagcacgguggaaugcuuguacguaauccacuguccaggaauagcacucaugagauguacuggguaaguuguggaaccggaaauauaguaucagcgguaaacaugacaucacgcaugcuauuaaacagguuuacgauggcucaccgcaaaccaaccuaugagagagauguagaucuuggagcuggcacgcgacacguagccguagaaccagagguagccaaccucgauaucauuggccaacggauagaaaauaucaaaaaugagcacaaaucaacauggcacuaugacgaggauaaucccuauaaaacuugggcauaucaugguucguacgaaguaaaaccgagcggcucagccaguuccaugguaaacgguguuguacggcugcugacaaaaccaugggauguuauaccgauggucacacaaaucgcaaugacugauacuacaccuuuugggcagcaaagaguauucaaagaaaaaguagacaccaggacaccaagggcaaaaagaggaacuacccagauaauggaaguaacugcaaaauggcuguggggguuccuaagcaggaauaagaaaccaagaauauguacacgagaagaguucacacgcaagguucgaagcaaugccgccauaggcgcgguuuuuguagaugagaaucaauggaacagugcuaaggaagcaguugaagacgaacguuucugggacuuagugcaucgagaaagggaauuacauaaacaaggaaaaugcgccacuugcguguacaauaugaugggaaaaagggagaagaaauuaggugaguucggaaaagcuaaaggcucucgagcaaucugguauauguggcugggagcacguuucuuagaguuugaagcacugggauuuaugaacgaagaucauugguucucgagagaaaacucauuaagcggagucgagggggaaggauugcauaaacuuggauauauuuuaagggauauuucgaagauaccaggagggaacauguacgcggacgauaccgcugggugggauacacguauaacagaagaugaccuucagaaugaggcgaaaauaacagauaucauggaacccgaacaugcacuacuagccacuucaauauucaaguuaacauaccaaaauaaaguaguacgcguucaacgaccagccaaaaacgguacggugauggacguuauuucacgacgcgaucagcguggcucgggucaagucggaacuuauggauuaaauaccuuuacuaacauggaagugcaauugauaaggcaaauggaaucagaaggaaucuuccuaccgagcgaacucgaaacucccaaccuugcagagaggguccuagauuggcuugagaaacauggagcagagagacuuaaaaggauggcgauaaguggggacgacugugucguuaaaccgauagacgacagauuugcaacggcucuaacugcguuaaacgacauggguaagguacgaaaagacauaccucagugggaacccucaaaagguuggaaugacuggcaacaaguaccguucugcagccaucauuuccaccaauuaauaaugaaagauggacgugaaauuguagugccaugucggaaccaagacgaauuagugggacgagcaagaguaagccagggcgcgggcuggucgcugagagaaacugcuuguuuaggaaaauccuaugcacaaauguggcaauuaauguauuuucaucggagagacuuaagacucgcugcuaaugcaauaugcagugcgguaccaguugauugggugccgacaagccgaacuacuuggucaauacacgcucaucaucaauggaugacaaccgaagauauguugucuguauggaacagaguauggauagaagaaaauccguggauggaggacaagacacauguaucgaguugggaagaaguccccuaucuagggaaaagagaagaucaauggugcgguucacuuauaggccuaaccgcacgagccacaugggcuacgaauauacaaguagcgaucaaucaaguacgaagacuuauagggaacgagaauuacuuagacuauaugacaucaaugaaaagguuuaaaaacgagucugacccggaaggagcucugugguga

SEQ ID NO: 21417 - RNA, 9879 nt, Artificial Sequence
  derived and/or modified CDS sequence (opt6) from DENV-1__FJ810415__SS-prME
ucaguuacuauguuauuaauguuacuaccgaccgcuuuagcguuccauuuaaccacgcgagguggggaaccgcacaugauuguaucuaaacaagaacgaggaaaaagucuccuauucaaaacaagugcaggagucaacauguguacauuaauagcaauggaccuaggugaauuaugugaagacaccaugacuuauaaaugcccaagaauaaccgaagcagaaccugaugauguagauugcugguguaaugcaacugacacuuggguaacauaugguacgugcucgcaaacuggugaacauaggcgagagaaaagguccguagccuuagcgccccauguagggcuggggcucgaaacuaggacggaaacauggauguccagugaaggagcuuggaaacaaauacaaaggguugagacuugggcacuucgccauccagguuucacgguaauagcuuucuuuuuagcucaugcgauuggaacuucaauaacacaaaaaggagucauuuucauacuuuuaaugcuaguaacaccgagcauggccaugaggugcguagguaucgguaaccgggacuuuguagaaggauuauccggagcuacaugggucgauguaguuuuggaacauggaaguugcguaacaacaauggccaaaaauaaaccgacccucgauaucgaauuacuaaaaacagaaguaacaaauccggcagugcugagaaaacucuguauagaggcaaaaauuucuaacacuacgacugacagcagauguccaacucaaggagaagcaacauuaguugaggagcaagacgcaaauuuuguuuguagaagaacuuuuguugacagaggguggggaaacgguuguggccuauucgguaaaggaucauuguuaacaugugcaaaguucaagugcgugacgaaacucgaaggcaaaaucguccaauaugaaaacuuaaaguauuccgucauaguaacaguucauacaggugaccagcaucaaguuggcaacgagacaaccgaacacgguacaauagcuacaauuacuccccaggcuccaacaucagagauacaacuaacggauuauggcgcccuaaccuuagacuguaguccucgcacugggcuagauuucaacgaaauggucuugcucacaaugaaagagaaaaguuggcuagugcacaaacaaugguucuuagaucuacccuuaccauggacaucaggagcaucgaccucucaagaaacauggaaccgacaggaccuauuagugacauuuaaaacugcgcaugcuaagaaacaggaaguugugguuuuagggucacaggagggagcgaugcacacagcuuuaaccggugcuacagagauucagacauccgggacaaccaccauuuuugcgggacacuugaaaugccgccuaaaaauggauaaacucacacuaaaggguaugaguuaugugauguguacaggaucauuuaaacuugaaaaagaaguagcugaaacacaacacgguacaguauuagugcagguuaaguaugagggaaccgaugcuccuuguaagaucccguuuaguacgcaagaugaaaaaggagugacccaaaacggccgacugaucacagcuaacccaauaguaacagauaaggaaaaaccagugaauauagaaacugaaccuccguucggggaaagcuacauuguaguuggagcgggagaaaaggccuugaaauuaaacugguuuaaaagaggaucaucuauagggaaaauguucgaagcaacugcacgaggagcaagaaggauggcaauuuugggugauacagcaugggauuuugggagcauaggcgguguguucaccaguguaggaaaguuaguucaucaaguuuuuggaacagcauacggaguacuguuuucagguguaaguuggacuaugaaaaucgggauaggaauccuacuaacauggcuaggacuaaauucuagaucaacaucauugagcaugaccuguauagcuguaggaauggucacacuauaccuaggagugaugguacaagccgauucuggcugcguuauaaauuggaagggaagggaacuuaaaugcgggucgggcauauucguuacaaaugaaguacauacguggacagaacaauauaaauuucaagcggauagucccaaacgcuugucugcagcaaucggaaaggcaugggaggaaggaguguguggaauacguagugcaacacgacuagagaauauuauguggaagcaaauaucaaacgagcuuaaucauauacucuuagaaaaugauaugaaauuuaccguggucguuggggaugccaacgggauacuggcgcaagguaagaaaaugauacguccucaaccuauggaacauaaauauucguggaaaucauggggaaaagcaaaaauaauuggagcggacauccaaaauacuacuuucauuauagacggcccagauacuccggaauguccugacggccaaagagcauggaauauaugggaaguggaagauuacggguuuggaguauuuacuacuaacaucugguuaaaguuacgagauaguuauacacaaaugugugaucaccgcuuaaugucggcggcaauuaaggauucaaaagcaguacaugcugauaugggguacuggauugaaucugagaaaaaugaaacauggaaauuggcuagagcaaguuuuauagaaguaaaaacgugcacuuggccaaagagucauacauuauggagcaaugggguacuggaaucggaaaugaucauacccaaaauuuacggagggccaauaucucagcacaacuacagaccgggguauuuuacacaaacagcuggaccuuggcaucuuggaaagcuggaacuagacuucgacuuaugugaagguaccacaguagugguagaugaacauuguggaaauagaggaccaucauuaaggacuacuaccgugacggguaaaauaauucacgaauggugcugcagaucuuguacauugccgccuuuacgauucagaggagaagauggauguugguauggaauggaaauuagaccaguaaaggaaaaagaggaaaaccuuguacgaucaauggucucggcagguagcggagaaguugacaguuucucacuagguaucuuaugugugaguauuaugauugaagagguaaugagaucgcgauggucacguaaaaugcuaaugacagguacuuuagcuguguuuuuauugcuaauaauggggcaacuuacuuggaacgacuuaauuagauuauguauaauggugggagcgaaugcaagugacagaauggguauggguacuacuuaucuugccuugauggcuacauucaagaugaggcccauguucgccgucggucuacuauucaggaggcuuacuucaagagagguacuucuacuaacaauaggauuaagccuaguugcaagcguggaauuaccaaauucguuggaagaacuuggugauggauuagcgauggggauuaugaugcuaaaauuauuaaccgaguuccagccacaucaacuauggacaacucuauugagccuaacguuuguaaagacgacacuuagucuagauuaugcauggaaaaccaccgccaugguucuuagcauuguuucauuguuuccucucugucucucgacaacuucacagaaaacuacaugguugccugucuuacuagggagcuuugguugcaagccgcuaacgauguuccuaaucaccgaaaacaaaauauggggacggaaaaguuggccacugaaugaagguaucauggcaauaggcauaguaaguauccuccuaucgucauuguuaaagaaugacguuccgcuagcagggccuuuaauagcugguggaauguuaauagcuugcuauguuauaucaggaucuucggcagaccucagccuggaaaaagcagccgagguuaguugggagcaagaagcggaacauucuggagcuucucauaauauccucguagaaguucaggacgauggcacgaugaaaaucaaagaugaggaacgugacgauacuuuaaccauauuacuuaaggcaacauuauuagcagucagugggguauauccaaugucaauaccugcuacauuauuuguuugguacuuuuggcagaaaaagaagcagagaucggggguguuaugggauaccccgagcccaccagaaguugaaagagcagucuuagaugacgguaucuacagaauuuuacagcgugggcugcuaggaagaucucaagucggcguagggguauuccaggaugggguauuucacacaauguggcacgucacaagaggugcaguguuaauguaccaagguaaacgacuagagccaucaugggcaaguguuaagaaagacuuaauaucguacggagggggauggcgauuucaagguuccuggaacacaggugaggagguucaaguuauagcagucgaaccagguaaaaaccccaaaaauguccaaacuacgccggggacauuuaaaacaccagaaggggaagugggugcaauagcacuugacuucaaaccaggaacaaguggaucgccgauagugaauagagaggguaaaauuguagguuuguacgguaauggggugguuacgacaaguggaaccuauguuucagccauagcacaggcuaaagccucucaggaaggaccguugccagaaauugaagaugaaguguuuaagaaaaggaacuuaacuauaauggauuuacaucccgggucuggaaaaacccgucguuaccuaccggcaauuguacgugaagcaauaaaacgcaaauuacggacgcuuauucucgcucccacccgggucguugcuuccgagauggcggaagcccugaagggaaugccuauacgguaucaaaccacggcugugaaguccgaacacacuggcagggaaauaguagaucuaaugugucaugcaacuuuuacuaugagauuacuuagcccggucaggguaccuaauuacaauaugauaauuauggacgaagcacacuuuaccgaucccgcgucaauagcggcuagaggauacauaucgacgagaguaggaaugggggaagccgcagccauauucaugacagcaacaccuccagguucuguugaggcauucccacaaucgaacgcugucauacaagacgaggagcgagacaucccugaacgguccuggaauagugguuacgauuggauaacggacuuucccgggaagaccguaugguucgucccuucaauaaaauccggcaaugacaucgcaaauugccuacgcaagaaugggaagcgaguaauacaacuuucuagaaaaacauuugacacagaguaccagaaaaccaaaaauaaugacugggauuacguaguuaccacagacauaucagaaaugggagcaaauuuuagagcggaucgaguaauagauccccgucguuguuuaaaaccaguaauccuuaaagauggaccagaacgagucauucuugcaggaccaaugccuguaacgguugcuucagcugcacagcgacgcggacguauugggagaaaccaaaacaaagaaggugaccaauauguguacaugggucaaccacuuaacaaugaugaggaucacgcacauuggacagaagccaaaauguuacuugauaacaucaauacgccagaagguauuauuccggcacuguuugaaccugaacgagaaaaauccgcugcuauagauggcgaauaucggcuacguggagaagcuagaaagaccuuugucgaguuaaugcggaggggcgauuugccugucuggcuaaguuauaaaguugcaagugaagguuuucaauauagugacaggagaugguguuuugacggagaaagaaauaaucaagucuuagaagaaaauauggauguggaaauauggaccaaagagggggaaaggaagaaauuacgaccuagaugguuagaugcccguacauauucagauccucuugcauuacgagaauuuaaagaauuugcagcaggaagaagaucaguaagcggagauuugauucuagaaaucggcaaacuuccucaacaccuaacauuacgggcacagaacgcacuugauaaucucguuaugcuacauaauagugagcagggaggaaaagcauauaggcacgcgauggaggaacucccugauacaauagagacucugauguuacuagcuuuaauugcaguauuaacuggcggcguaacucucuucuuuuuaucaggaaagggucugggaaaaacgucaaucggcuuauuauguguuacggccucuuccgcacuacuauggauggcaucagucgagccccacuggauagcagccucaauuauauuagaguucuuucuaauggucuuacuuaucccggaaccagaccgacaaagaaccccgcaggauaaucagcuagcuuaugucgucauaggauuacucuuuaugauucuuacaguagccgcuaacgaaauggggcuauuagagacaacgaagaaagaucucggaauaggcuacguugccgcugaaaaccaccagcaugccacuauguuagauguagaucuucacccggcuagugcuuggacacuuuacgccguugcaacaacagucauuacaccaaugaugaggcacaccauagagaacacaacagcgaacauaucucuaaccgcuaucgcuaaccaggcggcaauauuaaugggucuugacaagggcuggccuauaaguaaaauggacauuggagugccucugcuggcacuaggauguuauucacaagugaacccuuugacucuaacagcggccguucuaauguugguagcacacuaugcaauaauuggucccggauugcaggccaaagcaacaagagaagcgcagaaacgaaccgcagcagguauuaugaaaaauccaacagucgauggcauaguagcaauagaccuggacccaguuguguacgaugccaaauucgaaaaacaacugggacaaauaaugcuuuuaaucuuauguacgucgcaaauucuguuaaugaggacuacgugggcacucugcgaaucaauuacuuuagcgacugguccgcuaaccacucuaugggaagguucaccgggaaaauuuuggaacaccacuauagcgguauccauggcaaauauauuuagagguucauaucuugcaggagcagguuuggccuucaguuuaaugaaaagucucggagggggaagaagaggaacaggagcccaaggagaaacauugggagaaaaauggaaaagacaauugaaucagcuaucgaaaagugaauuuaauacauauaagaggucggguaucauggagguagaucguucagaagcaaaggaaggucuuaagagaggggaaacuacuaagcaugcaguaucaagaggcacggcaaaacugagaugguucguagaaaggaauuugguaaaaccagaagguaaaguaaucgauuuagguugcggucguggcggguggaguuacuauugugcaggccugaaaaagguaacagagguaaaaggguacacaaaaggggguccgggccaugaagaaccuaucccuauggcaacauacggcuggaacuuaguaaaguugcauucaggaaaagacguauucuuuaugccaccagaaaaaugugauacccuacuuugcgauaucggugaauccucuccaaacccaacaaucgaagagggaaggaccuuaagaguuuuaaagauggucgaaccgugguugagaggaaaccaauuuugcauaaaaauacugaauccuuacaugccuucuguagucgaaacgcucgaacaaaugcaacgaaagcauggcggaaugcuaguacgaaacccguugucuagaaauucaacucaugagauguauuggguaaguugcggaacgggaaacauagucucugcggugaacaugaccaguaggauguugcuaaacagguuuacaauggcucaccgaaaaccuacauaugagcgagacguagaucuaggugcuggaacgaggcaugucgcgguagagccagaaguagcaaauuuggacaucauuggccaaaggauagaaaauaucaaaaaugagcacaagucgacuuggcacuaugacgaagauaaucccuacaagacaugggccuaccauggaagcuacgagguaaaaccaagugguagugcauccucuaugguaaacgguguaguacgauuguuaacaaagccaugggacguaauaccaauggugacucaaauagcuaugacugacaccacuccuuucggacaacagcgugucuuuaaggaaaaaguagacacaagaaccccgagagccaaacgcgguacaacgcaaauuauggaagugacugcaaaauggcuuuggggauuuuugagucgaaacaagaaaccgagaauauguacacgagaggaauuuacuagaaaaguacguuccaaugcggcuaucggagccguauuuguggaugaaaaccaauggaacucugcaaaagaggcaguugaagacgaacgcuucugggaucuaguacacagagagcgugaauuacauaaacaaggcaaaugugcuacauguguuuauaacaugauggggaaaagagagaagaaauuaggugaauuugguaaagcgaaggggucgcgcgcaauuugguacauguggcugggagccagguucuuagaauuugaggcucuaggauucaugaacgaagaccacugguucuccagggagaacagucuaucuggcguugaaggagaaggacugcauaaguuaggauauauauugagagacaucaguaaaauaccgggaggaaacauguaugcagacgauaccgcaggaugggauacgagaauaacagaggacgaucuacaaaacgaagcgaaaaucaccgauaucauggaaccagaacaugcuuuguuggccacuucuauauuuaaauugacauaccagaauaaagucguacgaguacaacgaccagcgaaaaauggaacuguuauggauguuauaucuagacgcgaucagcgcggaucuggucaaguaggaaccuauggucucaacacguucacaaauauggaaguucaauuaauacgacaaauggaaucggaggggauauuucucccaucugaacuagaaacaccgaaucuagccgaaagggccuuagacugguuagagaaacauggugcggaaagauuaaagaggauggcaauaucaggcgacgauuguguagugaaaccaauagaugacagauuugcaaccgcauuaacagcauugaacgacauggguaaaguuagaaaagacaucccccaaugggaaccauccaaagguuggaacgauuggcagcagguccccuuuuguagucaucacuuccaccagcucaucaugaaagacggucgagaaauaguaguuccaugucguaaucaagaugaacuuguaggucgugccagaguuagucagggugcgggguggucuuuacgagaaacugcaugucuuggaaaaucuuacgcucaaauguggcagcuaauguauuuucaucgaagagaccuucggcuggcagcaaaugccauauguagugcagugcccguagacuggguacccacaagucgaacgacauggucgauacaugcccaccaucaauggaugacaacugaagacaugcuaaguguuuggaacagaguguggaucgaagagaauccguggauggaagacaagacucauguuucuaguugggaagaaguaccuuacuuaggaaagagagaagaucaguggugcggcagcuuaauuggucugacugcgcgggcaacaugggccacaaauauccagguagcuauuaaccagguaagacgcuuaauuggaaacgagaacuacuuagauuauaugacuuccaugaaaagauucaaaaaugaaagugacccggagggagcauuaugguga

SEQ ID NO: 21418 - RNA, 9879 nt, Artificial Sequence
  derived and/or modified CDS sequence (opt6) from DENV-1__FJ639814__SS-prME
ucugugacuauguuauuaauguugcuucccacagcguuagcauuucacuugacuacacgagggggagaaccccacaugauaguaagcaaacaagaacggggaaaaucuuuauuguuuaaaacuucagcgggagugaauaugugcacuuuaauugcuauggaccucggagaacuuugugaagauacaaugacuuacaaaugcccaaggauuacugaagcagagcccgaugacguugacugcugguguaaugccacugauacaugggugacuuacggaacaugcucccaaacuggagagcacagacgugagaaaagauccgucgcauuagcuccccauguagguuuaggucuagaaacccgaacagaaacuuggaugucaucagaaggagcauggaaacaaauacaaagagucgaaacaugggcgcugagacauccggguuuuacugucauagcauucuuucuagcucaugcuauaggaacgaguauuacccaaaaaggcauaauuuuuauucuauugauguuagucacuccuucaauggcaaugcgauguguaggcauaggaaaccgugacuuuguugaaggauuaucuggcgcaacaugggucgacguaguccuggaacauggaucuugugucacaacaauggccaaaaauaagccuacucuagauauagaauuacuaaaaacggaaguaacuaacccagcuguguuacggaaacuuuguauugaagcaaaaauuucaaauacaacuacugacaguagguguccuacucaaggcgaagcaacguugguagaggagcaagaugcaaauuucgugugcagaagaacauuuguugacagaggauggggcaauggaugcggucuguucggaaaaggaaguuuauuaacaugcgcaaaauucaaguguguaacuaagcucgaaggaaaaauuguccaauacgagaauuugaaauauucaguuauugugacuguacauacgggagaucaacaccaaguuggaaacgaaacaacagagcacggaacgauugccacaauaacaccgcaagcucccacaagugaaauucaauugacagacuacggagccuuaaccuuggauugcaguccgaggacaggucuugauuuuaacgaaaugguauugcuaacgaugaaagaaaaaucgugguuaguucacaaacaaugguuucuagaucugccgcuaccuuggacaaguggagcaaguaccucucaagaaacauggaauagacaagaucuauuaguaaccuucaaaacugcacaugccaagaagcaagaaguagugguauuaggaucgcaagaaggcgcgaugcauacugcguuaacgggagcuacagaaauacaaacuagcgguacaacuacaauuuuugcuggucaucugaagugccgucuuaaaauggauaaauugacuuuaaaaggaaugaguuacgugaugugcaccggaucuuucaaauuagaaaaagaaguugcagaaacucaacauggaacaguuuuaguacaaguaaaauaugaagggacagaugcaccuugcaagauaccauucucuacacaagaugaaaaaggagucacacaaaauggucgauuaauuacagccaauccaauaguuacagacaaggaaaaaccuguuaauauugaaacggaaccgccauuuggagaaucauacauuguagugggagccggugaaaaagcucuuaagcugucuugguucaagagaggcucuaguauagggaaaauguuugaggcuacagcaagaggagcuaggaggauggcgauacuuggggauacagcgugggacuucggcucgauuggggguguuuuuacuagcguaggcaaauugguacaccaagucuuuggcaccgcuuaugguguauuauuuaguggugucagcuggacaaugaaaauaggaaucggcauauuauuaaccuggcucggccuuaauagucgaucaacuucguuaaguaugacuuguauagcugucggaaugguaacucucuauuuaggaguuaugguacaagcugauucgggguguguaaucaacuggaaaggacgggaacuuaaaugcgguagcggaauuuuugugacgaaugaaguacauacguggacggagcaauauaaauuccaagcugauagcccuaaaagacucucggcggccauuggcaaagcgugggaggaaggcguauguggaaucagaucggcgacgagacuagaaaauauuauguggaaacaaauaagcaacgaauuaaaucauauuuugcucgagaaugauaugaaguucacuguagugguuggcgacgcgaaugguauacuagcacaaggcaagaaaaugauaaggccacagccuauggagcacaaauacuccuggaagucuuggggaaaagcaaagauaauaggagcugauauccaaaauaccacguuuaucauagacgguccggauacaccggaaugccccgacgggcaaagggcauggaauauaugggaaguggaggacuaugguuucggaguguuuaccacaaacauauggcucaaacuuagagauucauauacacaaaugugugaccaucggcucaugagugcagcuaucaaagauuccaaggccguacacgcagauauggguuacuggaucgaguccgagaaaaacgaaacauggaaacuugcacgggcuagcuuuaucgaaguaaaaacguguacauggccuaaaucccacacguuauggaguaauggggugcuagaauccgagaugauaauaccuaaaauauacggaggaccaauuucccaacacaacuaccgaccaggauauuuuacccagacagcugguccauggcauuuagggaaguuagaauuagauuucaaucuaugugaaggaacuacaguuguugucgaugagcauugugguaauagagguccuucgcuuagaacuacaaccgugacugguaagauaauucaugaaugguguugucguaguugcacacuuccaccacuacgcuucagaggcgaagaugguuguugguacggcauggaaauaaggccuguuaaggaaaaagaagaaaaccuuguaagaucuaugguaucagccgguaguggagaaguugacucguucucuuuagguauacuaugugucagcauaaugauagaggaaguaaugaggagucgauggucgagaaagaugcuaaugacaggcacacucgcaguauucuuacuuuuaauuaugggacaauuaacuuggaacgaccuaauucgcuuauguauuaugguuggagcgaaugcaucagacagaaugggcaugggcacaacauauuuggcacucauggcuacauucaaaaugcguccaauguuugccgucggccuacuguuuaggagacuaacauccagggagguuuuacuauugacaaucggguuaucauugguugcuucaguagaacucccaaauucuuuagaagaauuaggagacggauuggcaaugggaaucaugaugcuaaaauuauuaacagaguuucagccucaccaauuauggacgacucuacuaagucugacuuuugugaagacaacacucagccucgacuacgcuuggaaaacgacagcaaugguauuaucaauaguaucccuauuuccacuaugccucucaacgacgucacagaaaaccacauggcugccuguauuauugggcucuuuuggaugcaagccgcuuaccauguuucuaauuacagagaacaaaaucuggggaagaaaaagcuggccgcucaaugaaggcaucauggcgauaggaaucguuaguauauuauuaucuagcuugcuuaagaaugacguaccuuuagcuggaccucugaucgcaggggguauguuaaucgcaugcuacguaaucagcggcucgagugccgacuuaucauuagaaaaagcggcggaaguaaguugggaacaagaagcugaacauuccggugcuucucauaacauccuaguugagguccaagaugauggaacaaugaaaauaaaggaugaggagcgggaugacacacuuacuauucuacuaaaagcgacacuuuuggcuguaagugggguauauccuaugaguaucccggcaacucucuuugugugguacuucuggcagaaaaagaaacaaaggucaggaguccucugggacacgcccagcccacccgaagucgaaagagcaguacuagacgacggaauuuaucgaauauugcaacgaggguuacucgggaggucucaagucggaguaggagucuuucaagacggaguauuucauacaauguggcauguaacaagaggugccguccucauguaucaagggaaaagauuagaaccaucuugggcaagcgugaagaaagaucugauaucguauggcggcggauggcgauuucagggcucuuggaauacaggagaagaaguacaagugauugcaguugaaccuggcaaaaaucccaaaaauguacagacgaccccagguacauucaaaacgcccgaaggcgaggugggcgccauagccuuggauuuuaaaccagggacuagcggaucucccauugucaacagagaagguaaaaucgugggauuauauggcaauggcguagugacgacgucagggacauacguaucggcuauagcgcaagcaaaagcaagccaagaaggaccucuaccugaaauagaagaugaagucuuuaagaaacgaaacuuaacaauaauggauuugcaccccggcagcgguaaaacaagacgauaucucccggccauuguaagggaagcaauaaaacgaaaacuccgcacauuaauuuuggcacccacuagagugguagcgagugagauggcugaggcauugaaaggcaugccaauacgauaccagacaaccgcugugaaaucugaacauacuggacgagaaauugucgacuugaugugucacgcuacauucacuaugcgguuauuaucaccgguacgcguaccaaacuacaacaugauuauuauggaugaagcucacuuuacagauccagcaucaauagcggcacguggcuacauaagcacuagaguaggaaugggugaagcugcagcgauauuuaugacagcaacgccaccaggauccguggaagcguucccucaaucgaacgccguuauucaagaugaagaacgcgauauuccggaacggucauggaauaguggguaugauuggauaacagauuuuccugguaaaaccguuugguucgugccaucaauaaaaucaggcaaugacaucgcuaauuguuuaaggaaaaauggaaaaaggguaauucaguuaucaagaaaaacguuugauacugaguaccagaaaacuaaaaauaacgacugggauuauguuguaaccacggauaucuccgaaaugggugcgaauuuuagagcugauagagucaucgauccgaggcggugucuuaaaccuguaauccuuaaagacgggccagaaagaguaauacuagccggccccaugccaguuacaguagcgagugccgcacaaaggcgaggaagaauaggaagaaaccagaauaaggaaggagaucaauauguauauaugggacaaccauuaaacaaugacgaggaccacgcacacuggacagaagcaaaaaugcuucuugauaacauuaauacuccagaaggaauaaucccagcucuguuugaaccagaacgugagaaaagugcagcaauagauggagaauacagauugagaggugaagcuagaaaaacauuuguugaauuaaugaggagaggcgaccucccuguuugguugucuuacaaaguggcaagugaaggguuucaauauagugacagaagauggugcuuugacggggagcgcaacaaucagguuuuagaagaaaauauggauguugagauuuggacaaaagaaggggaaagaaagaaacuucgaccacguugguuagaugcucgaacguauuccgacccuuuagcccuucgcgaguucaaggaauuugcagcgggacguagaaguguaagcggugauuuaauacuggagauuggcaaauuaccacagcaucugacucuaagggcacaaaacgcacucgauaauuuaguaaugcuacauaacucagaacaaggaggaaaagcauaucgucaugcgauggaagaacuuccugauacaauagaaacccuuaugcugcuugcacuuauugcaguccugacugggggugugacacuauucuuucuuaguggaaagggucuaggaaaaacaagcauaggucuucucuguguaacagcaucgucggcauuauuguggauggcuucagucgaaccucauuggauagcagcuucuauaaucuuagaguucuuucucaugguacuacucaucccagaacccgauagacaaagaacaccucaagauaaucaauuggccuacgucguaauugguuugcuauucaugauauuaaccguugcagcaaacgaaaugggucugcuggaaacaacgaagaaagaucucggaauugguuacgucgcggcugagaaucaucagcaugcuaccaugcuagacguagauuuacauccugcaagcgccuggaccuuauacgccguagcuacaacagugaucacaccaaugaugagacauacgauagagaauaccacagcgaauauuucgcuuacugccauugcuaaucaagcagcuauacucauggggcucgauaagggauggcccauuuccaaaauggauaucggaguuccgcucuuagcacuaggguguuacucucagguuaauccccuuacccugacggcagcuguacucauguugguagcucacuaugcaaucauaggaccagguuuacaagccaaagcaacaagagaggcgcaaaagagaacagccgcgggcauuaugaagaauccaacagucgaugggauagucgcaauagaucuugauccaguaguauacgaugcgaaauuugaaaagcaauugggacaaauaaugcuuuugauacuauguacgucgcaaauauuauuaaugaggacaacgugggcguuaugugaaucgauaacucucgcaacaggcccccugacgacucuaugggaaggcucaccugguaaguucuggaauacuacgauagcgguguccauggcaaacaucuuccgaggaagcuauuuggccggagcaggucuagccuucagucuaaugaaguccuugggagggggacgacgcggcacgggugcucaaggugaaacacuuggagaaaaauggaaacgacaacuuaaucaauuauccaaaagcgaauuuaauaccuauaaaagaucagguaucauggaaguggacagauccgaggcuaaagaaggauuaaaaagaggggagacaacgaaacacgcgguaucaagaggaacugcaaaguugagaugguuuguggaacggaacuugguaaaaccagaggguaagguaauugaucuaggguguggucgcgguggauggucauacuacugugcuggucuaaagaaaguuacugagguaaagggcuauacuaaggguggcccagggcaugaggaacccauacccauggcaacuuaugguuggaauuuggugaaauuacacucgggaaaagacguauucuuuaugccacccgaaaagugugacacacuucuaugugauauaggcgaaucuagcccaaauccaacuauugaggaaggacgaacauuaaggguccuuaagaugguagaaccaugguugcgcggcaaccaauucuguauuaaaauucuaaaucccuauaugccaucuguaguagaaacccuggagcaaaugcagagaaaacauggcggaauguuggucagaaacccacugucucguaacagcacucaugaaauguauugggucucgugcggcacaggcaauauaguuucugcaguaaacaugacgagcaggaugcuccucaaucgcuuuacuauggcccaccgaaaaccaacuuaugagagagauguggacuuaggcgcggggacacggcacguggccguggagccggaaguagccaauuuagacauaauaggccaacggauugagaauauaaagaaugaacauaagucaacguggcauuacgaugaggauaauccuuacaaaaccugggcauaccauggaaguuacgaaguuaaaccaagcggaagugcgucauccaugguaaacggaguaguaagacuucucacgaaaccaugggaugugauccccauggucacacaaauagcgaugacugauacuacucccuucggacaacaaaggguauucaaagaaaaaguagacaccaggacuccacgcgcaaaacgcggaacaacccaaauuauggaaguaaccgcuaagugguuauggggguuucuuucuagaaauaagaaaccucgaaucuguacaagagaagaauuuacacgcaaaguacggaguaaugcugcuauaggcgcagucuuuguggacgaaaaccaguggaauagcgccaaagaagcuguugaagaugaaagguuuugggaucuaguacaccgcgagcgagagcugcacaagcaagggaaaugugcaacuugcguauauaauaugaugggcaagagagagaagaaacuuggugaauuuggaaaagccaaaggaucuagagccauaugguauauguggcuaggagccagauuuuuagaauuugaagcccuaggguucaugaacgaagaccacugguucucaagggaaaauagucuuagcgguguugagggagagggcuuacauaaacucgguuauauacuccgagauaucucaaaaauucccgguggaaacauguacgcugacgacacugcuggcugggauacacguaucacagaagacgauuuacaaaaugaggccaaaauuacagacauaauggaaccggagcacgcgcuacuugcaacgagcauauuuaaacuuacuuaucagaauaaagugguccgagugcaaagacccgcuaaaaauggaacggucauggauguuaucagucggcgggaccagagggguuccggccaaguugguacauauggccuaaauacauucacuaacauggaaguacagcuuauacgccaaauggaaucagaagggaucuuucuaccuucggaauuagagacaccaaaucuagcagaaagagcauuagauuggcucgaaaagcauggggcugagcguuuaaaacguauggcaauuucaggagacgacugugucguuaaaccaauagacgauagguucgcgaccgcauuaacggccuuaaaugauaugggaaaaguaagaaaagauaucccgcaaugggaaccaagcaaaggguggaaugacuggcaacaggucccguuuugcagccaccacuuucaucaguugaucaugaaagauggucgagaaaucguagucccauguagaaaccaagacgaauuaguggguagagcacgggugucucaaggcgccggguggucacuuagagaaacagccugccuuggaaaaucauacgcccaaauguggcaguuaauguacuuucacagacgugauuugagauuggcggcaaacgcuauaugcucagcgguuccaguugacuggguacccaccucuagaacuaccuggucaauacacgcacaccaccaauggaugacaacugaggauaugcuaucagucuggaaucggguguggauagaagaaaacccauggauggaggacaagacacaugucagcagcugggaggaaguuccguauuuggggaagagggaggaucaaugguguggaucucuaauaggauuaaccgccagggcaacuugggcaaccaauauucaaguagcaauaaaccaagugcgacgucuuauagguaaugagaacuaccuggauuauaugacaucuaugaagagauucaaaaacgaaucugauccugaaggcgcguuaugguaa

SEQ ID NO: 21419 - RNA, 9879 nt, Artificial Sequence
  derived and/or modified CDS sequence (opt6) from DENV-1__FJ639815__SS-prME
ucuguaacgaugcuauuaaugcuuuuaccaaccgcgcuggcguuucauuugacuacacguggaggcgaaccgcauaugaucguaagcaaacaagaaagaggaaaaagccuacuauuuaaaaccucagcgggagugaauauguguacucuaauugcaauggauuuaggugaauuaugugaagauacuaugacauacaaauguccgagaauuacugaagcugaaccagaugacguggauugcuggugcaaugccacagacacgugggugacauauggcacaugcucacaaacuggagaacauagacgagagaaaagaucaguagcauuagccccucauguaggacuaggccuagaaacacgaacagaaacauggaugucaucagaaggugcauggaaacaaauacaaagagucgaaacuugggcccuaagacacccgggauuuacaguuauagccuucuuuuuggcgcacgcaauuggcacgucaaucacgcaaaaaggcauuaucuuuauauuguuaaugcuuguaacuccgaguauggcuaugcgcuguguuggcauuggaaaucgcgauuucguugaaggauuaucaggagcuacuuggguagauguaguucuugaacaugguucuugcguaacuacaauggccaaaaauaaaccuaccuuagauauugaauuauuaaaaacagaagucacuaacccagcaguucugagaaaacucugcauagaagcaaaaauuagcaacacgacaacagacucgcgauguccuacgcaaggcgaagcuacucuaguggaagaacaagaugcaaauuucguaugucgaagaacuuuuguagaccgaggauggggaaauggauguggauuauuugguaaaggcucacuacuuacaugcgcuaaauucaaauguguaacgaaacuagagggaaaaaucguacaauacgagaaccucaaauacuccguaauuguaacgguacauaccggggaccaacaucaaguaggaaacgaaacgaccgagcacggaacaaucgcaacgauaacaccacaagcgccgaccucggagauccagcuaacugauuauggggcucuaacacuagacugcaguccaagaacuggauuagauuucaaugaaauggucuuguuaacaaugaaagaaaaaucaugguuaguccauaaacaaugguuucuugauuuaccgcuuccauggacaaguggagcaaguacaucgcaagaaacuuggaacagacaggaucuccugguuacuuuuaaaaccgcacaugcgaagaaacaagagguaguaguuuuagggagucaggaaggcgccaugcacaccgcauuaacgggugcaacagaaauacaaacaucgggaacaacaacgauauuugcaggucaucuaaaauguagauuaaaaauggacaaauuaacacugaaagguaugucguaugucauguguacggguucauuuaaauuagaaaaagagguugcagaaacacaacaugguacaguccuaguacagguaaaauaugaaggcaccgaugcuccauguaaaauuccauuuucaacucaggaugagaaaggaguaacucaaaauggucggcucauaacagcuaauccaauugugacugauaaagagaaaccaguaaacauagaaacagagccaccguuuggcgagucauauauaguagucggggcuggggagaaagcauuaaagcuaucaugguuuaaaagagguagcucuauugguaaaauguuugaagcgacggcacguggugcuagacguauggcuauauuaggggacacugcuugggauuuuggaaguauuggaggaguauuuacaaguguaggaaaauugguacaucagguguuugggacagcauacggaguacuauuuagcggcguuucauggacaaugaagauaggaauagggauccuauuaacguggcucggacuaaacucccgaaguacaagccuaucgaugacauguaucgcuguugggauggucacauuauauuuaggggugaugguacaggcagauucagguugcgugauaaacuggaaaggaagggaauugaaauguggaaguggaauauuuguuacaaacgaaguucauacuuggacugaacaauauaaauuucaagccgacaguccuaaaagauuaucagcagccauuggaaaagcaugggaggagggaguaugcgggauuagaagugccacucgacuugaaaacauaauguggaaacaaaucucuaacgagcucaaucauauccucuuggaaaacgauaugaaauuuacuguuguugucggugacgcuaauggaauuuuggcacaaggaaagaaaaugauacgaccacaaccaauggaacauaaauacaguuggaaauccugggguaaagccaaaauuaucggcgcggacauccaaaacacaacuuuuauaauagacggcccagacacacccgaaugccccgauggacaaagagcuuggaacauaugggagguggaagauuacggauucgguguguuuacuaccaauaucuggcuaaaacuucgugauucauacacacaaaugugugaucaucgucuuaugagugcagcaauaaaagauucaaaagccguccaugcggacaugggauauuggauugaauccgaaaagaaugaaacauggaaacucgcaagagccucauucauagaaguaaaaacuuguacuuggcccaaaucccauacauuauggaguaauggaguacuagagagugagaugauuauuccaaaaauuuauggaggcccaauaucacagcauaauuauagaccaggcuauuucacacaaacagcaggaccuuggcaucuggggaaauuagaauuggacuuugauuuaugcgaagguacuacuguaguuguggaugagcauugugguaaucgggggcccagcuugcgaacaacaaccgucacaggaaagauuauacacgaaugguguuguagaucaugcacccuacccccauugcgauuuagaggugaagacggauguugguauggcauggagaucaggccaguuaaagaaaaagaagaaaaucuaguaagaucgaugguuagcgcuggguccggcgaaguagauucauucagucugggaauauuauguguaaguauaaugauagaagaaguaaugcgaucgcgauggucacgcaagauguuaaugacugggacauuagcuguauuccuccuccuaauaaugggucaacugacauggaaugacuuaauccgacugugcauaaugguuggagcuaaugcaucagacagaaugggaauggguacaacguaucuagcuuuaauggcuacuuuuaaaaugcgaccuauguuugcuguagggcuacucuuucgccgacuuacuagcagggaaguacuucuacucacaauagggcuauccuuaguggcaucaguagaauugccaaauagucuugaggaacugggugaugguuuagccaugggaauuaugaugcuaaaauuacuuacagaauuucaaccucaccaacucuggacaacuuuauuaucuuugacguucgucaaaacuacacuaucucuagauuaugcauggaagacgacugcuaugcuacuuaguaucgucucacucuucccccuauguuuaagcacgacgucgcagaaaacuacgugguuacccguucuuuuagguagcuuugggugcaaaccguugacuauguucuuaauaaccgaaaauaaaauuugggguaggaaguccuggccucugaaugaagguauaauggcgauugggaucguuagcauauuacuuaguucccugcugaaaaaugacguaccuuuagccggaccguuaaucgcuggaggcaugcucaucgcuuguuauguaaucagugggaguagcgccgaucuaucccucgagaaagcugcugagguaaguugggaacaagaggccgaacauucuggagcuagccauaacauucucguagaaguccaagacgacgguacgaugaaaaucaaagaugaagaacgcgaugacacauuaacaauucucuuaaaagcgacccuauuagcugugaguggaguauauccaaugucgauaccugcgacgcuauuugugugguauuuuuggcaaaagaagaaacaacgaucaggaguauuaugggauacaccuucaccaccugaaguagaacgugcugucuuagacgauggaauuuauaggauucuucaaaggggauuacuugggcgaucacaagugggaguuggagucuuucaagauggaguuuuccauacuauguggcauguuaccagaggggcuguccuuauguaccaaggcaaaagauuagagccaaguugggcaucagucaagaaagaucuuauaaguuauggaggagguuggagauuccaaggcagcuggaauacuggcgaagaggugcaaguuaucgcuguugaaccugggaagaauccuaaaaauguccaaacaaccccgggaacuuuuaaaacgccggagggagaaguuggagcgaucgcguuagacuucaaacccggaacaucaggaucuccuauaguuaaucgagaaggcaagaucguuggacuauaugggaacgguguaguuacaacaucaggaacauacguaagugcgaucgcgcaagcgaaagcuagucaagaggggccguuaccugaaauugaagacgaaguuuuuaagaaacgaaaccuaacuauaauggauuugcaccccggaucggguaaaacuaggcguuaccugccugcuaucguccgugaagcuauuaaacggaaacuccgcacccucauccuagccccaacgaggguaguagcaagugaaauggcugaagcccuuaaggggaugccuauaagauaucaaacaaccgcgguaaaaucugagcacacgggaagagaaauuguagacuugaugugucacgccacuuuuacuaugagacuccuuagcccgguucgagugccuaacuacaauaugauuauaauggaugaagcacauuucacugauccagcaucaaucgcagcacgaggcuauauaucuacacgcguagguaugggagaagcugccgccauauuuaugaccgcuacaccuccagguagcguugaggcauuuccucaaucaaaugccguaauccaagacgaagaaagggauaucccagaaagaaguuggaauaguggguacgacuggauaacggauuucccaggaaaaacaguaugguucguaccgucuauuaaauccgggaaugauauagccaauugucuaaggaaaaacgggaaaagaguuauucaacuaucaaggaaaacuuuugacacugaguaucaaaagacuaaaaacaacgacugggacuauguuguaaccacagauauaucagaaaugggagcaaauuuuagagcugaccguguuauugacccacguagaugcuugaagccaguuauacuaaaagacggccccgaacgggucauucucgccggacccaugccaguuaccgucgcauccgcugcccaacgacgaggucgaauugguagaaaucaaaauaaagagggagaucaguauguauacaugggacaaccucuaaauaaugaugaggaucaugcacacuggacugaagcuaaaaugcugcuagauaacauaaacacacccgaaggaauaauuccugcgcuauucgagccagaacgcgagaaaagcgcugcuauugacggagaguauagacuucgaggcgaagcacgcaagacauuuguagaauuaaugagacguggcgaucuuccaguaugguuauccuauaaaguagcgucggaaggauuucaauauucugaucgccgaugguguuucgacggagaaagaaacaaucaaguguuggaagagaauauggauguugaaaucuggaccaaagaaggggagcgcaagaaauuacgccccagguggcuggaugcacgaaccuauagcgacccucuugcauuacgggaguucaaagaauuugcugcuggccgacggucgguuucuggagaucucauauuggaaauuggaaaacuuccgcaacaucuaacacuaagggcacagaaugcccuugacaaccuugucauguuacauaauucugaacaaggaggaaaagccuauagacaugcaauggaggaacuucccgauacuauagaaaccuugaugcuacuggcucuaaucgcaguacucacaggcgguguaacucuauucuuuuuaucuggaaagggucuaggaaaaacaucaauugguuuguuauguguuacagccucuucugcacuauuauggauggcaucaguggagccccacuggauagcugcuaguauaauucucgaguucuuccuuauggucuuauuaauaccggaaccggaucgccaaagaacaccgcaggauaaucagcuggcguauguuguaaucggauuauuauuuaugauccuaacaguagcagcaaacgaaaugggccuauuagaaaccaccaagaaagacuuagguauaggauauguagcugcggaaaaucaccaacacgcaacaaugcucgacguugaucuacauccugccucagcauggacauuauaugcuguugcaaccacagucauaaccccgaugaugcggcauacaauagaaaauacaacagcgaauauuucguugacagcuauugcuaaccaggcagcgauacucaugggucuagauaaaggauggccuauaucuaaaauggauauaggaguaccauuauuagcauuaggcugcuacucgcaaguaaauccacuaacuuuaacugcagcaguacucaugcuaguagcacauuacgccauaauugguccaggacuacaggcaaaagccaccagggaagcucaaaagcguacagcagcagguauuaugaaaaaccccacaguugacgggauaguagccaucgacuuagauccuguggucuaugaugccaaauuugagaaacaguuaggucagauaauguuacucaucuugugcacuucacagauauuauuaaugcgcacaacuugggcgcuuugugaaagcauuacgcucgcgacgggaccauuaacaacccuaugggaagguagucccgguaaauuuuggaauacaacuauugcugugagcauggccaacauuuucaggggcucauacuuagcaggggccggucucgcguucucgcugaugaaauccuuaggcgggggaagaagaggaacgggagcgcaaggagagacauuaggcgaaaaguggaagcgacaacuaaaccagcuaucgaagucugaguucaacacauauaaacguaguggaaucauggagguggauagaucugaggcaaaagaagggcuuaagagaggagaaaccacuaaacaugcuguaaguagaggaacagcaaaguugagaugguuuguagaaaggaauuuaguaaaaccggaaggcaaagucauagaucuaggaugugggagagguggauggucauacuacugugcuggucucaagaaagucaccgaagugaaaggauacacaaaaggaggucccggccaugaggaaccaauaccaauggcgacuuacggauggaaccuuguaaaacugcauagugggaaggacgucuuuuucaugccuccagaaaaaugugauacacuuuuaugcgauauuggggagucaucuccuaauccaacaauagaggaaggacguacguuacgaguacuaaaaaugguagaaccuuggcuacgcggcaaccaauucugcaucaaaauauugaaccccuacaugccaagcguaguagaaacccuagagcaaaugcaacggaagcauggaggaaugcuagugcguaaucccuugagucgcaacucaacucacgaaauguacugggugucgugugguacuggcaacauaguaucugcugucaauaugacaagucgaaugcuauuaaauagauucacaauggcucaucgaaagccaacuuaugaaagagauguagaucuuggagcaggaacuagacauguagcaguugagccagaaguggcaaaccucgauauaauaggacaaagaauugagaauauuaaaaaugagcauaaaagcacuuggcacuaugacgaagacaacccauacaaaacuugggcauaccauggaucauacgaagugaaaccuucaggcucagcaucuucuaugguuaauggaguaguaagacuccucacaaagccaugggauguuauaccuauggucacccagauugcaaugacagacacgacacccuuuggacaacaacgcgucuucaaagaaaaaguggauacaagaacuccgagagcaaaacgggguacuacacaaauuauggagguuaccgcuaaaugguuguggggguuccuuucaagaaauaagaaaccgcguauuugcacuagggaagaguuuacuaggaaaguacgaucgaaugcagcaaucggggcaguuuucguagacgaaaaucaauggaacucugcaaaagaggcgguugaagaugagcgcuucugggaccuaguucaccgugagagagaacugcauaaacagggcaagugcgccacuuguguguacaacaugauggggaaacgugagaagaaauuaggugaauuugguaaagccaaagguucccgugcuauuugguauauguggcucggggcaagguuccucgaguucgaggcguuaggauucaugaacgaagaucauugguucucuagagaaaauucucuauccggggucgaaggagagggucuacauaaacuaggauauauacucagggacauaucaaagauuccaggcgguaauauguacgcggaugauacagcuggaugggacaccaggauaacugaagaugacuuacaaaaugaagcuaaaaucacggacaucauggaaccagaacacgcacucuuagcaacuagcauauuuaaauugacauaucaaaacaaagucguaagagugcaacguccugcuaaaaauggcaccgugauggaugugauaucaagacgagaucaaagagggagugggcaaguaggaacauauggacuaaauaccuuuacuaacauggaaguacaauuaaucagacagauggaauccgaaggcauauuucuaccaucagaacuagaaacaccgaacuuagcugaaagagcgcuagauugguuagaaaaacauggagccgaacgccuaaagaggauggcgaucagcggugaugacugugucgucaaaccaauugaugacagguuugcaacagcauugacagcacucaaugauaugggcaaaguaagaaaagauauuccgcaaugggaaccaucaaaaggguggaacgauuggcagcaaguaccguuuuguagccaccacuuccaucaauuaaucaugaaagacgguagagaaauuguaguccccugucgaaaucaggaugaauuaguuggucgcgcacgaguaagccaaggugcaggguggucauugagagaaacagcaugccuuggaaagucauacgcacaaauguggcaauuaauguacuuccacagacgagacuuacgacucgcagcaaaugcuaucugcagugcuguaccuguagauuggguacccacuucaaggacaacguggucaauacacgcucaccaccaauggaugacuacggaggauaugcuuucaguauggaaccgaguuuggauugaagagaauccguggauggaggauaagacacauguuaguuccugggaagaaguaccauacuuagguaaacgagaagaucaauggugcggaucauugauaggguuaacugcacgggcaacaugggccacaaauauccaaguagcgaucaaccagguccggaggcucauagguaaugagaacuacuuagacuauaugacaagcaugaaacgguucaaaaaugaaagcgauccagagggugcauugugguga

SEQ ID NO: 21420 - RNA, 9879 nt, Artificial Sequence
  derived and/or modified CDS sequence (opt6) from DENV-1__FJ639818__SS-prME
agugugacaaugcuuuuaaugcuuuuacccacugcuuuagcauuccauuuaacuacgcguggaggggaaccacauaugauagucucuaaacaagaacgugguaaaagccuccuguuuaaaacaagcgcaggagugaauaugugcacauugauagcgauggaccugggagaauuaugugaagauacgaugaccuacaaaugcccaaggauaacugaggcagaaccugaugacguagacugcugguguaauacaaccgauacguggguuacauaugggacguguucucaaacaggagaacauagacgugacaaaagaagugucgcguuagcuccgcauguaggucuugguuuagaaacacguacagaaacauggaugucaucugaaggugcguggaaacaaauccaacggguugaaaccugggcccuaagacauccuggcuucacagugauugcgcuauuuuuggcucacgcuauaggaaccucuauaacccaaaaaggaauaauauuuauucuuuuaaugcuugugacaccaucuauggcuaugcgauguguaggcauugggaaucgggauuuugucgaaggucuuucuggggcaaccuggguagauguuguuuuagaacauggcucauguguaacaaccauggcuaaaaacaaaccaaccuuagauauagaacuacucaaaacagaagucacaaauccugcuguccugcgcaaauuauguauagaagccaaaauaaguaauacaacaacugacagccgauguccgacucaaggagaagcaacacuuguagaagaacaagaugccaauuuugugugcagaagaacuuuuguugauagaggcugggggaauggaugcgguuuguuuggaaaagguucgcuucuuacuugcgccaaauucaaaugcguuacuaaacuugaaggaaaaauaguucaguaugaaaauuuaaaauacucggucauaguaacuguucacacuggugaccaacaucaaguugguaaugaaacaacagaacauggaacuauagcaacuauuacgccgcaagcgcccacaucagaaauucagcuaacugauuauggagcauuaacuuuagacuguuccccaaggacaggcuuagacuucaaugaaaugguauuguugacaaugaaagagaaaaguuggcuaguacacaaacaaugguuuuuggaucuaccguuaccguggacaucgggugcaucgaccagccaagaaacguggaaucgacaggacuuacuuguuacauucaaaacagcacacgccaagaaacaagaaguaguugucuuagguucacaagagggagccaugcacacugcucuuacgggugcaaccgagauucagacgagcggaaccacuaccauuuuugcuggccaccucaaaugcaggcucaaaauggaaaaauuaacauuaaaagguaugucuuauguuaugugcacagggucuuuuaaacuagagaaagaagucgcggaaacacagcacggaacaguacucgugcagguaaaauaugaggguacggaugcccccugcaaaauuccuuucaguacccaagaugaaaaagguguaacgcaaaauggucggcuuauaacggcuaaucccaucgucacugauaaagaaaaaccagugaacauagaaacagagcccccauuuggcgagaguuauauaguaguaggagcaggcgaaaaggccuuaaaacugagcugguuuaagaaagguaguucaauagguaaaauguucgaagcaacugccagaggggcucgacguauggcgauucugggggauacagccugggacuuugggaguaucgguggcguauuuacaucuguuggaaaauuaguacaucaaguauuugggacggccuauggaguguuguucucgggaguuaguuggaccaugaaaauaggcauaggcauacuuuuaacguggcuuggacuaaacagucgaagcaccagcuugucuaugaccuguauagcuguuggaauggucacacuauauuuagggguaaugguacaggcagacagcggaugcgucauaaacuggaaaggaagagaauuaaaaugugggucugguauauucgugacuaaugaaguccacacauggacagaacaauacaaauuccaggcagauaguccaaaacgucuaucagcagcaauuggcaaggcuugggaagagggcgugugugguaucagaagugccacgcgauuagagaauauaauguggaaacaaaucuccaacgaacugaaucauauccuucuggagaaugauaugaaguuuacaguaguuguaggcgacgcgaauggcauuuuggcgcaaggaaagaaaaugauaagaccccaacccauggaacacaaauacucuuggaaaucguggggaaaagcgaaaauaaucggggcagauauacagaacacaacguucauuaucgauggaccagauacaccagaauguccugauggccaaagggcuuggaauauaugggaaguugaagacuacggcuuuggaauuuuuacaacuaacauuuggcuuaaacucagagauuccuacacccaaaugugcgaucaccguuugaugagugcugcaauaaaagacuccaaagcgguccaugcggauaugggauacuggauagaauccgagaaaaaugaaaccuggaaacuugcaagagccaguuuuauagaagucaagacgugcacuuggccaaaaagucacacacucuggaguaauggaguucuugaaucugaaaugauuauaccuaaaaucuacggaggaccaauaagucagcauaacuacagaccaggauauuuuacacaaacagcugggccuuggcacuugggaaagcucgaauuagauuuugaccuaugugaaggcacaacaguaguaguagaugaacauugcggaaauagagguccgaguuuaagaacuaccacuguaacaggaaagauaauccaugaauggugcugcaggucaugcacgcuuccuccucuccgauuuagaggugaagauggcuguugguacgguauggaaauacggccaguaaaagaaaaagaagaaaauuuagucagguccauggugagugccggcagcggugaaguugauaguuuuagucuggggauauuauguguaucaaucaugauagaagaagucaugagaucaagauggaguaggaaaaugcuaaugaccggaacacuggcuguauucuuauuacucauuaugggucaauuaacuuggaacgacuuaauuagauuaugcaucauggucggagccaacgcuuccgauagaaugggaaugggaacgacacaucuagcucucauggcaacauuuaagaugagaccaauguuugcggucggucuuuuauuuagaagacuuacaagucgugaaguucuccuacuaacgaucggauuaucacucguagcuaguguagaguugccaaacucacuugaagaacuuggagacggacuggcgauggggauaaugaugcugaaguuauuaacugaauuucaaccacaccaacuuuggaccaccuuacucucauuaacuuucgucaaaaccacauuaucuuuggauuacgccuggaaaacuacggcaaugguacuaucgauaguuaguuuauuuccauuaugucuaaguacuaccucacagaagacaaccugguugcccguuuuauugggcucauucgggugcaagccauuaacuauguuccuaauuaccgagaacaaaauauggggacguaaaagcuggccucuaaaugaaggaauuauggcuaucgggauaguaucaaucuuacuaucaagucugcuuaaaaacgacguaccacuagcggggccgcugaucgccggcggaaugcucauagcuuguuauguuauaaguggaucuucagcagaccugaguuuagaaaaagcggcagagguuucaugggagcaagaagcagaacauagcggcgcuucccauaauauccuugucgaaguucaggaugacggaaccaugaaaauaaaggaugaagaaagagacgauacacuuaccaucuuauugaaagccacucuguuagcaguauccggugucuaucccaugucuauccccgcaacgcuuuuugucugguauuucuggcagaagaagaaacaacgcagcggcgucuuaugggacacuccaucaccaccagaagucgaaagagcuguauuagaugaugggauauauagaauacugcagcguggauuauuaggcagaucccaagucggugucggcguauuucaagauggaguuuuccauacgauguggcaugugacccgaggugcaguacuuauguaucaagggaaaagacuagaacccucaugggccagcguuaaaaaggaucuaauuucuuaugggggaggauggagauuucaaggaaguuggaauacaggggaagaaguacaagucauugcuguggaaccagguaaaaacccuaagaauguucagacgaccccaggaacguuuaaaacaccggaaggugaagucggagcaaucgcuuuggacuucaagccaggaacgucagguucaccgaucguuaauagagaaggaaaaauuguugguuuauacggaaauggugucgugacuacguccggaacguauguuucugccauagcgcaagcuaaagccucacaagaggguccucuuccggaaauugaggaugagguuuuuaagaaaaggaaccuaacaaucauggaucuacaucccgguuccggcaaaaccaggagauacuuaccagcaauagucagagaagccauaaaaaggaaguuaagaacauuaauacuagcaccuacacgaguaguggcuagugaaauggcugaggcucuaaaaggaaugccuauucgguaucaaacgaccgcgguuaaaucagagcacacaggccgagaaauuguugaccugaugugccacgcaacauucacuaugagauuacuaagcccaguacggguaccaaauuauaacaugaucauuauggacgaagcgcacuuuacggacccugcuagcauagcugcgagaggguacauuuccacuagaguaggaaugggagaagcugcugcaauauucaugacggcuacaccucccggcuccguagaagccuuuccacagagcaaugcagucauacaagaugaagaacgagacauacccgaacgaucguggaauagugguuaugacuggauaacugauuuuccaggcaaaacuguaugguucguuccuaguauaaagucugguaacgacauugccaacugcuuacgaaagaaugguaaaaggguaauacaacuauccagaaaaacauuugacacagaguaccagaaaaccaaaaauaaugacugggacuacguuguaacuacugauaucuccgaaaugggcgcuaauuuucgcgcugacagagugauagauccucgucggugucugaaaccaguaauuuuaaaggaugggccugaaagagucauauuggccgggccaaugccagucacuguagcaagugcggcacaaagaagagggagaauagguaggaaccagaauaaagaaggagaucaauacguguauaugggacaaccucugaauaacgaugaagaccaugcacacuggacugaagcaaaaaugcuccuugacaacauaaacacaccagaagguauaauaccugcauuauuugaaccagaaagagagaaaucugcggcgauagauggagaauacagacuucgaggcgaagcaaggaaaacauucgucgaguugaugagacgcggugauuuaccuguauggcuaucauacaaaguggcuagugagggcuuucaauauagugaucgcagaugguguuuugacggugaaagaaauaaucagguccuugaggaaaauauggauguggagauauggacaaaagaaggcgagaggaagaaacuuagaccgagauggcuagacgcccgaacguacagugacccgcucgcuuuaagggaguuuaaagaauuugcugcugguagaagaagugucucaggagaccucauacuagagauagggaaauuaccucaacauuugacauugcgggcccaaaaugcguuggauaaucuaguaauguugcauaauagcgagcaaggagguaaggcuuauagacaugcaauggaagaauuaccagauacgauugagacgcuaaugcuguuggcacucaucgcgguacuuacagggggcguaacacuuuucuucuuaucuggcaagggccuagguaagacaucuauuggcuuguuauguguaacugcuucaagugcauuacuauggauggcgagcguggaaccgcacuggauugcagcaucaauaauauuagaguucuuucugauggucuuacuaauucccgagccagauagacaaaggacgccgcaagacaaucaauuagcauacguuguuaucggccuauuauuuaugauacuaacuguggcagccaacgaaaugggccuccucgaaacaacaaagaaagacuuagguaucggauacguagcagcagaaaaucaucagcacgcaacuauguuggauguugacuuaagacccgcauccgcguggacacuauaugcuguugcuacuacugucauaacaccuaugaugcgacauacuauagaaaauaccacggcuaacaucucuuugaccgcaauugcaaaucaggcugcuauucuuaugggauuagauaagggguggccuauaucgaaaauggauauagguguaccccuacuagcacuaggguguuauagccagguaaacccucuuacacuaacggcggcuguucuaaugcuaguagcgcauuacgcuauaaucgguccgggacuucaagcaaaggcuacuagagaagcgcagaaaaggacagcugcaggcauaaugaagaacccaacaguugauggaauuguugcgauagacuuagacccaguuguauaugaugcaaaguucgaaaagcaauuaggucagauaaugcuguuaauucuauguacuucacaaauucuauuaaugaggacaacuugggcccucugugaaucaauuacacuggcgacaggaccguuaacaacacuaugggaggggagcccaggcaaauucuggaacaccacuauugcaguuucuauggcuaauauuuuucgaggaucauaucuggccggagcaggauuggcauuuuccuuaaugaagucuuuaggcggaggacgaagagggaccggcgcacagggggaaacguuaggagaaaaauggaagcgacaacuaaaccaacuaagcaaaucagaguuuaauacauauaaacggagcgggauuauggagguagaucguucagaagccaaagaaggacugaaaagaggagaaacuacuaaacacgcaguuagccguggaacggcaaaauugagaugguuuguagaacguaaucugguaaaaccagaaggaaagguuauagacuuaggaugugguagaggugguuggucauauuauugcgcaggccugaaaaagguaacggaaguaaagggauauacuaaaggggguccaggacaugaagaaccaaucccuauggccacuuacggauggaaccuaguaaaacuucauaguggcaaagacgucuucuuuaugccaccagaaaagugugauacuuuacuuugugacauaggagaaaguaguccgaauccaacgauagaagaaggacgcacguugaggguauuaaagaugguagaaccauggcuaaaagggaaucaauuuuguaucaaaauacuuaauccguauaugccaucgguugucgagacuuuagagcagaugcagcggaaacacggugggaugcuaguacguaauccacugaguaggaauaguacccaugagauguacugggucucgugugggacagguaacauugucagugcaguaaacaugacgucucgaaugcuacuuaaucgauucacaauggcccacaggaaaccaacuuaugaaagagacguagacuuaggagcagguacccgacacguagcuguggaaccggagguagcuaacuuggauauuauuggacaaagaauugaaaacauuaagaaugaacacaaaagcacauggcauuaugaugaagacaauccauauaaaacuugggcguaucaugguagcuacgaaguaaaaccuucugggucugcaucuuccaugguaaauggcgucguuagauuacucacaaaaccaugggacguaauaccaaugguaacacaaauagcaaugacagauacaacaccuuucggacaacaacgaguguuuaaggaaaaagucgauacuagaacaccacgagcaaaacgaggcacaacucaaauuauggaaguuacagcaaaauggcucugggguuuucuuucaagaaacaagaaaccacgaauauguacuagagaagaauuuacaaggaaaguacguuccaacgcagcuaucggugccguuuuuguggaugagaaucaauggaauagcgccaaggaagcaguggaggacgaaagauuuugggauuuaguccauagagagagagaguuacauaagcaaggcaaaugcgcuaccugcguauauaacaugaugggaaagagagagaagaaacugggggaauuuggcaaagcaaaaggaucucgggcuauuugguacaugugguuaggcgcccgauuuuuagaguucgaagcacuuggauuuaugaaugaagaccauugguuuaguagagaaaacucacucucugguguggagggcgaaggauugcauaaauugggguacauuuugagggacauuagcaaaauuccagguggcaauauguaugccgaugauacugcaggaugggauacuagaauaacagaggaugaucuccaaaacgaggcuaaaauaacggauauuauggagccugaacaugccuuacuugcaacgagcauauuuaaguugacauaucagaacaaaguaguuagaguacaacgcccagccaaaaacggaacaguaauggaugugaucucuagacgugaucagcgagguucaggacaagucgguacguaugguuuaaauaccuucacuaacauggagguucagcucauuagacaaauggaaagcgaagggauauuucuaccaucagaauuagaaaccccaaacuuagcugaaagagucuuagacugguuggagaagcauggcgcugaaagacuaaaaagaauggcaauuucuggagaugacugcguaguuaaaccgauagacgauagauucgccacugcgcuuacugcuuuaaaugacauggguaaagucaggaaagauauuccacaaugggaacccaguaaaggauggaaugauuggcagcaaguuccuuuuugcucucaucauuuucaucaacuaauuaugaaagauggaagagaaauaguaguccccugccgaaaucaagaugaauuaguaggcagagcgagaguaagccaaggagcuggcuggucuuugagagaaacggccugucuugggaaauccuaugcacaaauguggcaacuaauguacuuccacagaagggauuuaaggcuggcggccaaugcgauaugcuccgcuguaccaguggacuggguaccgacuucaaggacuacauggucaauacaugcucaucaucaauggaugacuacugaagauauguugucaguuuggaacagaguuuggauagaggaaaacccguggauggaagauaaaacucacguuucaucuugggaggaaguucccuaucuagggaagcgggaagaucaauggugcggaagucuaauugguuugacagccagggcaacgugggcuacaaacauucagguagcaauuaaucaaguuagacgucugauaggaaacgagaauuaucuagauuauaugacuucaaugaaaagguuuaagaaugaaagcgauccugaaggcgccuugugguga

SEQ ID NO: 21421 - RNA, 9879 nt, Artificial Sequence
  derived and/or modified CDS sequence (opt6) from DENV-1__FJ639819__SS-prME
agcgucaccauguuacuuauguuacugccaacugcucucgcguuucacuuaacaaccagagggggcgaaccccauaugauagugucaaaacaagaacgagggaaaucgcuacucuuuaaaacaagugcggguguaaacaugugcacccuaaucgcaauggaucuaggagaacucugcgaagauacaaugaccuacaagugcccuagaauuaccgaagcagaacccgacgacguagacuguuggugcaacgcuacugauacauggguaacauauggaaccugcucacaaacaggagaacauaggcgagaaaagagauccguugcucuagcgccgcacguagguuuaggccuugaaacccgaacugaaaccuggaugucaagcgaaggagcauggaagcaaauucagcgagucgaaacgugggcgcuacgacauccuggauuuacggugauagcauucuuucuagcucaugcgauugggacaagcauaacacaaaaagguauaauauucauacucuugauguuagugacaccaucuauggcaaugagauguguuggcauagggaaucgagauuucgucgaaggucugaguggagcgacauggguagauguugugcucgaacauggcucgugcguaacaaccauggcgaaaaauaagccuacacuagauauagaacuucugaaaaccgaagugacgaacccugccgugcuaagaaaacuauguauagaagcuaaaauaucaaauacuacaacggacucaaggugucccacucaaggugaagcaaccuuagucgaagaacaagaugcgaauuucgugugucguagaacauuugucgaucggggauggggaaacggaugcggccuuuucggaaaaggaucucuacuuacaugugccaaauucaagugcguuaccaaauuagaagguaaaaucguucaauaugaaaauuuaaaauacagcgugauugugacaguacauaccggugaccaacaucaagugggaaacgaaaccacggaacacggcacgauugcaacuauuacgccacaagcuccaacuucagaaauucaacuaacugauuauggagcgcugacccuugacuguagcccaagaacggggcuagauuucaaugaaaugguuuuacuuaccaugaaagaaaaaucauggcuuguacauaaacaaugguuucuugauuuaccuuuaccuuggacaagcggggcaucaacaagccaagaaacauggaaccgucaggaucuuuugguaaccuuuaagaccgcucacgccaagaaacaagaaguaguaguccuagguucacaagagggagcgaugcauacugcccucacuggagccacagagauccaaacaucaggcaccacuacaaucuucgcaggucauuuaaaaugucgucuaaaaauggacaaauuaacauuaaaaggaaugagcuacgucaugugcacuggaucauucaaguuagaaaaagagguugcugagacacaacacggcacaguacucguacaagucaaauaugaaggaacugaugcaccuuguaaaauaccauucucaacacaagacgagaaaggaguaacgcaaaacggcagacuuaucacggcuaaucccauaguaacggacaaagaaaaaccaguaaacauugagaccgaaccgccguucggagaaagcuauauagugguuggagcaggagagaaagcguuaaaauuaucaugguuuaaaagaggauccagcauagguaagauguuugaggcaacagcacguggagcuagacguauggcuauucuuggugauacugccugggacuucggcagcauuggcggugucuucacuucagugggaaaguugguacaccaaguauuuggaacagcguacggggucuuauuuagcggcguaaguuggaccaugaaaauagguauugguauucuacuuacuugguuaggcuuaaacucaaggucaacgagucuaagcaugaccuguauugcaguaggaauggucacacuuuauuugggaguuaugguacaagcagacucagguugcguuaucaacuggaagggucgagaauuaaaaugugguaguggaaucuuugucacuaaugaaguucauacauggacugaacaauacaaguuccaggcugauagccccaaacgauuguccgcugccaucggcaaggcaugggaagaaggcguguguggaaucagaagugcuacucgauuggagaauaucauguggaaacaaaucucaaacgaauugaaccauauauuauuagagaacgauaugaaauuuacuguuguaguaggggaugcaaauggaauauuagcucaaggcaagaaaaugauacgaccgcagccaauggaacauaaauauucguggaaaucgugggguaaggcaaaaauaauuggagcagacauccaaaacacaacauuuaucauagauggccccgacaccccagaaugcccggauggacaaagagcauggaauauuugggaagucgaagauuacggauuuggaauuuucacuacaaacauuugguuaaaacuuagagacucauacacucagaugugugaccaccggcucaugucugcagcaauaaaagauaguaaagcaguacaugcagauaugggcuauuggauugaaucagagaaaaaugaaaccuggaaacucgccagagccagcuuuauugaaguuaaaacauguacauggccaaaaucucacacgcucuggagcaacggaguauuggagagcgaaaugaucaucccgaaaauauacggugguccuauaucacaacauaacuacagaccaggauacuucacccaaacagccgggccguggcacuuagggaaacuugaacuagacuucgacuuaugcgaagggacuacaguuguugucgacgagcauugcggaaauagagguccuuccuuaagaacuacgacgguaacaggcaaaauuauacacgaaugguguugccguagcugcacacugccuccauuaagauuccgaggugaagacgguugcugguacggaauggaaauacggcccguuaaggagaaggaagagaauuuaguccguucaauggucagcgccgguucaggcgagguugacaauuuuagucuagguauauuauguguaucgauaaugauagaagaggucaugaggagcagauggucccgcaagaugcuuaugacugguacauuagcaguauuucugcugcuaauaaugggccaauuaacuuggaacgauuuaauaagacucuguauuaugguaggcgcaaaugcaucagauagaaugggaaugggaacaacauauuuagccuugauggcuaccuucaaaaugcgaccaauguuugccgugggacuacuauuuagaaggcuaacaucacgugaagucuuacuacuuaccauaggucuaucccucguugcaagugucgaauuaccgaacucccucgaagaacugggugacgguuuggcaauggguauuaugauguugaagcuacuaacagaauuucaaccacaucaauuauggacgacauuguugucacuaacauuugugaagacaacacuuagccuagauuaugcauggaagacuacugcuauggugcucucgauuguuagucuguuuccauuaugcuuaucuacuacgucgcagaaaacuacauggcugcccguuuuacugggaucauucggauguaaaccauuaacaauguuuuugauuacugaaaauaaaauauggggacgaaaguccuggccuuuaaaugaggggauaauggccauagguauaguuucaauccuacucucaucguuacuaaagaaugaugucccauuagccggaccauugauagcaggaggcauguuaauagcauguuaugucauaucuggcaguagugccgacuuaagucuugaaaaagccgcagaaguaagcugggaacaagaggcugaacacucaggugcaagucauaacauauuaguugaagugcaagaugaugguacaaugaaaaucaaagaugaagaaagagacgauacuuuaacaauacuccugaaagccacgcucuuagcaguaucgggaguguacccuaugucaauaccagcgacgcuauucgugugguauuuuuggcaaaagaagaaacaacguaguggggugcuuugggacacaccuagcccgccagaggucgaacgggccguucuagacgacgguauauauagaauacuucagcgaggauuauuaggacgaucucaaguagggguuggaguguuucaagaugguguuuuucauacaauguggcacguaacuagaggcgcgguccuaauguaucaagguaagagacuagaaccuaguugggcuuguguuaaaaaggaucucauaagcuauggagguggguggcgcuuucagggguuauggaacacaggggaagaaguacaagugauugcagucgaacccgguaaaaauccgaaaaauguacaaacaacuccugguacauucaaaacacccgaaggagaaguaggcgcaauugcauuggauuucaaaccaggcacaagcggaaguccuauagugaaccgggaagggaaaauaguaggguuauacgguaaugguguugugacaacaucggguacauaugugucagcgaucgcacaagcuaaagcaagccaagaaggcccguuacccgaaauugaagaugaaguauuuaagaaaaggaaucuaaccauaauggaccuacacccuggaucaggaaaaacacgacgcuaucuucccgcaauaguuagagaggcuauuaaaagaaaacuccgaacauugauuuuagccccaacaagaguuguggcaucagagauggccgaagcauuaaaagguaugccuaucagauaucagaccacggcgguuaaaucugaacauacaggucgcgaaauaguagaucuaaugugucaugcuaccuuuacaaugcgauuauuaucaccaguaagagugccaaacuauaauaugaucauaauggacgaagcacauuuuacggacccugccuccauagcagcaagaggcuauauauccacgcgaguuggcaugggcgaggcugcggcuauuuucaugacugcgacuccuccagggucaguagaagcguuuccucaaucuaaugcuguaauacaggaugaggagcgagauaucccugaacguucguggaauaguggauaugauuggauaaccgauuucccaggcaaaacugucugguucgucccgaguauuaaaaguggaaacgacauugccaacugucuuagaaagaacgguaaaagaguuauucaauugagccgcaaaacauuugacacagaauaccagaagacuaagaauaacgauugggauuacgugguaacuaccgauauaagugaaaugggugcuaauuuccgcgcugauagaguuauagaucccagaagauguuuaaaaccgguuauauugaaggauggacccgaacgcgucauacuagccggacccaugccaguaaccguagcgucggcagcccaaaggcgcgguagaauugggaggaaccaaaauaaagaaggagaccaauacguauauaugggccaaccauuaaacaaugaugaggaccacgcucauuggacugaggcaaaaaugcuuuuggauaauauaaauacaccggaaggaaucauccccgcauuguuugaaccagaaagagagaaauccgccgcaauugauggggaauauagauuaagaggugaagcacgaaaaacauucgucgaauugaugagacguggagauuugccaguaugguugagcuauaaggucgcgucugaaggcuuucaauauagugacagacguugguguuucgacggcgagagaaacaaucaaguccuagaggaaaacauggauguggaaauuuggacaaaggagggcgaaaggaagaaauugcgaccacgauggcuagaugcuagaacuuauucggauccucucgccuugagagaauuuaaagaauuugcagcaggccgucgaagcguuucuggugacuugauuuuagagauaggaaaacuaccacaacaccuaacauugagagcacaaaaugcacuugacaauuuaguaaugcuccacaauucggagcaaggcgggaaggcauauaggcacgcuauggaggaacugcccgacacuauagaaacguuaaugcuacucgccuuaauagcaguucucaccggggguguuacgcuauuuuuccuauccggcaaaggacuugguaagacgucgauagggcuucuuugugugacggcaucuuccgcuuuacuauggauggcaagcguugagccacacuggaucgccgcgaguauaauauuagaguucuuucuuaugguauuauuaauacccgaaccugaccgucaaaggaccccacaagauaaucagcucgcauacguaguaaucggucuccucuucaugauacucacugucgcugcuaaugaaaugggcuuguuagagacaacuaagaaagacuuagggauaggauacguagccgcggagaaccaccaacacgcaaccauguuagauguagaucuccaccccgcaucagcauggacgcuauacgcaguggccacgacaguaauuacaccuaugaugaggcacacaauagaaaauacuacggcuaauauaucccuaacagcaauagcgaaucaagcugcaauacugaugggcuuagauaaaggauggccaauaaguaagauggacauaggcguaccacuacuagcucugggcugcuacucccaaguuaacccgcucacccuaacagcggcuguauugauguuaguagcucacuaugcaauuauaggcccaggacuccaagcgaaagccacacgggaagcucagaaaagaacugcagcagggauaaugaaaaauccuacaguugaugguaucguggccauugaucuagauccgguaguauaugaugcaaaauuugaaaaacaguuaggacaaauaaugcuacugauacuaugcacgucacaaauacugcuaaugagaaccacuugggcccuuugugagaguaucacacucgcaacaggcccguuaacuacgcucugggaaggaaguccaggaaaguuuuggaauacaacuauagccguaagcauggcgaacauuuucagaggaucguacuuagcgggagcugguuuagcauuuucuuuaaugaaaucguuaggaggcggacgacgaggcaccggagcacaaggugaaaccuuaggugaaaaauggaaacgucaguuaaaucagcuuagcaaaagcgaguuuaauacauacaaaagaaguggaauaauggaggucgauagaucagaagcuaaagagggguuaaaacgcggugaaacaaccaagcacgcagugagucggggcacugcgaagcuacguugguucguugaaagaaacuuaguuaaaccagaaggaaaaguuauagaucuaggcugcggaaggggagguuggucauauuacugugcugguuugaagaaaguuaccgaggugaaagguuauacuaaaggaggaccgggacacgaagaaccaauuccaauggcaacuuauggauggaauuuaguaaaauuacauucagguaaagauguauuuuucaugcccccagaaaaaugugacacacuacuaugcgauauuggugaaaguucccccaaucccacaauugaagaaggucgaacacuucggguauuaaaaaugguagaaccaugguuaagaggaaaucaauucuguauuaaaauccuuaacccuuacaugcccaguguaguagaaacacucgaacaaaugcaaagaaaacaugggggcaugcuaguaaggaauccuuuaagucgaaacagcacacacgaaauguacugggugagcugcggaaccggaaauauagucucggcuguaaacaugacaagucgaaugcuacuaaauagauuuacaauggcucaucgaaaaccuacuuaugaacgagauguugacuuaggcgcuggaacaagacaugucgccgucgaaccagaagucgccaauuuagauauuauaggucaaagaauagaaaacauaaagaacgaacacaaauccaccuggcauuacgacgaagauaacccuuacaagacuugggcguaccacggaucuuaugaagucaaaccgucuggaucagccagcucaaugguaaacggaguagucaggcuacugacaaaacccugggauguuauaccaaugguaacucagaucgcaaugacagacacuaccccauucggccagcaaagaguauuuaaagagaaagucgacacacgcacuccucgagcaaagagagggacgacacaaaucauggaaguaacugcgaaaugguuauggggauuuuuaagccgaaacaagaaaccaaggaucugcacaagagaagaauuuacaagaaaaguacgaucaaacgcggcaauaggagcuguguuuguagacgaaaaucaauggaacucggcaaaagaagcaguggaagaugaaagguucugggaccugguacaccgagaaagagaauuacacaaacaagguaaaugcgccaccuguguuuacaauaugauggguaaacgagagaagaaacuuggugaguucggaaaagcaaaagggucgcgggcaauaugguacauguggcuuggagcgcguuuucucgaguucgaagcccuugguuuuaugaaugaagaucauugguucucucgggaaaauucguuauccggaguagagggagaaggacuucacaaacuuggcuacauauuaagagauaucaguaaaauaccagguggaaauauguaugcugaugacacggcagggugggacacacguauaacagaggacgacuuacagaacgaagcuaaaauaacggauauuauggaaccugagcaugcacugcucgcaacuucgauuuucaaacuuaccuaccaaaacaaaguggugagaguucaacgcccagcaaagaacgguacaguaauggacguaauaucacggcgcgaucagaggggaucagggcaaguuggcaccuaugguuuaaacacguuuacgaauauggaaguccagcuuauuagacaaauggaaagugaaggcauuuuucucccuagugagcuagaaaccccgaaucuggcugaaagaguacuagauuggcuggaaaagcauggggcagagagauugaaaagaauggcaauaucaggagaugauuguguaguaaagccuauagacgaccgauuugcaacagcgcuaacagccuuaaaugacaugggaaagguacgaaaggauauuccucaaugggagcccucuaaaggcuggaaugauuggcaacaagugccuuuuugcucacaucauuuucaccaacuuauuaugaaagacggucgugaaauaguuguaccguguaggaaucaagacgagcuaguugggagagccagagugucucagggagcgggguggucauuaagagaaacugcuugccuuggaaaaucauacgcacaaauguggcaacugauguauuuucaccgacgugauuuaagauuggcggcuaaugcaaucuguucugcaguaccuguugauugggucccgacaaguagaaccacguggaguauucaugcacaucaccaauggaugacgacagaagauauguuaagcgucuggaaccggguauggauagaagagaauccuuggauggaagacaaaacucacgugagcaguugggaagaaguaccauacuuaggcaaaagagaggaucaaugguguggauccuuaauaggccuaacagcccgugcaacuugggcgacaaauauucaagucgcaauuaaccaaguacggagguugauagggaaugaaaauuaucucgauuauaugacaucaaugaaaagguuuaagaaugaaucagacccagagggugcacugugguaa

SEQ ID NO: 21422 - RNA, 9879 nt, Artificial Sequence
  derived and/or modified CDS sequence (opt6) from DENV-1__FJ639820__SS-prME
ucaguaacuaugcuacuuauguuauugccuacggcgcuggcauuccaucucacuacaagaggcggggaaccccauaugaucguuagcaaacaagaaagaggaaaaucgcuccuuuuuaaaacuucggcaggcgucaacauguguacccucauugcgauggauuuaggugaauuaugcgaagauaccaugacauacaaauguccucggaucacugaagcagaaccugacgauguagauugcuggugcaacgcuacagauacauggguaaccuauggaacgugcagucaaacaggagaacacagacgagacaaacguucaguagcccuagcuccacaugucggcuuagguuuagaaaccagaacggagacguggaugaguucagaaggcgcauggaaacaaauccaaaggguagaaacaugggcccuaagacauccagguuuuacaguaaucgcgcucuuuuuagcacaugccauugguacuuccauaacucagaagggaauaauuuucauacuauuaaugcucguuacuccuaguauggcuaugagguguguaggcaucggcaauagagacuuuguagaaggucuaucuggagcaacguggguggauguaguauuggaacacggaucgugcgugacaacaauggccaaaaauaaaccgacuuuagauauagaacuuuuaaagacugaagugacuaauccagcagugcuacggaaacuuugcauugaagcaaaaauaucaaacacuacaacagacaguagaugcccgacacagggcgaagcaacgcuaguagaagaacaagacgcuaauuuuguuugcagacgaacguucgucgauagggguuggggcaauggcuguggauuguuugguaaaggaucgcuauuaacuugugccaaauucaaguguguuacaaagcuagaaggaaaaauuguacaauaugaaaaccuaaaauacucagucauagucacaguucacacaggagaucaacaccaaguugggaaugagacaacugaacaugguacaauugcaaccauuacgccacaagcgcccacgagugagauucaauugacugacuauggggcucuuacccuugauuguucuccgagaaccggguuagauuuuaacgagaugguucuacuaacuaugaaggaaaaaucaugguuaguucacaaacagugguuccucgauuugccauugccauggaccaguggagcgaguacaagucaagagacuuggaacaggcaagaucuucuaguaacauucaaaaccgcgcaugcgaagaaacaagagguggucguucugggcagucaggaaggagcaaugcacacugccuuaacaggugcaacagaaauacaaacaucaggaacaacaacgauauuugcgggacacuuaaaaugccgcuugaaaauggacaaacuaacacuaaaaggaaugaguuacgugaugugcacagguucuuuuaaacuagaaaaagaaguugcugagacccaacaugguaccgugcucguucaagugaaguaugaggguacggaugcaccaugcaaaauaccguuuucuacacaagaugaaaaaggagucacucagaauggccggcucauaaccgccaauccaauagugacagacaaggaaaagcccgucaauaucgaaacugaaccuccauuuggcgagucauauaucguugugggagcaggcgaaaaggcuuugaaguuaucuugguuuaaaaagggaaguaguauaggaaaaauguucgaagcuaccgcacgcggagcgaggagaauggcuaucuugggugacacggcgugggauuucgguaguauagguggugucuuuaccucggucggaaaauugguacaucaagucuuuggaacagcuuauggaguacuuuuuaguggcguaaguuggaccaugaaaauaggaaucggaauauuauuaaccugguuaggcuuaaauucacguagcacaaguuuaucgaugaccuguauagcaguaggaauggucacgcuauaucuaggaguaaugguacaggcagauucuggcugcguaauuaacuggaaaggaagagaauuaaaaugcggaagugggauauuugucacaaaugaaguacacaccuggacggaacaauauaaauuucaggcagauucccccaagagauugucugcagcaauugggaaagcaugggaagaggguguuugugguauucgaagugcaacaagacuggaaaacaucauguggaaacagauaaguaacgagcuuaaucacauauuacuggaaaacgauaugaaauucacaguaguagugggcgaugcuaacgggauacuagcacaagguaagaaaaugauaaggccacaaccaauggaacacaaauauucauggaagucauggggaaaagcgaaaauaauaggagcagacauacaaaacacgacuuuuauaauagauggcccagacaccccugaauguccggacggacagcgagcauggaacauaugggaggucgaagauuaugguuuuggaauuuuuacaacuaauaucuggcuaaaauuaagggauucauacacgcaaaugugcgaucacagauugaugucagcagcaauaaaagacucaaaagccguacaugcugacaugggauauuggauagaaucagagaaaaaugaaaccuggaagcuagcuagagcaaguuucauugagguaaaaacauguacauggccaaaaucgcauacuuuguggucaaacgggguucuagaaagcgagaugaucauuccaaaaaucuacgggggaccaaucucgcaacacaacuacagacccggauauuuuacucaaacagcaggaccauggcaccuuggcaaauuggaguuagauuucgaucuuugcgaaggaacgacaguugucgucgacgaacauuguggcaauaggggaccaucucuuagaacgacaacaguuacagguaaaaucauucacgaaugguguugucguucauguacgcuaccaccucugagauucagaggcgaagauggcuguugguauggcauggaaauuaggccgguaaaggagaaagaagaaaauuugguaaggaguauggucucugcuggaucuggagaaguugacagcuuuucauuaggaauacuuuguguaaguauaaugauagaagagguuaugagaucacgauggucuaggaaaaugcuaaugacaggcacuuuagcgguauucuugcuacuaauuaugggacagcugacuuggaacgacuugauaagguuauguauuauggucggagcuaacgcaagugacagaauggggaugggcaccaccuauuuagcgcugauggccacauucaaaaugagacccauguucgccguaggacuauuauucagaagacuaacuuccagagaaguacugcuguugacaauaggcuuaucauuagucgccuccguugaauuaccaaauagcuuagaagaauuaggagaugguuuagcuaugggaauaaugauguuaaaauuauuaacugaauuucaaccccaucaauuauggacaacguuauuaagucuaacauuuguuaagacaacgcuaagucuggacuaugcauggaagacuaccgcuauggugcuaucuauagugucauuauuuccucuuuguuugucaacuacaucgcagaaaacuacguggcuacccguacucuuaggcaguuuuggcuguaaaccauuaacaauguucuugauuacagaaaacaagauauggggaaggaaaucuuggccucuuaaugaagguaucauggcuaucgguauagucucaauuuugcucucuucucuccuuaaaaaugauguacccuuagcagguccacuaauugcggguggcaugcuuauagccugcuacguaauuaguggcaguucagcagacuuaagccucgagaaagcggcagaaguuucaugggaacaagaagccgagcauaguggagcaucacauaacauucuaguagagguacaagaugaugggacgaugaagauaaaggaugaagaaagagaugacacauuaacgauacuacuaaaggcaacucuucucgcaguaucaggcguauacccaaugucuauacccgcgacacuauuuguaugguacuuuuggcagaagaagaaacagagaucaggaguauuaugggauacaccgucucccccugaaguugagagagccguucuggacgaugguaucuauaggauauuacagaggggauuauuggguagaagucaagucggaguaggaguguuucaagauggaguauuccacacgauguggcauguaacacggggugcuguacuuauguaccagggaaaacgacuugaaccaagcugggcuagugucaagaaagacuugauaagcuacggagggggcuggagauuucagggaucauggaauacaggcgaagaaguccaaguaauagcuguagaaccgggcaaaaaucccaaaaacguacagaccacuccggguacauuuaagaccccagaaggggaaguaggugcuauugcauuagacuucaaaccaggaacgucgggaagucccauaguaaaucgagaagguaagauaguaggccuauaugguaacggaguugucacaaccagugggacauacgucucggccauagcacaagcuaaggccucgcaggaagguccccuaccugaaauagaagacgaaguauuuaagaaacgaaaucuuaccauaauggaucuucacccagguucuggaaaaacaagaagauaucuuccagcgauuguacgcgaagccauaaaaagaaaacugcggacuuuaauacuugcgccgacgaggguaguggcgucagaaauggcagaagcacucaaagggaugcccauacgauaucagacaaccgcagugaaaucugaacauaccggccgugagaucguggaucuuaugugucacgcaacuuuuacaaugaggcuucuuaguccaguccgaguuccuaauuacaacaugauuauaauggacgaagcacauuuuacagacccugcaucaauugcggcaagagguuauauuagcacucgcguuggaaugggcgaagccgcugcaauuuuuaugacggcuacaccaccagguucaguggaggcuuuuccacaaucgaaugcaguaauccaggaugaagaaagagauauccccgaaagaucguggaacuccggauaugauuggauaacugacuuuccugggaaaaccgucugguuugucccuuccauuaagucugguaaugauauagcuaacugccucaggaaaaauggaaaaagaguaauccaacuaaguagaaaaaccuuugacacggaauaccagaaaaccaaaaacaacgauugggauuauguaguaacaacugauauaucugagaugggcgcgaacuuucgggcagauaggguaauagauccucguagguguuuaaagccaguuauccuaaaagauggaccagaacgaguaauacuagcgggaccaaugccaguaacgguagcauccgcagcgcaaagacgaggaagaauaggaagaaaucaaaauaaagaaggggaccaauauguguauaugggacagccacugaacaacgaugaagaccaugcacacuggacugaggccaaaauguuguuagauaauauuaacacuccggaaggaaucaucccagcguuguuugaaccagaacgugaaaaauccgccgccauagauggagaauauagguuacgaggagaagcgagaaaaaccuucgucgaguuaaugcggaggggagaucugccaguguggcugucauacaaagucgcuucugaagguuuccaauauucagaccgaagaugguguuuugacggggaacgcaacaaucaaguauuagaagaaaacauggacguugaaaucuggacuaaggaaggagaacggaagaaacuaagaccucgcugguuagacgccagaacauauagcgauccuuuagcacugcgagaauuuaaagaguucgcugcuggccgacgaagcgugucuggagaucuaauauuggaaauuggcaaauuaccgcaacaucuaacauuaagggcccaaaacgcacuggacaaucuagcaauguugcacaauucagagcaaggaggcaaagcauaccgccaugcuauggaagaauugcccgauaccauugagacgcuuaugcuacuagcccucauagcuguguuaaccggaggcguaacacuauucuuucugagugggaaaggcuugggaaagacuagcauaggacugcuuuguguuacagcaaguucugcuuuauuauggauggcaagcguugaaccgcauuggauugcugcaucuauuauauuagaguucuuucuaaugguucucuuaauuccggaaccugauagacaacgaacaccacaggacaaucagcuagcauaugucgugaucggacuucuauuuaugauacuaaccguugccgccaaugaaaugggcuuacuugaaacaacgaagaaagaccuuggaauaggauauguagcagcagaaaaccaucaacaugcaacaaugcuagaugucgauuugagaccugcgucagcauggacucucuacgcugucgcgacuacaguaauaacaccgaugaugcggcacacuauagagaacacaaccgcuaauauuagucugacugcgauagcaaaccaagccgcgauauugaugggacuugauaaaggauggcccauaagcaaaauggacauaggaguaccuuuacuagcccuaggguguuauucccaaguaaauccauugacacuaacugccgcaguccucauguugguagcacauuaugccauaauaggcccgggauuacaagcaaaagcuacgagggaggcacagaaaagaacugcugccgggaucaugaaaaauccgacaguugacgguaucguggcuauagauuuagauccggugguauaugaugccaaauucgagaaacagcucggccagaucaugcucuuaauuuuaugcacaagucaaauauuacucaugagaacuacgugggcucugugcgaaagcaucacccuugcuacuggacccuuaacuacauuaugggaaggaaguccaggaaaauuuuggaacacaacgaucgccguuuccauggcaaauaucuuucgaggaucauaucuugcaggcgccggacuggcuuucucacucaugaaaucguuaggcgguggacgaagagggaccggugcccaaggagaaacgcucggugaaaaauggaaaagacagcuaaaccaguugagcaaaagcgaauuuaauacuuauaaacgcagcgguaucauggagguagauaggagugaagcaaaagagggauugaaaagaggagaaacaacaaaacaugcuguuucgcgggguacugcaaaacugagaugguuuguagaaagaaauuuaguaaagcccgaaggaaaagucaucgaccuuggaugugggagaggaggcuggucauauuauugugcaggacucaagaaaguuacagaagucaaagguuauacuaaaggagguccuggacacgaagaaccgauucccauggcgacauauggcuggaauuuagucaaacuacacaguggcaaggauguauucuuuaugccuccugaaaaaugugauacacugcuaugugauauaggagaaagcucaccuaaucccacuauagaagagggucgaacacucagaguacuuaaaaugguagagccuugguugaaagggaaucaguuuugcauaaaaauucuaaauccauacaugccauccgucguagagaccuuagaacagaugcaacgcaaacacggggguaugcucguucgaaauccuuuaucucgcaacucgacucacgaaauguauuggguuucuugcggaacugguaauauaguuagcgcgguaaauaugacaaguagaaugcuucuaaauagauuuacuauggcucacagaaaaccuacauacgaaagggacgucgaccuaggagcugguacaagacacguagcaguggaaccagaggucgcuaaucucgauauaauaggacagaggauugaaaacauuaaaaacgaacauaaaucgacauggcacuaugacgaggauaacccguauaaaacuugggccuaucauggcucguaugaaguuaagccuucagguucagcaucuuccaugguaaacggagucguacgacuguuaaccaaaccaugggacguuauacccaugguaacgcagaucgccaugacagauacuacgccauuugggcagcaacgugucuuuaaagagaagguagacacuaggacacccagggcuaaaagggguacgacccaaauaauggaagucacggcuaaauggcuguggggguucuuaucccggaacaagaaaccaaggauaugcacccgugaggaauuuacacguaaaguacgcucuaaugcagcaauuggggcagucuuugucgacgaaaaucaauggaacagcgcaaaagaagcggucgaagaugaacguuucugggaccucguacaucgagaaagggagcugcacaaacaaggaaaaugugccacauguguuuauaacaugaugggcaaacgcgaaaagaaacucggagaauuugggaaagcuaaaggaagcagagccaucugguauaugugguugggagcccguuucuuggaauuugaagcauugggcuucaugaaugaagaccauugguuuucgagagagaauagccuauccgggguugaaggagaaggacuacauaaauuaggguacauacugcgagacaucucaaaaaucccuggagguaacauguaugcugacgauacagccggcugggacacuagaauuaccgaagacgacuuacaaaacgaagcuaaaauaacggauauaauggaaccugagcacgcacuauuggcaacaucuauauucaaacuaacauaucaaaacaaaguuguaaggguacaaagacccgccaaaaacgguacugugauggauguuauuucccggagagaucagcgcggcucaggacaaguggggacuuauggacuuaauacauucacgaacauggaaguucagcuuaucagacaaauggagucagaaggaauuuuucuaccguccgaauuggagacgcccaauuuggcugaaaggguacuggauugguuagagaaacacggagcagaaagguuaaagaggauggcuauaucuggugaugacugcgucguuaaacccauugaugaucgguucgccacagcauuaacugcucuuaaugacauggguaaaguaaggaaagauauuccacagugggaaccgaguaagggauggaaugauuggcaacaaguaccauuuugcucucaccacuuucaucaacuaauuaugaaagaugguagagaaaucguuguuccuugcaggaaucaagaugagcuaguaggucgagcaagaguaucccaaggagcaggauggagucuacgugaaacggcuugucuuggaaaaucguaugcucagauguggcaacuuauguauuuccaccgacgcgacuuacguuuagccgcaaacgcuauauguagugcugugcccguagauuggguaccaacaagucggacuacauggucaauccaugcacaucaucaauggaugacaacagaggacauguuaucuguauggaaucgaguuuggauugaagaaaauccauggauggaagauaaaacgcacgucagcuccugggaagaaguucccuauuuagggaaacgcgaggaccaauggugugguucccuuauaggacucacugcuagagccacuugggcgacuaacauacagguugcaauuaaucaagugcgaagacuaauaggaaaugaaaauuaccuagauuacaugaccucgaugaaacgauuuaaaaacgagagcgaccccgaaggugcguuaugguag

SEQ ID NO: 21423 - RNA, 9879 nt, Artificial Sequence
  derived and/or modified CDS sequence (opt6) from DENV-1__FJ639821__SS-prME
ucggcgacaauguuacuaaugcuuuugccaacagcacuagcuuuucauuuaacuacacgcggaggggaaccacacaugauagucucaaaacaagaacggggaaaaucacuacuuuucaaaacuucagcuggaguaaauaugugcacauuaauagcgauggaucuaggugaauugugcgaagauacuaugacuuacaaauguccaaggauaacugaagcagaaccagaugacguggauugcugguguaacgcaacagacacuuggguaacauauggaacauguagucaaacaggagagcaccgucgcgagaaacguaguguagcauuggccccucaugugggauuaggacuagaaacgcgaacugaaacuuggaugucuucagaaggugcuuggaaacaaauacaacguguugaaacaugggcauugaggcauccuggguuuacuguuauagcauuuuucuuagcucaugcaauaggaacuucgauuacacaaaaagguaucaucuucauucuuuuaaugcuggucacaccuuccauggcaaugagguguguugggaucggcaauagggauuuuguagaaggacuuaguggagcuacuugggucgauguuguucuagaacauggaucaugcguaaccacaauggccaaaaacaaaccaacauuggauauugaauuacuaaaaacugaagucacuaacccggcuguacucaggaaacuuuguauugaggcaaaaauuucaaauacaacaacagauucccguugcccgacacaaggggaagcgaccuuaguagaagaacaagacgccaauuuuguuugccgacgaacauuugucgauaggggcuggggcaauggauguggguuauuugggaaagguagccugcugacgugugcgaaauuuaaaugcguuacgaaacucgagggaaaaauuguucaauacgagaauuugaaauacucagugauagugacuguacacaccggugaucaacaccaaguuggaaacgaaaccacggagcauggcacaauugccacuauuacaccacaagcgccuacaagcgagauacaacuaacagauuauggagcuuuaacacucgauugcucaccuagaacaggauuggauuucaacgaaauggucuuacuaacaaugaaagagaaaagcuggcuaguacacaaacaaugguucuuggaccuaccuuugccguggacuuccggagcaucgacaucgcaagaaacuuggaaucgccaggaccuguugguuacauuuaaaacggcucacgccaagaaacaagaagucguagucuuagguucccaagaaggugcaaugcacacagcguuaacaggagcgacggaaauacaaacguccggaacaaccacaaucuucgccggccaucuaaaaugucgauugaaaauggacaaacuaacucuaaaaggaaugucauauguaauguguaccgguucauuuaaauuagaaaaagaaguugccgagacacagcaugguacgguguugguucaaguaagauacgaaggaacagaugcaccguguaaaauaccauuuucuacgcaagaugaaaaaggagugacgcagaacggaagacuaauaacagcaaaccccauugucacugauaaggagaaaccaguaaacauagaaacugagccacccuucggcgaaagcuauauaguggucggcgcuggcgaaaaagcucuaaaacuaagcugguucaagaggggcaguucaauagggaaaauguuugaagcgacagcacgaggcgcaaggagaauggcaauucugggugauacagcgugggauuucggcaguaucggugggguauucaccucuguuggaaaauuaguucaucaaguauuugguacugcauacgggguguuauucucggguguuaguuggacgaugaaaauagggaucgggauuuuacugaccuggcuaggacuuaacucacgaucuacgagucuaaguaugacauguauugcgguuggaaugguuacauuauaccugggcguaauggugcaggcagacagugggugcgugauuaauuggaaaggacgagaguugaaaugcgguagcggaauauuuguaacaaaugaaguccauacauggacagagcaguacaaauuucaagcggacucaccaaaacgauugucagcugcaauaggcaaggcuugggaggagggugugugugggauacguuccgcuacaagacuggaaaauauuauguggaaacaaauuaguaaugaauugaaccacaucuuguuagaaaaugauaugaaguucacuguaguaguaggagacgcaaauggaauauuagcucaaggaaagaaaaugauaaggccacaaccgauggaacauaaauacagcuggaaaucuugggguaaagccaaaauaauuggcgccgauauacaaaauacgaccuucaucauugauggacccgacacacccgaauguccagacggacaaagagcguggaauauaugggaaguugaagacuauggauuugggauauuuacaacaaacauuuggcuaaaauuaagggacucuuauacacaaaugugugaucauaggcugaugagugcggcaauaaaagauaguaaagcgguucaugcggauauggguuauuggauugaaucugagaaaaacgaaacauggaaauuagcacgugcgucuuucaucgaggucaaaacguguaccuggccuaaaagccacacacuuuggaguaacggugucuuagaaagugaaaugaucauucccaaaauauauggagguccaaucucacaacacaacuacagaccugguuauuauacacaaacagcaggaccuuggcacuuggguaagcuggaacuagauuuugauuuaugugaaggaacaacaguuguaguagaugagcauugcggcaauagaggaccuucauuaagaacaacaacaguuaccggaaaaauaauucaugaaugguguugucgcuccuguacuuuaccgccgcuccgauuccggggcgaagauggaugcugguaugguauggaaauaaggccaguaaaggaaaaagaggagaaucuugugcgaucuaugguaucugcgggaucuggagaaguugauaauuuuuccuuagggauccucuguguuagcaucaugauugaggaaguaaugcguagcagauggucacggaagaugcuaaugacaggcacgcucgcgguauuuuuacuuuuaaucaugggacaauuaacuuggaacgaucuaauaagacuauguauaaugguaggugcuaaugcuucggacgguaugggaaugggaacaacguauuuggcauuaauggccacguuuaaaaugcguccaauguucgccguaggacuguuauuccguagacuaacuucacgggaagucuuacuguuaacgauugggcugagccuaguggcgucaguugaacuaccaaacucuuuggaggaacuaggagacgguuuagcgaugggaauaaugauguuaaaauuacuuaccgaguuccaaccgcaucaauuauggaccacauugcucucacuuacguuuguuaaaaccacauuaagucuugacuaugcuuggaaaaccacagcuauggucuuauccauaguuuccuuguucccauugugcuuaucaaccacaucucagaaaacgacauggcugcccguucuucuagguuccuuugguuguaaaccccuaaccauguuuuuaaucaccgaaaauaaaauuugggguagaaaaucuuggcccuugaaugaaggaauuauggcuauugggauuguaaguauccucuuaaguucauuguugaaaaacgaugugcccuuagcaggaccguuaaucgcugggggaaugcuaauugcauguuaugugauaucagguaguagugcugaucuaucacucgauaaggcggcagaagucuccugggaacaagaagcagaacauagcggagcaagucacaauauaagcguagaaguacaagaugauggcacaaugaaaauuaaagacgaagaacgagaugauacauuaaccauccuacuaaaggcuacauuguuagcaguaucagguguguaucccauguccaucccggcaacacuguuugucugguauuucuggcagaagaagaaacaaagaucagguguauugugggauacuccaucucccccagaggucgaaagagcuguuuuggacgaugguauauaccgcauucuccaacgcgguuuacugggacgcucacagguaggaguagguguuuuccaagacgguguauuccauacaauguggcacgucacucggggagcaguauuaauguaccagggaaaacgccucgaacccuccugggccuguguuaagaaagauuugauaucuuaugguggaggguggagguuucaaggaucguggaacacuggcgaagagguacaaguaauugcaguggagccuggcaaaaauccuaagaauguacagacuacaccgggcacauucaagacuccggaaggggaaguaggcgcaaucgcauuagauuuuaaaccaggaacaucagguagucccauaguuaaucgugaaggaaaaauaguuggauuauaugguaacggaguaguuacuaccaguggaacauauguuucggcuauugcucaggcuaaagcaagucaagaaggaccgcugccggaaauagaagacgaaguuuuuaagaaacggaacuuaacaauaauggauuuacacccagguucgggaaaaacucgccgauaucucccugcgauaguaagagaagcaaucaaacguaaauuaaggacguugauacuagcaccaacucguguaguugcaagugagauggcagaggcuuugaagggaaugccuauccgcuaccaaacgacagcaguaaaaucagaacauacagggagggagauuguagaccugaugugccaugcgacauuuacgaugagacuauuaucgccaguucguguacccaacuacaacaugauaauaauggaugaggcccauuuuacagacccggcgaguauagcugcuagaggauauauaucuacuaggguugguaugggugaggcugcagcuauuuuuaugacagcuacgccuccugggagcgucgaagcguuuccccaaagcaacgcagugauacaggaugaggaacgugacauacccgaaaggaguuggaacucgggauacgauuggaucaccgacuuccccgguaaaaccguaugguuuguuccaucuauaaaaagcggcaacgacauugcgaauuguuuaaggaagaacgggaaaagaguaauucaauuaagcaggaaaacuuucgacacagaauaccagaaaacuaaaaacaaugauugggauuauguugugacgacugauaucagcgaaaugggcgcgaauuuucgagccgaucgagucauagaccccagacguugucuaaaaccuguuauucuuaaagacggacccgaacgaguuauccuagccgguccaaugccgguuacagucgcuucugcggcccaaagaagagggcgaauuggaagaaaucaaaacaaagaaggcgaucaguacguuuauaugggacagccgcuuaauaacgaugaggaucaugcacacuggacagaagcaaaaauguugcuagauaacauuaacacuccggaagguaucaucccugcauuauuugaaccugaaagggaaaagagcgcugcgauagauggagaguauaggcuacgcggcgaagccaggaagacuuuugucgaauugaugcgacgcggagaucucccuguuugguuaucauacaagguggcuucugagggcuuccaauauucagacaggcgcugguguuuugauggagaaagaaauaaucaaguauuagaggaaaacauggacguagagauuuggaccaaagaaggcgaaaggaagaaacuaaggccacgaugguuagaugcgaggaccuacuccgacccucuagcccuaagagaauuuaaagaguuugcggcaggaagaagaucugucucuggugauuugauucuagaaauaggaaagcucccgcagcauuugacauuaagagcccagaacgcgcuugauaacuuaguaaugcuccacaacucggaacagggaggaaaggcauaucgccaugcgauggaagaacucccagauaccauagaaacguuaauguuacucgccuugauugcaguguugaccgggggaguuaccuuauuuuuccuuucuggcaaggguuuaggaaaaaccucuauaggauuacucugcgucacugcuaguucugcauuauuauggauggcaucaguagaaccacauuggauagcagcgucaaucauauuagaguuuuucuugaugguacugcugauaccugaaccugauaggcagagaacaccacaagauaaccagcuggcguauguagucaucggauuauuguucaugauccuaacaguggcugcaaaugaaaugggccuacuugaaacaaccaagaaagaccucggcauuggauauguugcggcugaaaaucaucaacaugcaaccauguuagacguagaucuccacccugcuagcgccuggacacuuuacgccguagccacuacggucaucacucccaugaugcgacacacgauugaaaauacaacagcuaauauaucuuuaacggcaauugcaaaucaggcagcaauacucaugggguuagauaaaggcuggccgauuaguaaaauggacauaggcgucccucugcuugccuuaggaugcuauagucaaguuaauccucuuacacuaacagcagcaguacugauguuaguagcucauuacgcaauaauaggaccgggucuacaggcaaaagcgacacgagaggcacaaaaacgaacugcagcggguauuaugaaaaauccgacaguagacgguauagucgcaauugaccuugacccaguaguguaugacguaaaauuugaaaaacagcuuggucaaauuauguuacuaauacuaugcacaucucaaauacugcucaugcgaaccacuugggcuuugugcgaaagcauaacccuugcuaccgguccguuaacuacacuaugggaagguaguccggguaaauucuggaacacuacaauagccguuucuauggcaaacauauucagagguaguuaucuagcuggugcaggauuagcauucagcuugaugaaaagccucgguggagguagacgaggcacgggagcucaaggagagaccuugggugagaaauggaaacgucagcuuaaccaacuuucuaaaucagaguuuaauacauauaaacgaaguggaauaauggaggucgaucgauccgaggcaaaagagggcuuaaaacggggagaaacuacgaaccacgcagucagcaggggaacagcaaaguuacgaugguuuguggaaagaaauuuagucaaaccagaaggcaagguuauagaccuuggcugcgggagagguggguggucauauuacugugccgggcuaaagaaaguuacggaagucaagggcuacacaaaaggcggaccuggacacgaagaaccuauaccaauggcaacguacggauggaauuuggucaagcuccauagcggcaaggauguuuucuuuaugccaccagaaaaaugcgauacauugcuaugcgauauaggagaaagcagucccaauccaacaauugaggaaggucguacauugagaguucuaaaaaugguugaacccugguuaagaggaaaccaguucuguauuaaaaucuuaaauccguauaugccgucggucguugaaacgcuugaacaaaugcaacguaaacaugguggaaugcuuguucgaaauccauugagcagaaauucaacucacgagauguacugggugucuuguggaacgggaaauauaguaucugccguaaacaugacaucuagaaugcuccuaaaccgguuuacuauggcucacagaaagccuacauacgaaagggauguagaccucggagcaggaacacgacauguaacaguagagccggaaguugcgaaucuggauauuaucggacaaagaauagaaaauaucaaaaaugaacacaaaucaacguggcauuaugaugaggauaauccauacaagacaugggcuuaucaugguagcuaugagguaaaaccuagugguuccgccuccucaaugguaaauggaguaguuagauugcuaacaaaacccugggauguuauaccgaugguaacccaaauagcgaugacagauacgacaccauuuggacaacaacgcguauuuaaagaaaagguagauacaagaacccccagggcaaaaagaggaacuacccaaauaauggaagucacagccaaauggcuuuggggauuucuaaguaggaacaagaaaccaaggaucuguacgagagaagaauuuacaagaaaaguaaggucuaaugcugccauuggugcgguauuugucgacgaaaaccaauggaacagcgcuaaagaagcgguagaggacgagagauuuugggaccucguccauagagaaagagaauuacauaaacagggcaaaugugcaaccuguguauauaauaugaugggaaaacgugagaagaaauuaggcgaguucggcaaagcaaagggaucgcgagcaaucugguauauguggcuaggagcuagauuccuugaguuugaagcacuuggauucaugaaugaagaucacugguuuucacgagaaaacagcuuaagugguguagaaggggaaggcuugcacaaacucggcuauauucuaagagauauuucaaaaauuccaggagggaacauguacgccgacgacacagcaggaugggauacacgaauuacagaagacgauuuacaaaaugaagcaaagauuacugacauaauggagccagagcaugcacuuuuagcaacuucaauuuuuaaacuaacauaccaaaauaagguggugcguguacaaaggccggccaaaaacggaacaguaauggacguaauaucgagaagagaucaaagggguagcggacaaguagguacauacggcuugaauaccuucacuaacauggaaguccaacucauacggcaaauggaaagugaagguauauuccuuccaucagaacuagagaccccaaauuuagcggagaggguacucgacugguuggagaaacauggugcagaacgccucaagagaauggcaauaucaggagaugauugcguagucaaaccaauugacgaccguuucgcaacggccuuaacugcacuuaacgacauggggaaaguaagaaaagauaucccccaaugggagccuagcaaaggcuggaaugauuggcaacaagugcccuucuguagucaccauuuucaccaauuaauuaugaaagaugggagagaaauaguaguuccgugcagaaaucaagacgagcuuguaggacgugcgagaguaucgcaaggagcuggauggagucugcgggaaacagcgugucuagggaaaaguuaugcacaaauguggcaacucauguauuuccaccgaagagauuuacgucucgcagcuaaugcaauuuguagugcagucccuguggacuggguuccaacaucacguaccaccuggucaauacaugcacaccaucaauggaugaccaccgaagauauguuaucaguguggaacagggucuggauugaagagaacccauggauggaggacaaaacacauguauccucgugggaagaaguaccuuacuuagguaaaagggaagaucaaugguguggaucccucauagggcugacugcacgagcuacaugggcgacuaauauucaagucgcaauaaaucagguccggagauuaaucgguaacgagaauuaucuagacuauaugacauccaugaaaagauucaaaaaugaaagcgacccagaaggcgcacuaugguag

SEQ ID NO: 21424 - RNA, 9879 nt, Artificial Sequence
  derived and/or modified CDS sequence (opt6) from DENV-1__FJ639824__SS-prME
ucaguaacgauguuacuuaugcuccuaccuacugcacuugcauuucacuuaacaacaagagggggugaaccgcauaugauaguauccaaacaagaaagggggaaauccuuauuauucaaaacuucggcagggguaaauauguguaccuugauagcaauggaucuaggggaacugugcgaagauaccaugacuuauaaaugcccucgaauaacagaagcagaaccggaugauguugacuguuggugcaaugcuaccgauacaugggugacauaugggacuuguagccaaacuggggaacacagacgggauaaaagaagcguagcauuggcuccucaugucggucugggcuuggaaacacgaacggaaacuuggaugucuucagaaggggcauggaaacagauucaaagaguagaaacgugggcacuacgccauccaggauucacuguaaucgcacuuuuccuugcacaugccauuggcacgucaauaacgcaaaaagggaucauauucaucuuacuuauguuaguuacuccaucgauggccaugcguugugugggaauugguaaucgugauuucguagaaggacuuucaggagcuacauggguggacguugucuuagaacauggauccuguguuacaacgauggcuaaaaacaaaccaacauuagacauugaacuacuaaaaacugaaguuacuaauccggcgguguuacgaaaauugugcauugaagcuaaaauaaguaauacuacaaccgauucucgauguccaacacaaggagaggcaacgcugguagaggaacaagaugcaaacuucguuugucggcguacauuuguagauagaggaugggguaauggauguggucuuuuuggaaaagguucgcuccuaacuugugcaaaauucaaauguguaacaaaacuugaaggaaaaauaguacaauaugagaacuuaaaguauagcguaauaguaacuguccacacgggagaccaacaucaaguuggaaacgaaacaacggaacacggaacaaucgcuacaauaacuccacaggcaccaacgagugaaauccaacuaaccgacuacggagcuuuaacucuggauugcagcccacguacaggacuggacuucaaugaaaugguucuacuaacuaugaaagaaaaaucaugguuagugcacaaacagugguuuuuagaccuaccucugcccuggacaucuggugcgagcacgucucaagaaacguggaauagacaagauuuauugguaaccuuuaaaaccgcucacgccaaaaagcaggagguagucguuuuaggaucgcaggagggcgcuaugcauacagccuuaaccggagcaacggaaauccagacaucgggaacuacaacaauuuucgcgggacacuugaaaugcagauuaaagauggacaaauuaacguuaaagggcaugaguuaugucauguguacugguucauucaaauuggaaaaagaaguagccgaaacccaacauggcacuguacucguucaaguaaaguaugagggaaccgacgcgcccuguaagauaccauucaguacacaggaugaaaaagguguaacucaaaacggaagacucauaacagcaaacccgauuguaacugacaaggaaaaaccgguuaacauugagacugaaccgccauuuggugaaucuuacauaguaguaggagcuggagaaaaagcacuaaaguuaaguugguuuaagaaagggucgucaauaggaaaaauguucgaagcaaccgcccgaggcgcaagacguauggcgaucuuaggugacacagcuugggauuucggaucaauaggcggaguauuuacaaguguuggaaagcuagugcaucaaguauucggcacugcauauggcguacuauuuucaggagucucauggacgaugaaaauugguauuggaauacuauuaacuuggcuuggacucaauucacgaaguacgagccuaagcaugaccuguaucgcaguugguaugguaacucuauauuugggaguuaugguccaagccgauagcgggugcgucauuaauuggaaggggcgagagcuaaaaugugguucagguauuuucgugacuaaugaaguacauacuuggacagaacaguauaaauuucaagccgacaguccaaaacgacucucagcugcuauuggaaaagccugggaggaaggcguaugcgggauacguagugcgacaaggcuggaaaauauaauguggaaacagaucucaaacgaacucaaucacauacuuuuagaaaaugacaugaaauucaccgucguagucggcgacgcaaauggaauuuuggcucaaggcaagaagaugauuagaccacaaccaauggaacauaaauauucguggaaaagcugggggaaagcgaaaauaauaggagcagacauacaaaacacuacauucauaauagauggaccagauacgccagaaugcccugauggucaacgugcauggaacaucugggaaguugaggauuacggcuuuggaaucuucaccacaaauauaugguuaaagcuccgcgacucguacacacaaaugugugaucacagguuaaugucagcugccauaaaggacucuaaagcgguacacgcugauauggguuauuggaucgaaagugaaaagaacgaaacguggaaauuagcgcgggcaucuuucaucgaaguaaaaacauguaccuggcccaaaagccauacacucuggucaaauggaguauuagaaagugagaugaucauccccaaaauauauggaggucccauuucucagcauaacuaucguccuggauauuuuacgcagacugcaggaccauggcaucuugggaaauuagagcucgacuuugauuuaugugaaggaacaacuguagugguagaugaacauuguggcaaucguggaccaucauuaaggacaacuacugugacaggaaagauaauacacgaaugguguuguaggagcugcacucuuccuccuuugcgauucagaggugaagauggaugcugguacggaauggagauucgucccguaaaagagaaggaggaaaaucuuguaagaagcaugguaucagcaggcaguggcgaaguagauucauucucauugggaauuuuaugcguaagcauaaugaucgaggaaguaaugagaucacgcuggucaagaaaaaugcuaaugaccgguacacuugcuguauuccuacucuuaaucaugggccaacugacuuggaaugaccuaauaagacuauguauaaugguuggugcuaacgcaucagauagaaugggcaugggaacgacauauuuagcguuaauggccacuuucaaaaugagaccgauguuugcaguugggcuuuuguuucgaagguugaccuccagagaagugcuacuauuaaccauaggucucagccuaguugcuucaguagaauuaccaaauucacuugaagaacuuggugaugggcuagcaaugggaauuaugaugcuuaaauuacucacugaauuucagccucaucaauuguggacaacucuucuuucacuaacauuugucaaaacaaccuuaucuuuggauuaugcguggaaaacuacagcuaugguacucagcauagucagccucuuuccgcuauguuuaaguacaaccucucaaaagacgacguggcuaccaguguuguuagguuccuuugggugcaaaccgcuaacaauguuccuaauuacugaaaauaagauuuggggacgcaaaucuuggccuuuaaaugaagguauuauggcuaucggcauagucucuauauuacuaucaucauugcucaaaaacgacgugccguuagcgggaccuuugguugcaggcgguauguuaauagcuugcuacguaauuucggggucuagugcagauuuaucucuugagaaagcggccgaaguauccugggaacaagaagcugaacauagcggagcaucacacaacauacuuguagaaguacaagacgauggaaccaugaagauaaaagaugaagaacgggacgauacauugacaauacuauuaaaagcuacauuauuagcaguaagcggcguuuaccccaugucaauacccgccacacucuucguaugguacuuuuggcagaagaagaaacagcgguccggugugcucugggauacgccaagcccuccugaaguagaacgagcaguauuagaugauggaauauaccggauacugcaacgcgguuuguugggaagaucccaaguaggagugggaguauuccaagauggcgucuuccauacaauguggcaugucaccagaggugcaguauugauguaucaaggaaaaaggcucgaaccuucuugggcuucuguuaagaaagacuuaauaucuuacggaggaggguggcgguuucaagguaguuggaauacaggugaagaggugcagguuauagcaguagaaccaggcaaaaaucccaaaaauguccagacgacuccaggaacguucaaaacaccugaaggugaagucggggcaauagcccuugacuuuaaaccuggcacgucagguagcccaauuguaaaccgagaagggaaaauagucggacuauacgguaauggugucguuacaacuucaggaacguaugucagcgccauugcucaagcuaaggcgucacaagaaggaccccucccagaaauagaggacgaaguguuuaagaaacgaaacuuaacgauuauggauuuacauccuggaaguggaaaaacaagaagguaucuaccugcuaucguacgagaagccauuaaaagaaaguuacguacacuaauacuagccccaacaagagucguggcuucugaaauggcagaagcauuaaaaggaaugccaaucagauaccagacaacagcuguaaaaucagaacacacggguagagagauaguagauuuaaugugucacgcgacauucacaaugcguuuacucucuccuguccgggugccuaacuauaauaugaucauaauggaugaggcgcauuucacagacccugcuaguauagcugcgagaggauauauaucaacaagaguagguaugggggaagcugcagccauauuuaugacagcaacaccuccaggaucuguugaggcuuuuccgcaaucaaaugcggucauucaagaugaggaaagagauauucccgagcgaucguggaacucaggcuaugauuggaucacugacuuuccaggaaaaacagucugguuuguaccgucgauuaaaucagggaacgacauagccaauugccuaagaaagaauggaaaacgagugauucaauuaagucggaaaacauucgauacugaauaucagaaaacuaaaaauaaugauugggacuacguaguuacaaccgauauaagcgaaaugggcgcuaauuuuagggcagauagaguaauugauccgagaagguguuuaaagccaguuauccugaaagauggucccgaaagaguuauauuagccgguccaaugccuguaacgguagcuagugcagcucagaggcgaggcagaauaggcagaaaucaaaacaaagaaggggaccaguauguauacaugggacagcccuuaaacaacgacgaagaucacgcacauuggacagaagcaaagaugcuccuagauaauaucaacaccccagaaggaauuauaccugcccuauucgaaccugaacgagaaaaaucugcagcaauugauggcgaauacaggcuuagaggcgaagcaaggaagacauuuguagaacuuaugagacggggagaucucccuguuuggcucucauauaaaguagcaagugaaggcuuucaauauagcgauagaaggugguguuuugauggcgaacgcaacaaccaaguguuagaagaaaacauggacguagaaauuuggacaaaagaaggggaaaggaagaaacugcgaccgagaugguuagacgcucguacauauucagauccgcuugcucuaagagaguuuaaggaauuugcggcuggcagaagaagcguaagcggagauuugaucuuagaaauuggaaaauuaccucagcaccuuacccuacgugcgcaaaacgccuuggacaaucuggugauguuacauaacucagaacaaggcgggaaggccuaccgacaugcaauggaagaguugccugacacaauugaaacacugaugcuacuagcauuaauugcgguguugacgggaggagugacgcuauucuuuuuaagugguaaagguuuaggcaaaacgucaauaggucuacuuuguguaacagccagcagugcacuacucuggauggcuagugucgaaccgcauuggauugcagcgucaauaauucucgaguucuuccuaaugguuuuauugauccccgaaccugauagacagagaacuccacaagauaaucagcuggcguauguuguaaucggccuuuuguucaugauucuuacuguagcugcuaacgaaaugggcuuacuagaaacuacuaagaaagaucuuggaauuggauacguagcagccgagaaccaccaacaugcgacaaugcuggacgucgaccugaggcccgcaucagccuggacccucuacgcaguugccacaacuguuaucacaccgaugaugcgucacaccauagagaauaccacagccaacauaucucucacggcaaucgcaaaccaagcugcaaucuuaaugggacuugacaaaggguggccuauuagcaaaauggacauaggcguuccguuacucgcuuuaggauguuacucucaaguuaacccccuaaccuuaacugcggcaguauuaauguugguugcucacuaugcgaucauuggcccgggacuucaggccaaagccacaagagaagcgcagaagaggaccgcggcuggaauaaugaaaaacccaaccgucgaugguauuguagccauugauuuagauccaguugucuaugaugcuaaauuugaaaaacaacuuggacaaauaauguuguuaauucugugcacuucccaaauacuacuaaugcgcacaacuugggcucuaugugaauccauaacucuugccacagggccuuuaacuacgcuaugggaaggguccccagguaaauucuggaauacgacaauugcagugucuauggcaaauauuuuccggggcucuuaucucgccggugcgggacuagccuucucauuaaugaagucccugggaggagggagacgcggaacuggugcgcaaggagagacucugggagaaaaauggaaaaggcaacuaaaccaacuuagcaagucagaauuuaacacguauaaaagaagcggcauaauggaagucgacagaagcgaagcaaaagaaggauuaaagagaggugaaacaacuaaacaugccguuagcagaggaacggccaaacuuagaugguuuguugaaagaaacuuaguaaagccugaagguaaaguaauagacuuagguugcggcaggggaggauggagcuauuauugugcuggucuuaagaaaguaacugaggugaaaggguauacaaaaggugggccaggccaugaagaaccgaucccuauggcuacauauggguggaaccuaguaaaacuacauucugggaaagacguauuuuucaugccgccagaaaaaugugacacauuacuaugugauauaggugaaucuucaccuaauccuacaauugaagaaggacgaacauugagaguccuuaagaugguagaaccauggcuaaagggcaaccaauuuuguaucaaaauucucaacccuuauaugccaucuguuguagaaacguuagaacaaaugcaaagaaaacacgguggaaugcucguaagaaacccacugucccgcaacucaacccaugagauguacuggguuucuugcggaaccgguaauaucgugucugcugucaacaugacuucaagaauguuacucaacagauuuacaauggcacacagaaaacccaccuacgagagagacgucgaucuaggggccgggaccagacauguugcuguagaaccggaggucgcaaaccucgacauaauaggucaaagaaucgagaacaucaaaaaugaacacaagucaaccuggcacuacgacgaggauaauccuuacaagacuugggcguaccaugguucauacgaaguaaaaccaagcggaagugcuucaaguauggucaacggcguaguacggcuacuuacgaaaccaugggauguaauaccuauggugacacaaaucgcaaugacugauacaacaccuuucggacaacaaagaguauucaaagaaaaaguagacacaagaaccccacgagccaaacgagggaccacucagauaauggagguaacagcaaaguggcuuuggggauuucuaucaagaaacaagaaaccaaggauauguacgagagaagaguucacccggaaagucagauccaaugccgcuauaggagccguuuucguagaugaaaaccaauggaacucagcaaaggaggcaguugaagaugaaagauucugggaucuuguacauagagagagagaacuucacaagcaaggaaaaugugcgacgugcguauauaauaugaugggcaagagagaaaagaaacuaggugaauuugguaaagccaaagggagcagagcuauuugguauauguggcucggugcaagauuucuagaguucgaggcacuagguuucaugaacgaggaucauugguuuaguagggaaaacagcuuaucuggagucgaaggugaaggacuucacaaauuaggauacaucuuacgagauaucucgaagauuccgggaggaaacauguaugcagacgauacagcuggaugggacacgcgcauaacugaggaugaucuacaaaaugaggcuaaaaucacugacaucauggagccagaacaugcucuccuagcgacaaguaucuucaaacuuacuuaccaaaauaaagugguuagaguccagagaccugccaaaaacggaacaguuauggacguuauuucacgaagagaucaacguggaucuggacaaguagguacauacggacuuaacacauuuacgaauauggaaguccaacuaaucagacaaauggaaucugaagguauauuccuacccagugaacuagaaacuccaaacuuagccgaacgaguucuagauuggcuagagaaacauggcgccgaaagacuaaagcggauggcgauaaguggugacgacuguguaguaaaacccauugacgacagauuugccacggcauuaacugcucuuaacgacauggguaaaguucguaaagacauaccccagugggaaccgucuaaaggcuggaacgauuggcaacaagugccauuuuguucacaucacuuccaccaguuaauaaugaaagauggacgugaaauuguuguaccauguagaaaucaagaugagcuugucggcagagcucguguuagucaaggcgcaggauggucccucagagagacggcuugucuugguaaaucuuaugcucaaauguggcaauugauguauuuccacagacgagaccuaagacuugcggccaacgcaauuuguuccgcuguaccaguagauugggugccaacuucgagaaccacuugguccauacacgcacaucaucaauggaugacaacugaggauaugcuaucgguguggaaccgcgucuggauagaagaaaauccguggauggaggauaagacucauguaagcucaugggaagaaguaccguaucucggaaaaagggaagaucaauggugcgggagccucaucgguuuaacggcacgcgccacaugggcgacuaauauccaaguagcuaucaaccaagugcgucgccuaaucgggaaugaaaacuauuuagacuacaugacuucuaugaaacgauucaaaaacgaaagugacccugaaggugcauuaugguaa

SEQ ID NO: 21425 - RNA, 9879 nt, Artificial Sequence
  derived and/or modified CDS sequence (opt6) from DENV-1__JN819425__SS-prME
agcguuaccaugcucuuaauguugcuccccacugcucuugcauuucauuuaacaacaagaggaggagaaccccauaugaucguuucuaaacaggaaagagguaaaagucucuuauucaaaacuuccgcggggguaaauauguguacauugauagcuauggauuugggagaacugugugaagauacgaugacauacaaauguccccguauaacugaagcugaaccagacgacguugauuguuggugcaaugcaacugacacuugggugaccuaugguacauguagucaaacgggagagcauagaagagagaaaagaagcgucgcccuugccccacacguuggauuaggauuggaaacuagaacagagacuuggaugaguucugagggugccuggaaacagauccaaagaguugagacuugggcgcuacgccacccaggcuuuaccguaauagcuuucuuucuggcccaugccauaggaacaaguaucacucaaaaaggaauuauauuuauacuauuaaugcuuguuacgcccaguauggcaaugaggugcguaggaauuggcaaucgugauuucguggaaggauuaaguggagcuacuuggguagacgucguauuagagcaugguuccugcgucacuacgauggcgaaaaacaaaccaacacuugacauugaacugcuuaaaacugaagugacuaacccggcaguauuaagaaaacuguguauugaggcaaaaauaucgaacacuacgacugauuccagaugucccacacagggggaagcaacucuugucgaagaacaagacgcuaauuuuguaugucgaagaaccuucguugaccgaggaugggguaaugguuguggauuguuugggaaaggcucguugcuuacaugcgcaaaauucaaauguguaacaaaacuagaagggaaaauuguucaauaugaaaaucuaaaauauaguguaauagucacaguucauaccggagaucaacaccagguuggaaacgaaacaacggagcacggaaccauagcgacaauuacaccucaagcgccaacuucagaaauacaguuaacagacuacggagcccuaacucuagacugcagcccucguacugguuuagauuuuaacgaaaugguucuacuaaccaugaaagaaaaaucaugguuggugcacaaacaaugguuccuagaucuaccccucccguggaccuccggggcaaguacgucacaggagacuuggaacagacaagauuuacuuguuacauucaaaacagcccacgccaagaaacaggagguaguaguccuugggagccaggagggagcuaugcacacagcccuuacaggggccacagaaauacaaacaucggguacaacgaccauuuuugcgggacaucugaaaugucgucucaaaauggacaaauuaacucuaaaaggaaugaguuacguaauguguacaggaucauuuaaauuggaaaaagaaguggcugaaacucaacacggaacaguauuaguacaaguaaaauaugaagguacugaugcccccuguaaaaucccauuuucaacucaagacgaaaaagggguuacucagaauggacguuugauaacugccaauccaauuguaacagauaaagaaaaaccaguaaauauagagaccgaaccuccauucggagaaaguuacaucgucguaggcgcuggugaaaaagcacuuaaacucaguugguuuaaacguggcuccuccaucggaaaaauguuugaagcgacggccaggggagcucgacguauggcaauauuaggagauacugcuugggacuucggcucaauagguggaguuuucacauccguugguaaguuaguucaucaaguauuuggaacugccuacggaguucuauuuucagguguaaguuggaccaugaaaauugggauagguauucuacucacauggcuaggucuaaacucuagaucaaccucgcuaucaaugacauguaucgcuguuggaaugguaacauuauauuuaggcgucaugguccaggcugauucgggaugcgugaucaauuggaaaggaagagaacuaaaaugugguucaggaauauuugucaccaaugaaguacacacauggacagagcaguacaaauuucaagcagacagucccaaaaggcucucggccgcaauaggaaaagcaugggaagaaggugucuguggcauucgaucagcaacucgacuugaaaauauuauguggaaacagaucagcaaugagcucaaucacauucuauuagaaaaugauaugaaauucacaguagugguaggagaugcaaacgguauuuuagcgcaagggaagaaaaugauccggccacaaccgauggagcauaaauacagcuggaaaaguuggggcaaggcaaagauaauaggagcagauauucaaaauacaacuuucauaauugaugggccugacacgccagaauguccggauggccagcgggccuggaauauaugggaaguggaagauuauggauucggaguauuuacuacaaauaucuggcugaaacugcgugauucguauacccaaaugugcgaucauagacuaaugagcgcagcaaucaaggauucgaaggcaguccaugcagauaugggguacuggauagagucagaaaagaaugaaacauggaaacuagcaagagcgagcuuuauagagguaaaaacauguacauggccaaagucacacacuuuguggucaaacggcguauuagagucugaaaugauaauaccaaaaauuuaugggggcccuauaucacaacauaauuacaggcccggauauuucacccaaacagcuggaccguggcaccuagggaaauuggaguuggacuuugacuugugcgaaggaaccacaguaguuguagaugaacacugcggcaaccguggcccuucccuuaggacaaccaccguaaccgggaagauuauccacgaaugguguugucgaaguugcacacugccaccccuacgauucaggggagaagauggguguugguauggaauggagauuaggccaguuaaggaaaaagaagaaaauuuaguuagaucaaugguaagugcaggaagcggugaagucgacaguuucucucucgguauacuaugcguauccauaaugaucgaagaaguuaugagaaguagaugguccagaaaaaugcuaaugaccggaacccuugccguuuuccuauuacuaaucaugggccaacugacguggaacgaucuaauuagacucugcauaaugguaggagcuaacgcauccgauagaaugggaaugggaacuacauaucuugcucuuauggccaccuuuaagaugcgacccauguucgcggucggauuacuuuuuagacgacuuacuucaagagagguauuguugcucacaauuggucuuucucuuguagcuucuguugagcuaccaaacagcuuagaagaacuaggggaugggcucgcgauggguauaaugauguuaaaacuauugacagaauuucaaccacaucaacuguggacuacgcuuuuaucacucacauucguaaagaccacgcucagcuuggacuacgcauggaaaacaacugcaaugguacucagcauuguuucgcuauuccccuuaugccucucuacuacuucacaaaagacaacuuggcucccaguucuacugggauccuucgguugcaaacccuugacaauguucuuaauuacagaaaauaaaaucuggggaagaaaauccuggccucuuaacgaagggauaauggcaauuggaauaguaucaauccuguugucuucacuauugaaaaacgauguacccuuagcuggaccuuuaauagcugggggcauguugaucgcgugcuacguuauaaguggaagcagugcagauuugucacuagagaaggcggucaagauuaguugggaacaagaagcugaacacagcggugccucgcacaacauacugguugaaguacaagaugauggaacgaugaaaauaaaagaugaagaacgugaugacacauuaacaauuuugcugaaggcaacauuauuagccguaucaggaguguauccgaugaguauacccgccacacuuuuuguaugguacuuuuggcaaaagaagaaacaacgcucaggcguauuaugggacacaccuaguccuccggagguugaaagggcagucuuggacgauggcaucuacagaauauuacaaagaggucucuuagggagaagucaagucggaguagguguguuucaagauggaguauuucauaccauguggcauguuacucgcggagcaguacuaauguaucaaggcaagagauuagaaccuagcugggcauccgucaagaaagacuugauaucauaugguggaggauggcguuuucaaggaucauggaacacaggcgaagaaguccagguaauugcaguagaaccgggcaaaaaccccaaaaauguucagaccacgccggguacauucaaaacucccgaaggugaaguuggugcaaucgcguuggauuucaaaccuggcacgagcggaucaccuauagucaauagagaaggcaaaauagugggauuauacgggaacggaguuguuacaacgucaggaacauacguauccgcgauagcucaagcaaaagcaucacaagaagggccgcuuccagaaaucgaggacgaagucuucaagaaacgaaaucuaacuauaauggaucuucauccgggcucggggaaaacaagacgauaccuuccagcaaucguaagagaagcaauuaaacgcaaacuccguacgcucauauuggcgccaacucgaguuguggccucagaaauggcugaagcauuaaaggggaugccaaucagauaucaaacuacugcagugaaaagcgaacacacuggaagagaaauaguagacuuaaugugccaugccacuuucacuaugcgacuguuaaguccuguaagaguaccuaacuacaacaugaucaucauggacgaggcgcacuuuacagauccggcuagcaucgcugcacggggauacaucucgacucgugugggcaugggugaggcagcugcaauuuuuaugacagccacuccaccaggauccgucgaggcauucccccaaaguaacgccguaauacaagaugaagaaagagauauaccggaaaggaguuggaacucugguuaugacuggauaacagacuuuccagguaaaacuguaugguuuguuccuucgauuaaauccggcaaugacauagcuaacugccucaggaaaaauggaaaacgaguaauacagcuaucaagaaaaacauucgacacagaauaucaaaagacuaaaaauaaugacugggacuacguuguaacaacagacauuucggaaaugggggcaaauuuuagggcagaccgaguuauugauccucggagauguuuaaagccgguaaucuuaaaagacgguccagaacgugugauauuagcuggaccgaugccuguuaccguagcaagugcagcccaaagaagagguaggauaggaagaaaucaaaacaaagagggggaucaauauguuuauaugggccagccuuuaaacaaugacgaagaucacgcccauuggacugaagcaaaaaugcugcuugacaauauuaauacuccagaaggcauuauaccggcguuauuugaaccggagagggaaaagagcgcagcaaucgacggagaguacagacucagaggagaagcaaggaagacauucguagaguuaaugaggagaggugaucuuccgguauggcuaucuuacaaaguagcaucugaagguuuccaauacuccgauagacguuggugcuucgauggagaacgaaauaaucaaguacuagaagagaauauggacguagagauauggacgaaagaaggugaaaggaagaaacuaagaccucgauggcuugacgcaaggacguacuccgauccacuagcccuaagagaauuuaaggaguuugcagcaggaagaagaucugucaguggagauuuaauucuagaaauagguaaauuaccacaacauuuaacccuuagggcacaaaacgccuuggacaaccuaguaauguuacacaauucagaacaaggcgguaaggccuauagacaugcaauggaagaacucccggauacuauagaaacccuaauguuauuggcgcuaauagcgguacuaacuggcggugucacucuuuucuuuuuaagcgggaagggauugggaaaaacauccauugguuuauuaugcguaacggcgucuucagcacuuuuauggauggcuaguguagaaccacauuggauagcagcuucgaucauuuuggaauuuuucuuaaugguacuauugauuccagaaccggauaggcaaaggacgccacaagauaaucaauuagcauauguugucauuggauugcuauucaugauacuaaccguugcugcgaaugaaaugggauuacuagaaacaacaaagaaggaccucgggaucgguuauguagcugcggagaaccaucaacaugcaaccauguuagauguugaucuucauccugcuucggcauggacuuuauaugcaguagcuacgacaguuauaacaccaaugaugcgucauacaauagaaaauacaacugcaaauauaagucuaacagcaauagcgaaccaagcggcaaucuuaauggggcuugauaaaggauggccgauaucuaaaauggauauuggagugccucugcuagcacucgggugcuacucucaaguuaauccgcuuacgcuaacagcggcaguacuuauguuaguagcacacuaugcuauaauugggcccgggcuacaggcuaaagcuacccgagaagcucaaaagagaacugcagcuggaaucaugaaaaaucccacaguggacgggaucguugcuaucgacuuagacccuguaguauaugaugcuaaauucgaaaaacaacuaggacagaucauguuacucauauuauguacgucgcaaauauuauuaaugagaacgacuugggcacuuugugagaguauuacgcuugcaacagguccauuaacaacccugugggagggcaguccuggaaaguuuuggaauacaacgauagcgguauccauggcuaacauauuccguggaucauauuuagccggggccgggcuagcauuuucccuaaugaaauccuuaggaggaggucgccgaggaacaggagcgcaaggagagacuuuaggagaaaaauggaaaagacaguuaaaucaacucuccaaaucggaauuuaauacuuauaagagaucaggaauaauggagguugaucgaucugaggcaaaagaagguuuaaagcguggagagacuacaaaacaugcaguuagucgaggcacagcaaaguugagaugguuuguagagagaaaucuaguaaaaccugagggcaaggucauagaucucggcuguggacgcggaggauggucuuauuauugcgcaggcuuaaagaagguuaccgaaguaaaagguuauacuaaaggaggacccggacacgaagaacccauucccauggccacauauggauggaaucuggucaaguuacacaguggaaaagacguauucuuuaugccgccugaaaaaugugauacucuccugugugauauaggcgagucaucuccgaauccgacgauagaagaaggccgaacgcuaagaguacuaaaaaugguugaaccguggcucagaggaaaucaauuuugcauaaaaauucuaaauccguauaugcccagugucguagagacgcuagaacagaugcaacguaaacauggagguaugcugguccguaauccacugucucgaaauagcacucaugaaauguacugggucagcugcggcacaggaaauauaguaucagcgguaaacaugacaaguagaaugcuacuaaaccgauuuaccauggcucaucguaaaccgacuuacgagcgugacguggaccucggagccggaacacgccacguagccguugaaccugaagucgcgaaucuggauauuauuggacaaagaauugaaaauauuaaaaacgagcacaagaguacauggcacuacgaugaagauaacccuuacaaaaccugggcuuaucacgggagcuacgaggugaaacccucagguucagcgucuuccaugguuaacggaguuguaagacugcuaaccaaaccgugggacgugaucccaauggucacacaaauugcaaugaccgacacgacaccuuucgggcaacagcgaguuuucaaagaaaaaguugauacaagaaccccacgcgcuaaacgaggcacaacucaaauaauggaagucaccgcaaaauggcuuuggggcuuccuuucucggaauaagaaaccuagaauuuguacaagggaagaguucaccaggaaagugagaucgaacgcggcgauuggugcagucuucguugaugaaaaccaauggaauagcgccaaggaagcaguagaagacgaaagauuuugggaccugguacauagagaaagagaauugcauaaacagggcaagugugcaaccugcguauauaacaugaugggaaaacgagagaagaaauuaggugaauuugguaaggcuaaaggaucucgugcaauuugguauauguggcucggugcaagauuuuuagaauuugaagcacucggauuuaugaaugaggaccacugguuuagccgugaaaauaguuuaucugggguagaaggugagggccuacauaaauuaggguauauucuacgugauauaucaaaaauuccuggaggaaauauguacgcggacgauacagcaggaugggauacaagaauaacugaggaugacuuacaaaacgaggccaaaauuacggacauaauggagcccgaacacgcucuacuggcaacaagcauuuucaaacuuacauaucaaaauaagguaguuaggguucaacgaccagcaaagaacggaacuguuauggauguuauauccagaagagaucaacgaggaagcggccagguagguacauauggcuuaaauacuuuuacuaauauggaagugcaacuuauuaggcaaauggaaagugagggaauauuucuaccuuccgagcuugagaccccuaauuuagcugaacgugcgcuagauugguuagaaaaacacggugcagaaagguuaaaaagaauggccauuagcggugacgauugugucgugaaaccaaucgacgauagauucgcuacagccuugacugcgcuuaacgauauggguaaaguuagaaaagauaucccucagugggaaccaaguaaagguuggaaugauuggcaacagguaccguuuuguucccaccauuuccaucaauugauaaugaaagacgggcgagaaauuguaguaccuugucgcaaccaagaugagcuagugggacgagccaggguaucgcaaggagcagguuggucgcuacgugagacugccugucuaggcaaaucuuaugcacaaauguggcaauuaauguacuuucaccgcagagaucuaagacuugccgcaaacgcaaucuguagcgcagucccuguagauuggguaccgacuucaagaacaacaugguccauccaugcacaccaucaauggaugacaacagaggacaugcuuucuguauggaauagaguauggaucgaagaaaaccccuggauggaagauaaaacacacguuucaucuugggaagaaguaccauacuuagggaaaagagaagaucaguggugugguagucugauugguuugacugccagagcgacgugggcgacaaacauccaaguagcuauaaaccaaguucgaagacuaauuggaaaugaaaacuaucuagauuauaugacuucaaugaaaagauucaaaaacgagagcgaccccgaaggagcacucugguag

SEQ ID NO: 21426 - RNA, 9879 nt, Artificial Sequence
  derived and/or modified CDS sequence (opt6) from DENV-1__FJ850099__SS-prME
aguguuacuauguuacuaauguuguugccuacggcguuagcauuucaucuuacuacuaggggaggggaaccacauaugauuguaagcaaacaagaaagagggaaaucacucuuauucaaaaccagcgcugguguaaauaugugcacucuuauagcaauggaucuaggagaacuaugugaagauacaaugaccuauaaauguccacguauaacugaagcagaaccugacgacguagauuguugguguaacgcaacagauacauggguuaccuacggaacaugcucgcaaacuggugaacacaggagagacaaacgaagcgucgcauuagcaccacacgugggacuaggacuagaaacccguacagaaaccuggaugaguucugaaggggcauggaaacaaauacaaagaguagaaacgugggcacugagacaccccggauuuacggucauugcauuauuuuuggcacaugcgauagggacuagcauuacucaaaaaggaauaauauuuauauuacugaugcuaguaacgccaaguauggcaaugcgcuguguaggaauaggaaacagagauuucguagagggucuaucaggggcuacauggguagacguaguauuggaacacggcucguguguaaccacaauggcuaaaaacaaaccuacacuugauauugaacuccuaaaaacagaaguaacgaauccugcaguccuccggaaauuauguauagaagcaaaaauuucuaauaccacgacagacagccgauguccaacgcaaggagaagcgaccuuaguggaggaacaagacgcuaauuucguaugcagacguaccuuugucgaccgaggcuggggaaacggaugugguuuauuugggaaagguagccuacucacuugcgcuaaauuuaaaugcguuacaaaacuagaaggcaaaauaguacaauaugaaaauuugaaguauagugugauagugacuguacauacaggagaucaacaucaagucgguaacgaaaccacugaacauggaacuauagcuacaauuacuccacaagcgccuacaagugaaauccaauuaaccgacuacggagcacuaacauuggauuguucaccaagaacaggucuagauuucaacgaaaugguccuuuuaaccaugaaagagaagaguuggcugguccauaaacaaugguuuuuggauuuaccacuuccuuggacaaguggggcuucuacaagucaagagacguggaauagacaagaccuacugguaacauuuaaaacugcccacgcuaaaaagcaagagguagucguacuagggucacaggaaggggcgaugcauacagcucuuaccggagcuacagaaauacaaaccucugggacaaccacuauauucgcagggcacuugaaguguagauuaaagauggacaaacuuacuuuaaaaggaaugaguuacgucauguguacgggaucguuuaaacuugaaaaagagguugcggaaacucagcaugguacugucuuaguacaaguaaaauaugaagguacagaugccccaugcaagauaccuuuuucuacacaggaugaaaaagguguaacucaaaacggacgccuaauaaccgccaaccccauaguuaccgauaaggaaaaaccaguaaacauagagacggagcccccuuuuggcgaauccuauauagucguaggagcaggagaaaaggcacuaaaacuaucaugguuuaagaaaggcucaaguaucgguaaaauguucgaagcaacagcuaggggagcacgaagaauggccauacuuggugauacagcaugggacuuuggaucgauaggaggaguguucacaucggugggcaaauuaguucaucaagucuuuggaacagcguacgggguuuuguuuucaggugugaguuggacgaugaagauaggcauuggcauuuuauuaacaugguugggucucaauucucggucaaccagucuaucaaugacuugcauugcagugggcaugguaaccuuauacuugggcguaauggugcaggccgacuccggaugcguuauuaacuggaaaggacgagaauuaaaauguggaagcgggaucuuuguuacuaaugaggugcauacauggacagagcaguauaaauuucaagcugacuccccuaaaagacugucggcugcaauuggaaaggcgugggaagaaggcgucugcggcauacgaagugcgacacgauuagaaaauauaauguggaagcaaauuucaaaugaguuaaaccacauauuacuugaaaacgauaugaaauuuacgguaguuguaggcgaugcuaaugguauucucgcucaaggcaagaaaaugauaaggccacaaccaauggaacauaaauauagcuggaagucuugggggaaagcuaaaauuauuggagcugauauucaaaauaccacuuuuauuauugauggaccugauacgccagaguguccagauggccagagagcauggaacauuugggagguagaagauuauggguucgggauauuuacuacaaauaucuggcuaaaauugagggacaguuacacacagaugugugaccauagacuuaugagcgcagcuauaaaagauagcaaagccguucacgcggauauggguuacuggauugagagcgagaaaaaugaaacuuggaaacuagcacgagcgucauuuauugaagucaaaaccuguaccuggccuaagucucauacguuaugguccaauggaguucuagagagugaaaugauaauucccaaaaucuauggcggaccaauaagccagcauaauuauagaccgggauacuuuacgcaaaccgcagguccauggcaucucgggaaacuggaacucgacuuugauuugugugaggguaccacugucgugguagaugaacauugcggaaacagaggaccaagccuucgaaccacaacggugaccggcaaaaucauucaugaguggugcugccgcucuugcacacucccucccuugcgcuuucgaggagaggacggauguugguaugggauggaaauaagacccguaaaggagaaagaagagaauuuaguaagaaguauggucagugcaggaucgggugaaguagauaguuuuucauuagguauuuuaugcguaagcauaaugauugaggaagucaugcgaagucgcuggagcagaaaaaugcucaugaccggaacacucgccguuuuucuacuuuugauuaugggacaacuuacuuggaaugauuugauccgcuuaugcauuaugguuggugcuaaugcuucugacaggauggggauggggacaacauaccuugcauuaauggcaacauuuaaaaugcgaccaauguuugcuguagguuugcuauucaggcgauuaacaagcagggagguauuauuguuaacgauaggucuuuccuuaguggcaagugucgaacuuccaaacagcuuagaggaauuaggggacggccucgccaugggaauaaugauguuaaaacuacuuacggaauuucaaccucaucaauuauggacgacgcuuuuaaguuugacauucgucaagacaacgcucucucucgauuacgccuggaaaacaacagcuauggugcuaaguauaguaucguuauuuccacuaugucucagcacaaccucacagaaaacuaccugguugccuguacugcuaggcaguuucgguuguaagccauugacgauguucuugauaacagagaauaaaauuuggggucguaaaucguggccccuaaaugaaggcauaauggcaauugguauuguaaguauacuucugucgucuuuacucaaaaacgacguaccacuagcggguccacuaauagcaggcgguaugcugaucgcauguuauguaauaagcggaaguucugcagaucuaucauuggaaaaggcagcggaagucuccugggaacaagaagccgagcacucgggagcaagccauaauaucuuaguugaaguccaagacgaugguacaaugaagauuaaagaugaggaacgcgaugacacgcucacuauacuauugaaagcaacccugcuagcagucaguggaguuuauccaauguccaucccagcuacacuauucguaugguauuuuuggcagaagaagaaacagagguccgggguacucugggacacuccuuccccaccagagguugaacgugcaguauuggacgaugggauauauaggauuuuacaacgcggauuacuggguagaagucaaguuggcguuggaguauuccaagacgguguauuucacaccauguggcauguuacgaggggagcuguuuuaauguaucaaggcaagcgacuagaaccaagcugggcaucaguaaagaaagauuuaauaucauacggcggaggguggagauuccagggaucuuggaacaccggggaagaaguacaaguuauagcaguugaacccggaaagaaucccaaaaacguacaaacaacaccagggacuuuuaaaacgccagagggcgaagugggugcaaucgcuuuagacuuuaaaccaggaacgagcggaucaccuaucguaaauagagaagguaaaauuguagguuuauacggaaauggaguuguaaccaccucaggaacguacguaagcgcaaucgcccaggcaaaagcaucacaagaaggaccuuugccugaaauugaagaugaaguauucaaaaagagaaauuuaacgauuauggauuuacauccugguucaggaaagacaagaagguacuuaccggccauaguacgagaagcaauaaagagaaaacuaagaacgcuaauauuggcaccgacgaggguagucgcuagugaaauggcugaagcgcuaaaaggaaugccgauaagauaucaaacuacggcuguaaaaucagagcauacgggcagagagauaguagaccuaaugugucacgcgacauuuacuaugagacugcugucaccuguucggguaccgaauuacaauaugauaauaauggacgaggcucacuuuacagauccagcaucaaucgcugcucgaggauauauaucaaccagaguaggaaugggagaggccgccgcaaucuuuaugacagccacgccuccugguagcguagaggcauuuccccagucgaacgcagugauacaagacgaagaaagagauaucccagaaagaucauggaauagcggguacgacuggauaacagauuucccagguaagacgguaugguuugugcccagcauaaaaucuggaaacgauauugcaaauuguuugcggaaaaacggaaagagaguaauacaauugucccguaaaacguuugauacggaauaucagaaaaccaaaaauaaugacugggacuaugucguaacaacagauauaucagaaaugggugcaaauuucagggcggauagagucauagauccgagaagaugccucaaaccaguaauacuaaaggauggacccgaacgagucauacuugcaggcccaaugcccguaacaguagcuuccgcagcccaacggcggggucguauaggucguaaucagaauaaagaaggagaucaauauguguauaugggucaaccuuuaaauaacgacgaggaccacgcgcacuggaccgaagcuaaaaugcuauuagauaauauaaacacacccgaaggcauuauucccgcacuauucgagccugaaagagagaaaagugcagcgauagauggagaguauagauuaagaggagaagcacggaaaacauuuguagaauuaaugaggcguggcgacuugccaguguggcucucauacaaaguggcaagugaaggauuucaauauagcgaccggagaugguguuucgacggggagcgaaauaaccaagucuuagaggagaacauggaugucgagauuuggacgaaggagggagaacggaagaaacuccgcccaagaugguuagacgcuagaacauauagcgaucccuuggcacugcgugaauuuaaagaauuugcagccggacgcaggucaguaucaggagauuugauauuagaaauugggaaacuuccgcaacacuugacucuuagagcucaaaacgcacuggacaaccuaguaauguugcauaauagugaacaggguggaaaagcauauagacaugcgauggaagaacuuccugacacuaucgagacuuugauguuacuagcacuuauugcuguucuuacaggaggggucacacuauucuuucucagcggcaagggauuaggaaaaacgagcaucggguuguuaugugucacagcgucaagcgccuugcuauggauggcuagcgucgaaccgcacuggaucgcagcaucaauuauauuagaguucuuccuaaugguacuuuugauaccggaaccugauagacaaagaaccccucaagauaaccaacuggcuuacguugugauaggauuauuauuuaugauauuaacuguagcagcaaaugaaaugggucuauuagaaaccacuaagaaagaucuugggauaggguauguggcggccgaaaaucaucagcaugcaacuauguuggauguagauuugcgacccgccagcgcguggacauuauaugcgguagcgacgacuguaauaaccccaaugaugcgucauacuaucgaaaauacgacagcgaacauaagucuuacggcuaucgccaaccaggcagcaaucuugauggguuuagauaaaggcuggccaauaaguaagauggauaucggagucccauuacucgccuuaggaugcuauagccagguaaacccguuaacauugacagcggcaguguuaaugcucgucgcacacuacgcgauaauaggaccagggcuucaagcaaaggccaccagagaagcucagaaaagaacugcagcuggaauaaugaaaaauccuacugucgacgggauaguagccauagauuuagauccuguaguguacgacgcgaaauucgaaaaacaacuaggucaaauuauguuacuaauucuauguaccucucagauacuacuaaugagaacaacuugggcucuaugugagaguauuacccuugcgacaggaccgcuaacgacauuaugggaaggaucuccaggaaaauucuggaacacuacaauugcaguaaguauggccaauauuuuuaggggaagcuauuuagcuggagcggggcuagcuuuuucgcuuaugaaaucucuaggaggaggcagaagagggacgggcgcccaaggggagacucuaggugaaaaauggaaaaggcaauuaaaucaacuuaguaagagugaauuuaauacauauaaacguucugguauaauggaaguagauaggagcgaggcuaaggaaggauuaaaaagaggugaaacgaccaaacaugccgucagucgagguacagcuaaacuuagaugguuuguugaacgcaaucuaguuaaaccagaaggaaaagugaucgauuuaggaugcgggagaggcggcuggucuuauuacugugcaggacuaaagaaagucacagaaguaaaagguuacacaaaaggugguccuggucacgaggaaccaaucccaauggcuaccuacggauggaaccugguaaaacuccauucagggaaagauguauucuuuaugccuccagagaaaugugauacgcuacuaugcgauauuggagaguccucucccaacccaacaauugaggaaggucgcacgcuuagagugcuuaaaaugguggagccuuggcuaaaagguaaucaguuuuguauuaaaauuuugaauccguauaugccaaguguaguagaaacacuggaacaaaugcaaaggaaacacggaggaauguugguaaggaaucccuugagccgcaauaguacucacgagauguauugggucaguugcgggacugguaacauagucagcgcaguaaauaugaccagcaggaugcucuuaaacagauuuacaauggcccaucgaaaaccuacuuacgaaagagacgucgauuuaggugcaggaacgagacaugucgcaguggaaccugaaguugcuaaucucgacaucauuggacaacggauagaaaauaucaaaaacgaacauaaaaguacauggcauuacgaugaagauaaccccuauaaaacgugggcauaccauggcagcuacgaagugaaaccgagcggaagugccucuucuaugguuaacggggucguaagacuucucacuaaaccaugggaugucauaccuaugguuacucaaauugcuaugacagacacaacuccauuugggcaacaacgaguguuuaaagaaaaaguugauacccgcaccccucgagcaaaaagaggaacaacacaaauuauggaaguaacagcaaaaugguuauggggguuccuaaguaggaauaagaaaccacgaauuuguacuagggaagaauuuacuagaaagguaagaucaaacgcggcaauuggagcgguauucguggaugagaaucaguggaauagcgcaaaagaagccguugaagaugaacgauuuugggaucuaguucaucgagaaagagaacugcauaaacaagggaagugugcuaccuguguuuauaauaugauggguaaacgggagaagaaauuaggcgaauuugguaaagcgaaggguucucgggccauaugguauaugugguuaggagcacgcuuccuagaguuugaggcguuagguuucaugaacgaagaccauugguuuagucgagaaaauaguuugucaggagucgaaggggaaggacuacauaaguuagguuauauuuuaagagauauuagcaaaauuccgggaggcaauauguaugcugaugacaccgccgguugggacacacgaauaacugaggacgaucuccaaaaugaggcuaagauuacagauauuauggaaccugagcacgcauuguuggcaaccagcaucuuuaaacuuaccuaucaaaauaaagucgucagaguacaaaggccagccaaaaacggaacggugauggauguaauauccaggagggaucagaggggcaguggccagguaggaacauauggcuuaaauacauucacaaauauggagguucaguuaauuagacaaauggaaucagaggguauauuucugagcagcgaguuagagacgccgaacuuggcggaaaggguacuggauuggcuugagaagcauggagcugaacgucuuaaacguauggcuauuucaggugaugauuguguggucaagccaauagacgaucgguuugcgaccgcucuaacggcccuaaacgauauggguaaaguuagaaaagauauaccccaaugggaaccaaguaaaggguggaacgauuggcaacaaguaccauucuguagccaucauuuucaccaacuuauaaugaaggauggcagagaaauuguaguaccauguagaaaccaagaugaauuagugggacgagccagaguaagccaaggagcaggcuggucgcugcgagagaccgcauguuuagguaagucauaugcccaaauguggcaacuaauguauuuccacagacgugacuugagacuagcagcuaaugcaauauguucagcugucccuguggauugggucccaacuucgagaacuacguggucaauacacgcucaccaucaguggaugacaaccgaggacauguuaagcguauggaaucgagucuggauugaggagaaccccuggauggaggacaaaacgcauguuuccucuugggaagaaguaccuuacuuagggaagcgagaagaccaguggugugguagccuuauugggcucacggcaagagcuacaugggcgaccaacauacaaguagccauaaaucaggugcgaagauuaauuggaaacgaaaauuacuuagauuauaugacuuccaugaaacguuuuaagaaugaauccgauccugaaggggcuuuaugguaa

SEQ ID NO: 21427 - RNA, 9879 nt, Artificial Sequence
  derived and/or modified CDS sequence (opt6) from DENV-1__FJ850100__SS-prME
agcgugacuauguuacuaauguuacuaccuaccgcauuagcauuccauuuaaccacaagagggggagaaccgcacaugaucgucucaaaacaggaacgaggaaaaucauuauuguuuaaaacgagugcuggagucaacauguguacacugauugcaauggacuuaggagaacuaugugaagacacaaugaccuauaaaugcccaaggauaacugaagcugaacccgacgaugucgacuguugguguaaugcuacugauacauggguuaccuacggaacuuguucucaaaccggagaacaccgacgagacaaaaggucuguagcauuagcuccacacgucggacuagggcuagaaaccagaacagaaaccuggaugucaucggaaggcgcauggaaacagauccaaaggguagaaacuugggcacuuagacauccaggauucaccguuauagcauuauuucuagcacacgcgauuggcaccucaaucacgcaaaaaggcaucauauucauucucuuaaugcucgugaccccuucaauggcaaugagaugcguugggauaggaaaucgggauuuuguggaaggucuuaguggagccacauggguagauguaguauuggaacacggaaguugcguaaccacuauggcuaagaacaaaccaacacuagauauagaguuguuaaaaacggagguaacaaaucccgcgguucuaaggaaguuaugcauagaggcaaagauaucuaauacaacaacggauucuagguguccuacacaaggggaagccacccuaguagaggaacaagacgccaauuucguuugucguaggacauucguagaccgcggguggggaaacggauguggcuuguuuggaaaaggaaguuuauuaacaugcgcuaaauuuaagugugucacuaaacuugaaggaaagaucguacaauaugaaaaucuaaaguacaguguuauuguaaccguacauacaggcgaucaacaucagguaggaaacgagacaaccgaacauggcacaaucgcaacgauuacgccacaagccccaaccucagaaauucaacuaacggauuauggagcauuaacucuggacugcuccccucgaacaggacuggauuucaaugagaugguccugcuaacaaugaaagaaaagagcugguuaguacauaaacaaugguuuuuagaccucccgcucccguggacaucaggagcuucaacaucucaagagaccuggaaccgccaagauuugcugguuacauucaaaacugcgcacgccaagaaacaagaagucguaguauuaggaucacaggaaggagccaugcauacagcacuaacaggagcuacugaaauccaaacauccgguacaacaacaaucuuugccggucaucugaaaugucgucuaaaaauggauaaacuaacacuaaaagguaugucauaugugauguguacagggagcuucaaauuagaaaaagagguagcagaaacgcaacaugggacgguuuuaguacagguaaaauaugaaggcacagaugcacccuguaaaauuccuuuuuccacgcaggaugaaaaagguguaacucagaauggccggcuaauaaccgcaaauccuauuguaacggauaaggaaaaaccggucaauauagaaacggaacccccauucggagagucguacauaguagugggggcaggcgagaaggcacuuaaauuaucgugguuuaagaaagggaguucaauagguaagauguuugaggcuacagcaagaggagcgagacgaauggcaauacugggugacacugcuugggauuuuggauccauuggcgguguuuucacuucaguaggaaaauuaguacaccaaguguucggcacagcuuacggcguacuuuuuagugggguaaguuggacuaugaaaaucgggauaggaauauuacuaacgugguugggacugaacagcagaucaacaucacucagcaugacauguauugcgguagguaugguuacauuauauuuggggguuaugguacaagcagauucgggcuguguaaucaauuggaaggggagagagcuuaaguguggauccgguauauuuguuacuaaugaaguacauacuuggacugaacaauacaaauuccaagcggacucccccaagcgccuuagcgccgcaauaggaaaagccugggaagaaggcguguguggcauaagaucagcaacaagacuagagaauauuauguggaaacaaauaaguaaugaguuaaaccacauauugcuggaaaaugacaugaaauucaccguagucgugggcgaugcaaauggaauccuggcacaaggaaagaaaaugauucgaccacagccaauggaacauaaauauaguuggaaaucauggggaaaggcaaaaauaauaggugcagacauacaaaacacaaccuuuauaauugauggcccagauacaccugaaugcccagauggccaacgagcuuggaauauuugggaaguagaggacuacggauuugguauauuuacaacaaacauauggcuuaagcuaagagacucauacacacaaaugugcgaccaccgucucaugucagcagcaaucaaggauaguaaagccguccaugccgacaugggauauuggauugaaucugagaaaaaugaaacguggaaacuugcaagagccagcuucaucgaggugaaaaccugcacuuggccuaagagccauacucuguggucgaaugguguauuagagagugagaugauaauuccaaaaaucuauggugguccaaucucccagcacaacuacaggccuggauacuucacgcaaacggcaggacccuggcaucuaggaaaacuagaguuggauuucgauuugugugaaggaacaacagucguaguugaugaacacuguggaaacagagggccuucccuacgaaccacaacaguaacuggaaaaaucauacacgaauggugcuguaggaguugcacauuaccaccuuuacguuuccggggugaagauggaugcugguacgggauggaaauaagaccagugaaggaaaaggaagaaaacuuaguuagaucaaugguuagugcaggcaguggggaaguugacaguuuuucucuaggcauauuaugugugucaauaaugauagaggaaguaaugcguucacgguggucacggaagaugcuaaugacggguacuuuggcgguauuuuugcuguuaauaaugggacaacucacuuggaaugauuugauacguuuaugcauuaugguaggagcgaacgcgucagaccgaaugggaaugggcaccacucauuuggcucuuauggcgacauuuaaaaugaggccuauguuugccgugggcuuacuauucagaagacuuacgucuagagaagucuugcuacuaacaauaggauuaaguuugauggcaucaauggaauuaccaaauagccuagaggaacucggagauggccuagccaugggcauuaugaugcugaaacuacuaacagaguuccagccacaucaacuauggacaacucuccucagcuugacuuucgucaagacaaccuugucauuggauuaugcuuggaagaccacggccaugauauuaucaauagucucccucuuuccacuaugucuuucuacaacaagucagaaaacaacgugguugccaguacuauuaggauccuucgguuguaaaccgcuaacaauguuucuaauuaccgagaauaagauaugggguaggaaaaguuggccucuaaaugagggaauuauggccauuggaauagucuccauacuccucucaaguuuacugaagaacgaugucccacuagccgguccucuaauagcagggggaauguuaaucgcuugcuauguaauaaguggcucauccgcugaccuaagucuagaaaaagcugcagaaguaucgugggaacaagaagcugaacacucgggugcaagucauaauauuuuagucgaaguacaagacgaugguacaaugaaaaucaaggaugaagaaagagaugauaccuugacaauacugcucaaagcuacacuauuggcaguaucuggaguauauccaaugucaauuccugcuacucuguuugucugguacuuuuggcaaaagaaaaagcagagauccgggguguugugggauacaccaagcccaccggaaguugaacgagcgguguuggacgauggcaucuaucgaaucuuacaaagaggacuauuaggaagaucucagguuggggucggggucuuccaggacggagucuuucauacaauguggcauguuacccgaggggcagugcucauguaccaggguaaaaggcuagaaccaucgugggcaucagucaaaaaggacuuaauuaguuacggagguggauggcgguuucaggguucauggaauacaggugaggaaguccagguaauagcuguugaacccgguaaaaauccgaaaaauguacaaacgacaccagguacuuuuaaaaccccugaaggagaagugggagcuauagcuuuagauuucaaaccaggaacaagugguagucccauugucaaccgcgaaggcaagauuguugguuuauaugguaaugguguaguaacgaccucaggaacauauguuucugcaauugcucaagcaaaagcgucccaagaggguccauuaccagaaauagaagacgaaguauuuaagaagagaaaucugacuaucauggaucuacaucccggaaguggcaaaacacgacgguaucuacccgcuauagucagagaagcgauaaaacgcaaauugagaacacuaauacuagcaccaacacgaguuguagcaagugagauggcugaagcauugaaagguaugccuauucgguaucaaaccacagcuguaaaaucagaacauacagggcgcgaaauaguugaucuuaugugucaugcuacauuuacaaugagacuacugucaccggugagggucccgaacuacaauaugauuauuauggacgaagcacauuucaccgaucccgcaucaauagcugcuagaggguacaucagcacacguguuggaaugggagaagcagccgcgauuuucaugaccgcaaccccaccuggaucaguugaagcauucccucagucaaaugccguaauccaagacgaagaaagagauaucccggaacgaucuuggaacucuggauaugauuggaucaccgacuuccccggaaaaacugucugguuugucccaucaauaaaaucaggcaaugauauagcuaauugucuacgcaaaaauggcaagaggguaauacaauugagcagaaaaacauucgauacugaauaucagaaaacgaaaaauaaugauugggauuauguagugacaacugacauaucagagaugggugcaaacuuccgagcagaccguguaauugauccacgaagaugucugaaaccagugauacuaaaagauggaccugagagaguuauacuagcgggcccuaugccaguaacagucgcaucagcggcucagagacguggaagaauuggucguaaucaaaacaaagaaggagaucaguauguauauauggggcagccauugaauaaugacgaggaccaugcccauuggacagaagcuaagauguuguuagacaauauuaauacaccugagggaauaauuccagcacuguuugaaccagagagagaaaaaucggcagcgauagacggagaauaccgguuaaggggagaggccaggaagaccuuuguggaacucaugagaagaggagaucuuccuguauggcuuucauauaaaguggcaagugaagguuuucaguauagugauagaaggugguguuucgacggcgaaagaaauaaucaagucuuagaagaaaauauggacguagaaauauggacuaaggaaggagaaaggaagaaacuacgcccacgcugguuggaugccagaacuuauagcgacccucuugcucuaagggaguuuaaggaauuugccgcugggcgacguuccgucucuggugaucuaauuuuagaaaucgguaaguuaccacaacaccuaacucucagagcgcaaaaugcacucgauaauuuaguuauguugcauaacucugaacaaggaggaaaggcguauagacaugcuauggaagaacuuccagauacgauagaaacucugaugcuacuggcguuaauugcaguguuaacggguggagucacguuauucuuucuuucuggcaaaggauuaggcaaaaccucuauuggccuauuauguguaacagcuucaaguacauuguuguggauggcgucaguugaaccacacuggauagcggccucaaucauacuggaauuuuucuuaaugguguuacucauaccagagccugaccggcaaagaacuccacaggauaaccaacucgcuuacguuguaauuggcuugcucuuuaugauauuaacaguagcugcaaacgaaauggggcuauuagagacgacuaaaaaggaucugggcaucggguacguggcggcagagaaccaucaacaugcaacaaugcucgacguggacuuacgacccgcaagcgccuggacuuuauaugcaguggcaacaacaguaaucaccccaaugaugcgucauacaaucgaaaauacaacagcuaauaucagucuuacugcuaucgcaaaucaagcugcuauauuaaugggguuagacaaaggguggccgauauccaagauggacaucgggguaccgcuauuggcacuuggguguuauucacaagugaauccacucacacuaaccgcugcgguucuaaugcuagucgcccauuaugccauaauagggccgggccuacaagcaaaagcaacaagagaagcccaaaaacgcaccgccgcugggauaaugaagaauccgacagucgacggaauuguggcaauugaucuagaucccgucguuuacgaugcaaaauuugagaaacaacuaggacaaaucaugcuucucauauuaugcaccagucaaauacuccuaaugcgaacaacuugggcgcuaugcgaaucgauuacccuagcuacggguccacuaacaacauugugggagggaaguccuggaaaauucuggaauacaacuaucgcugucucgauggccaacauauucagagguucguaucucgccggugcuggacuggcauuuucguuaaugaaaaguuuaggaggaggacgacgaggcacaggggcucaaggagagacgcuaggagaaaaauggaagagacaguuaaaccaacuaaguaaaucagaauuuaauacauacaaacgaaguggaauuauggagguagaucggucggaagccaaagaaggacuaaaaagaggagaaacuacaaaacaugcugugagcagagguaccgcaaaacuaagaugguucguagaacguaauuugguuaaacccgaaggcaagguaauagaucuaggaugcggcagagggggcuggucguauuacugugccggccugaagaaaguaacugagguaaagggcuauacgaaaggugggcccggacaugaagaaccaauuccgauggcaaccuaugguuggaauuuaguaaaacuacacagcggaaaagacguauucuuuaugcccccagaaaaaugugauacucuucugugugauauuggggaaagcucgccaaacccgaccauagaggaagggagaacauuaagaguacuaaaaaugguagaaccauggcuaaaaggcaaucaauuuuguauuaaaauucuaaauccauauaugcccagcguaguggaaacacuggaacagaugcaaaggaaacacgggggaaugcuuguacgcaauccccuuagucggaauagcacacacgagauguauuggguaucaugcggaacugguaacauuguuucagcagucaacaugacauccagaauguuauuaaauagauuuaccauggcacaucguaaaccuacguacgagagagacguggacuuaggugcgggcacacgacaugucgcuguugagccagaagucgccaaccucgauauuauugggcaaaggauagagaauauaaagaaugaacacaagucaacguggcauuacgacgaagacaauccuuacaaaacuugggcauaccauggaaguuaugaggugaaacccucuggcucugcuagcucaaugguaaaugggguaguccggcuauuaacuaaaccaugggauguaauuccuaugguaacccaaaucgcaaugacagacacaacgccuuuuggucaacagagaguuuucaaggaaaaaguugauacgagaacaccuagggcaaaaaggggaacuacacaaaucauggaaguuacagccaaaugguuauggggguucuuauccagaaacaaaaagccucggauauguacaagggaagaguucacccgaaaagucagaaguaacgcugcgauaggagcaguauuuguugacgagaaucaguggaauagugcuaaagaggcaguugaagaugaacgguuuugggaucuugugcacagagaacgagaguuacauaaacaagguaaaugcgcgacuugcguauacaacaugauggggaaacgugagaagaaauuaggcgaauuuggaaaggcuaaagggucccgcgcaaucugguacauguggcuaggcgcucgguuccuagaauuugaggcacucgguuuuaugaaugaagaucauugguuuagucgagaaaauucuuugucaggcguggagggugaaggguuacacaagcuaggauauauuuuaagagauauuuccaaaauaccgggcgguaauauguacgcggaugacacagcaggcugggauacucgaauuacagaagaugauuuacaaaaugaagcaaaaauuacagacauaauggaaccagaacacgcauugcucgccaccucaauauuuaaacuuacuuaccagaauaaaguuguucgaguccagagaccagcuaagaauggaacaguuauggacguaauuaguaggagagaucagcggggcucaggccaaguagguacauauggcuuaaacaccuuuacuaauauggagguccaauugauccgacaaauggagagcgaaggaauauuucuaccgagcgaacuggagacuccgaauuuggcagaaagaguauuggauugguuagaaaaacacggcgcagaaagauugaaacgcauggcaauuucaggagacgauugugucguaaaaccaaucgaugacagauucgcuacagcauugacugcgcuaaaugauauggguaaagugcgaaaagauauuccacaaugggaaccguccaaaggcuggaaugauuggcagcaaguuccuuucugcagccaccauuuucaucaacucauaaugaaagaugggagggaaauagugguaccuugcagaaaucaagacgaacuuguaggacgagcccgugugagucagggggcaggguggucacuuagagagacggcgugucuaggaaaaucuuaugcucaaauguggcaacuaauguauuuccaucgccgcgaucugcgucuugccgcgaacgcaauauguagugcaguuccgguagauuggguaccgacaagucguacuaccuggagcauucaugcacaucaucaauggaugacaacagaagauauguuguccguauggaaucgaguauggauugaagaaaacccauggauggaagacaagacacauguaagcuccugggaagaaguucccuaucuuggaaaacgggaggaucaauggugugggucacuuauagggcuaacggcgagagcuacgugggcaacuaacauacaggucgcaauaaaccaggucagacgauuaauuggcaacgaaaacuaucuugauuauaugaccucgaugaaaagauuuaaaaaugaaagugacccagaaggagcgcucugguga

SEQ ID NO: 21428 - RNA, 9879 nt, Artificial Sequence
  derived and/or modified CDS sequence (opt6) from DENV-1__FJ882579__SS-prME
ucagugacuauguugcuuauguuguugccuaccgcacuugcauuucauuuaacuacgcgcggaggagaaccacauaugauaguaucuaaacaagaacggggaaaaucauugcuguucaaaacuucugcugggguuaacaugugcacucuuauugcuauggaucucggcgaacuaugugaagacacuaugaccuacaaauguccgcgaauuacggaggccgagcccgacgauguagacuguuggugcaacgcgacugauaccuggguaacauacgggacaugcagccaaacaggagaacacagacgugauaaacgaaguguggcuuuggcgccucauguuggucuaggacuagagacaagaacagagacguggaugucgagugagggagcguggaaacaaauacaaagaguagaaaccugggcacuacgacacccagguuuuacaguuauagcguucuuccuugcgcacgccauaggaacaaguauaacacaaaaaggaauaauauuuaucuuacuaaugcuuguuacuccgucaauggcgaugagauguguuggaauuggaaaucgcgacuuuguggaaggacucucuggagcgacauggguagacgugguucuugaacacggauccuguguuaccacuauggcgaaaaauaaaccaacgcuagauauagaacugcuaaaaaccgagguaaccaaucccgccguauuacguaaacucuguauagaagcaaaaaucucaaacacuacaacagacagucgauguccaacacaaggcgaagcaaccuuggucgaagaacaagaugcaaacuucguuuguagacgaaccuuuguugauagagguuggggcaauggguguggcuuauuugggaaaggcucauuauuaacgugcgccaaauucaaaugcguuacuaaacuagaagguaaaauugugcaauaugaaaacuuaaaauauuccgugaucguuacaguucacacuggugaccaacaucaaguggggaaugaaaccaccgaacaugguacaauagccacgauuacaccacaagcgccgacaucugagauacaacugacagacuauggagcuuuaacacuggauugcagucccaggacaggacuggauuuuaacgaaaugguacuguuaacgaugaaagaaaaauccugguuagugcauaaacaaugguuucuagaccucccauuaccuuggacaagcggagcuucgacgucccaagaaacuuggaaccggcaagaucuauugguuacuuucaaaacugcccaugccaagaaacaggaagugguuguucuaggaucgcaagagggcgcaaugcauaccgcgcucacaggcgcuacugagauacagaccagcgguacuacgacgauuuucgcaggucaccucaaaugucgcuugaaaauggacaaauuaacauugaaaggaaugucauacgugauguguacagguucuuuuaaauuagaaaaagaaguggcugagacgcaacauggaacagugcuaguacaaguuaaauaugaaggaacagaugcaccauguaaaauaccuuuuagcacacaagacgaaaaaggaguaacacaaaacggaaggcucaucacagcuaacccuaucguuacagauaaagaaaaaccaguaaacauugaaacugaaccaccuuucggagaaagcuacaucguagucggagcuggugagaaagcccugaaacugagcugguuuaagaaagguucaagcauagggaaaauguuugaagcuaccgccagaggcgcaaggagaauggcuauauuaggcgacacagccugggauuuugguagcaucggaggaguauucacauccguaggaaaguuaguacaccaaguauucgguacugccuacggcguauuauuuucuggaguaaguuggacaaugaaaauuggcauagguauacugcuaacaugguuagggcuuaauucuagaagcacuucauuaucaaugacuuguauagcaguagggaugguaacucuuuacuuaggggugaugguacaggccgacagcggcugugucauuaacuggaaagguagggaacuaaaauguggaucuggaauuuuuguuacuaaugagguacauacguggacagagcaauacaaauuucaagcagauucuccuaaacgacuaucugcagccauaggcaaggcuugggaggaggggguguguggcauuagauccgccacgagacuggaaaauauuauguggaaacaaauaagcaaugaauuaaaccauauauuacuugagaacgacaugaaauuuaccgugguggucggggaugcaaaugguauucugacacagggaaagaaaaugauucgcccacaaccgauggaacauaaauacucauggaagaguuggggaaaagcaaaaaucaucggagcagacauucaaaauacuaccuucauaauagauggaccagauacuccagaauguccagauggucagagagcuuggaacauuugggaaguagaagauuauggguuugguauuuucaccacaaauauauggcuaaaacuaagagauaguuauacacaaaugugcgaccauagguugaugucugcagcaaucaaagauucuaaagcuguacacgcagauaugggguauuggauugagucggagaaaaaugaaacauggaaguuagcacgggcuucuuuuauagaagugaaaacauguacauggccgaagagucacaccuuauggagcaacggugucuuggaaagugaaaugauaauuccaaagauauacggggguccaauuucacaacacaauuauagaccugguuacuuuacucagacggcuggaccauggcaucuaggaaaauuagagcucgauuuugauuugugcgaaggaacgacgguaguaguagaugaacacugcggaaauagaggacccucucuuagaacgaccacaguuacugggaaaauaauucacgaaugguguugucguaguuguacucuaccaccccuuagauuucguggagaagacgguuguugguacggaauggagauccggccggucaaggaaaaagaagagaacuugguacgcucuauggugucagcugguagcggagaaguggacucguuuucccucgguauacucuguguaaguauaaugauagaagaagucaugagaagccgauggucaagaaaaauguugaugacaggcacauuagcaguauuucuacuucuaauuaugggacagcuuacuuggaaugauuuaauaagacugugcaucauggucggugcaaaugccagcgaucguaugggaaugggaacaacauauuuagcucucauggccacauuuaagaugagaccuauguucgcuguuggacugcucuuucgaagacuuacuucgcgggaaguauuacuguuaacgauaggcuuaucacugguagcgaguguugagcuuccgaacucacuggaagaacuaggagacggauuagcuaugggaauaaugauguugaaauuguuaacggaguuccaaccucaucaacuauggacgacacuauuaagucucacauuuguaaaaacuacgcugucgcuugacuaugccuggaaaaccacugcgaugguacuuaguaucgucagcuuauucccuuuaugucuaaguacaacgucgcagaaaaccaccuggcuacccguacuucucggcagcuuuggaugcaagccucuaacaauguuuuugauaacagaaaacaaaauauggggaagaaagucauggccguugaaugaaggaauaauggcaaucggaauaguaucaauacuucuaucuucucuucuuaaaaacgauguaccccucgcagguccauuaaucgcaggaggaaugcucauagcgugcuacguaauaagugguucaagcgcagauuuauuacucgaaaaagcagcggaaguuucaugggaacaagaagcagagcauagcggcgcuucgcauaacauauuaguagaaguucaagaugauggcacgaugaagauuaaagaugaagagagagaugauacccuuacgauuuuacucaaggcuacccuacuagcaguaucggguguauacccaaugucgauuccagcuacacuauuuguuugguauuuuuggcagaagaagaaacaaaggaguggaguuuuaugggacacucccucgccuccugaaguugagcgggcaguuuuggaugacggcauauauaggauacugcaacggggauuauuaggccguucucaagucggggugggaguuuuccaagauggcguguuucacacaauguggcaugucacgaggggcgcaguuuuaauguaucagggaaaaaggcuugagcccaguugggcaagugucaagaaagacuuaauuagcuaugguggagguuggagauuccaaggaucauggaauacuggagaagaaguacaaguaauagcgguggaaccagguaaaaauccuaaaaauguacagacuacacccgguaccuuuaaaacgccagaaggggaagucggagccauugcuuuagauuuuaaaccaggcacaucagguucaccuaucguaaacagagaagggaagauuguaggauuauacgguaacggagugguuacuacaagcgguacuuacgugucagcaauagcacaagcaaaagccagccaagaagguccgcuuccagaaauugaggacgaaguauucaagaaacgcaaucucaccauaauggaccuccacccaggaucaggcaaaacacgaagauauuugccagccauuguacgugaagcgauaaaaagaaaacuuaggacguuaauacuggcaccgacgagaguuguugcaucggaaauggcagaagccuuaaaaggcaugccuauacgauaucaaacaacagccgugaaaucggaacauacgggucgagaaauaguagaucucaugugucaugccacauuuacaaugcgguuauuaagcccugucagaguaccaaauuauaauaugauuaucauggacgaggcucauuuuacagacccagcaucaauagcugcuagaggguauauaucuacaagaguagguaugggugaagcagcagcgauauucaugacugcgaccccuccagguuccguagaagcauuuccacaaucgaacgcagucauucaagacgaagagagagacauaccugaaagauccuggaacucagguuaugauuggauaacagauuucccuggaaaaacagucugguuuguacccagcauuaaaaguggcaaugauauugcaaauugucuaaggaaaaauggaaagagaguuauucaauugagucgaaaaacauuugauacagaguaccagaaaacuaaaaauaaugauugggauuacguuguuacgacggacauaucagaaaugggagcgaauuucagagcugauagagugauagauccaagaaggugucugaaaccugugauuuuaaaggauggaccagagcgcguuauauuagcuggaccuaugccaguaacuguagcaagcgccgcacaaagaagggguagaauugguaggaaucaaaacaaagaaggagaucaguauguguauaugggacaaccauuaaauaaugacgaagaucacgcacauuggacugaagccaaaaugcuguuggauaauauaaauacaccagaaggaauuauuccagcuuuguuugagccugaacgagagaaaagugccgcuauugacggggaguacagacuuagaggagaagcuagaaaaacauuugucgaacuaaugagaagaggagaucucccuguuugguugucguauaaaguggcaucagaaggauuucaauacucagauagaagaugguguuucgacggcgaaagaaauaaccaaguccuagaggaaaauauggauguagaaauuuggacuaaggaaggcgagaggaagaaauuacggcccagguggcucgaugcccgaaccuauagcgaccccuuagcacuacgcgaauuuaaagaauuugccgcugggcggcgaagcguaaguggugaccuaaucuuagaaauugguaaacucccgcaacaucuuacauuacgugcacaaaacgcacuugacaauuuaguuauguuacauaacagcgagcaaggaggaaaggcauauagacacgcgauggaagaguuaccagauacuauagagacccugaugcuuuuggcccucauagccguauuaacugggggaguaacacuauucuuucucucaggaaagggauuaggcaaaacaagcaucggauuauuaugcguaacggcaucaucagcacuauuauggauggcuagcguagaaccucacuggauagcagcaaguauaauuuuagaguucuuucuaaugguucugcuuauuccagaaccagacagacaacguacuccgcaagacaaccaguuagcuuacgucguaaucggauugcuauuuaugauauuaacagucgcggcaaaugaaaugggacuuuuagaaacaacuaaaaaggaucuagggauuggguacguggcagcggagaaucaucaacacgccaccauguuagauguagaucuacgccccgcgagcgcuuggacucuguaugcagucgcuacaacagugaucacgccaaugaugcgacauacaauugaaaauacaaccgcaaauaucagcuuaaccgcaaucgccaaccaagcggcaauacugaugggguuagauaagggauggcccauaaguaaaauggauauuggcguaccccuacuugcacuaggcugcuauagccaagucaauccauuaacccuaacagcggcaguauuaauguuaguagcacacuaugcuaucauuggaccuggguugcaggcaaaggcaacacgggaagcacagaagaggacugccgcaggaaucaugaaaaauccgacaguagaugggauaguagccauagauuuagacccagugguauacgacgcaaaauuugaaaaacagcucgggcagauuauguuacugaucuuguguacuucacaaauauuauuaaugaggacaaccugggcauuaugcgaaagcauuacacuagcaacagguccacugacgacauuaugggaaggcucccccggaaaguucuggaauacgaccaucgccguuagcauggcaaacauuuuucguggaaguuaucuagcaggagcuggucuggcauucucauuaaugaaaagccucgggggaggacgaagagguacuggcgcucaaggugaaacacucggcgagaaauggaaacgacaauuaaaccagcuaucaaaaagugaauuuaacacauauaagagaucagguaucauggaaguggaucgcucugaggcgaaagagggcuuaaaaagaggcgagacgacuaaacaugccguaaguagggggacggcaaagcuacgaugguucgucgaacgaaacuuaguuaaacccgaagguaaaguuauugacuuaggguguggucgaggaggcuggagcuacuacugcgcaggacuaaagaaagucaccgaagugaaaggauauacuaaagguggcccuggacacgaggaaccaauccccauggcaaccuauggcuggaauuuaguuaaacuacacuccggaaaagauguguucuuuaugcccccggaaaaaugugacacccuauugugcgacauaggggaaucuucgccuaauccgacuauagaggaaggaaggaccuugagaguuuuaaaaaugguagaaccauggcuaaaagguaaccaauuuuguauaaagauccuaaauccauacaugcccagcguugucgaaacgcuugagcaaaugcaaaggaagcauggaggaauguuaguacggaacccacuaagucgaaauaguacucaugagauguacuggguaaguuguggcaccgggaacauuguuucagcagucaauaugacuucccguauguuacuaaauagauuuacuauggcacacagaaaaccaacuuaugagcgcgacguggaccuaggagcugguacacgacauguugccguggagccggaagucgccaaucuagauaucaucggucagagaauagaaaauaucaaaaacgaacacaagucaacguggcacuaugacgaagauaacccguauaaaacuugggcauaucauggcagcuaugaaguaaaaccaucuggaagcgcuucgucaauggucaauggagugguacgccucuugaccaaaccgugggacguuauuccuauggucacucagauagcaaugaccgauacuacaccguuugggcaacaaagagucuuuaaagaaaaaguugacacucguacgccaagagccaagcgagguacaacacaaauaauggaaguaacggcgaaauggcuguggggcuuuuuaagcagaaacaagaaaccucguaucuguacuagagaagaauuuacucguaaaguacgaaguaacgcagcuaucggagcaguauuugucgacgaaaaucaauggaacagugcgaaagaagcuguagaggaugaaagauuuugggaucuuguacaccgagaaagagaacuacacaaacaaggcaagugugcaacaugugucuacaauaugaugggcaaacgugagaagaaacuuggugaauuuggaaaagcuaaaggaagcagagcaauaugguauaugugguugggugcucgauuucuagaguucgaagcauugggauuuaugaaugaagaucacugguuuaguagagagaacucccuaucaggagucgaaggcgaaggauuacauaaacuaggguacauauuacgugauauuucgaagauuccuggcgggaauauguacgcagaugauacagcugguugggauacuaggauaacagaagaugaccugcaaaaugaagccaaaaucaccgacauuauggaacccgaacaugcccuguuagcaaccucuauauucaaguugacuuaucaaaacaaagucgugagaguacaacgacccgccaaaaaugggacgguaauggacgucauuucaagaagggaucagagagguuccgggcaaguggggacguauggccuaaauacuuucacaaauauggaaguucaacuuauucgacaaauggaaucugagggcauauuucuaccaucagaauuggagacaccaaaucuggcagaaagaguacuagauuggcucgaaaaacacggagcugaaagauuaaaaagaauggcuauaucaggagaugacugcgucgugaaaccaauugacgaccgguuugcaacagcuuugacggcguugaacgacaugggaaaaguaagaaaggauauaccucagugggaaccauccaagggguggaacgacuggcagcaagucccguucuguucacaccacuuccaucaguuaauaaugaaagauggucgcgagauaguaguccccugcagaaaucaagacgaauuaguaggucgugcccguguaagccagggugcaggauggagccuucgagaaacagcuugcuuaggcaaaucauacgcgcagauguggcagcuuauguauuuucacagacgagaccuacgacucgccgccaaugcaauauguucagcuguuccgguugauuggguucccacaagcagaaccacauggucaauacaugcacaucaucaauggaugacaacagaagauauguuaagcguuuggaauaggguuuggauugaggaaaacccuuggauggaagacaaaacucacguuuccagcugggaagaaguaccauaucuugggaaaagagaagaccaauggugcggaucccuuauaggacuaaccgcuagggcuacuugggcuacgaacauccaaguggccauuaaucaggugagacguuuaauugguaacgagaauuacuuagauuauaugacauccaugaaaagauuuaagaacgaaucugauccugaaggagcacuaugguaa

SEQ ID NO: 21429 - RNA, 9879 nt, Artificial Sequence
  derived and/or modified CDS sequence (opt6) from DENV-1__JN819414__SS-prME
ucaguuacuauguuguugauguuauuacccaccgcacuagcguuccaccucacuacucguggaggugaaccacauaugauuguaucuaaacaagaacgggguaaaucauuauuauuuaaaacauccgcugggguaaauaugugcacacuaaucgcuauggacuuaggagaauuaugcgaagauacuaugaccuauaaauguccucgaaucacggaagcugaaccggacgacguggauuguugguguaaugcaacugauacguggguaacguauggaacuuguucgcaaacaggagaacaccggagagauaagcgauccguggcacucgcgccgcacgugggucucggauuagagacgcgaaccgagacauggaugaguucugaaggugcguggaagcaaauacagagaguagaaacgugggcgcuuaggcaccccgguuucacagugaucgccuuguuucuagcuuaugccauuggcacaaguaucacacaaaaaggaauaauuuucauauuacuuaugcucguaacaccaagcauggcaaugagaugcguaggaauagguaauagagacuuugucgaaggauuaagcggggcuacauggguugauguaguccuggagcauggcaguuguguaacuacaauggcgaaaaauaaacccacuuuagauauagaacucuuaaaaacugaaguuacaaacccugcaguauuaagaaaauuauguauagaggcgaaaauaucaaauaccaccacagauagcagaugcccgacacaaggagaagcgacauugguagaagaacaagacgccaauuuugucugucggaggacuuuuguagauaggggauggggaaacggauguggacuuuuuggcaagggaucucuauuaacaugugcaaaauucaaaugcguaaccaaauuggaaggaaaaauuguacaauacgagaaucuaaaguauuccguuauaguaacugugcauacgggagaucaacaccaaguagguaaugagacuacagagcauggaaccauugcgaccauuacgccucaagcuccuacaucugagauacaacugacggacuauggcgcacuaacguuagauuguucaccccgcacuggauuagacuuuaaugagaugguuuuacucacuaugaaagagaaaaguuggcuaguacauaaacaaugguuucuagaucuaccacuaccauggaccagcggagccucaaccagucaagaaaccuggaaccgucaagacuuauuaguaacauuuaagaccgcucacgccaagaaacaggaaguaguaguacuaggcagucaagaaggugcgaugcauacggcauuaacuggugcaacugaaauacagacaaguggcacuaccacuauuuuugcuggacaucuaaaaugccgucucaaaauggacaaauugacauugaaaggaaugucuuacguaaugugcaccgguaguuucaaauuagaaaaggaagucgccgaaacgcaacacgguacgguacuuguucaaguuaaguaugaagggacagacgcccccuguaaaauuccauuuucaacacaagaugaaaaagggguuacucaaaauggaagacucauuacggcuaacccgauaguaacagacaaagagaagccagucaauaucgaaacugaaccgccuuucggagaaucguacaucguaguuggcgcgggagaaaaggcauuaaaacucucaugguuuaagaaaggaaguaguauagggaagauguucgaggcaacggcaagaggcgcacggcgaauggcaauucuuggagacacugcuugggacuucgguaguauaggagguguguucacgagcguuggaaaguuaguccaccaaguguucgguacugcauacggaguccucuuuucuggggucaguuggacaaugaagauagguauugguaucuuauugaccuggcuuggacucaauucaagaucaacuucauugucaaugacauguauagcugucggaauggugacuuuauauuugggggugaugguacaggcugauaguggaugcguaauaaauuggaaagguagagagcuuaaaugcgguaguggaaucuuugucacgaaugaaguacacacauggacagaacaguacaaauuccaggcugauaguccuaaaagauuauccgcugcuaucggcaaggcuugggaggaggguguauguggaauuagaagugcaacuagauuagagaacaucauguggaaacagauauccaaugaauuaaaccauauucuacuagaaaaugacaugaaauuuacuguuguaguuggagaugcgaauggaauccucgcucaaggcaagaaaaugauuagaccucaaccuauggaacauaaauauaguuggaagucuuggggcaaagcuaagauaauaggagcagauauucaaaauacaacuuucauuaucgacggaccugauaccccagaauguccagauggucaacgagcguggaauauaugggaaguugaagauuauggauuugguaucuuuacaacuaauaucuggcuuaaacucagagauucauauacacagaugugugaucauagguugaugucagccgcaauaaaagauagcaaagcaguacaugccgauaugggcuacuggauagaaagcgagaaaaacgaaacuuggaaauuagcacgugcauccuucauugaaguaaaaacaugcacauggcccaaaucccacacacuauggucgaacgguguacuugagagcgaaaugauaauacccaagauuuauggagggccgauaucacaacacaauuaucguccaggguacuucacccaaacggcaggcccauggcaucucggaaaauuagaacuagacuucgaucucugugagggaacgaccguaguaguagacgaacauuguggcaaccggggaccuucucugcguaccaccacagugacgggaaaaaucauacaugaauggugcugccgguccuguacacucccaccacugcgauuuagaggugaagacggaugcugguauggaauggagauucggccaguaaaagaaaaagaagaaaaccuagugcgcucaauggucagugcagguuccggggaaguugauucuuuuucgcuuggaauacuguguguaucaauaaugauagaagaaguaaugagaucccguuggagccguaaaauguuaaugaccgggacguuggcgguauucuuacuucuaauaauggggcaauuaacuuggaaugauuuaauaagauugugcauaaugguaggagcgaaugccucggaccgaaugggaaugggaacuacguauuuagcauugauggcgacauucaaaaugagaccaauguuugcgguuggucuuuuauuccgaagacuaaccucuagagaagucuuauuauugacuaucggguuaucacuuguggcaagcgucgaacugcccaauuccuuagaggaacucggagacggccuagcuauggggauaaugaugcugaaauuguuaacagaauuucagccgcaucaacuguggaccacguuacuaagccuuacuuucgucaaaacuacauuaucauuagacuacgcuuggaaaacaacagcaaugguauuaucuauaguuucgcuuuuuccgcuaugccuaucaaccacgagucagaaaacaacauggcuaccgguccuacuaggaucauuuggguguaaaccucucaccauguuuuugauaacagagaacaaaauuugggggcgaaagucuuggccuuuaaaugaagguauaauggcaauagguaucgucuccauauuacugucaucauuacuaaagaacgauguuccucuagcgggaccccuuauagcuggugguauguuaauugcguguuaugucauaucgggaaguagugccgaucuauuguuagaaaaggcugccgaggugaguugggagcaagaagcugaacacucuggcgcgucacauaauauuuugguagaagugcaagaugaugguacaaugaaaaucaaagaugaagaacgcgacgacacuuuaacaauacugcuuaaagccacauuguuagcuguaucuggagucuauccuaugucaaucccggcuacucuauuugugugguauuuuuggcagaagaagaaacaaagaucagggguucuaugggauacuccgagcccacccgaaguagaaagagcuguauuagacgaugggauauacagaauacugcaaaggggguuauuggguaggucacaagugggaguugggguauuccaggacggaguguuccauacuauguggcacgugacccguggugcuguacucauguaccaggggaagcgacucgaaccaaguugggcuagcgucaaaaaggauuuaauaucauauggaggaggguggcgguuucaaggaucuuggaauacuggggaagaagugcagguaauugcaguugaaccgggaaagaacccgaaaaauguacaaacuacaccugggacauucaaaacccccgaaggagagguuggagcuauagcacuggauuucaaaccugguaccaguggaaguccaauaguuaaucgagaagguaaaauagucggauuauauggaaacgguguuguuacuacaggaggaaccuauguauccgccauagcccaggcgaaggcaagccaagaagggccacuccccgagauagaagacgaagucuucaagaaacguaaucuaacuauaauggaccugcauccuggaucagguaaaacaagaagauacuugccggcgauugucagagaagcaauaaagcgaaaacuccgaacacuaaucuuggcuccaaccagagugguugcuagugaaauggcggaggcauugaaggggaugccuauaagauaucaaacaacagcaguaaaaagcgaacauacgggaagagaaauuguugacuugaugugccaugcuacguucaccaugagacuuuuaucgcccguuagaguccccaacuacaacaugauaauuauggaugaagcacacuucaccgacccugccucuauagcugcucgaggauauaucucuaccagaguagguaugggugaagccgcagcaauauuuaugacagcuaccccuccaggaagugucgaagccuucccacagaguaaugccgugauccaggaugaagaaagagauauaccagaacgaaguuggaacucaggauaugacuggauaacagacuucccggguaaaacgguuugguuuguuccguccauaaaauccggaaacgacauugcuaacugucuacguaaaaacgguaaaaggguuauucagcuaucucggaaaacuuuugacacggaauaucagaaaacuaaaaauaacgacugggauuacgugguaacgacagacauaucugaaaugggagccaacuuucgugcagacagaguuauagacccacguaggugucucaaaccaguaauucuuaaggacgguccggaacgaguuauucuugccgggcccaugcccguaacaguagccagugcagcacaaaggagaggacggauagggcguaaccaaaauaaagaaggagaccaauacguuuacaugggacaacccuugaauaaugaugaagaucaugcacauuggacagaagcaaagauguuguuagacaauauaaacacgccggaaggaauuauaccagccuuguuugaaccagaacgagaaaaaucugcugccauagacggcgaguacagacuaagaggagaagcuagaaaaacauuuguagagcugaugcgucgaggggaccuaccagugugguuaucauacaaggucgcaagcgaaggauuucaauacagcgauagaagauggugcuucgauggcgaaagaaauaaccaaguauuagaagagaacauggaugucgaaauauggaccaaggaaggagaaaggaagaaauuacgcccacggugguuagacgcccgaacguacagugauccauuagcacuaagagaauuuaaggaauuugcagccggacgccgaucggucucuggagaucuuauacuugagauugguaaauuaccacaacaccuuacacuccgugcccaaaacgcguuagauaacuugguaaugcugcauaacucagaacaagguggaaaagcguacagacaugcgauggaagaacuuccugauacuauagaaacauuaauguuacuugcauuaauagcgguccuaacagguggagucacacuguucuuccucagugguaagggccuuggaaaaaccaguauuggcuuacuuuguguaacggcaagcucugcacuucuguggauggcaaguguggagccccauuggauagcggcgagcauuauauuggaguucuuucuuaugguacuuuugauaccagagccugacaggcaaagaacuccgcaagacaaccaacuugcuuauguuguaauugggcuauuauuuaugauuuuaacaguggcagcuaacgaaaugggucuuuuagaaacgacaaagaaagaccuaggaaucggauacguagcagcugaaaaucaucaacaugcaacuaugcucgacguugaucuaagacccgcaucagcauggacacucuaugcaguugcaacuacagucauuacaccaaugaugcgacacacgauagaaaacacaacagcaaacaucucgcuuacugcuauagcaaaucaagcagcaaucuuaauggggcuugacaaaggguggccaauaucuaaaauggauauugguguaccuuuauuggcacugggauguuauagucaggucaacccacuaacccuuaccgcugccguccuaauguuaguagcacacuaugcaauaauagggccuggacuucaagcaaaggcaacccgagaagcucaaaaacguacagcagccgggauuaugaaaaacccaacaguugauggaauagucgcaauagaucuagauccaguuguuuaugacgcaaaauuugagaaacagcuaggacaaauaauguugcuuaucuugugcaccagccaaauauuacuaaugagaacgacuugggcuuuaugcgaaucuauaacauuggcuacaggaccacuaacaacgcugugggaagguaguccgggcaaauucuggaauaccacuauagcaguuucuauggcgaauaucuuucgcggguccuauuuagcaggcgcaggacuggcauuuagucugaugaaaucacuaggcggaggcaggaggggcacuggagcacaaggagaaacucuuggcgaaaaguggaaacgacagcucaaucaacuuagcaaaagugaguucaauacuuauaaaagguccgguaucauggagguagacagaagugaggcgaaagagggucuaaaacgaggagaaacuacaaagcaugcaguaucucgaggcacagccaaauuacggugguuuguugagagaaauuuagugaagccugaagggaaaguaauagaccugggguguggaagaggaggcuggaguuacuauugugcgggauugaagaagguuacugaaguaaaaggauacaccaagggcgggccaggacaugaagaaccuauaccaauggcuacguacggguggaauuuaguaaaauuacauucggggaaagacguguucuuuaugccuccugaaaagugugacacccuauugugcgacauuggagaaucuucaccaaauccuacuaucgaggagggaaggacacuaagaguucuaaaaaugguagagccaugguuaaagggaaaucaauucugcauuaaaauauuaaacccuuauaugccaagcguuguggaaacacuugaacaaaugcaaagaaaacauggcggaauguuaguucgaaacccccuauccagaaauucaacucacgagauguacugggugagcugugguacugguaacauuguaagugcaguaaauaugacaagucggaugcuucuuaaucgauucacuauggcgcaucgcaaaccaacauaugaacgagauguagacuuaggugcagguaccagacauguagcuguagaaccagaaguugcaaauuuagauauaauaggacaaaggauagagaauauaaagaaugaacacaaaaguacauggcauuaugacgaagacaauccguauaagaccugggcguaucauggaaguuacgagguaaaaccauccggaagugcgagcucuaugguaaaugggguaguacgacuacuuacaaaaccuugggauguuauucccaugguuacacagauagcgaugacagauaccacgccauuuggacaacagcgcguguuuaaagaaaaaguagauacucggaccccaagagcgaaacgugggaccacccaaauuauggaaguuacugcuaaauggcucuggggauuucugucgaggaauaagaaacccagaauuuguacgcgcgaagaguucacaaggaaaguacgaagcaaugcagcaaucggagcaguuuuuguagaugagaaucaguggaauacugcgaaagaagcgguagaggaugaaagauucugggacuuagugcauagagaaagagaacuacauaagcaaggaaaaugcgcaaccuguguuuauaauaugauggguaagcgagagaaaaaguuaggagaguucgguaaagcgaaaggaagcagagcgauaugguacaugugguuaggagccagauuccuagaguuugaggcguugggauuuaugaacgaagaccauugguucuccagagaaaauuccuuaucaggcgucgaaggcgagggauugcauaaauugggguacauucucagagacaucuccaaaauucccggcgguaauauguaugcggacgauacagcaggaugggacacaagaaucaccgaagacgauuuacaaaaugaggcuaaaauaacagacauuauggaacccgagcaugccuuauuagcaacaucgaucuucaaauuaaccuaccagaauaagguaguaagagugcaaagaccagccaaaaacggaaccgugauggacgugauaucgagacgagaucagcgcggaucuggccaaguaggaacuuaugguuuaaauacguuuaccaauauggaggugcaguugauacgacagauggagagcgaagguauauuccuacccagugaauuagagacaccuaacuuggcggaacgugccuuagauuggcucgagaaacacggagcagaaagauugaagcggauggcgauaaguggagacgauugcgucguaaaaccaauagacgaccguuucgcgaccgcucucacggcguuaaaugauaugggaaagguuagaaaagacauuccccaaugggaaccaucuaaaggauggaaugauuggcaacaagugccuuuuugcucccaccauuuucaucaguuaauaaugaaggacggacgcgaaaucgucgucccgugcaggaaccaggaugagcuaguagggagagcuagaguaagccagggagcagguuggucauuaagagaaacagcgugccuaggaaaaucauacgcacaaauguggcaacugauguauuuucauaggcgagacuuacgucucgcggccaacgcuauuuguagugccguacccguggauuggguaccgacaaguaggacuacuuggagcauucacgcacaucaccaauggaugacgacagaagauaugcuaucgguuuggaauagagucuggauugaagaaaacccauggauggaagauaaaacacacgucucuagcugggaagaggugccauauuuaggaaaaagagaagaucaguggugugguaguuuaauuggauuaacagcuagagcgacaugggcuacuaauauucaaguagcaauaaaccaggucagacgacuaauaggaaaugaaaauuaccuagacuauaugacgucaaugaagagauuuaaaaaugaguccgauccagaaggcgcuuugugguaa

SEQ ID NO: 21430 - RNA, 9879 nt, Artificial Sequence
  derived and/or modified CDS sequence (opt6) from DENV-1__FJ873810__SS-prME
ucggugacaaugcuauuaaugcuucugccgacggcauuggcuuuucauuuaacgacaagagguggagaaccgcauaugauaguaaguaaacaagaaagaggaaaaagucuauuguuuaaaacauccguuggugugaauauguguacguuaauagccauggaucuuggugaauuaugcgaagacacuaugacauauaaauguccaagaauaacugaagcagaaccggaugauguugacugcuggugcaaugcuacugacacaugggucaccuaugggacgugcucucaaacaggugagcaucgacgagagaaaaggaguguugcuuuagcuccccacguuggcuugggacuagaaacaagaacagaaacauggaugucuucugaaggcgcauggaaacagauacaaaggguagaaacaugggcauuacgucauccaggauuuacggucauugcauucuuuuuagcgcacgcgauaggaacuucgauaacacagaaaggaauaaucuuuauacugcucaugcucgugaccccgaguauggcuaugagauguguuggaauuggaaaucgcgauuuuguagaaggacuaaguggggcgacauggguugauguaguauuagaacaugguagcugcguaacaacuauggccaaaaauaaacccaccuuagauauagaguuauugaaaaccgagguaacgaaucccgcagugcucaggaaacucuguauagaggccaagauaagcaacacuacgacagauagucguugcccuacucagggagaagcaacuuuggucgaagaacaagaugcuaauuuuguguguaggcgcacuuuuguggaucgggguugggguaacggaugugguuuauuugguaaagggucuuuacuaacaugugcaaaauuuaagugcgugacaaaacuagaggguaaaauagugcaauaugaaaaccuaaaguauagcguaaucguaacuguacacacuggagaucagcaucaaguuggcaaugaaacgacggagcacgggacaaucgccacaaucacgccucaagcaccaacuucggaaauacaacugaccgauuacggcgcccucacguuagacugcaguccuagaacgggucuugacuucaaugagaugguacuacucacuaugaaagagaaaaguuggcugguucauaaacagugguuccuagauuuaccauuaccauggacgagcggugcaucaacaagucaggaaaccuggaaccgucaagaucuauuaguaaccuuuaagacagcucaugcaaagaaacaggaagucguuguccugggcucucaagagggugcgaugcauacugcgcuuaccggugcuacagaaauucaaacauccggaacgacaacaauauuugcaggccacuuaaaaugucgucuuaaaauggauaaacuuaccuuaaaggguaugaguuaugucauguguacagggucguuuaaguuagagaaagaaguugcagaaacgcaacacggcacgguccuuguccaaguaaaguaugaagggacugaugcuccuuguaaaauaccguuuaguacacaggacgagaagggaguuacucaaaaugguagauuaauaacggcaaacccaauaguaaccgauaaggaaaaaccagugaacaucgaaacugagccuccguuuggagaaaguuauauaguuguuggugccggcgaaaaagcauuaaaauugucaugguucaaaagaggaaguucaauaggaaaaauguucgaagcaaccgcgagaggugccagaaggauggcuauuuugggggacacagcuugggauuuugguagcauaggaggaguauuuacaagugucgguaaacuuguacaucaggucuuuggaacugcauauggaguauuauucaguggagucucauggacaaugaaaauaggaauaggaauuuuacuaacaugguuagguuugaauaguagaaguacuucgcugaguaugacauguauagcgguagguaugguaacacuauaccuggggguaaugguacaagcggauagcggaugcguaauuaacuggaaaggcagagaauuaaaauguggguccggaaucuuugucacaaacgagguacauaccuggacugaacaauauaaguuucaagcagauucaccuaagaggcugucagcagcgauugggaaagcaugggaggaggggguaugugguauaagaucagcaacgcgccucgaaaauaucauguggaaacagauaaguaaugaauuaaaucauauucuacuagagaaugacaugaaauuuaccguggucguaggugacgcuaauggcauauuggcacaggguaaaaagaugauuagaccacaaccaauggaacauaaauacaguuggaaaucauggggaaaagcuaagauaauaggagcagacauacaaaacaccacuuucauaaucgacgggccugauacuccagaauguccugauggucaacgugccuggaauaucugggaagucgaagacuauggcuuuggaguauucacaacgaauauauggcuaaaacuacgugacucauacacacagaugugcgaucacagguugaugucagcugcaauaaaagacaguaaagcgguccaugcagacaugggguauuggauugaaagcgaaaagaaugagacauggaaguuagcaagggccaguuuuauagaaguaaaaacauguaccuggcccaaaucacacacuuuguggaguaauggaguauuggagagugaaaugauuauuccuaagauauacggaggaccaauaucacaacauaauuaucgcccggguuauuucacacaaaccgccggaccauggcaccuaggaaaauuagaacuagacuucgauuuaugcgaagguacaaccgugguaguagaugaacauugugggaauagaggcccgagccuucgcacuacaacuguuaccgguaagauaauccaugaauggugcugucgaucauguacucugcccccuuugagauuuaggggugaggauggaugcugguauggaauggaaauccggccaguuaaagaaaaagaagaaaauuuaguaagaaguaugguuucggcaggaagcggagaaguugacaguuucagccuaggaauacuauguguaaguauaaugauagaagaggugaugagaucccgauggucuagaaagaugcuaaugacuggaacgcucgccguauuuuugcuguuaauuaugggacaacugacauggaacgaucuuauaagguuaugcauaauggucggagcgaaugcaagugauaggaugggaauggguaccacuuaucuugcacucauggcuacuuucaaaaugagaccaauguuugccgugggguuauuguuuagaagacuaacgucucgcgaaguauuacugcucaccauaggccucucucuaguugccaguguagaacuaccuaacucuuuagaagaacucggagauggauuagcaaugggcauaaugauguuaaaauuacuaacugaauuucaaccacaccaguuauggacaacauuauuaucccuuacuuucguuaagaccacauuaagccuagauuaugcuuggaaaacuacggcaaugguauuaucaaucgucagcuuguucccucuaugccuaucaacaacuucacagaaaacaacuugguugccuguacuauuaggcucauucgguuguaaaccauugacaauguuucuaaucacagagaacaaaaucuggggaaggaaaucauggccgcuuaaugaggguauuauggcaauagggaucguaucuauucuauugaguucacucuuaaagaaugauguccccuuagcaggaccgcuaauagcuggugguauguuaauugcaugcuauguaauaagugggagcucagcagaucuauccuuagagaaagcggcugaagucucaugggaacaggaggcagaacauaguggcgcuagucauaauauauuaguggaaguccaagaugacgguacgaugaaaaucaaggaugaagaacgagacgauacguuaaccauuuuacucaaggcaacccuauuagcaguuaguggugucuacccgaugucgauaccagcuacccuauuuguaugguauuuuuggcagaagaagaaacagagaagcggggucuuaugggauacccccagcccaccugaaguagagcgggcgguacuagaugaugguauauauagaauacuacagcguggccuucuuggcaggucacaaguagguguaggagucuuccaagacggugucuuccacacaauguggcauguaaccagaggugcuguucuaauguaucaaggaaaaagacucgaaccuucaugggcgucuguuaagaaagacuuaauaucuuauggagggggauggagauuucagggaagcuggaauacgggagaagaagugcaaguuauagcaguggaaccggguaaaaaucccaaaaauguccaaaccaccccaggaacauuuaaaacgccagaaggagaaguaggugcaauugcuuuggacuucaaaccuggaacuucuggaucaccaauaguaaaucgugaggguaagauaguaggucuuuauggcaacgguguggucacaacgucagggaccuacguaagugcaauugcccaagcaaaagccucacaagaggguccuuuaccugaaauugaggaugagguauuuaagaaaagaaauuuaacaauaauggauuuacauccuggaucuggaaaaaccagaagauaccuacccgcaauagugagagaggcaauuaagagaaaauuacgaacuuuaauccuugcuccgacaagagugguugcaucagaaauggccgaagcauuaaagggaaugccgauacgauaccaaacaacagccgugaaaucagagcauacaggucgagagauuguugacuugaugugccaugcaaccuuuacaaugcgacuauugagcccagugaggguuccgaacuauaacaugauuauuauggacgaagcacacuuuacagauccagccaguauagcagcgagggguuauauaaguacuaggguugggaugggcgaagcggcugccauuuucaugacagcaacaccgcccggcuccguagaggcuuucccacagucgaacgcaguaauucaagaugaagaaagggauauaccagaacguuccuggaacucuggauaugauuggaucacugauuucccuggcaaaaccguaugguuuguaccauccauaaaaucuggaaaugacauagcuaauuguuugaggaaaaacggaaaaaggguaauucaauuaucacgaaaaacguuugacacagaauaccagaaaacuaaaaauaacgauugggacuacguaguaacaacagauauauccgaaaugggugcgaauuuccgagcugaucgcguuauagauccuaggaggugcuuaaaaccugucauacuaaaagacgguccagagagaguaauacuagcuggaccaaugcccguaaccguggcgucagcagcccaacggcgaggccguauaggaaggaaccaaaacaaagagggagaucaauacguuuauaugggacaacccuuaaauaacgaugaagaucacgcccacuggacagaggcaaaaaugcuacuagacaacauaaauacaccugaaggaaucauaccugcccuauuugaaccugaacgagaaaaaucugcugcaauagauggugaguacagauuacgaggagaagcucgaaaaacguucgucgaacuaaugaggagaggugaucuucccguauggcuaucuuauaagguggcuagcgaaggauuccaauauucagaucgucgaugguguuuugauggagaaaggaacaaccaaguacucgaagaaaauauggaugucgaaaucuggacaaaagaaggagaacggaagaaacuucgcccacgcuggcuagaugcacgaacauauucugauccauuagcacuucgagaguucaaagaauuugcagcuggccgaagaaguguaucgggugaccuaauacuugaaauaggaaaacuaccgcaacauuugacuuuacgugcacaaaacgcauuggacaaucucgugaugcuacacaacagugaacaaggagguaaagcguacagacaugcaauggaagaacuacccgauacaauagaaacccuuauguuacuugcgcuuauugccguacugacuggcgggguuacacuauucuuuuugucugguaaaggucucgggaagaccagcauugggcuacuaugugucaccgcaucaucagcucuauuauggauggcuuccguggagccacauuggauugcggcaucgauaauuuuggaguucuuucuaaugguuuuacuaaucccugagccagacagacaaagaacuccccaagacaaucaauuagcauauguaguuauaggauuauuauuuaugauuuuaaccguggcugccaaugaaaugggcuuacuagagacuacaaagaaagaccuaggcauuggguauguagcugcugagaaccaccagcaugcaacuauguuagauguagacuuacaccccgccucggccuggacucuuuacgcagucgcaacgacgguaauaacaccuaugaugaggcauacaaucgaaaauacgacggcuaauauaagccuaacagccaucgccaaccaggcagcaauauugaugggguuagauaaaggguggccaauaucuaagauggacauaggcguaccacuguuagcauuaggauguuauucacaagugaauccacucacuuuaacugcagccguacugaugcucguggcucauuacgcaaucauaggaccaggccuacaagcaaaagcuaccagagaggcucagaaacguacggcugcgggcauaaugaaaaauccuaccguagacgguauaguagcaaucgaccuagacccuguaguauaugacgccaaauuugaaaaacaacucggacaaaucauguuauuaauccugugcacaagccaaauacuuuuaaugagaacgacuugggcccugugugaaagcauaacucuagcuacagguccuuugacaacccuaugggaagguaguccaggcaaguuuuggaauaccacaauugcagucucaauggcaaacauauuucgugguaguuaucuagcaggcgcaggacuagcauuuaguuugaugaaaucccuugggggcggucgucgagguacuggagcucaaggcgaaacgcuaggagaaaaguggaagagacagcuuaaucaacuaucgaaaagcgaauuuaauacauacaaaaggaguggaauaauggagguagaucgaagugaggcaaaagaaggauuaaaacgcggugagacuacaaaacaugcaguauccagaggaacggccaaguuaagaugguuuguagaaaggaaccuaguaaagccggaggggaaaguuauagaccuaggaugcggcagagguggcuggagcuauuauugcgcuggucugaagaaaguaacugaaguuaagggauauacaaaagguggaccaggacacgaagaaccuauaccuauggcaacuuacggauggaaccuaguaaaauugcacucaggaaaagauguauucuuuaugcccccggaaaagugugauacgcuauuaugugauauuggagaaucaaguccgaacccgacgaucgaagaaggcagaacccucaggguguuaaaaaugguagagccuugguuacgagguaaucaauucuguauaaaaauuuuaaauccauauaugccgucggucgucgaaacguuagaacaaaugcaaagaaaacauggugggaugcuuguaagaaacccuuuaagccguaauucuacacaugagauguacuggguuuccugcggaacgggcaauauaguuagugcaguaaauaugaccagccgaaugcuccucaauagauuuacgauggcucaccgaaagcccacauacgagcgggauguugaucuaggugcuggcacacgacauguugcagucgagccagaaguugccaaccuagauaucaucgggcagagaauugaaaauaucaaaaacgaacauaaaaguacuuggcacuacgaugaggauaacccguauaaaacaugggcauaccauggaucuuaugaagugaaaccaaguggaagugcaaguagcaugguuaacggugugguaagacuacuuacaaagccuugggauguaauccccaugguaacgcagauugccaugacagauacgaccccuuucggacaacaacgagucuuuaaagagaaaguugacacuaggacuccccgagccaaacgcggcacgacacaaaucauggagguaacggcuaaauggcucuggggauuuuuaucaagaaauaagaaaccaagaaucugcacacgugaggaauuuaccagaaaagugcgaucuaacgcggcuauuggagccguuuuuguugaugaaaaucaauggaacucagcuaaagaagcaguagaggaugaaagauucugggaucuggugcauagggaaagggaacuacacaagcaaggcaagugugcaacauguguguacaauaugaugggaaaaagggaaaagaagcucggagaauuuggaaaagcaaaagggagccgggccauaugguacauguggcucggagccagguuuuuagaauuugaggcuuuaggauucaugaaugaagaccauugguuuucuagagagaauaguuuaucaggagucgaaggcgaaggucuacauaaauuaggauacauauugcgugauaucaguaaaauaccaggaggaaauauguaugccgaugacacugcagguugggacacccguaucacggaagaugaccuucagaacgaagcaaaaauaacagauauuauggagccagaacacgcccuguuagccacuagcauauuuaaacuuacuuaucaaaauaaaguaguuagaguacaaagacccgccaaaaacgguacaguaauggacgugauuuccagaagagaucaaagaggcucaggccaaguaggaaccuauggucucaauacauuuacaaacauggaaguccagcuaauacggcaaauggaaucagaagguauauuuuugcccucagaauuagaaacacccaaucuugcugaaagagcauuagacuggcuagaaaagcacggugcugaaagguuaaagaggauggccaucaguggagacgacuguguuguuaaaccgauugaugauagguucgcuacagcguuaacagcuuuaaacgauauggguaaaguacggaaagacauaccgcaaugggaaccaucgaagggguggaacgauuggcaacaaguacccuuuuguagccaucauuuccaccagcuuauaaugaaagacggucgagaaauuguuguaccuugucgcaaccaagaugaguuaguaggcagagcuagggucucgcaaggagccggauggucuuuacgggaaacugcuugccucggcaaaucauaugcgcaaauguggcaguugauguauuuucaucgacgggaucuccgucuagcugcuaaugcuaucuguucagccgucccaguggacugggucccuacaucaagaacaacguggucgauccacgcacaucaucaguggaugacgacugaagauaugcuaucaguuuggaaucguguguggauugaagagaacccuuggauggaggacaagacacacguaaguaguugggaagagguuccauaucuuggaaaacgagaagaucaaugguguggaagccuaauuggccuuacggcacgagcaaccugggcuacuaacauacagguagcaauaaaucaaguacgacgauuaauaggaaaugaaaauuacuuagauuacaugaccuccaugaaacguuucaagaaugagucugacccagaaggcgcacuuugguaa

SEQ ID NO: 21431 - RNA, 9879 nt, Artificial Sequence
  derived and/or modified CDS sequence (opt6) from DENV-1__FJ850103__SS-prME
ucgguuacgaugcuacuuauguuauuaccgacugcuuuagcauuucaccuaaccacuaggggaggugaaccccacaugauuguaagcaaacaagaacguggcaaaucauuacucuuuaaaacuucugcuggaguaaauauguguacuuuaauagcgauggaucucggcgaauugugcgaagacacgaugacuuauaaauguccuagaauaacugaagccgaaccggacgaugucgauugcugguguaaugcgacugauaccuggguaacuuauggaacaugcagccaaacuggagaacaccgucgagaaaaacgaucaguagcacucgcaccucacguaggauuaggacuugaaacuagaacugaaacuuggaugaguagcgaaggugcuuggaaacaaauacaaaggguggaaacaugggcacuucgacacccaggcuucacgguaauagcauucuuucuggcccaugcuauaggaacaagcauaacucaaaaagguaucaucuuuauauugcucaugcuaguaacaccaucuauggcuaugagaugcguaggaauaggcaauagagauuuuguagaggguuuaucgggcgcgacauggguagacgucguacuagagcauggaaguugcguaacaacuauggccaaaaacaaaccaacucuagauaucgaauuauuaaaaacagaagucacuaauccggcagucuuacggaaauuauguauugaggcaaaaauaagcaacaccacgacggauucaagaugucccacacaaggagaagcuacauugguagaagaacaagacgcaaauuuugucuguagaaggacauucguugauaggggauggggaaacggauguggacuguuuggaaaaggaucccuauuaacuugcgccaaauucaaaugcguaacuaaauuagaggggaaaauaguacaguacgaaaauuuaaaguauucuguuauaguuacaguacacacaggagaucaacaccagguuggaaaugagaccacugaacacgguaccauagccaccauuacaccucaagcuccuacuucagaaauacaacucacagauuauggagcauuaacucucgacuguucgccaagaacaggucucgauuucaaugagaugguccuuuuaacaaugaaagaaaaauccuggcuaguccacaaacagugguucuuagacuugccauuaccauggacgaguggcgcaaguacuucucaagagacauggaauagacaagaucuccucguaacuuuuaagacugcacacgcgaagaaacaagaaguuguaguacuagguucgcaagagggcgcaaugcauacagcacugacaggagcuacagaaauccaaacauccgguaccacaacaauauuugccggacacuuaaaauguagauugaaaauggauaaacugacauuaaaggguaugucauaugucauguguacuggaucauuuaaacuggaaaaagaaguggcugaaacacaacaugguacaguauuagugcagguuaaguaugaaggcacagaugcgcccuguaaaauuccguucuccacccaggaugagaaggggguuacccagaaugggcguuuaauuacagcuaauccgauagucaccgauaaagaaaaaccaguuaauauagaaacugaaccgcccuucggggaaucauacaucgucguaggagccggugaaaaagcguugaaacuuucuugguucaaacguggaagcucaauagggaagauguuugaagccaccgcgagaggagcuagacgaauggcgauacugggugauacggccugggauuucggaagcauugguggcguguuuacuagcguaggcaaguugguacaccaaguauuuggcacugccuacggaguauuguucucaggaguauccuggacaaugaagauaggaaucggaauacuucuaacguggcuaggguuaaauucgagaucaacaucauugucgaugacuugcauugcaguaggaauggucacauuauaccuaggggucaugguacaagcugacucuggaugugugaucaauuggaaggggagagaacuaaagugcggaagcgguaucuuugucacaaacgaagugcacacguggacugaacaauauaaguuccaagcugauaguccuaagcgacuaagcgccgcgaucggcaaggcgugggaagaaggaguuugcgggauuagaagcgcuacucgacucgaaaauauuauguggaaacagauaagcaaugaauuaaaccauauacuacucgaaaaugauaugaaauuuaccgucguaguaggcgaugcaaacggaaucuuagcacaagguaagaaaaugauacguccgcaaccaauggaacauaaauacagcuggaaaucgugggguaaagcaaagauaaucggggccgauauccagaacacgacauuuauaauagaugguccggauaccccagaaugucccgaugggcaacgagcguggaauauaugggaaguagaagauuauggauuuggggucuuuacaacaaacauauggcucaaauuacgugacagcuauacacaaaugugcgaccacagacugaugucggcggcgauuaaagacucgaaagcugugcaugcugacaugggcuauuggauugaaagugagaaaaaugagacauggaaauuagcaagagcaaguuuuauagaggugaaaacgugcauuuggccuaaaagccauacguuguggucaaacggaguucuagaaagugaaaugauuauucccaagauauauggaggaccaauaucacaacauaauuaccgaccgggcuauuucacacaaacagcaggaccauggcaucucggaaaacuagaauuagacuucgaucuaugcgaaggaacuacggugguuguagacgaacacugcggcaacagaggacccucucuucggacaacgacugucacgggaaagaucauacacgaauggugcuguagaucuuguacccucccgccauuacguuucagaggggaagaugggugcugguaugguauggaaauuagaccuguuaaagaaaaggaagagaacuuagucaggucaauggucagugccggaagcggagaggucgacucauucaguuuagguauuuuauguguaaguauaaugauagaagaagugaugagaagucgcuggucccgaaaaauguuaaugacagguacacuagccguguucuuauuacuaauuaugggacaacuaacguggaacgaucugauucgauuaugcauaauggugggcgcaaaugcaagcgauagaaugggcauggguacuacauaucuggcauuaauggcgacauuuaaaaugagaccaauguuugcagucggcuuguuauuucgucgauuaacaagucgcgaaguguuauuacuaacaauuggauuaagccuuguagcauccgucgaauuaccaaauucccuugaagaauuaggagaugguuuagcuauggguauaaugauguuaaaguuguuaacagaguuucaaccucaccaguuauggacaacauuauuaagccucacauucguuaagacuacauuaucauuggauuacgcuuggaaaacaaccgcuaugguuuuaucgauagugaguuuguuuccacuuugucucucaacgacaagucagaaaacgacauggcuaccaguucuucucgguuccuucggauguaaaccuuugacuauguuuuugaucacugaaaacaaaauauggggaagaaaaucuuggccccuaaacgaggguauaauggcuauagguauaguaaguauauuguuaaguucucuucuuaaaaaugauguucccuuagcagguccgcuaauagcagggggaauguuaauugcgugcuacguaauaucgggaucuucagcugauuuaucuuuggaaaaagcugcggaaguguccugggagcaagaagcagagcacucaggagcuagccacaauauacuuguagagguucaagacgaugggaccaugaaaauaaaagaugaagaaagggaugacacacuuacaauacuccuaaaagcaacauuauuagcagugucugggguauacccuaugucuauacccgcaacauuauuuguaugguacuuuuggcaaaagaagaaacaacgaagcgggguucugugggacacgccuaguccaccagaaguagaacgcgcaguucuagaugaugguauuuaucguauccugcaacguggacuccugggaaggucacaaguuggagucggaguguuucaggauggugucuuccauacgauguggcauguaacuagaggggcuguucuaauguaccaagguaaacggcuagaaccuucaugggcaagcgucaagaaagauuuaauaucauaugguggaggguggcgauuccagggaucuuggaacacgggugaagaaguucaagugauagcaguugaaccugggaaaaacccaaagaacguucagacaacaccugggacuuucaaaacgccagaaggggaaguaggcgccauagcgcuugauuucaaaccagguacaaguggcucgccaauuguaaaucgugaagggaaaauuguaggacuauacggcaacggaguggugacuacauccggaacuuaugugagcgcgauagcucaagcaaaggcuucgcaggaaggaccucugccugaaauagaggaugaaguauuuaagaaacgaaauuugacaaucauggaucuacauccggguucgggcaaaacaagaagauacuugccagcaauagucagggaaucgauuaaaaggaaacuuaggacauuaauucuggcaccgaccagagucguggcaucagaaauggcggaggcguugaaagguaugccgauaagauaucagacuacggcugucaaaucagagcauacaggccgcgaaaucguagauuuaaugugucaugcaacguuuacuaugagauuguuaucgcccgugcgaguuccaaacuacaauaugauaauaauggaugaggcacacuuuacugacccugcuucuaucgcagcccgaggauauauuaguacaagaguaggcaugggcgaagcagcagcaauauuuaugacagcuaccccacccggaaguguagaagcguucccacaaaguaacgcaguaauacaggacgaagaaagggauauaccagagaggucauggaacucgggauaugacuggauaacggacuucccugguaaaacaguuugguuuguccccucuauaaaaagugggaacgauauugcgaacuguuuaaggaaaaacgguaagagagugauucaacugaguagaaaaaccuucgauaccgaauaucagaaaaccaagaacaaugauugggacuaugucguuacuacugauaucagugaaaugggugcuaauuucagggcagauagagucauagauccccgucgguguuuaaagccugucauacuaaaggacggcccagaaagaguaauacuagccggaccuaugccaguaacaguugcaucagcugcccaacgaaggggucgaaucggaaggaaccaaaacaaggaaggcgaucaguauguauauauggggcagccacuuaauaaugaugaggaucaugcacauuggaccgaagccaagaugcuuuuagauaauauaaauacuccugaaggcauaauaccggcacucuuugagcccgaaagggaaaaauccgcugccauagauggagaguauaggcuucggggagaagcacguaaaacauucguggaauuaaugcgacggggagacuuacccguuuggcucuccuacaaaguagcaagugagggcuuucaauauucggauaggagauggugcuucgauggagaacgcaauaaucagguuuuggaagagaacauggacguagagauuuggacaaaggaaggcgaacgaaagaaacuucgaccccgaugguuagaugcucgaacguauucagauccauuagcacuuagagaguucaaagaguuugcggcaggcagaagaagugucucaggagaucuaaucuuggaaauaggaaagcuaccacaacaucuuacucugagagcucaaaaugcacuggacaaucuuguuaugcuucauaacagcgagcaaggagguaaagcauauagacaugcuauggaggaauugccugauacaauugaaacauuaaugcuuuuagcacucauagcagucuuaacgggagguguaacacuuuucuuuuuaucaggaaaaggucugggaaaaacauccauaggcuuauuaugcgucacggcuuccagugcacuguuauggauggcaagcguagagccacauuggauagcagcaucgauaauauuagaguucuuucugaugguacuccuaauuccggaaccagauaggcaaaggacaccacaggauaaucaauuagcguauguaguaaucggccuucuguuuaugaucuugaccgucgcugcaaacgaaauggggcuuuuagaaaccacuaagaaagaccuggguaucggauauguagcugcagagaaucaucaacaugcaaccaugcuugacgucgaccuucacccagcaagugccuggacuuuauaugcuguggcuacaacuguuaucacuccaaugaugaggcauaccauagagaauacuacagcaaauaucucauuaaccgccauugcaaaucaagcagcaauucugaugggucuggauaaagguuggcccauuucuaagauggacauuggaguaccauugcuugcguuggggugcuacagccaaguuaauccucuuacucucacagcagccguguuaaugcuaguugcacauuacgcuauuaucggcccaggguuacaagcgaaggcaacaagagaagcacaaaaacgaaccgcagcuggcauaaugaaaaacccaacgguugaugguauaguagcuaucgaucuagaucccgugguauaugaugcaaaauuugaaaaacaacuaggucaaauaauguuauuaauauugugcacaucacagauacuguugaugcgaacaacuugggcgcuuugugaaaguaucacuuuggccacgggaccucucacuacuuuaugggaaggaucgcccggcaaauuuuggaauacuacuauugccgugucuauggcaaacaucuucagaggaucauaccuggcuggcgcaggucuggcuuuuucacugaugaagucauuaggugguggcaggagaggcacuggcgcacaaggagaaacacuaggagaaaaauggaaaaggcagcuaaaccaauuaucuaaaucugaauuuaacacauauaaaagaagcgguauaauggaaguugaucgauccgaagcaaaagaaggucugaaaagaggugaaacaacaaaacaugcaguaucaagagggacagccaagcuccgaugguucguagaaagaaaucuaguaaagcccgaagguaaaguaauagaccuuggcuguggcagaggcggauggucauauuacugcgcagguuuaaagaaagugaccgaaguaaaaggauacacgaaaggaggaccaggacacgaagaaccgauaccgauggcuaccuaugguuggaaucuggucaaacugcauagugggaaagacgucuuuuucaugcccccagagaaaugcgauacguugcucugugacauuggggaaagcucaccaaauccaacuaucgaagagggaaggacgcuaagaguauuaaaaaugguggagccaugguuacggggaaaucaauuuugcaucaagauuuuaaaucccuacaugcccagcguuguugagacucucgaacaaaugcaaagaaaacaugguggaaugcucguacgaaaucccuuaagccgaaacaguacucacgagauguacugggucagcugcggaacaggcaauauaguaucagcugucaauaugacuagcagaauguuauugaaccgauuuacuauggcacauagaaaacccacauacgagagagacguagacuugggagcugguacccgacacguugcaguagaaccagaaguggcaaaucuggauauaauuggccaaaggaucgaaaauauuaaaaacgagcauaaaagcacauggcauuaugacgaagauaauccuuauaaaacuugggccuaucacggguccuacgaagugaagccaucagggucagcuaguucaaugguaaacgguguaguuaaauuacucacaaaaccgugggaugugauaccaaugguuacucaaaucgcaaugacugacacaacuccauucggucagcagcggguguucaaagaaaaaguggauacacggacaccgagagcaaagcguggaacaacucagauuauggagguuacagcuaaaugguuguggggguuucuaagucgaaauaagaaaccacgaaucuguacacgcgaggaguucaccagaaagguuaggucaaaugcugcgauuggugcagucuuuguagacgagaaucaguggaacucagcuaaagaggcuguggaagacgaacgcuuuugggaucuugugcauagagaaagagaacuacauaaacaggguaagugugcaacguguguuuauaauaugauggguaaacgcgagaagaaacucggggaguucggaaaagcgaaaggaucuagagcaauuugguauaugugguugggagcaagauucuuagaguuugaagcauuagguuuuaugaacgaagaccauugguuuucuagagaaaauucacuaucugggguggaaggugaagguuuacauaagcugggauacaucuuaagagauauaagcaaaauaccagggggaaacauguaugcagaugauacagccgggugggauacucgaauaacagaagacgauuuacaaaaugaagcuaaaaucaccgauaucauggaaccagaacaugcauuauuagcuaccaguauuuucaagcugacauaucagaacaaagugguacgaguacaacguccagccaaaaauggaacugugauggaugugauuagcagacgagaucaaagaggaucuggacaagucggaacauacggcuugaauacguucacgaacauggaaguucaguuaauuaggcagauggaaucagaagggauauucuugcccucagaguuggaaacaccuaaucucgcagagcgugcuuuagacugguuagaaaagcacggcgcagaacgucuaaaaaggauggcgauaucaggagaugacuguguaguuaaacccaucgacgauagauuugccaccgcucuaacagcucucaacgauaugggcaaagucagaaaggacauaccccaaugggaaccuaguaagggcuggaaugauuggcaacaaguuccauucugcagccaucauuuucaucaauuaauaaugaaagacgggagagaaauagugguuccuugcagaaaucaagaugagcuaguaggacgagcaagagucagccaaggagcggguuggaguuugagagaaacugcauguuugggaaaaucauaugcacagauguggcaacuaauguauuuccacagacgagacuuacgccuugcagcuaacgccauaugcucagcuguuccaguggacugggucccgacgaguaggacaacuuggagcauacaugcacaucaucaauggaugacgacagaagauaugcugaguguguggaauagaguauggaucgaagaaaauccuuggauggaggacaagacccauguaucaucaugggaagaagugccuuauuuaggaaaaagggaggaccaauggugugggaguuuaauaggauuaaccgcucgagcuacuugggcaacaaauauacagguugcgaucaaccaaguaagacgauugauaggcaacgaaaauuaucuggauuacaugacaaguaugaagagguuuaagaaugagagcgaucccgaaggagcccuuugguaa

SEQ ID NO: 21432 - RNA, 9879 nt, Artificial Sequence
  derived and/or modified CDS sequence (opt6) from DENV-1__FJ850104__SS-prME
ucagugacuauguuauugauguuacuacccacggcccuagcuuuccauuuaacuacaagagguggggaaccacauaugaucgugaguaaacaagaaaggggaaagagcuuacuuuuuaaaacgagugcaggaguaaauauguguacccuaauagccauggaucuuggugaauugugugaagauacaaugacuuacaaaugcccaagaauaaccgaagcagaaccagaugauguugauugcuggugcaaugucacugauacuuggguaacauacggaacauguucccaaacaggcgaacauaggcgagauaaacgaucugucgcccucgcaccgcauguaggacuagggcuagaaacgagaacagaaacuuggauguccagugaaggugcauggaaacaaauucaacgcguagaaacuugggccuuacgacacccaggauuuacaguaauagcacuauuuuuagcacaugcaaucggaacaucgauaacacaaaaagggaucaucuucauacugcucaugcucguuacuccgucgauggcgaugagauguguaggaauaggaaauagagacuucguagaaggucugucuggagcgaccuggguugauguugucuuagaacauggcagcugcgucacaacgauggcgaaaaauaaaccgacauuagauaucgaauuguugaaaacggaaguuacgaauccugcuguacucaggaaacuuuguauagaagcgaaaauaucaaacacaacaacugauagucgauguccuacacaaggggaggcuacguugguagaggaacaagacgcaaauuucgugugccgaaggacuuucguugaucgcgguugggggaacggauguggacucuuuggaaaaggaucguugcuaaccugcgcuaaauuuaaguguguaacuaaauuagaagguaaaauaguucaauacgagaaccuaaaauauaguguuauaguaacgguacacacaggagaccaacaccaaguuggaaacgaaacuaccgaacacggaacaauugcaacaauuacuccacaagcgccuacgucugaaauacaauugacugauuauggggcucugacccuugauugcucgccacggaccggacuagacuucaacgaaauggucuuacuuacuaugaaagagaaaagcuggcuaguucacaaacaaugguuuuuagaccucccauuaccauggacaaguggagcuucuacaucacaagaaacauggaaucgacaagacuuauuagucacauuuaaaacagcacacgcaaagaaacaagaaguagucguacuggguucacaagaaggcgcaaugcauacagcauuaacgggagccacagaaauacaaacgucaggaacuacaacuauauuugcagggcacuuaaaaugucgucucaagauggauaaauuaacguuaaagggcaugucuuauguaaugugcacuggaucguucaaacuugaaaaagaaguugcggaaacgcaacaugggacuguacucguucaagucaaauacgaggguacagaugcuccauguaaaauucccuuuuccacgcaagaugaaaaaggagucacacaaaauggacgacucaucacagcuaauccuauuguaacagauaaagaaaaaccaguaaauauugaaacagagccaccguuuggcgaguccuauauaguagugggcgccggugagaaagcguuaaaacucucaugguucaagaaagguaguucaauugggaaaauguuugaggcaacagcaagaggagcccgccgaauggcuauacuuggcgauacagcuugggacuucgguucaaucggaggaguauucaccucuguaggaaaacuugugcaccaaguauucgggacugcauaugguguguuauucucaggcgucaguuggacaaugaaaauagguauaggaauauuacugacguggcuuggguuaaacucgagauccacaagucuuucuaugacuuguauagcugucggaaugguuacauuauaccucgggguaaugguacaagcagacaguggauguguuauaaacuggaaaggccgcgaacuaaaauguggaagcgguauauuugucacaaacgaggugcauacauggacugaacaauacaaguuucaagcugacaguccaaaacgauugucggcugcgaucggcaaggccugggaagaagguguguguggaaucagaagcgcuacacguuuagagaacauaauguggaaacaaaucagcaaugaacucaaucacauauuacuugaaaaugauaugaaauucacuguaguagucggcgacgcuaaugguauacuugcacaagguaaaaagaugauuaggccucaaccaauggaacauaaauauucauggaaaaguugggguaaagccaaaauaaucggugcagauauccaaaacacuacuuucauaauagauggaccugauacuccugaauguccugauggacaacgagcuuggaacauaugggaggucgaagauuauggguuuggaauauucacaacuaacauaugguuaaaacucagagauucauacacucaaaugugcgaccaucgauuaaugagcgccgcaauuaaagacaguaaagcggugcacgcagauaugggauauuggauugaaagugagaaaaaugagacauggaaguuggcgagagcuucuuuuauagaaguaaaaacuuguacuuggccaaaaucacacacguuguggucaaauggcguccuagaaagugaaaugauuaucccaaaaaucuacggaggaccgaucucgcagcacaaucauagaccgggauacuuuacacagacagcagguccauggcaucucgggaaauuagaacuagauuucgaccucugcgagggaaccacuguaguaguagacgaacauuguggaaacagagggccauccuugaggacaacuacuguaacaggaaagaucauccacgaauggugcugcagaucguguacucucccaccauuaagauuucguggagaggacgguugcugguaugguauggaaauaaggccaguaaaggaaaaggaagaaaaccuuguuagaucgaugguaucugcgggcuccggcgaaguagauucauucagucuugguauucugugugugagcauaaugauugaagaaguaaugagaaguagguggagucgcaaaaugcuaaugaccgguacucuagcaguauuuuuacuuuugauaauggggcaacuuaccuggaaugaccuaaucagacucugcaucaugguaggugcaaaugcgucugauaggaugggcaugggaacaacuuaucuagccuuaauggcaacuuucaaaaugagaccgauguucgcuguuggacuucuguucagaagauuaacgaguagggaaguauuguuacucacaauaggauugaguuuaguugcauccguugaauuaccuaauagucuagaagaacuaggggacgguuuagcaauggggauuaugauguuaaaacuuuuaacagaguuucagccgcaccaguuauggaccacacuuuuaucguugacuuuugugaaaacaacucuuagcuuagauuacgcauggaaaacuacagcuaugguucuaaguauuguaucacuauucccuuuauguuuaucaacaacuucgcagaaaacuacuuggcugccaguauuacuugggucuuucgguuguaagccauugacaauguuccucauaacagaaaacaagauauggggucggaaaucuuggccccucaacgaggggauuauggccauaggaauuguaucgauauuacuaaguagucuacucaaaaaugauguuccauuagcaggaccucuuauugcagggggcauguuaaucgccuguuacgugauuucgggcuccagcgcugauuuaucucuugaaaaagcagcagaggucucaugggaacaagaagccgagcacaguggagccucccacaacaucuuaguugaagugcaggaugaugguacgaugaaaaucaaagacgaagaacgagaugauacgcucaccauacuacuaaaggcgacacuauuagcuguuaguggggucuaucccaugucaauuccugcaacgcuauucguaugguauuucuggcagaagaagaaacaaagaagcggaguauuaugggauacaccauccccucccgaaguugaacgagccguacucgaugauggaauauauagaauccuccaacgaggacuucugggacguucacaagugggcgucggaguuuuucaagacggaguauuccauacaauguggcacgucacaagaggcgcaguacucauguaucagggaaaaagauuagaaccuagcugggcaagcgucaagaaagauuugauaucguauggaggugguuggcgguuccaagguaguuggaauacuggugaagaaguucaaguaaucgcuguugaaccaggaaagaaucccaaaaauguccaaacaacaccgggcacauucaagacaccggaaggugagguuggagcgauugcucucgauuuuaaaccuggaacaucuggaucuccaauuguaaaccgcgaaggaaaaauaguggguuuguauggaaacggcgucguaaccacgucagggacuuauguaucugcuauagcccaagccaaagcaagccaagaaggaccauugccggaaauagaagaugaaguguuuaagaaaaggaaucugacaaucauggaccuucauccaggaagcggaaaaacgaggagauaccuacccgcaauaguaagagaagcaaucaaacggaaacuucgaacauugauacuagccccaaccagaguagucgcaagugaaauggcggaagcacuaaaaggcaugccgauaagguaucaaaccacagcuguaaagucagaacauacuggaagagaaauaguagaucuaaugugccacgcaacguucacaaugagacugcuaucacccguccgugugcccaauuauaacaugauuaucauggaugaagcacacuuuacagauccugccucuauagcagcccguggauauauaaguacucgaguugggaugggugaagcagcggccauauuuaugacggcuacuccuccuggaaguguggaggcauuuccucaaucaaacgcaguaauacaagacgaagaacgagacauuccugagagaaguuggaacucuggauaugauuggauaacagauuuuccagguaaaacaguaugguucgugccaucaaucaaaagugggaaugacauagccaauugucucaggaaaaacggaaaacguguaauucaguuaucacgaaagacauucgauacugaauaucaaaagaccaaaaauaaugacugggacuacguaguuacaacugacaucagugaaaugggcgcgaauuuccgagcugaucggguaauagauccuagacgaugucucaagccaguuaucuuaaaagacggaccugaaagaguuauauuagcuggaccaaugccgguaacaguagcaucagcggcacagagaagaggucggauugguagaaaccagaauaaagaaggcgaccaauacguuuacaugggacagccccuuaauaacgacgaagaucaugcacauuggacugaggccaaaauguuacucgauaauauuaauacaccagaaggcauuaucccagcauuauuugagcccgagagggagaagucugcagcuaucgauggugaauaucguuuacguggagaggcaagaaaaacauucguagagcuuaugagacgcggcgaucuaccgguauggcucaguuauaaaguagcaucagaaggauuccaauauucggaucggagaugguguuucgacggcgaacgcaacaaccaaguacucgaagaaaacauggacguugaaauauggacaaaggaaggcgaaagaaagaaguugagaccaagguggcuggaugccaggacguauagugauccauuagcacugagagaguucaaagaguucgcggccggucggcguucaguuucuggggacuuaauucuggaaauuggcaaguugccucaacacuuaacgcuaagggcacagaaugcgcuggauaaccuaguaaugcuucacaacucagaacagggugggaaggcauacagacaugcgauggaagaauuaccggacacuauugagacucucauguuacuggccuuaauagcugucuugacagguggugucacacucuucuuucuuucaggcaaaggguuggguaagacaaguaucggacuguuaugcgucacagcaucaucugcuuuacuuuggauggcaagcguagaaccccauuggauagccgcaucaauaauccuggaguucuuucuuaugguccugcugauuccagaaccugauagacagagaacaccucaagacaaucagcuagcuuacguugucauaggacuacuauucaugaucuugacuguagcugccaaugaaaugggcuuacucgagacgacuaagaaagaucucggaaucggcuacguagcagcggagaaucaccaacaugcaacgaugcuagauguggacuuaagaccggcaucagccuggacauuguacgcaguagcaaccacaguaauuacuccuaugaugaggcacacaaucgaaaacacgacagccaauauaaguuuaacggcgauugccaaucaagcagcaauauugaugggccuggauaaaggguggccuauaucuaagauggauauuggaguucccuuauuagcguugggcuguuacagucaaguaaauccgcucacccuuacugcagcaguucuaaugcugguugcucacuacgcaauuauuggccccggacuccaggcuaaggcaaccagagaagcccagaaaagaacagcggcaggaauaaugaagaauccaaccguagaugguauagucgccauagacuuggauccaguagucuaugaugcaaaguucgaaaaacagcucggccaaauuauguuacuaauauuaugcacaucucaaauucucuuaaugaggacuacaugggcauuaugugaaucaauuacacuagcaacuggaccacuaacgacccucugggaagguucccccggaaaauucuggaacaccacaauagcaguuuccauggcgaacauuuuccgaggaagcuacuuagcaggagcgggucuggcauuuucauuaaugaaaagccugggaggaggacggagaggcacaggcgcccaaggagaaacauuaggcgaaaaauggaaaagacagcucaaccagcuuaguaaaucagaauuuaauacguauaaaaggucaggaauaauggagguagauaggucggaagccaaagaaggucuaaaacgaggugagacgacaaaacaugcagugaguagaggaacagccaaacuaaggugguuuguugaacguaauuuggucaaaccugaaggaaaagugauagacuugggcugugguagggguggcuggucauauuauugugcagggcugaagaaagucacugaaguaaagggauauacaaaaggagggccagggcaugaagaaccaauacccauggcuacguauggcuggaauuuagucaaacuucauucuggcaaggacguuuucuucaugccaccugaaaaaugcgauacacuacugugugacauuggagaaucaucgccuaaccccacaauagaagaagguaggacccucaggguauugaaaaugguagaacccugguuaagagggaaucaauucuguauuaagauuuuaaacccguacaugccuucuguaguagagaccuuggagcaaaugcaaaggaagcaugguggcaugcucguaagaaauccucuaucgagaaauucuacacacgaaauguauugggugucgugcggaacaggaaauauuguauccgcaguaaauaugacgagccgaauguuacucaaucguuuuacaauggcgcaccgcaaaccuacguaugaaagggauguugauuuaggggcugguacacgccacguugcgguagaaccagaagaagcaaauuuagauauaaucggacaaagaauagaaaacauuaagaacgagcacaaaagcacuuggcacuacgaugaagacaauccauauaagacgugggcauaccauggcaguuaugagguuaagccuagcggaucugcuaguuccauggucaauggaguuguacggcuuuugaccaaaccaugggauguaaucccuaugguuacacaaauagcaaugacugauacaacuccguuuggccaacagagaguauucaaggagaaaguugauacacguacaccaagagcaaaacgagggaccacacaaaucauggaaguaacagcuaaguggcuuuggggauuuuugucgagaaacaaaaagccaagaauauguacuagagaagaguucacuagaaaaguacguucaaaugccgcaauuggcgcggucuucguggaugagaaccaauggaacucggcuaaggaggccguugaagaugagagauuuugggaucucguacauagagagcgggaacuacauaagcaggggaagugugcgacaugcguuuacaacaugauggguaaaagggaaaagaaauugggugaauuuggaaaagcaaaggggucaagggcaauaugguacauguggcugggagcaagauuuuuggaguuugaagcccugggauuuaugaaugaagaccauugguucagcagggaaaacucgcuaucaggaguagagggagaagguuuacauaaauugggauauaucuuacgcgauaucucuaagauaccaggcgguaacauguacgcggacgauacugccggaugggauacuagaauaacugaagacgaccuccagaacgaagccaaaauaacggauauuauggagcccgaacaugcgcugcuugcgacaaguauuuuuaaguuaacguaucagaauaaggucgucagaguacagagacccgcgaagaacggcaccguaauggacguaauaagucggagagaccaacguggaucgggacaggugggcacauacggucuaaauaccuuuacuaauauggagguucaacucauuagacaaauggagagugaaggaauauuucugccuucggaauuagaaaccccuaauuuagcggaacgcguccuagauuggcuggaaaaacauggcgccgaacgucuaaagagaauggccaucucaggcgaugauugcgucguuaaacccauugaugauagguuugcuacggccuugacagcauugaaugacaugggaaaaguaagaaaagauauaccucaaugggaaccgucuaaaggauggaaugauuggcagcaaguaccauuuuguagucaucacuuucaucaacuuauaaugaaagauggaagagaaauaguggucccauguagaaaccaagacgaauuagucgggcgagcaagggugucacagggcgcgggguggucauuacgugaaacagcauguuugggcaaaucauacgcacaaauguggcaacugauguacuuucaccgaagagaucuucgacuagcagcuaacgcaauuuguagugccguuccagucgacuggguuccuacaagucgaacaacuuggagcauacaugcacaccaucaauggaugacaacugaggauauguuaucaguguggaacagaguguggaucgaagaaaauccauggauggaagauaagacccacguuucuaguugggaagaaguuccauauuugggaaaacgagaagaccaauggugugguucacuuauaggguuaacagcgcgugccacaugggcaacaaauauacaaguagcaauuaaccaaguucggagauuaaucggcaacgagaauuaccuugauuacaugacuucgaugaaaagguucaagaaugaaagcgauccagaaggcgcguuaugguaa

SEQ ID NO: 21433 - RNA, 9879 nt, Artificial Sequence
  derived and/or modified CDS sequence (opt6) from DENV-1__JN819405__SS-prME
aguguuacuauguuauuaauguuguuaccaacugcuuuagcauuucacuuaacaacacgugguggggaaccccacaugauagugucuaaacaagaaagggguaaaucacuuuuguuuaaaacaucagcaggagucaauaugugcacguuaauugcuauggaucuaggugaauuaugcgaagauaccaugacauacaaaugcccgagaauaacagaagcagaaccagaugauguagacugcuggugcaacgcuacggacacauggguaacuuacgguaccuguucccaaacaggagaacauaggcgcgauaaaagaucaguagcuuuagcaccgcauguaggauuagggcuagaaacaagaacggaaaccuggaugagcucagaaggcgcguggaaacagauacaacgagucgagacaugggcauuacgccacccuggauucaccgugauagcauuauuccuugcucaugccauagguacuuccaucacucaaaaaggaauaauauucauuuugcuaauguuagugacuccgucaauggcaaugagaugcguaggcauagguaauagagauuuuguagaggggcuaagcggugccaccuggguagacgugguauuagaacacggauccuguguaacuacaauggccaaaaauaaaccaaccuuagauauugagcuucuaaaaacugagguaacaaauccugcuguacuucgaaaauuauguauagaagcuaaaaucagcaauaccacgaccgacagccgaugcccaacacaaggcgaggccaccuuaguugaagaacaagaugcaaauuucgucuguagaaggaccuuuguagauagaggauggggcaaugggugcggucuuuuuggaaaaggaucauuauuaacuugcgcgaaauuuaaauguguaacaaaauuggaagguaaaaucguacaauacgagaacuugaaauauucuguuaucgugacaguacacacgggagaccaacaccagguaggaaaugaaacuaccgagcauggaacgauagcaacuauuacgccucaagcaccgacaagugaaauacaacucacggacuacggcgcauugacuuuggacuguagccccagaaccggcuuggauuuuaacgaaaugguacuucucacaaugaaagaaaaauccugguuaguccauaaacaaugguuccucgauuuaccgcuacccuggaccagcggcgcguccaccucacaggaaacauggaauaggcaagaucuauuaguuacauuuaaaacugcacacgccaagaaacaagaaguagucguccuggggagucaagaaggagcaaugcauacugcauuaacuggagcuacagaaauccaaacuuccggaacaacuaccauauuugcaggccaccuaaaaugccgauuaaagauggauaagcuaacacuaaaagguaugucuuaugucauguguaccgguucauuuaagcuggaaaaagaaguggcugaaacccaacacgguacgguucuaguacaggugaaauaugaaggcacugaugcaccuuguaagaucccauucucaacgcaagacgagaaaggggucacacaaaacggaagacucauuacagcaaacccaauaguuacagacaaagagaaaccagucaauauagagaccgaaccuccauucggugaaaguuacauuguuguaggcgcaggagagaaagcucuuaaauugaguugguucaagaaaggaucuucaauugguaaaauguucgaagcuaccgcgcgcggagcaagacgaauggcaauccucggagacacagcgugggacuuuggcaguaucggaggaguauuuacuucuguaggcaagcuagugcaucaagucuucgggacagcuuacgguguauuauuuucaggcguuaguuggaccaugaaaauagguaucggcaucuuacuaacauggcugggacuuaauucaagaucaacuagccugagcaugacaugcauagcggucggcaugguuacuuuauauuuagguguaaugguacaggcggacagcgguugcguaaucaacuggaagggacgcgaauuaaagugcggcucuggaauauucguuaccaacgagguacacacguggacagaacaauauaaauuucaagcagauagcccuaaacgacuuuccgcggcaauagggaaggccugggaagaagggguaugcggaauacgaagugcgacgagguuagaaaacauaauguggaaacaaauuucaaaugaguugaaccacauauuacuggaaaacgauaugaaauucacaguaguuguuggugacgcaaacggcauuuuagcgcaaggcaagaaaaugauuaggccacagccuauggaacauaaguauucuuggaagucguggggcaaggcgaaaaucaucggagcagacauucagaauacaacguuuauaauagaugggccagauacgccugaaugucccgaugggcaacgggcguggaauaucugggaggucgaggauuacgguuucggaauauucacaacuaacauuuggcuaaaacucagggauucauacacccaaaugugugaucaucgauuaauguccgcagcuauuaaagauuccaaggcuguacacgcagacauggguuauuggauugaaucagaaaagaaugaaacauggaaguuggcacgcgcaaguuuuauugaggucaaaaccuguacauggcccaagucccauacgcuauggaguaauggcguccuagaaucugaaaugauuauaccaaaaauuuauggcgggccaauaagucaacacaauuauagaccaggauauuucacacaaaccgcuggaccguggcaucuugguaaauuagagcuugacuucgauuuaugugaggguacaacaguuguaguagacgaacauuguggcaacagaggaccuagucugaggacuacaaccguaacagguaaaauaauucaugaaugguguugccguagcuguacguugccaccucucagauuucgaggagaagauggguguugguauggaauggaaauacgaccaguuaaagaaaaagaagaaaaccuaguaaggucaauggucucagcagggucuggugagguugacuccuucucacuaggaauacuguguguaucaauaaugaucgaagaaguuaugagaagccguuggucacgaaaaauguugaugacaggaacauuggccguauuccuccuuuuaauuaugggacagcuuacuuggaaugaucuaauacgacuuugcauaauggugggagcuaaugcgagcgauagaaugggcauggggacuacucaccuagcuuugauggcaacuuuuaaaaugagacccauguucgcagugggauugcuguucaggcgguugacaucccgugaaguacuuuuacuaaccauagggcuuucauuaauggcgaguauggagcuuccuaacagccuagaagaauuaggagacggguuagccaugggaauaaugaugcuuaagcuacuuaccgaguuccaaccacaucagcucuggacgacacuauuaucauuaacuuuuguaaaaacaacuuuaucgcuagauuacgcauggaaaaccacagcuaugauuuuaaguauaguaucacuguuuccacuuugucuaucaacgacaagucagaaaacaacaugguugccaguucuucuugguagcuuuggguguaagccccuuaccauguuuuuaauaacggagaauaaaauuuggggaagaaaaaguuggccuuugaacgaagggauaauggcaaucggaauagucuccauacuauuaagcaguuuguugaaaaaugauguuccuuuagcuggaccucuaauagccggcgguauguuaauagcguguuaugugauaaguggauccucagccgaucugucucuagagaaagcugcagaggucaguugggaacaggaagcagaacacucgggagcaucgcauaacauacugguugaaguacaagaugauggaacaaugaaaauaaaagacgaggaaagagaugacacgcuaacaauauuacucaaagcuacacucuuagccguaagugguguguaccccauguccauucccgcgacacucuuuguuugguacuuuuggcagaagaagaaacaacgauccggcguguugugggauacuccaagcccuccagaaguugaaagggcgguguuggaugacggaauauaucggauuuuacaaaggggccucuuaggacgaucacaaguaggagugggaguauuccaggauggcguauuccacacgauguggcacguuaccagaggggcuguuuuaauguaucaaggaaagagguuggaaccgaguugggcuucuguuaagaaagaucuaauaucuuauggaggugguuggcguuuucaagggucauggaauacaggugaagaagugcaggucauugccgucgagcccgguaaaaaucccaaaaacguccagacaacuccaggcacauuuaaaacaccugaaggugaaguaggagcgaucgcgcucgauuucaagccuggcacgucuggaucgcccauuguaaauagagaagguaaaauaguaggguuguacggaaauggaguaguaacaacuagcggaacauauguaucugcaauagcacaagccaaagcaagucaagaaggaccacuaccugaaauagaagacgaaguuuucaagaagagaaaccugacaauuauggauuuacaucccgggucugguaagacacgccgguacuugccggcgauaguccgagaagcaauuaaaaggaaacuaagaacacuaauauuagcuccuacgagagucguagcuucagaaauggcagaagcacugaagggaaugccaauaagauaucagacaacggcgguuaaaagcgaaacuacaggacgagagaucguggaccucaugugccaugcgacauuuacgaugcgucuccuaucgcccguuaggguaccgaauuauaauaugaucauuauggacgaagcccauuuuaccgaucccgccagcaucgccgcuagaggauacauaucaacacgcguuggaaugggagaagcagcagccauauuuaugaccgcuacuccuccaggcaguguagaagccuuuccucaaucuaaugcagugauacaggaugaagaaagagauauaccagagagaagcuggaacucuggauacgauuggauaacagauuuuccugggaaaacuguuugguucguaccuucaauuaaaucuggaaaugacauagccaauugccuccgcaaaaacgguaaaagaguaauacagcuaucacgaaaaacauuugacacagaauaucagaaaacuaaaaauaacgauugggacuauguaguuacaacagacaucucagaaaugggugccaacuuccgagcagacagaguaauugacccacgaagaugucuuaagccgguuauacuaaaagauggucccgagagaguaauccucgcaggcccuaugccaguuaccgucgcauccgccgcgcaaagaagaggaagaauaggucgcaaccaaaacaaagaaggugaccaauacguauauaugggucaaccauugaauaaugaugaggaucaugcacauuggacagaagccaaaaugcuauuagauaauauaaauacgccggagggaauuaucccagcccuuuucgagccggagagagaaaaaucggcagccaucgauggggaauauagauugagaggagaagccagaaaaacuuuuguagaacuuaugagaaggggugaccuucccgucugguuaucauauaaaguagcaucggaaggauuccaauauagcgauaggagaugguguuucgacggugaaagaaacaaccaagucuuagaagaaaauauggacguugaaauauggacgaaggaaggggaacggaaaaagcuaaggccacgauggcuagacgcaaggacauauucggauccguuagcccuacgcgaauuuaaagaauuugcagcuggucggcgcuccguaucgggugaucuaauauuggaaauuggaaaguugccacaacaccuaacauuaagagcgcagaaugcguuagauaacuuagugauguuacauaauagcgaacagggcgggaaagcauauagacacgcgauggaggaacucccagauacgaucgaaacccuuauguuauuagcacucauagcaguucuaacuggaggcgucacucuauucuuccuuucaggaaaaggcuuggggaagacaucuauaggauuauuaugcguuacugcaaguucagcguuauuauggauggcuaguguagaaccacauuggaucgcugcaaguauaauauuggaguuuuuccucaugguucuuuuaauuccagaaccagaucgacagagaacuccccaagacaaucaauuagcauauguaguuauuggucucuuauuuaugauucugacuguagcagcaaaugaaaugggucuauuagaaacaacgaagaaagaucugggaauaggauaugucgcggcggagaaucaucaacaugcaaccauguuagauguagauuuaagaccggcaucggcauggaccuuauaugcaguggcuaccacaguaaucacgccgaugaugagacauaccauagaaaauacaacugcaaacauaagucuaacugcuauagcgaaucaagcugcuauacuaaugggacuagacaaaggauggcccauauccaaaauggauauaggaguaccauuacuagcacuuggcugcuauucacaaguaaacccuuuaacguuaacugcggccguacugaugcuaguugcacacuaugccauaaucgguccuggacuucaagccaaagccacacgggaggcacaaaaacguaccgccgcaggaauaaugaaaaacccaaccguugacggaauaguagcuauagauuuagauccagugguuuaugaugccaaauucgagaaacaauugggucaaauuaugcuccugauccuauguacuagccaaauauuacuuaugagaacuacgugggcauuaugugagucaauaacauuagcgacaggaccauuaaccacucuaugggaggguagcccagguaaauucuggaacacuacaauugcgguguccauggcgaacauuuucagaggaaguuaucuugcaggagcaggccuagcguuuuccuugaugaagucacuaggaggaggaaggagagggacgggcgcacaaggagaaacacugggagagaaauggaaacgucagcuuaaccagcuuuccaagagugaauuuaauacuuacaaaagaagcgguauaauggaaguggaucgaucagaagcuaaggaaggucucaaaagaggcgaaaccaccaaacacgcggucucuagaggcacagcaaaacucagaugguucguagaaagaaaccugguaaagcccgagggaaaggugauagacuugggauguggaagaggaggguggucauauuauugcgcaggacuuaaaaauuucacagaaguuaaaggguauacuucagguggaccuggacacgaagaaccuauaccaauggcaacguacggauggaaccucguuaaacuacauuccgggaaggaugucuucuuuaugccuccugaaaaaugugacacuuuauuaugugacaucggagaaucaucuccgaauccaacaauagaagagggcaggacauuacggguccugaaaauggucgaaccguggcugaaagguaaucaguuuuguauaaagauauuaaaccccuauaugccaucaguuguagaaacauuggaacagaugcaaaggaaacauggaggaaugcucguucgaaauccacuuucaagaaacucaacucaugagauguauuggguaagcugugguacaggaaauauuguaagcgcagugaacaugacgucuaggaugcuauuaaaucgauuuaccauggcccacagaaaacccacauacgaacgugauguugaucucggugcuggaacaaggcauguagcaguggaaccggaaguagcaaacuuagauauaauaggacaacgcauagaaaauaucaaaaacgaacauaaaagcaccuggcacuacgaugaagauaaccccuacaaaacuugggcguaccaugguagcuacgagguuaagcccucaggcagugccucaaguauggucaauggugugguuaggcucuuaacaaaaccgugggauguaaucccuaugguuacucagauagccaugacugacacuaccccguucggacagcaaagaguauucaaggagaaaguggacacuagaacaccacgugcgaaaagagguacuacacaaaucauggaaguaacggcuaaaugguuauggggguucuuaagucggaacaagaaaccacggaucuguacgagggaggaguucacacgaaaaguaagaucuaaugcugcgaucggggcuguauuuguugacgaaaaccaauggaacucagcgaaggaagcaguugaagacgagagauucugggaucucguucauagagaacgagaguuacacaagcaggggaagugcgcaacuuguguauacaacaugauggggaagcgugaaaagaagcucggggaguucggaaaagcuaaaggauccagagcaaucugguauaugugguuaggcgcuagauuuuuggaguucgaagcccucggcuucaugaacgaggaccacugguucucaagagaaaauagucuaaguggagucgaaggugagggacuccauaaacuuggauauaucuuaagagacaucagcaaaauuccagguggcaacauguaugccgacgacacggcagguugggacacucgaauaaccgaagaugaucugcaaaaugaagcgaaaaucaccgauauaauggaaccagagcaugcauuacuggcuacaagcauuuuuaaguuaacguaccaaaauaaagucguaagaguacaacggcccgcgaaaaacggaaccguaauggacguuauaagucgcagagaccaacgugguagcggacaaguggguacuuauggacugaauaccuuuacuaauauggagguacaguuaauaagacagauggagucugaaggaauuuucuuacccucagagcuagaaacucccaacuuagcagaaagaguacuugauugguuagagaaacacggggcagaaagauugaaaagaauggcaauaucuggagaugauugcguaguaaagccgauugaugauagauuugccacagcauugacagcguuaaacgauaugggaaaaguuagaaaagacauaccacaaugggaaccaaguaaagguuggaacgauuggcaacaaguaccauucugcucucaccauuuucaucaguuaauaaugaaagauggccgagaaauagucgucccuuguagaaaucaggaugaauuaguugguagggcgcguguaagccaaggagcugguuggucucuacgagaaacggcauguuuagggaaaaguuaugcgcaaauguggcaauuaauguacuuucaucguagggaccucagguuggcugcuaaugcaauuugcucagccguuccaguagacuggguaccaaccucaagaacaacauggucaauacacgcucaccaucaauggaugacaacugaggauaugcugucgguauggaaucguguuuggauagaagaaaauccguggauggaagacaaaacucauguuagcaguugggaagaaguaccuuauuuggguaagcgagaagaccaaugguguggcucauuaauaggacucacagcucgagcuaccugggcaacaaacauccaaguggccaucaaucaaguacgaagguuaaucggaaacgaaaacuauuuagauuauaugacaucuaugaaaagauucaagaacgaauccgauccugagggugccuuaugguaa

SEQ ID NO: 21434 - RNA, 9879 nt, Artificial Sequence
  derived and/or modified CDS sequence (opt6) from DENV-1__GQ199877__SS-prME
uccguuacgaugcuacuaaugcuauuacccacggcguuggcuuuucaccuaacuacgcgaggaggagaaccacacaugauuguuucuaaacaagaaagagguaaaucgcuacucuuuaagacauccgcggguguuaacauguguacacuaauagcaauggaccuaggggaacuaugugaagacacuaugacauauaaauguccacggauaacggaagcagaaccagacgauguagauugcuggugcaacgccacggauacuugggugacuuacggcacuugcucucaaacaggggaacauagaagagaaaaacgaagcguggcauuagcuccacaugucggccuuggguuagaaacuagaacagaaacauggaugucaagugagggggccuggaagcaaauacaacgaguagaaacaugggcuuugcggcacccagguuucacagucaucgcauucuuucuugcccaugcaaucgguacaucuauaacucaaaaaggaauaauauucauacuguuaaugcucgucacaccaaguauggcuaugcgguguguaggaauugguaaccgagauuuuguagaggggcuuucaggcgcaacauggguagaugugguauuagaacaugguagcugugucacaacuauggcuaagaauaaaccuacgcuggacauagaauuacuuaaaacagaagucacuaacccagccguuuuacgaaaauugugcauagaggcuaaaauuucaaacacuaccacugacucacgguguccaacacaaggagaagcaaccuuagucgaagaacaagacgccaauuucgucugucgccgaacguuuguagauagaggaugggggaacggaugugggcuauuugguaaaggaagccuguuaacaugugcaaaauucaagugcguuacaaaauuagaaggaaaaauugugcaauacgaaaauuugaaguauucuguuauugugacaguacauacaggagaccaacaucaagucgguaaugaaacaacugaacaugguaccauagcaacuauaaccccacaagcaccaacaucagaaauacaacuaaccgauuacggagcacuuacacuugacugcuccccucggacaggauuagacuuuaacgaaaugguuuuauuaacaaugaaggagaaaaguuggcuuguacauaaacaaugguuccuagauuugccucucccguggacaagcggagcaucaacgagucaagagacuuggaauagacaggaucuuuugguaacauuuaaaaccgcgcaugcgaagaagcaagaaguaguaguucuagguucacaagaaggagccaugcauacugcucuaacaggagcaacugaaauccaaacaucagggacaacaacaauauuugccgggcauuuaaaauguagacuuaagauggauaaacucacguuaaagggaaugagcuaugucaugugcacugguucauuuaaauuagaaaaggaaguugcggaaacucaacauggaacaguacucguucagguaaaauaugagggcacugaugcaccauguaaaauaccuuucucaacgcaagacgaaaaaggaguuacacaaaauggaagauuaauuacugcaaacccuauaguuacagauaaggagaaaccagugaacauagaaaccgagccucccuuuggugaaaguuacauagucgucggagcgggcgaaaaagcgcuuaagcuaaguugguuuaagagagguuccagcauuggaaaaauguucgaagcaaccgcucgcggagcgcggcguauggcgauauugggugacacugcuugggauuucggcucaauaggaggcguauuuacuucgguaggaaaacugguccaucaaguguuuggaacugcuuacggaguauuauuuucaggugucucuuggaccaugaagauugguaucggcauucuacuaaccugguuagggcuaaacagccgaucuaccucuuugaguaugacguguaucgcaguaggaauggugacauuguauuuaggaguaaugguucaagcggacucaggcugcguaauaaauuggaaggguagggaacuaaagugcggaaguggaauauucgucacuaacgaaguacacacauggacagagcaauauaaauuccaagcagauucacccaaaagauuaucugcagcaaucggaaaggccugggaagaaggggucuguggaauaaggagugcaacaaggcuagagaauauuauguggaagcaaauaucaaaugaauuaaaccauauauuacuagaaaacgacaugaaguucacggugguaguaggugaugcuaacggcauucucgcacagggcaaaaagaugauacguccccagccaauggaacauaaauacucguggaagucguggggaaaagcaaaaauuaucggagcggacauucaaaacacuacauuuaucauagauggaccggauacccccgaauguccugacggacaacgagcguggaacauaugggaggucgaggauuacgguuucggcguguuuaccacgaacauuugguuaaaacucagagacucauauacacaaaugugcgaucacagguuaaugagcgccgccauaaaggacaguaaagcaguacacgcagauaugggauauuggauugaauccgaaaagaaugaaaccuggaaacucgccagggcaaguuucaucgaaguaaagacaugcacauggccaaaaucacacacauugugguccaacgguguauuagaguccgaaaugauuauaccaaagaucuacggcgggccaauaagucaacauaauuauagaccagguuauuucacacaaacagcagguccuuggcaccuagggaaacuggaacuagauuuugaucuuugugaggguacuacggucguugucgacgaacacuguggaaaucgggggccaucucucaggacgacgaccgugacagguaaaauaauacaugaguggugcuguagaaguuguacacuuccgccgcuacgguuccguggagaggaugguuguugguacgguauggaaauaagacccgugaaggaaaaagaggaaaacuuaguuaggaguaugguaagcgcagguucuggugaagucgacucuuucucauuaggcauccucugcgugucaaucaugauagaagaggucaugagaucgcgauggagccggaaaaugcuuaugacaggaacacucgcagucuuucuccuauuaaucaugggacaauugacguggaaugaccuuauacggcuaugcauuaugguaggagcuaaugcaagugacagaaugggcauggguaccacuuaucuugcucuaauggcaacauucaaaaugcgaccuauguuugcaguggggcuguuguuucgcagacucacgagucgugaaguacugcuguuaacaauaggguugaguuuggucgccagcguagaauuaccgucgucucuagaagaguugggcgaugggcuggcaaugggcauuaugaugcuuaaacuacucaccgaauuucaaccccaucaacuuuggacgacguuacuaucgcugacguuuguuaaaacgacucugucacuugauuacgcauggaaaacaacugcuaugguacuaucaauaguuucauuauuuccucugugucuaucaacaaccucucagaaaacuaccugguuaccagugcugcucgggagcuuuggauguaagccuuuaacuauguuuuuaauaacagaaaacaaaauaugggggagaaaaucauggccacucaaugaaggaauaauggcuauagggauuguaaguauacucuugaguaguuugcucaagaaugaugucccgcuggcgggaccacucaucgccggugguauguuaauugcauguuaugucauuaguggaagcagugcggaccucaguuuagaaaaagcagcggaaguuagcugggagcaagaggccgaacauucaggagcaagucacaauauacuugucgaaguucaagaugacggaacaaugaaaauuaaagaugaagaacgagaugauacacuuacuauuuuauugaaggccacguuacuggcuguauccggcgucuauccaaugaguauuccggccacacucuucgucugguacuuuuggcagaagaagaaacaaagguccgggguauugugggauacuccuaguccuccagaaguagaaagggcaguacuagacgacgggauuuaccguauauugcagagaggccuacuaggucguucucaaguaggaguaggaguauuucaagacggaguauuucauacgauguggcaugucacacgaggugcgguauugauguaccaagguaaacgacuagaacccucuugggcauccguaaagaaagacuugauaucauacgggggaggcuggagguuucagggcucauggaauacgggugaagaaguacaaguaauagcugucgaaccgggcaaaaacccgaaaaacguucaaacgacacccggaacauucaagacaccagaaggcgaagugggcgcaauagcccuagauuucaagccgggcaccucuggcucaccgauagugaauagagaaggcaagauaguuggauuauacggaaacggaguugugacaacaucagguacauaugugagugcuauugcacaagcuaaagcgagccaagaaggaccguuaccugaaauagaggaugaaguauucaaaaagcgcaaccuaacaaucauggaccuacauccagggucgggaaaaacgcgucgcuaucuuccagcgauaguaagagaagcaaucaaacgcaaauuacggacguuaaucuuagcaccaacuagaguaguugccucagagauggcggaagcucuaaaaggaaugccuaucagauaucagacaacagcaguaaaaagugagcauacgggacgagaaauaguggauuuaaugugccaugcuacauucacgaugcgacuauuauccccagucagaguaccgaacuauaauaugauuauuauggaugaggcucacuucacagauccagcaucuauagcggcuagaggcuauaucaguacaaggguagguaugggugaagcggcugcaauauucaugacugcuaccccaccaggaaguguagaagccuucccucaaucgaaugcaguaauacaggacgaagaacgcgacauaccugagagaaguuggaacucuggauaugacuggaucacagauuucccuggaaaaaccguaugguucgugccuaguaucaaaucgggaaaugacauagcaaauugucuaaggaaaaauggcaaaagagucauacaauuaagccguaaaacguucgauacagaauaccaaaagaccaaaaauaacgacugggauuaugucgugacuacagauauauccgaaaugggggcaaauuuucgcgcagacagaguuauugauccccggcgauguuugaaaccuguaauacuaaaagacgggccagaaagagucauacuugccggaccgaugcccgucacaguggcaagugcggcacaacguagaggaagaaucggacggaaccaaaauaaggaaggcgaucaauauguauauaugggacagccccuaaacaaugaugaggaucaugcucacuggacugaggcuaaaaugcugcuggacaauaucaauacuccugaagguauaauacccgcacucuucgaaccagaaagagagaaaagcgccgcuauagauggugaauauagguuaagaggagaggcgcgaaaaacguucguugaauuaaugaggaggggugaucuaccggucugguuaucauauaagguugcaagugaaggauuucaauacucagauagacguuggugcuucgauggagaacggaauaaccaaguauuggaggaaaauauggacguagaaaucuggaccaaggaaggagaaaggaagaaauuaaggccuagauggcuagacgcccggacuuauucugacccuuuagcccuucgugaguucaaggaauuugcagcgggacgaagaagcgucucuggagauuugauauuagaaauagggaaacuuccucaacacuuaacguuaagagcgcaaaacgcucuggauaaccuuguaaugcugcacaauucagaacagggagggaaagcauaucggcacgcuauggaagaguugccagauacaauagaaacauuaaugcuuuuagcuuugauugccguuuugaccgggggcguaacacuauucuucuugucaggcaaaggucucgguaagacaucuauaggguuauuaugcguuacggcgucuucagcacuuuuguggauggcaucgguagaaccucauuggauugcagcauccauaauacuagaguucuuucugaugguacuucuaauaccugaacccgaucgacaacgaacaccacaggacaaucaacuugcauauguagugauagggcuucucuuuaugauacucaccguagcagcaaacgaaauggguuuguuagaaacaacuaagaaggaucuaggaauaggcuauguagcagccgagaaucaucaacacgcuacgauguuagaugucgaccugcacccugcaucagcauggacacuuuacgcggucgcaacaacugucauaacaccuaugaugcgucauaccauugaaaauacaacugcaaauauuaguuuaaccgcaaucgcaaaucaagcugcgauacugauggguuuggacaaaggguggccgauaucaaagauggacauuggaguaccguuacucgcacuuggauguuacucacaaguuaacccauuaacauuaaccgcggcgguucuaaugcuuguagcacauuaugcaauaaucgguccuggucuacaagccaaggcuacacgagaagcucagaaaagaacagcagccggaaucaugaaaaacccaacugucgaugguauugucgcuaucgacuuagaccccgucgucuaugaugcgaaauuugaaaaacaacuaggccaaauaauguuacuuaucuugugcacaucgcagauauuguuaaugagaacaacgugggcgcuaugugaaucuauaacuuuggccacuggcccauugacaacguugugggaaggaaguccuggcaaguuuuggaauacuacgauugcaguuagcauggcgaacauauuuagaggaucauauuuggcgggcgcaggauuagcauuuagucuuaugaaaaguuuaggaggaggaagaagaggaacaggcgcgcaaggcgagacgcuuggggaaaaauggaaaagacagcucaaccaauuaucuaaaagugaguucaacacuuauaagaaaucagguauaauggagguagacaggucugaagcuaaagaaggacugaaacgaggcgaaacaacaaaacaugcagugucaagagguacagcaaagcuaagaugguuuguagaaaggaaucuagucaagccagaagggaagguaauagaucuaggauguggcagaggaggauggucauauuacugugcugggcuaaagaaagugacagaagucaaagguuacacaaaaggcggaccgggucacgaagaacccauaccuauggcaacauauggguggaaucuugucaagcuacacucaggaaaagacguauuuuucaugccuccagaaaaaugugacacacuacuaugugauauaggagaguccuccccgaauccaacgauagaggaagggcguacuuuacgcguucuaaaaaugguugaaccgugguuacgcgguaaccaauucugcauuaagauauuaaacccuuauaugccaucaguaguagagacauuggaacagaugcagaggaaacaugggggcaugcucgugcgaaaucccuuaucaaggaauaguacgcaugaaauguauuggguaucaugcggaacaggaaacauaguaagugcaguaaauaugacaagcagaauguuacuaaacagauucacuauggcacauagaaaaccaacguacgagagagauguagacuugggagccggaacgaggcacguggcaguggagccugaagucgccaaucuagacauuauuggacaaaggaucgagaauauaaagaaugagcauaaaucaacuuggcacuaugaugaagauaauccuuacaagacaugggcauaucacggcucguaugaggugaaacccucaggcagugcaucauccaugguaaaugggguugugcgacuucuuacaaaaccaugggauguaauuccuaugguuacacaaauagcgaugacugauacaacaccauucggacagcaaagaguuuuuaaagaaaagguugauacacguacuccaagagcaaaaagagggacaacacaaauaauggaagugacagcaaaguggcuuuggggauuccuuuccagaaacaagaaaccuaggauuugcacgcgagaagaguuuacuagaaaaguacguaguaaugccgcuaucggggcuguuuucguagaugagaaccaguggaacagugcaaaagaggcaguugaagaugagcgcuucugggaccucguacauagggaaagagaacuccauaaacaaggcaagugcgcuacuugcgucuauaauaugauggggaagcgugagaagaaauuaggugaauuugggaaagcaaaagggucgcgagcaauaugguauauguggcucggagccagauuuuuagaauuugaggcauuagguuucaugaaugaggaucacugguuuagucgugaaaauucauuauccggcgucgagggggaaggacuacacaaacuuggauacauauuaagagauauaucgaaaaucccuggaggaaauauguaugcagaugauacugcgggaugggacacacggauaaccgaagaugaccuucagaacgaagcuaaaauaacagauauaauggagccugaacaugcauugcuagcuacaucaauuuucaaauuaacguaucaaaauaagguugucagagugcaacgcccugcuaaaaacgggacagucauggauguuauuaguagaagagaccaacguggaucaggccaaguaggaacuuauggacucaauaccuucacuaauauggagguacaacuaauaagacaaauggaaucagaagggaucuucuuaccuagugagcuugaaaccccgaaccuagcggaaagggcccucgauuggcuagaaaaacauggcgcagaacgacuaaaacguauggcaauauccggagaugauugugucguaaaaccaaucgaugauagauuugccaccgcccuaacugcccuuaacgauaugggcaaaguccgcaaagauauaccacaaugggagccuucaaaaggauggaacgauuggcaacagguaccuuuuuguucucaccauuuccaucaacucauaaugaaagacggaagggaaaucguaguaccaugccguaaccaagacgaacugguuggcagagcacgugugucacaaggugcaggauggagucuacgggaaacagcuuguuuagggaagucguaugcucagauguggcaacucauguauuuucaucgacgggauuuacgucuggcugccaaugcaauuuguucugccguuccaguugauuggguaccgacauccagaacaacuuggucuauccacgcacaccaccaguggaugacuacagaagacauguugagcguauggaaucgaguuuggauugaagaaaacccauggauggaagauaaaacacacguaaguaguugggaggaaguaccuuacuuaggaaaacgagaagaucaguggugcgguucucuaaucggccuaacggcuagagcaaccugggcgacaaauauacaaguugcuauaaaucaaguacggcgacugaucgguaacgaaaauuacuuagacuacaugacaaguaugaaaagauucaagaacgagagugacccggaaggagcauuaugguga

SEQ ID NO: 21435 - RNA, 9879 nt, Artificial Sequence
  derived and/or modified CDS sequence (opt6) from DENV-1__GU056029__SS-prME
ucaguuacuauguuguuaauguuacuaccaaccgcacucgcuuuucacuuaacuacucgaggaggagaaccgcacaugauaguuucuaaacaagaaagagguaaaucucuccuguuuaaaacaagugcagggguaaauauguguacauuaauugcgauggaucuaggagaacugugcgaagauaccaugacauacaaaugcccaagaauuaccgaagcggagccugaugacguagacugcugguguaaugcaacagacacauggguuacuuacggcaccuguucccaaacuggagaacauaggagggagaaaaggagcguggcuuuagcgccacacguagguuugggccucgaaacaaggacagaaacauggaugucuagugaaggugcauggaaacaaauacaaagaguugaaaccugggcacuaagacauccaggcuucacuguaauugcauucuuuuuagcccaugcaauuggaacuagcauaacucaaaaagggauuauauuuauacuacuaauguuaguaacaccgaguauggcgaugagaugcguaggaauagguaacagagacuuuguggaggggcuaagcggagcgacaugggucgacguggugcuagaacacgguuccugugucacaacgauggccaaaaauaaaccgacacuagacauagaauugcuuaaaacagaagucaccaauccagcggucuuacggaaauuguguauagaagccaaaauaucaaauacaaccacagauucgcgaugcccuacacaaggagaagcaaccuugguagaagaacaagacgcuaauuuuguuugucguagaacguuuguagauagaggauggggaaacggauguggcuuauuugggaaagggucucuauuaacuugcgccaaauuuaaaugugugacaaaacuugaagguaaaauaguacaauacgagaacuugaaauauagcgucauagucacaguacacaccggggaucagcaccaaguuggaaaugaaacuacugaacacggcacgauagccacgaucacuccccaggcuccgacaagugaaauacaauuaacagauuauggagcauuaacucuugauugcucaccaaggacaggguuagauuucaacgagaugguccuuuuaacaaugaaagaaaaaucguggcuaguacauaaacagugguuucucgauuugccguuaccguggacaucaggagccucgacaucacaagaaacauggaaccgucaggaucugcuuguaacauucaaaaccgcacaugccaagaaacaggaaguuguugucuuggguucccaagagggagccaugcauacugcucuuacuggagcuacagagauucagacgucaggcacaaccacaauuuuugcaggacaccuaaagugcagguuaaaaauggauaaacuuaccuuaaaaggcaugaguuacguuauguguacaggauccuuuaaacuagaaaaagagguggcagaaacgcaacauggaacaguccuaguucaaguaaaguaugagggaaccgaugcaccauguaaaauuccauuuuccacacaggacgaaaaagggguuacgcaaaacgguagacuaauaacugccaauccgauaguaacugacaaagaaaaaccuguaaauauagaaacagaaccaccuuuuggggagucguauauuguuguaggcgccggagaaaaagcguuaaaauugucuugguuuaaaagagguucguccauaggaaaaauguuugaagcuacggcgaggggagcgcgaaggauggcuauucuaggagacaccgcuugggauuuugguagcauaggagguguguuuacaaguguuggaaaauugguucaucaagucuucgguacagcguacgguguauuguucucugguguaucauggacaaugaaaauagggaucgggauucuauugacauggcuuggauuaaauagucguaguaccuccuuaucaaugacauguaucgcaguagguaugguaacccuuuaccuggggguuaugguucaagccgauagcggcugugucauuaacuggaaagguagagaguuaaagugugggucuggaauauuuguuacaaaugaggugcauacguggacugaacaauauaaguuucaggcagacagcccgaaacgcuuaucugcugcaauagggaaagcaugggaggaagguguguguggcauaagauccgcgacacgauuggagaacauaauguggaaacaaauaucuaaugaguuaaaucacauuuuauuggagaaugauaugaaauucacaguaguaguuggagaugcaaaugggaucuuaguacaagggaagaaaaugauccggccacaaccgauggagcacaaauauucuuggaaaucgugggguaaagcuaaaauaauaggugcagauauccagaacacgaccuuuauuauagauggaccugauacuccagaaugccccgauggucaaagagcauggaauauaugggaggucgaagauuacggcuucggaguguucacaacaaauauauggcucaagcuaagggacucguauacgcaaaugugcgaucaucgucuuaugagcgcugcgaucaaagauuccaaagcagugcaugcagacauggguuacuggauagaaucagagaaaaaugagacauggaaguuggcgcgagcaucauuuauugaaguaaaaacuuguacuuggccgaaaagucacacucuuuggucuaauggaguuuuagaauccgagaugauaaucccuaaaauuuaugggggaccuauaagccaacauaauuauagaccuggcuacuucacgcagacugcagggccauggcauuuaggcaaacuagaauuagacuucgaucucugcgagggaacuacuguaguuguugaugaacacugcggaaauagagggccuucucuuagaacuacaacggugacugguaaaaucauacaugaaugguguuguagaaguugcacucuacccccguugcgguucaggggcgaagacggauguugguacggaauggaaauucguccagucaaggagaaagaagaaaaccuugugcggucgaugguaagugcuggcucgggcgaaguagauucauucaguuugggcauucuguguguaucgauaaugaucgaagaaguaaugagaucacgguggucgcguaaaaugcucaugacggguacucuagcaguguuccuauuauuaauaaugggccaacuuacauggaacgaucucaucagauuauguauaaugguaggagccaacgcgagugaucggauggguaugggaacaacguacuuggcgcuaauggcgaccuucaaaaugaggcccauguuugcaguaggacuacuauuccgaagacuaacgucaagagaaguauugcuauuaaccauuggacuaucauuaguggccaguguagagcuucccaauucacucgaagaauuaggcgacggguuggccauggguauuaugauguuaaaacuacuuacagaauuucagccacaucaauuguggacaacccuauuaagucuaacuuucguaaaaacagcccuuucguuagauuaugcauggaagacaaccgcuaugguuuuaucgauagucagcuuauucccauugugcuuaagcacaacgucucagaaaacaaccugguuaccaguacuuuuggguucauuuggcugcaaaccauuaacaauguuuuuaaucacagagaauaagauauggggcagaaaaucguggccucuaaacgaagggaucauggccauaggcaucguguccauuuuacucagcagucuauugaaaaaugacgucccauuggcaggcccccucauagcgggcggaaugcuaauugccugcuacguuaucagcggcaguagcgcagacuugagcuuagaaaaagcggcggaaguaaguugggagcaagaagcugaacacagcggugcaucacauaacauauuaguugaagugcaagaugacggaacaaugaagauaaaggaugaagaaagagaugauacccuuaccauauuauugaaagcuacguuacucgcaguaucaggugucuaucccaugaguauaccagccacuuuguucguaugguacuucuggcagaagaagaaacaacgcagugguguacuuugggauacaccaucaccaccagaaguugaaagggcaguauuagauaacgguauuuacaggauauuacagcgagguuuacuaggcaggagucaagugggcguuggcguauuucaggauggaguuuuucauacuauguggcauguaacgagaggcgcuguucuuauguaucagggcaagcgucuggaacccucgugggcuucagucaagaaagauuuaauuucuuauggaggcggguggagauuccagggcagcuggaauacaggugaagaaguucagguaauagcaguugagccaggcaaaaauccuaaaaauguucaaacaaccccagguacauuuaaaacaccugaaggagaaguaggggccauagcuuuagauuuuaaaccugguacuucaggaaguccuauaguaaaucgagaaggaaaaauuguaggauuauacggcaauggugucguaacaacgucggguacuuacgugucggccauagcacaagcuaaggcuucccaagagggcccguuaccugaaauugaggacgagguguucaaaaagcggaacuuaaccauaauggacuuacauccagguagcggaaagacgagaagguaucuaccggccauuguccgugaagcgauuaagagaaaauuaagaacguuaauuuuggcgccgacaagaguaguagcuucagagauggcugaagcacugaaggguaugccaauaagguaucaaaccacggcuguaaaaagcgaacauaccgguagggagauaguagaucuuaugugucaugcuacauuuacuaugcgacuucuaucaccuguucgcguaccaaacuauaacaugauaaucauggacgaggcacauuuuaccgacccggcgaguauugcggcgcgcggauacauuaguacaagaguagggaugggugaagccgcagcuauauuuaugacagccacgccgccugguagcguagaagcauucccucagucuaaugccguaauccaggaugaagaacgugauauacccgaaagaaguuggaauagcggguacgacuggauaaccgauuucccugggaagacaguuugguucguuccaucaauaaaaagcggaaaugauauugcuaacuguuugaggaaaaacgguaaaagaguuauacaauuaagcagaaaaacguuugauacugaauaucagaaaacgaagaauaacgacugggauuauguaguuacgacggacaucagugaaaugggugcaaauuuccgagccgauagagucaucgauccuagaagguguuugaaacccgucauacuuaaagacgguccugaacgaguuauacucgcaggucccaugcccguaacgguggcuucagcugcacaaagacgugggagaauagggagaaaccagaauaaagaaggagaucaauauguuuauaugggucagccacuuaauaacgaugaagaucacgcccauuggacagaagcgaaaauguugcuagauaacauaaacacucccgagggaauuauaccagcauuauucgaaccugaacgagagaaaucagcagcgaucgacggcgaauaucgccugaggggugaagcaagaaaaacuuucguugaacuuaugagacggggugaccuuccaguauggcucucguacaaaguggccagcgaaggauuccaauauagcgacaggagaugguguuuugacggagaaagaaauaaucaaguacucgaagagaauauggacguugagaucuggacuaaagaaggugaacgcaaaaaguuacguccgagauggcucgacgcucguacauacagugacccauuggcccuacgagaauuuaaagaguuugcugcaggucgacguucuguaucaggugacuuaauacuugagauaggaaaauuaccccaacaucuuacacuacgagcucaaaacgccuuagauaaucuaguaauguugcacaacagcgaacagggagguaaagcguauaggcaugcaauggaagaauugccggauacaauagagacccucauguuauuagcucuaaucgcugugcucacaggcggaguuacacuauucuuucucuccgguaaggguuuaggaaagacaucaauaggacuacucugcguuacugcuaguucggcucucuuauggauggcaucggucgaaccucacuggauugcggccucuauaauccuagaguucuuuuuaaugguacuccuaauacccgaacccgaccgucaacgaacaccccaagauaaccaauuagcuuauguaguuaucggccuauuauuuaugauccucacagucgcagcgaacgaaauggggcuauuagaaacaacuaagaaagauuuaggaauaggcuaugucgcagcggaaaaccaccaacacgccaccauguuagacguugauuugcaucccgcgagugcguggacacuuuacgcuguggcaacuaccguaaucacuccgaugaugcgucauacaauagaaaauaccacugcaaauauaucuuuaacugcgaucgcuaaccaagcugcaauauuaauggggcuagauaaaggauggccaaucucgaagauggacauuggaguaccacuguuagcgcuuggaugcuacucgcagguuaauccacucacacuaacagcggcuguacuuaugcucguugcccauuaugcaauaauaggccccggcuuacaggcuaaagcaacccgugaagcacagaagagaacagcggcggggauuaugaaaaacccgacaguugacggcauuguggcuauugacuuggauccugucguauaugacgccaaauuugaaaaacaacuggggcagauaauguuauuaauacuauguacuucacaaauacuccuuaugagaacaacaugggcacuuugcgaaaguaucacucuagccaccgguccacucacaacauuaugggaagggucacccgguaaauuuuggaauaccacuauugcuguaucuauggcgaauauauuccgaggaagcuaccuagcgggugcaggacuggcauucucgcuuaugaaaucccuugggggaggacgucggggaacaggcgcucagggcgaaacgcuaggugaaaaauggaaaagacaacuaaaucaacuaaguaagucugaguucaauacauacaagaggaguggaauaauggaaguagaccgaucagaggccaaagaaggauuaaaacgaggcgaaacaacaaaacaugcgguuucuagaggaacagcaaaguuacggugguuugucgagagaaacuugguuaagccagaagguaaaguuauugauuuagggugcggacgcggaggcuggucuuacuacugugcgggacuuaagaaaguaacugaaguaaaagguuacacaaaaggcgggccgggccaugaagaaccaauaccaauggcgacguacggcuggaacuugguaaaauuacauagcggaaaagacguauucuuuaugccuccggaaaaaugcgacacgcuacuuugugauauaggcgagaguaguccuaauccaaccauagaagagggucggacuuuacgaguacuuaaaaugguagaaccaugguuacguggaaaccaauucuguauuaaaauacucaaucccuauaugcccagcgugguugaaacguuagaacagaugcaacguaaacacggaggaauguuaguacggaauccguugaguagaaacucaacucaugagauguacuggguuagcugugguacaggaaacauuguuagugcaguaaauaugacaucucgaauguuauuaaauagauuuacuauggcacacagaaaacccacauaugaaagggacgucgauuuaggggcaggaacgcgacauguggcaguugaaccagagguagcaaauuuagacaucauuggccagcggauagagaauauaaagaaugaacauaaaucgacauggcauuaugaugaagacaacccuuacaaaaccugggcguaccaugguagcuacgaagugaaaccaucaggaagugcaaguucuauggugaaugguguaguaagauuguuaaccaaaccaugggaugugauaccuauggugacacaaauagcaaugacagauaccacgccguucggacaacagcgaguuuuuaaagaaaaagucgauaccagaacacccagggcgaagcgagguacuacgcaaauaauggaagugaccgcuaaaugguuauggggauuucugaguagaaacaagaaaccgcgcauauguacccgggaagaguucacucguaaagugagaucaaaugcggccauuggagcaguauucguagacgaaaaucaguggaacucagcgaaagaagcaguggaagacgaaagguucugggauuuaguacaucgagaacgggaacuacauaaacaaggcaaaugcgcaacaugcguguauaauaugaugggaaaaagggagaagaaacugggagaauuugguaaagcuaaagguucaagggccauuugguacaugugguugggcgcucgauuucuagaauuugaagcguugggauuuaugaaugaagaccacugguuuucacgugaaaacucauugagcgguguagagggugaaggucugcauaaauuaggcuauauuuuacgggacauuagcaaaauaccaggaggcaauauguaugcugacgacaccgcagguugggacacaagaauuacagaagaugaucuccagaacgaagcaaaaauuacugacauaauggaaccggaacacgcuuuacuagcaacaagcauuuuuaaacuaaccuaucaaaacaagguagucagaguacaaagaccagccaaaaauggcacggugauggacgucaucagccgaagagaccaaagaggaucaggacaagucggaacuuacggcuuaaacacauuuacgaacauggagguacaauugauacgacaaauggaaagcgaggguauuuuccuuccgucugaacuggaaacuccaaaccucgcggaacgcgcgcuagacugguuagaaaaacauggagcagaaagauuaaaaagaauggcaauaaguggugacgauugcgucguaaaaccuauagaugaucguuuugcuacugcucucacugcacuaaaugauaugggcaaaguuagaaaagauauaccacagugggagccauccaaaggguggaaugauuggcaacaaguacccuuuuguagucaucacuuccaccaacugauaaugaaagaugggcgugaaaucgugguccccugucgaaaucaagaugaauuaguaggucgagcacgugugagucaaggagccggguggaguuuacgugagacugcuuguuuaggaaaaucguacgcccaaauguggcaacuaauguacuuccacagaagggauuuacggcucgcagcgaacgcaauuugcagugcuguaccgguugauuggguuccuaccaguagaaccacauggucuauacaugcucaucaucaauggaugacaacagaagacauguuaagugucuggaaucggguauggauagaagagaauccauggauggaagauaaaacccacguuaguagcugggaagaaguaccauauuuaggcaaacgggaagaucaauggugugguagccuaauuggcuuaacagcaagagcgaccugggcaaccaauauacaaguggccauuaaucaaguacgaagacuuauagguaaugagaauuaucuggauuacaugacaucaaugaaacgauucaaaaacgaaucagauucugaaggagcgcuaugguga

SEQ ID NO: 21436 - RNA, 9879 nt, Artificial Sequence
  derived and/or modified CDS sequence (opt6) from DENV-1__GU056030__SS-prME
ucugucacaaugcuacugaugcuacugccuacagcacuagcguuccaccuaacaacgagagguggggaaccccauaugauagugucaaaacaggaacgagggaaaucacuccuauuuaaaacaucagccggugucaauauguguacauugaucgcuauggacuuaggagaauuaugugaagauaccaugacguauaaaugcccaagaauaacagaagcagaaccagacgauguugacuguugguguaacgcuacugacacguggguaaccuacgguacauguucacaaaccggagaacaccggagagaaaaacguucaguugcauuggcaccgcaugugggacuaggacuugaaaccaggacugaaacguggaugaguagugaaggagcuuggaaacagauacaacgaguugaaacaugggcauuacgacacccaggguuuaccgucaucgcauuuuuccuagcacacgccauagggacgucgauaacacaaaaaggaaucauuuucaucuuacuaauguugguaacuccaucuauggcuaugagaugcguaggaauaggaaaucgagacuuuguagaagggcuauccggagcaacguggguagauguaguccucgaacauggaucaugugucaccacaauggccaaaaauaaaccuacauuagauauugaacuacugaaaaccgaagucaccaauccagccguacuuaggaaacuaugcauugaagcgaaaauaucuaauacgacaacugauagucguuguccaacccaaggagaagcuacgcuuguugaagaacaagacgcaaauuucguaugccgccguacauuuguagaucgcggauggggcaacgguuguggguuauuuggaaaaggcucguuauuaacaugugcuaaauuuaaaugcguuacgaaacucgaaggcaaaauaguucaauacgaaaaucuuaaauauaguguaauaguaacaguacauacaggagaccagcaccaagucggaaacgaaacaacagaacacgguacgauagccaccauuacuccccaggcgccaacaucggaaauucaacuaacagauuauggagcauugacccuagauuguucacccagaacugggcuugauuucaaugaaaugguuuuguugacaaugaaagaaaaaucauggcuagugcacaaacagugguuucuagaccugccucugcccuggacaaguggggccucgacaucacaggaaaccuggaacagacaggaccucuuaguaacauucaaaaccgcgcacgccaagaaacaagaaguaguaguauuaggcucacaagaaggggcgaugcacacagcuuuaacuggggcaacagaaauacagacgucagggacaacaacaauuuucgcaggucacuuaaaauguagauuaaaaauggauaaauugacauuaaagggaaugaguuaugugauguguacuggaucauucaaacucgaaaaggaaguagcugaaacucaacauggaacuguauugguucaagucagauacgaaggaacagaugcaccaugcaaaauaccauuuagcacccaagacgaaaaaggagucacgcaaaauggacgacuuaucacggcaaauccaauaguuacagacaaagaaaagccagucaacauagaaacagaacccccauucggugaaaguuacauuguugucggagccggggaaaaagcacucaaacuuagcugguuuaaaaggggcucuaguauaggaaagauguuugaggccaccgcaaggggcgcacguagaauggccauucugggggauacugcaugggacuucgggaguauagggggagucuucacgucgguggggaagcuaguucaccaagucuucgguacagcuuacggagugcuauucagugggguuaguuggacuaugaagaucgguaucggcauccuacugacaugguuaggauuaaauucaaggucaacuagccuguccaugacgugcaucgccgugggcauggugaccuuauaccuagggguaaugguucaggccgauagcgguugcguuauaaauuggaaggggcgagaacuaaaaugugguucggguauuuucguaacaaaugaaguacauacuuggacugaacaauauaaguuucaagccgauagcccgaagagacuuagugcagcgaucggcaaagcgugggaagaaggugucugcgggauccggucagcaacacggcuggaaaacaucauguggaaacaaauaucaaaugaauuaaaucacauauuauuagaaaaugacaugaaguucacaguaguuguaggugacgcaaacgguauauuagcccaaggcaagaaaaugauacgaccacaaccaauggaacauaaauauucauggaaaaguugggguaaagcgaaaauuaucggugcagacauucaaaauacaacuuuuauaaucgacggcccagauacacccgaauguccugacgggcaacgugcauggaacauaugggaaguggaagauuauggguucgggauuuucacaacaaacauuuggcuaaagcuacgugauaguuauacccagaugugcgaucauagauuaaugucugcagcaauaaaagauaguaaggcuguucaugccgacaugggauacuggauugagucugaaaagaaugagacuuggaaauuagcuagagcgucauuuaucgaagugaaaacguguaccuggcccaaaucacauacuuuauggucuaacggaguauuggaaagugaaaugauaauaccaaaaauauaugguggaccaauuucccagcauaacuacagaccaggauacuauacacaaacugcuggcccguggcaucuuggaaaauuagagcucgauuucgacuuaugcgagggcaccaccguuguuguagaugaacauugcgguaaucguggacccucauuaagaacuacgaccgucaccgggaagauaauacaugaaugguguugcagaucguguaccuuaccuccuuuacguuuccgaggagaagauggcuguugguauggaauggaaaucagaccagugaaggaaaaagaagaaaauuuaguacggucaaugguaucagcuggaaguggugaaguagacaacuuuaguuuaggcauucuuugcguuucaauaaugaucgaagagguuaugcguagucgguggagcagaaagaugcucaugacuggaacccucgcggucuuccuauuauuaaucaugggacaauuaacuuggaacgauuuaauaaggcucuguaucaugguuggcgcgaaugcuucagauggaaugggaauggguaccacuuacuuagcauuaauggccacguucaagaugagaccaauguuugcugucggacuuuuauuucgacgccuuacuagccgagaaguacuauuauuaacaaucggacuaagccuaguagcauccguagaauugccaaauuccuuagaagaacuaggagaugggcucgcaauggguauuaugaugcuuaaacuauuaacggaguuccagccucaucaacuuuggacaacguugcuaucuuugacauuuguaaaaacuacccuaucccuagacuaugcauggaagacgacggcuaugguuuuaucuauuguaucauuauuuccccuuugcuugaguacaacaagucagaaaacaacaugguuaccugugcuacuugguuccuucgguuguaaaccccuuacuauguuccucaucacggaaaauaaaauauggggaagaaagucuuggccacuaaacgaggggauaauggcuauagguaucgugucuauucuacuuucaaguuuauugaaaaaugacgucccuuuagcugggcccuuaauagcaggcgggauguuaauagcaugcuauguaauuagcgguaguucagcggauuuaucuuuggauaaagcagcagagguaaguugggagcaagaagccgaacacaguggugcuucacacaauauaaguguggagguacaagacgacggaaccaugaaaauaaaagaugaggagagggacgacacucuuaccaucuuguuaaaagcaacguuacuagcaguaucuggaguauauccaaugaguauaccagcaacauuguucguaugguauuuuuggcagaagaagaaacaacgaucuggaguccuaugggauaccccgagcccaccugaagucgaacgugcagugcucgacgacggaauauaccgaauacuucagcgaggguuacuagggcgcucccaaguaggaguaggaguguuucaagaugguguauuccauacaauguggcacguaacacgaggagcuguguugauguaccaaggaaaaaggcuagaacccaguugggcuugcgucaaaaaggauuuaauuucuuacggcgggggcuggagauuucaaggguccuggaauacgggggaggaaguacaagugauagcugucgaaccugguaaaaauccaaagaacguacagacuacaccaggaacauuuaagacgccagaaggcgaaguuggagcaaucgcccuugauuuuaaaccggggacaaguggaucacccauuguaaauagggaagguaaaauuguuggucuauauggaaacggaguuguaacgacuagcgggacuuacguuucggcuaucgcccaggcuaaagcaucacaagaggggccguuaccggaaauagaagaugagguguuuaagaaaagaaauuuaacaauuauggacuuacacccgggaagcggaaagacaagaagguaucugccagcaauaguuagagaggcgauaaaaagaaaacuacguacuuuaauuuuagcgccaacgagaguaguggccagugaaauggcggaagcacugaagggcaugccaaucagauaccaaacuacagcuguuaaaucugaacacaccgguagggaaauuguugauuuaaugugucaugcaaccuuuacuaugagacuguuaaguccaguaagaguaccaaacuauaacaugauuauaauggacgaagcacauuuuacagacccugcuucaauugcggcaaggggauauauuagcacuaggguaggcaugggagaagcugcagcuauuuuuaugaccgcuacaccuccaggaaguguagaggcuuuuccgcaauccaacgcuguaauacaagaugaagaaagagacauucccgaaaggucauggaacucagguuaugauuggauuacugacuuccccggaaaaacagugugguuuguccccaguauaaaaucuggcaaugauaucgcgaacugucuaaggaaaaauggaaagagaguaauacaacucucaaggaaaacuuuugauacugaauaucagaagacuaaaaauaaugauugggacuauguaguuacaacagauaucagugagaugggagccaacuuccgagcggauagagugauugauccuaggagaugccuaaaaccagucaucuugaaagacgggccugaaagaguaauacuagcaggacccaugccaguaacuguagcuucagcagcccagagacgcggacguauaggucgaaaucaaaacaaagagggcgaucaauacguauacaugggacagccccuaaauaaugaugaagaccaugcgcacuggacggaagcuaaaauguugcuagacaacauaaacacccccgaaggaauuauuccagcacuuuuugaaccugaacgggaaaaaucugcggcuauugauggagaauauagacugagaggggaagcaagaaaaacuuucguggaacuaaugagacgcggggaccuaccgguuuggcuaucauauaaaguagcaagcgaaggauuccaguauagugauagaagguggugcuuugauggagaaaggaauaaucagguauuagaagaaaauauggauguugaaauauggaccaaggaaggggaaagaaagaaacucagaccucggugguuagacgcaagaacauacucagacccucuagcguuaagggaguucaaagaauuugccgcagggcgucgaagugugaguggagacuugauacucgaaauaggcaaacuaccucaacauuugacguuaagagcgcaaaacgcccuugauaauuuggugaugcuacauaauucagaacaaggcgguaaggcuuaucgacacgcaauggaagaauuaccggauaccauugaaacucugaugcuacuagcgcugaucgcuguuuugacuggaggaguaacacuauucuuccuaagugggaaagggcuagggaaaaccagcauaggccuauugugcguaaccgcaagcuccgcgcuguuauggauggcaucaguggaaccucacuggauugccgcaucaauaaucuuagaguucuuuuuaaugguuuuacugauuccugaaccagaucggcaaagaacgccacaagauaaccaacuugcauauguagugauaggcuuauuguucaugauauuaaccguagcagcuaaugagaugggacuacuggagaccacuaagaaagaccucggcaucgguuacguagcugcagagaaucaccagcaugcuacaaugcuagacguugaccugcaccccgcaucagccuggacacucuacgcgguagcuacgacugucauuacuccaaugaugagacacacgaucgagaauacaacggcuaacauuagucuaacagcuauugcgaaucaagcugccauauugaugggucuugacaaagguuggccuauuuccaaaauggacauaggagucccacuuuuagcacuaggcuguuauucucaaguuaacccauugacacugacugcagccgucuuaauguuaguagcucacuacgccauaaucggacccggccuccaagcgaaagccacacgagaagcacaaaaacgaacagccgccgguauuaugaagaaucccacuguagauggaauagucgccauagaucuagauccaguuguuuacgaugucaaauuugaaaaacaguuaggucaaauaauguuauugauucuguguacgagucaaauauuacuaaugagaacaacgugggcucuaugcgaaucuauaaccuuagcaacuggaccuuuaaccacuuuaugggagggaaguccagguaaauuuuggaacacgacaaucgcgguaagcauggcuaacauauuuagaggcagcuauuuagcuggggcaggauuagccuuuucccuaaugaagucucuagguggaggaagaagaggcacgggcgcucagggugaaacacugggagagaaauggaagcgucaauuaaaucaacuaucgaaaucagaauuuaauacuuauaagcgaagcgggauuauggagguagauagaucugaagcaaaggagggucuaaaacguggagaaacuacgaaucacgcuguaucacgagggacagcgaaauugaggugguuuguggaacguaauuuagugaaacccgaggguaaggucauagaccuugguugcggccgaggaggguggucuuacuauugugcaggacucaaaaagguaacugagguuaagggcuauacaaaaggaggacccggucaugaagaaccuauaccaauggcuacguauggauggaaccucguaaaauuacacucuggcaaagacguauucuuuaugccgccagaaaagugugauacguuauuaugugacauaggggaaagcucacccaauccuacgauugaggaaggacgaacacugagaguguuaaaaaugguggagccgugguuaagaggaaaccaauucugcauaaaaauauuaaaccccuacaugcccucagugguugaaacccucgaacaaaugcaaagaaaacacggagguaugcucguacgaaacccauuaucaaggaauaguacccaugagauguauuggguuagcugcggcacugggaacaucguaagugcggugaauaugacaagucguauguuauuaaacagauuuaccauggcucaccguaaacccacauaugaacgagauguugacuuaggcgcggggacaaggcauguuacaguggaaccagagguugcaaacuuggacauuauaggucaacggauagagaacauaaagaaugagcauaaaucaacuuggcacuacgaugaagauaacccuuauaaaacaugggcuuaucauggaaguuacgaaguaaaacccaguggaagugcuaguaguauggugaacgguguuguacgauuacugacaaaacccugggacguaauaccaaugguaacacaaauugcgaugacagauaccacacccuuugggcaacaaagaguauucaaagaaaaaguugacacucgaacgcccagggcuaagagaggaacuacacaaauuauggagguaacagcuaaauggcuuuggggauuuuugucccgaaauaagaaaccacggauauguacucgagaagaauuuacccgcaaggugagaucuaaugcggcuaucggugcaguuuucguugacgaaaaucaauggaacucggcuaaagaagcaguggaagacgaaagguucugggaucucguacaccgggaacgagaacugcacaagcaagggaagugugcuacgugcguguauaauaugaugggaaaacgagagaagaaacuaggggaguucggaaaagcgaaaggcucacgcgcaaucugguauauguggcuaggugcaagauuuuuagaauuugaggcacuaggguuuaugaaugaagaccacugguucucacgugaaaacagccuaaguggcguagaaggugaaggccugcauaaacucggauacauccuucgagacaucucaaaaaucccuggaggaaacauguacgcggacgacacagcgggaugggauacccgcauaacagaagaugaucuacaaaacgaagcgaaaauaacagauaucauggaaccagagcaugcauuauuagcaacguccaucuuuaaacuaacauaucagaauaaagucgugagaguacagcgccccgccaaaaacgguacgguaauggacgugauaaguagaagggaucaacgaggauccggccaaguagggacuuauggauuaaacaccuucacuaauauggagguacaacuaauuagacaaauggaaagcgaagggauauuucucccaucugaacuagaaacucccaaccuagcagaaaggguauuagauugguuggaaaaacacggagccgagagguuaaagcgaauggcuauuucaggcgaugauugcgucguuaagccuaucgacgaccgcuucgcuacagcacuaacugcuuugaacgauaugggcaagguaagaaaagacaucccgcaaugggaacccuccaaaggauggaacgacuggcaacaaguuccauucugcucacaccacuuccaccaauuaaucaugaaagacggucgagagauugucguaccuuguaggaaucaagaugagcuagugggaagggcacgaguaagccaaggagccgguuggucacuacgggaaaccgcgugucuagguaaaucguaugcacagauguggcagcuaauguauuuucaccgaagggacuugagacucgcagcaaaugcgauaugcucagcagugcccguugauuggguuccgacuagcagaacuacuuggucaauacacgcacaucaucaguggaugacaacugaagacauguuaaguguguggaacagaguuuggauugaggagaacccauggauggaagauaagacacacguuuccucaugggaagaaguaccguaccugggaaaaagagaagaccaauggugcggaucacuuauugggcucacagccagagcgacaugggcgacgaauauacaaguugcaauaaaucaaguucggcgucuaauaggcaacgaaaacuacuuagauuauaugacaucaaugaaacgauuuaaaaacgaaagcgauccagaaggcgcucuuugguag

SEQ ID NO: 21437 - RNA, 9879 nt, Artificial Sequence
  derived and/or modified CDS sequence (opt6) from DENV-1__GU056031__SS-prME
ucaguaacuaugcugcuaaugcuccucccaacagcauuagcuuuucaucucacuacucgagguggggaaccacauaugaucguaucuaaacaagaaagaggaaaaucgcuucuauuuaaaacgucggcaggagucaauauguguaccuugauagcuauggauuugggagaauuaugugaagauaccaugacauauaaaugccccaggauaacagaagcagaaccagacgaugucgacuguugguguaacgcaacagauacguggguaacauacggaacaugcucacaaacgggcgaacacagaagggagaaaagauccguagcacuugcaccucauguaggauuaggucuagaaacacgcacugaaacuuggaugaguucggaaggagcauggaaacaaauccaaaggguagaaaccugggcucuacgacauccuggcuuuacuguuauagcauucuuuuuggcacaugcuauugguacgucaauuacucaaaaagguauaaucuuuauacucuuaaugcucguuacgccaucgauggcaaugcgguguguagguaucgguaauagggauuuuguagaaggacuaagcggagccacauggguugaugucgucuuagaacacggcucgugugugacuacaauggccaaaaacaagccuacucuagacauagagcuguuaaaaacagaggucacgaaccccgcuguacuacguaaacuguguauagaggcgaaaauuagcaacacaacaacagauaguagauguccaacacaaggagaggcgacuuuaguagaagaacaggaugcuaauuucgucugccggagaacguuugucgacagaggauggggcaauggcuguggguuauuuggcaaggggucucucuuaacaugugcuaaauuuaagugcguaacaaaguuagaaggaaaaauaguccaauaugaaaaucuaaaauacagcgugauuguaacgguacauacaggagaccaacaucaggucggaaaugaaacuacagaacaugggaccauagcaacaaucacaccgcaagccccuacgucagaaauucaauugacagauuauggggcucuaacacuagauuguagcccacguaccggacucgauuuuaaugagaugguccuacuaacuaugaaagaaaaaucguggcuagugcacaaacaaugguuccuugacuuaccucucccuuggacuucaggagccucaacgagucaagagacuuggaauaggcaggaucuucuuguuacauuuaaaacggcucacgcgaagaaacaagagguaguaguauuagggucccaagaaggggcaaugcacacagcuuuaaccggugcaaccgagauacagacgaguggaacuacaacgaucuucgcaggucaccuuaaaugcaggcuuaaaauggacaaauuaacguugaaagguaugagcuauguuaugugcacuggaucuuuuaaauuagaaaaagagguagcggaaacacaacauggaacagugcuugugcagguaaaguaugaagguaccgaugcuccuugcaaaauacccuucucgacucaagacgaaaaaggaguuacacaaaaugguaggcuaauaacugccaacccgaucgucacugauaaagagaagccaguaaauauagagacugagccaccguuuggagaguccuacauaguagucggugccggugaaaaggcgcuaaaauuaaguugguucaagaggggcaguaguauugguaaaauguucgaagcuacggcuaggggcgccagaagaauggcaauuuuaggcgacacagccugggacuucggaucgauagggggagucuuuaccaguguuggaaaguuaguucaucagguguuugguaccgccuaugggguacuauuuagcggagucaguuggaccaugaaaauuggaaucgggauauuauuaacaugguuagggcuaaacucaagaucaacaagccuuucaaugaccuguauugcaguagguaugguuacauuauauuuaggagugaugguucaagcagauucagguugcguuaucaauuggaaggguagagaauugaaaugugguagugguauauuugucaccaaugaaguacauacguggacggaacaguauaaauuccaagccgauucccccaaaagacugagugcagcaauaggaaaggcuugggaggagggggugugcggcauacgaucagcgacgagacuagaaaauauaauguggaaacaaauaucaaaugaguuaaaccacauauuacuagaaaacgauaugaaauucacagugguggucggagaugcgaacggaauacucgcacaaggaaagaaaaugaucagaccacagccuauggagcacaaauacucuuggaaaaguuggggaaaggcgaagauuauaggagcggacauacaaaacacuacauuuauaauugauggacccgauacuccagagugcccggauggacaaagagcauggaauauuugggagguggaagacuacgguuuuggaguauucacaacgaacauaugguuaaaauuaagggacuccuauacccaaaugugugaccaccggcuaaugagcgcagcaaucaaagauaguaaagccguacacgcugacaugggauacuggaucgaaucagagaaaaaugaaacguggaaacuagcaagagcuuccuuuaucgaaguaaaaacuuguacuuggccaaaaagucauacauuguggucgaauggaguccuagaauccgagaugauuaucccaaaaauauaugggggucccauaucccaacauaacuacagaccuggauacuuuacgcagacugcuggucccuggcauuuaggcaaacucgaguuggauuuuaaccuaugcgaagggaccacuguaguuguugaugaacacugugguaaucgugguccaagucuuaggacaaccacaguaacgggaaaaauaauccacgaauggugcuguagaucauguacguuaccgccuuuaagauucagaggggaagauggguguugguacggaauggaaauucgacccguaaaagaaaaggaggaaaaucuagugaggucuaugguuucagcugggaguggagaaguagauagcuuuagucuggguauucucuguguuagcauaaugaucgaagaaguaaugagaaguagguggucacgcaagaugcuaaugaccgguacuuuagcaguauuuuuacuucuuauaaugggacaacucacauggaacgaucuaauuagacucugcauaaugguuggugcgaaugcuagcgaccguaugggaaugggaacaacauacuuggcacugauggcaacuuuuaagaugagaccuauguuugcuguuggucuccuauuucgucgauugacaucccgcgaaguacugcuacuaacgauuggucugaguuugguugcauccguagaauuaccaaauucgcuugaagaauuaggugacggauuagcaaugggaauaaugaugcugaaacuccuuacugaauuucagccgcaucaacuuuggacaacucuauugucauuaacauucguaaaaacgacauugucucuagauuacgcauggaagacaacugcaaugguuuuaucuauaguaagccucuucccauuauguuuaaguacgacgagccagaaaacgaccugguuaccgguuuuacuagggucguuuggauguaaaccuucaacuauguuucucauaaccgaaaauaaaauuuggggaagaaaauccuggccgcuuaaugaaggaaucauggcgaucggaauugugaguauacuccuaagcucucugcuuaaaaacgauguuccauuagcggguccuuuaauagccgggggaaugcuuauugcuuguuaugucaucucgggcagcucagcagacuugagccuagaaaaagcagcugaaguuucaugggaacaagaagccgaacacucaggagcuucucauaacauucuaguggaaguacaggacgacggcacaaugaagauaaaagaugaagaacgugaugacacauugacgauacuucuuaaagcaacgcugcucgcagugucagggguguacccaaugucgaucccggcgacauuauuugucugguauuucuggcagaaaaagaagcaaagaucgggagugcuaugggauacaccaagcccaccggaagucgaacgcgcgguucuugaugacgggaucuacagaauacuacaaaggggccuauuaggaagaagucaagucgggguuggaguauuccaagaugguguuuuucacacuauguggcaugucaccaggggagcugugcucauguaccaagggaaacgacuagagccuaguugggcaucagucaagaaagaucuaaucagcuacgguggagguuggcgguuucagggaaguuggaauacaggcgaagaaguacaaguaauugcggucgaacccggcaaaaaucccaaaaauguucaaacuacaccggguacguucaaaacaccagaaggggagguaggggccauagcucuugacuuuaagccgggaacaaguggaucgccaauaguaaaccgagagggaaaaauagucggccuuuacggcaacgguguagugacgacgucagggacguacguaucagcgaucgcccaagcgaaagcaucgcaggaagguccacugccagaaauagaagaugaaguauucaagaaaagaaaucuaacuauaauggacuugcauccgggcucagguaagacucgccgcuacuuaccagcuauaguacgugaagcuauaaaaagaaaguugaggacuuugaucuuagcuccgacucguguuguagcgagugaaauggcugaggcuuuaaaaggcaugccaauucgauaucagaccacugccguaaaaagcgaacauacgggaagagaaauaguagaccuaaugugccacgcaacuuucacaaugagauuacuuucgccggucagggucccaaauuauaacaugauaauaauggacgaagcucacuucacugacccagcuaguauugccgcaaggggcuacaucagcacaagaguagguaugggagaagcagcagcgauauuuaugacggccacaccaccgggaagcguagaagcauucccacagaguaaugcuguaauucaagaugaagagagggacauuccagagaggucauggaacucgggauacgacuggauuacugauuucccaggcaaaacgguuugguuugugccaaguauuaaaucugggaacgacauugcaaacuguuuacgcaagaaugggaaacguguuauacagcucucucgcaaaacauuugauacggaauaccagaagacuaagaauaacgauugggacuacguuguaacaaccgauauaagcgaaaugggagcaaacuuccgggccgaucggguuaucgauccacguagauguuugaaaccaguuauacucaaggauggcccggagcgugucaucuuagcaggcccaaugccugugaccguggcaucagcugcccagagaagaggccguauaggccgcaaucaaaacaaggaaggugaucaauauguauacaugggucaaccucucaauaacgacgaggaccaugcacauuggacagaggcaaaaaugcuacuagacaacauaaauacuccggaaggaauaauaccugcccuauuugagccugaacgugagaagucugcggcaauagauggugaauauagacuaagaggugaggcacgaaaaacuuucguagaacuuaugagaagaggcgaucugccuguauggcuuucuuauaaaguugcaucugaaggauuucaauauuccgaucguagguggugcuucgacggggagcgcaauaaccaaguauuagaggaaaauauggacguagaaaucuggacgaaagagggagaacggaagaaacuaagaccacggugguuagaugcccgaacguauucagacccacuugcgcugagagaauuuaaagaauuugcagcuggucgucggagcgucuccggugauuuaauucuugaaauagguaaauuaccacaacaucuaaccuuaagagcucagaaugcauuagacaaccuugugaugcuacauaauucagaacaaggagggaaagcauacagacacgcaauggaagaacugcccgauacaauagagacucuuaugcuccuugcucuaaucgcugucuuaacgggcggagucacacuauuuuucuuaucgggaaaaggauuaggaaaaacuucgauuggguugcuaugugucacagcaucaucagcacuccuuuggauggcgucaguagaaccacauuggauugccgcaucaauuauacucgaauuuuucuuaaugguccuauugauaccagaaccugacagacagaggacaccacaggauaaucaauuagcauaugugguaauuggacuucuauuuaugauacuaaccguagcugcuaacgaaauggguuuauuggagacgaccaagaaagaccuagggauaggcuaugucgccgcggagaaccaucaacacgcuaccauguuagauguggacuuacauccagcgagcgcauggacgcucuacgcagucgcaacuaccguaauaacccccaugaugagacauacgaucgaaaauacuacugcgaauaucagcuuaacagcgauugccaaucaagcagccauuuugaugggccucgauaaaggguggccaauaucaaaaauggacauagggguaccuuuacuugcucucggcuguuauucucaaguuaauccauuaacccuuacagcugcaguacuuauguuaguugcacauuacgcaauaauaggaccuggcuuacaggcaaaagcuaccagagaagcucaaaagaggaccgcagcaggcauaaugaaaaauccaaccguagacgggauaguugcaauagauuuggacccgguaguuuacgacgcgaaauuugaaaaacaauuaggacagauuaugcuacugauccuguguacuucucaaauacuauuaaugaggacaacuugggcguuaugugagagcauaacgcuagcuacagguccacuuaccacucuuugggaaggaagcccgggaaaguuuuggaauacgacgauagcuguuaguauggcaaacauauuucgcggaagcuaccuagcaggagcuggcuuagcauucagucucaugaaaucgcucgggggcggaagaagggguacgggggcucaaggggaaacauuaggugaaaaauggaaaagacagcugaaccaguuaaguaaaucagaauuuaacacauacaaacgcucaggaaucauggaaguagaucgcagcgaagcaaaggaagguuuaaaaagaggggaaacaacgaaacaugcaguuagcaggggaacugcaaaauuaaggugguucguagaaaggaaucuaguuaaacccgaagguaaaguaauagauuugggauguggaagggguggcuggaguuauuauugugcaggacucaaaaagguaacagaaguaaaaggauauacaaaaggaggaccaggacaugaggaaccaauaccuauggcaacauauggcuggaauuuagucaaacuacauucaggcaaagacguauucuuuaugcccccugagaaaugugauacccuacuuugugauauaggugaaagcucuccaaaccccacgauugaagaagggaggacacuaagaguuuuaaaaaugguugaacccugguugagaggaaaccaauucuguauaaaaaucuuaaacccuuacaugccauccguuguugagacguuagaacaaaugcaaaggaaacauggcggaaugcuuguaagaaacccauuaagccgaaauaguacacaugagauguauuggguuaguuguggaacuggaaacauaguuagugccguaaauaugacaucgcguauguuacuaaacagauucacaauggcacacaggaaaccuacauaugagagagaugucgauuuaggcgcggguacuaggcauguugcagucgaaccagaagucgcaaauuuagauauuaucggacaacgcauagaaaacauuaaaaaugaacauaaaucaaccuggcauuaugaugaagauaauccguauaaaacaugggccuaucauggauccuaugagguaaaaccgagcggaagcgcuuccaguaugguaaaugguguuguaagauuauuaacaaaaccaugggacguuauccccaugguuacgcagaucgcaaugacagacacaacaccauucgggcagcaaagaguuuucaaagaaaaaguagauacaagaaccccaagagcgaaaagaggcacuacccaaauaauggaagucacagccaaauggcuuuggggauuucuuucucgcaacaagaaaccgcggaucuguacuagagaagaguuuaccagaaaaguccgaucaaacgcagcuaucggugcuguauucguugaugaaaaccaauggaacucugcuaaagaagcuguagaagaugaaagauucugggaucuaguacaucgcgaaagggaguuacacaaacaaggcaagugugcuacuugcgucuauaauaugauggguaagagggagaaaaaguuaggggaauuuggcaaagcgaagggcagucgggcgaucugguauaugugguuaggagcuagguuuuuagaguucgaagcucucggcuuuaugaacgaagaucacugguucucgcgcgaaaauaguuugucuggcguggaaggagaagguuuacacaaacuugguuacauacuacgggauauuucaaagaucccaggggguaacauguacgcagacgauacagcaggaugggacacacggauaacugaggacgauuugcaaaaugaagcuaagauaacggacauuauggaacccgaacaugcguuguuagcgacgagcauauuuaaacuaaccuaucagaacaaaguaguacguguacagagaccugccaaaaauggcacaguuauggacguaaucucucgaagggaccaacguggcucgggucaaguaggaacauauggucucaauacuuuuacaaauauggaaguacaacucauucgucaaauggagagcgaaggcauauuccuaccaucagaauuggaaacacccaaucuagcagaacgugcacuugauuggcuggaaaaacauggggcugaaagacuuaaaagaauggcuauaucgggagacgauugugugguaaaacccauagaugacagauucgcgacggcacugaccgcacucaaugauaugggaaaaguuaggaaagauaucccucaaugggaaccaaguaaggguuggaaugauuggcaacaaguuccguuuugcucacaucauuuccaucaguuaaucaugaaagauggaagggaaauagucgucccguguaggaaccaagacgaauuaguuggucgugcccgcguaagucaaggagcugguuggagcuugcgagaaaccgcaugcuuaggaaaaaguuaugcucaaauguggcaacucauguauuuucaccguagggaucugcgccuagcugcuaacgcaauaugcucugcuguuccaguagauugggucccuacaucgcguacgacauggagcauucaugcacaucaccaauggaugacaacagaagacauguugucaguauggaacaggguauggaucgaagaaaacccuuggauggaagauaaaacccacgugaguucaugggaagaaguaccauaucucggaaagcgugaagaccaauggugugguagucuaauaggacuaacagcaagagcaaccugggcgacuaacauccaaguugcaauuaaccaaguucgaaggcucauagguaaugaaaacuauucagauuauaugacauccaugaaacgauuuaaaaaugaaagcgauccggaaggugcauuaugguga

SEQ ID NO: 21438 - RNA, 9879 nt, Artificial Sequence
  derived and/or modified CDS sequence (opt6) from DENV-1__GU056032__SS-prME
ucaguagcaauguuauuaauguuacuaccaacagcacuggccuuucacuuaacgacaagaggaggggaaccgcacaugauagucagcaaacaagaaagagggaaaucgcuacucuuuaaaaccagcgcgggugucaacaugugcacauuaauagcaauggauuuaggggaacuuugcgaagacacuaugacauauaaaugcccaagaauaacagaagcagaacccgaugauguugacugcugguguaacgcaacagauacauggguuacauauggcacauguucacaaacuggagagcacagaagagauaaacguagcguugcuuuagcaccacacguggguuuaggacucgagacgagaacagaaacauggaugucaagugagggugcguggaaacaaauacaacguguagaaaccugggcuuuaaggcacccuggauuuacagugauugcacucuuuuuggcucaugcuaucgguacaucgauuacacaaaaagguauuauauuuauauuauuaaugcuugucacaccaagcauggccaugagaugcguggggauaggaaaucgggacuuuguagaaggguuaaguggcgcaacguggguggauguaguacuugaacauggcucuugcgugaccacuauggccaaaaauaaaccgacccuagauaucgaacuauugaaaacagaaguaacuaacccagcagugcuacgcaaauuguguauugaagcgaaaauuaguaacaccacuacggauucaagauguccgacucaaggcgaagcgacccuaguggaagaacaggaugcaaauuuuguaugccgccgaacauucguagauagaggcugggggaacggauguggucuguuuggcaaggggagcuugcuuacaugugcaaaguucaaaugcgucaccaaguuagaagggaaaauagugcaauaugaaaaucuaaaauauucagucauagucacaguacacacgggugaucaacaucaagucggcaacgagacaacggaacauggcacaauugcgacuauuacuccacaagcaccgacaagugaaauacagcuaaccgauuacggggcacuaacauuagacugcucgccuagaacaggccuagauuuuaaugagauggucuuauuaacuaugaaagaaaaaucauggcugguacauaaacagugguuucuggaucuaccauugccguggacaucaggagccucaacaagccaagaaacuuggaaccgucaagauuuacuugugacguuuaagacagcgcaugcuaagaagcaagaaguaguaguguuggguagccaagaaggugccaugcacacugcuuuaacgggagcuacugaaauccaaaccuccggcacaacaacuauauuugcaggucaccuuaaauguagauuaaagauggauaaguuaaccuugaaaggcacgaguuauguaauguguacugggucauuuaaacuagagaaagaaguagcggaaacacagcacggaacaguuuuaguacagguuaaauaugaagggacagacgcaccaugcaaaauucccuucaguacccaggaugagaagggugugacacagaacggaagauuaauuacugccaauccgauuguaacagauaaagagaagccuguuaauauugaaaccgaaccacccuucggcgaaucguauauagugguaggagcaggagaaaaagcguuaaaguuaucgugguuuaagaaaggaagcuccauuggcaaaauguuugaagcaacggccagaggagcuagaagaauggcuaucuuaggcgauaccgcuugggauuuugguaguauuggaggcguguuuacaucuguagggaaacuuguccaucaaguauuuggaaccgcguacgguguucuuuuuagcggugugucauggacuaugaagaucggaauaggaauacuucuaacaugguugggucuaaauagccguagcacuagccuuucaaugacuugcauagcaguaggcaugguaacacucuaccugggaguaaugguacaagcagacucaggcugugucaucaacuggaaaggaagagaauuaaaaugcggaagcgguauauucguuacaaacgaaguacacacauggacggaacaauauaaguuucaagcugacucaccaaaaaggcuaucugcagcaauuggaaaggcuugggaagaaggaguuugcggaauaagaagugcaacaagguuggagaauaucauguggaaacagauuucaaaugaacucaaccauauucuucuagaaaacgacaugaaauucacaguaguugugggagaugcuaacggcaucuuagcacaagggaaaaagaugauaagaccacaaccgauggaacauaaguacucuuggaaaucuuggggcaaagcgaagaucauuggcgcagacauacaaaauacaacauuuauuauugaugguccagauacgccagaguguccugacgaccagcgagcuuggaauauaugggagguagaagauuaugguuuugguauauuuacaaccaauauaugguuaaaacuaagagacucuuauacucaaaugugcgaucauaggcuuaugucugcugcuauaaaggacagcaaagcggugcaugcagacaugggauacuggauagaaucggagaaaaaugaaaccuggaaacuggcacgugcaaguuuuauugagguuaagacuugcacguggccaaagagucacacuuuauggucuaauggaguccucgaaagugaaaugauaauaccuaagauuuauggcggaccaauuucgcagcacaauuauagaccagguuauuuuacucaaacggcgggaccguggcauuuagggaaacuugaacuugacuuugaccucugcgaagguacgaccgucguugucgaugaacauuguggaaaccgaggaccgucucugagaacaacaaccgucacggguaaaauuauccaugaaugguguugucggucaugcacucuuccuccauuaagauuucguggagaagacggauguugguacgggauggagauccgaccgguaaaggaaaaagaagaaaacuuggugcguuccaugguaagcgcagguaguggcgaaguagacagcuuuaguuuagguauauuaugugucagcaucaugaucgaagaaguaaugagaagccgauggaguagaaaaaugcugaugacaggcacacuugccguauuuuuguugcuaauuaugggucaguuaacuuggaacgaccuaauaaggcuaugcauaauggucggcgccaacgcaagcgaucguaugggcauggggacgacauaucuugcccuaauggcaacguuuaagaugaggccgauguuugcagucggacuuuuguuucguagauuaaccucgagagaaguauuacugcucacaauaggacuuagcuuaguugcguccgucgaauuacccaacucguuagaggaacuuggagaugggcuugcaauggguauaaugauguugaagcuguugacggaauuucaaccucaucaacuauggacaacgcuccugagccugacauuuauuaaaacaacucuaucauuagacuaugcauggaaaaccacggcuaugguacuaucaauaguuagccuguuuccacuauguuuaucuacaacgucccagaaaacaacauggcucccuguacuuuuaggaaguuucggguguaaacccuuaacaauguuucuaauuacagaaaauaaaaucuggggacguaaaucuuggccacuuaaugaaggaauaauggcugucggcauuguaucuauguuauuaaguaguuuacuaaagaacgacguuccuuuagcaggacccuuaauagcaggaggaaugcuuauagcguguuacguuauaagugguaguagcgcggacuuaucucuagaaaaagcugccgaggucucaugggaacaagaggccgagcauucaggcacaagccacaacauauuaguugaaguucaagaugauggaacuaugaaaaucaaagacgaagaacgagacgauaccuuaacuauuuuguuaaaagcaacacuguuagcgguaucaggaguauauccaaugucaauaccugccacguuguucguuugguacuuuuggcagaagaagaaacaaaggucaggaguucuuugggacacgccaucaccaccagaagucgagcgggcaguuuuagaugaugguauuuauagaauccugcaacgugguuugcuaggaagaucucaggugggugucggaguauuccaagauggaguguuucauacuauguggcacgugacuagaggugcaguucuaauguaccaggguaaaaggcuggaacccaguugggcuucaguaaagaaagacuuaauaucauauggaggcggcuggagguuucagggaucauggaacaccggagaagaaguccaaguaauugccguggagccgggcaaaaacccuaaaaacguucaaacaacuccugggacauuuaaaaccccugaaggggaggucggugcaauugcuuuggauuucaagccugguaccucugguagucccauugugaauagagaagggaagauagugggacuuuauggaaauggaguaguuaccacgucagguacuuauguaucggcuauagcgcaagcuaaggcuucacaggaaggaccucugcccgaaauagaagaugaagucuuuaagaaaaggaauuuaacgauuauggaucugcaccccggaucaggaaagacacgucgauacuuacccgcuauuguaagggaggcuauaaagcgaaaacuaagaacgcuaauucucgcgccgacacgaguuguagcaucggaaauggcggaagcccuaaaagguaugccaauuagguaucaaacaacagcgguaaaaucagaacacacggggagagaaauuguugauuuaaugugucacgccacauuuaccaugcgguuauuaucaccuguuagaguuccaaacuauaacaugaucauaauggaugaagcacauuucacugauccugcaucaauugcugcaagaggauacauaaguacacgagucgggaugggggaggcugcagcuaucuuuaugacagcuacuccaccaggaucagucgaggcuuuuccccaaucaaacgcugugauucaagacgaagaaagggauauaccggaaagaaguuggaacuccgguuaugauuggauaacagauuucccaggcaagacaguuugguucguaccgucaaucaaaucgggaaaugauauugcuaauuguuugagaaagaacgguaaacgagucauucaacuuagcaggaaaacuuuugacacagaguaucaaaagacgaaaaauaaugacugggacuauguugugacuacagacauuucugagaugggagcgaauuucagagcggauagaguaauagauccgagacggugcuugaaaccugucauuuuaaaagacggaccugaaagaguuauucuugcagguccaaugccuguuacagucgcgucugcagcgcaaagacgcggaagaauugggagaaaucaaaacaaagagggagaucaauauguuuacaugggacaaccuuuaaauaaugacgaagaucaugcucacuggacagaagccaagauguuacuagauaauauaaauacgccagaaggaauuauacccgcucuuuucgaaccagaaagagagaaaagcgcagcaaucgauggggaguaucggcuaaggggagaagcucgaaaaacauuuguagaguuaaugcgcaggggagaucuaccaguauggcuuucauauaagguagcaagcgaaggauuucaauacucugauagaagauggugcuuugacggagaacgcaauaaccagguacuagaggaaaacauggauguagaaauauggacaaaggaaggugaacgaaagaaguuacguccuagguggcuagaugcgagaacguacucugauccauuagccuugcgagaauuuaaagaauuugcagcuggaaggcgauccgucucaggcgaucuaauauuggaaauuggaaagcugccacagcaccuaacucuaagagcacaaaacgcauuagauaaucuagucaugcuucauaacucggaacaaggcggcaaagcauauagacaugcuauggaagaacuucccgacacaauagaaaccuuaaugcuauuagcucuaauagcgguguuaaccggcgggguuacauuguucuuccugagcggaaaagggcuugguaagacaaguauuggguugcuauguguuacagcaucaucugcuuuacuuuggauggcgaguguagaaccgcacuggauugccgcaucaauaauauuggaguucuuuuuaauggucuuauuaauuccagaaccagaucgacagagaacuccacaagauaaccaacucgccuacguuguaaucggcuuacuauucaugauacuaacgguagcagcaaaugaaaugggacuguuggaaaccaccaagaaagauuugggaaucggacauguggcagcggaaaaccaucaacaugcaacaaugcucgauguagacuugcgaccagcaagugcguggacacuauacgcgguggcuacaacagugauaacucccaugaugaggcauacgauagaaaauacaacggcaaacauuagucuuacugccaucgcaaaucaagcagcuauucuaaugggcuuggauaaaggauggccgauuaguaagauggauauaggagugccacuauuggcauuaggaugcuauagccaagucaauccauuaacucugacggcagcuguguugauguuaguagcacacuaugcuauuauuggucccggauuacaggcaaaagcaaccagggaagcccagaaaagaacagccgcaggaauaaugaagaauccaacgguagacggaaucguugcgauagauuuagauccugugguauacgacgcaaaguuugaaaaacaacuuggacaaaucaugcuauuaauccuauguacaucacaaauauuauuaaugagaacgaccugggcacugugugaaaguauaacacuagcgacagggccauuaaccacucuuugggagggcaguccagguaaauuuuggaauacuacgauagcaguaaguauggccaauaucuuuaggggaucauaccuagcaggagccggauuagcguucagcuugaugaaaagccuaggaggcgggcgcaggggcacaggagcgcaaggagaaacauuaggggaaaaguggaagcgucaguugaaucaacugucgaaaagugaauuuaauacauacaagcggucuggaaucauggaaguagacaggagcgaagcgaaagaaggucuaaaaaggggagaaacaacaaaacacgccguaaguaggggaacagcuaaacuucguugguuuguugaaagaaaccuagucaaaccggaaggcaagguaauugacuuagguuguggaaggggaggcuggaguuauuacugugcgggucuaaagaaagucacagagguaaagggguauaccaaaggaggacccggacaugaagaaccgaucccaauggcgaccuacggguggaacuuaguaaaacugcacagcggcaaggaugucuucuucaugcccccagagaagugugacacgcuacuuugugauaucggagaaucaucuccaaauccuacgauagaggaaggaagaacacuaagaguacugaaaaugguagaacccugguuaagggggaaccaauucuguauaaaaauucuaaacccguauaugcccucagucguagaaaccuuggaacaaaugcaacggaagcauggggguauguuaguaagaaauccauuaucucgcaauagcacccaugagauguacuggguauccuguggcacgggaaacauaguuucugcgguaaauaugacaagucgaauguugcuaaauagauuuacuauggcgcaccggaagcccaccuaugagcgagauguagaccuuggcgcgggaacaaggcaugucgcaguagaaccggagguugcaaauuuagacauaauuggucaacguauagaaaauaucaaaaaugaacauaaaucaacuuggcauuaugaugaggacaauccuuauaagacaugggcauaucacgguaguuaugagguaaaaccuaguggauccgcgucaucaauggucaacgguguagucagacugcuaacuaaaccuugggauguuauaccaauggucacacaaauugcgaugacggacacaacaccauucggucaacaaagaguguuuaaagagaagguagauaccagaacgccgagagcaaagcguggcacgacacagauuauggaaguaacagcaaaauggcuuuggggauuuuuaucgcgaaacaagaaaccgaggauaugcacacgagaagaguucaccagaaaaguacggucuaaugcagcuauuggagcaguauuuguagacgaaaaucaauggaacucugcuaaagaagcgguugaagaugaacgcuucugggauuuaguucauagggaaagagaauuacacaaacaaggaaaaugugcuacgugcguauacaauaugauggggaaaagggagaagaaacugggagaauuugggaaagcaaaaggcucaagagccauuugguauaugugguugggugcuagguuucuugaauuugaagcgcuugguuuuaugaaugaagaucacugguuuucgcgagaaaauucucucuccgggguugaaggggaagguuuacauaaguuagguuauauuuuaagagauauuucaaaaauuccgggaggaaacauguacgcugaugauacugcggggugggauacacgaauuacugaagacgaucuucaaaaugaagcgaagauaacggacauaauggagccugaacaugcacucuuagccacaagcauauuuaaacuuacguaucaaaacaaggucgugaggguccaaaggccugcuaaaaaugguacaguuauggauguaauaucacgacgagaccagcguggaucaggacaagugggaaccuauggucuaaacaccuuuacaaauauggaaguacaacucauuagacagauggaguccgaaggaaucuuccugccaagcgagcuagagacacccaaccuugcagaaagggugcuggacugguuagagaaacauggugcggaacgauuaaaaagaauggcgauuucaggcgaugauuguguagucaagccgauugaugaucguuucgcuacggcuuugacugccuugaacgacaugggcaaaauaagaaaagacaucccacaaugggagccguccaaaggauggaaugauuggcagcagguaccguuuuguagucaucauuuccaucagcuaauuaugaaagauggucgugaaauaguuguuccaugucggaaucaagaugaguuaguaggacgagcacgcgucagccaaggagcuggauggucguuacgagaaacggcaugccucgguaaaucauaugcacaaauguggcaauuaauguacuuccauaggagagauuuacgacuugcagcgaacgcgauauguagugcgguaccgguagauuggguaccaacaaguaggacaacauggagcauacaugcgcaucaucaauggaugacgacagaggauauguuaagcgucuggaacagggucuggauagaagagaaccccuggauggaagacaagacucacguaucuucgugggaagaagugccuuaccugggaaaacgagaagaucaauggugcgggucuuuaauaggauugaccgcacgugcuacuugggcuaccaauauccagguagcaauuaaucaggugcgcaggcuuauagguaacgaaaacuacuuagauuauaugacaagcaugaaaagauucaaaaaugaaucugauacugaaggagcacuuugguga

SEQ ID NO: 21439 - RNA, 9879 nt, Artificial Sequence
  derived and/or modified CDS sequence (opt6) from DENV-1__GU056033__SS-prME
ucugugacgauguugcugaugcuucuaccaaccgcacuagcuuuccaucuaacuaccagagguggggaaccgcauaugauuguaucgaaacaagaaagagggaaaucgcuauuguucaaaacaaguguaggugugaacauguguacucuuauagcaauggauuuaggagaacuuugugaagauacaaugacuuacaaauguccucggauuaccgaagcggaaccugacgaugucgauugcugguguaacgcaaccgauacauggguaaccuacgguacauguagucaaacgggugaacacaggcgagacaaaagaaguguugcgcuagcaccgcaugugggguuaggccuagaaacaagaacugaaacauggaugagcucugaaggggcauggaaacagauccaaaggguugagaccugggcacuucgacauccaggguucacaguuauugcacuauucuuagcucaugcuauagguacaaguauuacucaaaaaggaauaauauuuauucugcucauguuagucaccccuucuauggcgaugcguuguguagguauaggcaaccgggacuucgucgaaggauuaaguggggcuacaugggucgauguagugcuagaacauggaagcuguguuacgacuauggccaaaaacaaaccaacucucgacauugaauugcuaaaaacugaaguuacgaacccugcaguacugagaaaacuguguauagaggcaaaaauuaguaauacaacuacagacucuagaugucccacucaaggggaggcgacguugguugaagaacaagacgcaaauuuuguauguagacggacauuuguggaucgugguugggguaacggauguggacucuucgguaaagguucucuucuaaccugcgcaaaauucaaaugcguuacaaaacuagaagguaaaauuguacaauaugaaaaccugaaauauucggucauaguaacuguucauacaggggaccagcaccaaguuggcaaugagaccacagaacauggaacaauugcaacaauuacuccucaagcuccuacaucagaaauacaguugacagacuauggggcuuugacucuagacugcaguccacggaccggacucgacuuuaacgaaaugguauuauuaacaaugaaagaaaaaucuuggcuaguacacaaacaaugguuuuuagacuuaccguuaccauggacaucaggagcaucuacaucucaagaaacguggaauagacaagaccugcuaguaacuuucaaaacggcacacgccaagaaacaagaaguaguaguacuagguagccaagaaggugcaaugcauacggcacugacuggagcaaccgaaauucaaacuucugggacuaccacaauauuugcagggcaccuuaaauguagauugaaaauggacaaauugacgcuuaaggggaugucuuaugucauguguacagguucauucaaauuagagaaagaaguagcagaaacgcaacaugguacagugcuuguacaagugaaauaugaagguacggaugcuccauguaaaauuccauucucuacacaagacgaaaaaggagugacacagaauggucgacuuauaacggcgaauccuauaguaaccgauaaagagaaaccagugaacauugaaacggaaccucccuuuggagaaucauauauuguuguuggugccggugaaaaagcccuuaaauuaagcugguuuaagaaagguagcaguauaggcaaaauguuugaagccaccgcuagaggugcaagacgcauggcaaucuugggagauacagcaugggacuuugggucuaucggcgguguuuucaccagcguugggaagcuagugcaucaaguuuuuggaacagcguaugguguauuauuuagcgguguaucauggacaaugaaaauaggaauaggcaucuuauuaacauggcuggguuugaauaguagaucaacaucuuugaguaugaccuguauugcggugggaauggugacucuuuaucuaggaguaauggugcaagcagacucgggaugcguuauaaauuggaaagggagagaauuaaaauguggaaguggcauuuuuguaacuaacgaaguacauacuuggacugaacaauacaaauuccaagcagauuccccaaaaagacuuucggcugcaauagggaaggcuugggaagaaggaguuugugguaucagaagugcaacaaggcuugagaauaucauguggaaacagauaucuaaugaauuaaaccauauucuguuagaaaaugacaugaaauuuacugucgugguaggugauguuaacggcauauuagcucaagggaagaaaaugauacggccacaaccaauggaacauaaauauucuuggaaaaguugggggaaagcaaaaauaauaggagcagacauacaaaauaccaccuuuauaauagaugguccugacacuccagaauguccggaugaccaaagagcauggaauauuugggaaguugaagacuacggauucggaauauucacuaccaacauauggcuaaaacuucgggauaguuacacacaaaugugugaccauagauuaaugucugccgcaauuaaagauuccaaggcuguccacgccgauaugggauauuggauugaaagugagaaaaacgagacauggaaacuggcuaaggccucauuuauugaaguaaaaacgugcaucuggccaaagucacauacauuauggaguaacgguguacuagaaagcgaaaugauaauaccgaagauauacggaggccccauaucacagcauaacuauagaccugguuacuucacacaaacagcagguccguggcacuuagguaaguuagaguuggacuuugaucuuugugaagggacuacuguuguuguggaugaacauugugggaacagaggccccucuuugcgcacuacgacaguuacugguaaaauuauacaugaaugguguugccggagcuguacacuucccccacugcgauucaggggagaagaugguugcugguauggaauggaaaucagaccuguaaaggaaaaggaagaaaaucuuguuaggaguaugguaucagcaggaucaggagaagucgacucauucucacuggguauucuauguguaagcauaaugauugaggaggugaugagaagcagauggaguaggaaaauguuaaugaccggcacauuagcuguauuccuacuacuaauuaugggacaauugacuuggaacgacuuaauacgacuuuguaucaugguaggagcuaaugcuagcgauaggaugggaaugggaacuaccuauuuggcccuaauggcgacauuuaaaaugaggccuauguucgcaguuggacuauuauuucguagguuaacuucuagggaaguacuacuacuaacgauaggauugagucugguugcaagcguagaguugccuaacagccuagaagaacugggugauggacuagcaauggguauaaugauguuaaaacuacucacagaauuucagccacaccagcucuggaccacguuacucucacuaacauuuauaaagacaacgcugagucuagacuaugcguggaaaacaacugcaauggcauuaaguaucgugucccuauuuccguuaugucugucgacaaccagccagaaaacuacauggcucccugugcuccuaggaucguuuggaugcaaaccacucacaauguuccuaauaaccgaaaauaaaaucugggggcgaaagucauggccacuuaaugaagguauaauggccauaggcauaguaucuauacuauuaaguagucuacuuaaaaaugacguuccucuagcaggaccuuuaauagccggcgguauguugauagcaugcuacguaauuaguggcucgucggcugauuuguccuuggaaaaagccgcugaaguaucuugggaacaggaagcagaacacucugggacaagucacaacauacuuguugaaguacaagacgaugguacgaugaaaauaaaagacgaagagagagacgauacccuuacaaucuuacuaaaggccacacuuuuagcugugaguggcguauacccgaugagcauaccagcgacgcuuuuuguuugguauuuuuggcagaagaagaaacaaaggucagggguguuaugggacacuccuucacccccagagguugaaagggccgugcuagacgacggcauuuacagaauuagucaaagaggguuguuaggacgcucacaagucggaguggggguuuuucaagauggaguuuuccacaccauguggcacguaacacguggugcuguguuaauguaucaggggaaacguuuagaacccaguugggcgucagucaagaaagauuuaauaucauacggagguggauggagauuucagggauccuggaauaccggagaggaaguacaaguaauugccguugaaccgggcaagaaucccaaaaaugugcagacaacgccugguacuuucaaaaccccagaaggcgaagugggagcaauagcacuugauuuuaagccggguacaagugggagucccauaguaaaccgugagggcaaaauuguaggccuauaugggaaugguguaguuacaaccagcggaacauacguauccgcaauagcccaagcuaaagcaucacaagaagguccuuuacccgaaauagaagacgaagucuuuaagaagagaaaccucacuauaauggaccuucauccugguucggggaagacuaggcgguacuuaccagcuauaguccgcgaagccaucaaacguaaacuuagaacauuaauauuagcaccaacccguguggucgcaagugaaauggcagaagcauuaaaaggaaugccuauaagguaucaaacuacagcagugaaauccgaacauacuggucgugaaauuguugaccuuaugugucaugccacuuucacaaugcgacucuuaaguccaguaagagugcccaauuauaauaugauaaucauggaugaagcucacuuuacagauccggcuucuauugcagcaaggggauauauaucaacacguguuggaaugggugaagcggccgcaauauuuaugacagcaacaccucccggcagugucgaagcauuuccacaaucgaaugcggugauucaggacgaagaaagggauauaccugaaaggucuuggaacucaggcuacgauuggaucacugacuuucccgguaagaccguuugguucgugccaagcaucaaaaguggaaaugacauugcaaauugccuuaggaagaauggaaaaagaguuauacaacugucaaggaagacauuugacacugaauaucagaaaacuaaaaauaacgauugggauuacgugguaaccacagacauaucugagaugggagcuaacuuuagagcagaucgaguaauagacccaaggcguugucucaaaccagucauuuugaaagaugguccggagcggguuauauuagccggaccaaugccuguaacagucgcuagcgcagcacaacgacguggaagaaucggaagaaaucaaaauaaggaaggggaucaauacguuuacauggggcaaccucuaaacaaugaugaagaucaugcacacuggacagaagcaaagauguugcuagauaauauuaauacgccugaaggaauaauuccggcauuauucgaaccugaaagagagaaaagugcagcaaucgauggcgaguaccguuugagaggugaagcuagaaaaacguuuguagaauuaaugagacgaggagacuugccuguauggcugucguauaaaguagcaagugaggguuuccaguacucggauagaagaugguguuuugauggggaaagaaauaaucagguacuggaagaaaauauggaugucgaaauuuggacuaaagagggagagcguaagaaauuacggccacgauggcuggaugcgagaacauacagcgauccacuggcccuuagagaauuuaaagaguuugcagcuggaagaagauccguauccggugacuuaauacuugaaauagggaaguugccacaacaucuuacucucagggcacaaaacgcacucgacaaucugguaaugcuccauaacucugaacaaggcgguaaagcauacagacaugccauggaagaauuaccugauacuauagaaacacuaaugcuacuugcuuuaaucgcugugcuuacaggagggguuacacuauucuuucuaagcggaaaagggcuagguaaaacauccauaggacuauuguguguuacggccucuucagcauuauuauggauggcgucuguagaaccacacuggauagccgccucgauaauauuagaguucuuucuuaugguucuccuaauuccagaaccagauagacaaagaacaccucaagauaaucaguuagcauauguuguuauaggcuuacuauucaugauacucacugucgcggcaaaugaaaugggccuacucgaaacuacuaagaaagaucucgguauuggccacgucgccgcggaaagucaucaacaugcuacaaugcuggauguggaucuuagacccgcuagugcuuggacacuuuaugcaguggcuacaacgguuaucacuccaaugaugaggcauacaauugagaacacgacagccaauauaagucugacagcgauugcaaaccaagcggcaauucuaaugggucuugacaagggguggcccauaucuaagauggauauaggcguaccucuucuggcguuaggcuguuauucccaaguaaauccgcuaacgcucacagcugcuguccuuauguugguagcacacuaugcaauuauaggacccggacuacaagcaaaagcuacaagagaagcacagaaaaggacggcagccggaauuaugaaaaaucccacggucgauggcauuguugccauagauuuggacccaguugucuaugaugcaaaauuugaaaaacaguugggccaaauuaugcuguuaauacuaugcacuucccaaauacuguuaaugagaacaaccugggcguugugcgaaucgauaacguuagcaacaggcccacuuacuacuuuaugggaggguuccccaggcaaauuuuggaacacaacaauugcugugucaauggcaaauauauucagagguuccuauuuagccggagcugguuuagcguuuucacuaaugaaaucucuaggcggagguaggagagguaccggagcacaaggcgaaaccuuaggagaaaaauggaaaagacaauugaaucaguuguccaagacggaguuuaacaccuacaagcgaaguggaauuauggaagucgacaggucagaagcgaaagagggauuaaagcgaggcgaaacaacaaaacaugcggugagucgcgguaccgcgaaauuaagaugguucguugaacggaaucuagugaagcccgaagguaaaguaaucgaucuuggaugcgggagaggaggauggagcuauuauugcgcuggacucaagaaaguuacugaagugaaaggauauacgaagggugggcugggucaugaagaacccauacccauggcaacauacggguggaauuugguaaagcuccacucgggaaaagauguguuuuucaugccgccagaaaagugugacacucuacugugcgauauuggcgagucgagcccgaauccaacaauagaggaagggcguacauuacgaguucuaaaaaugguggagccguggcuaagaggcaaccaauuuuguauuaaaaucuuaaauccauacaugcccucagugguagagacauuggaacaaaugcaaagaaaacauggugggaugcuagugagaaauccccuaucccggaauaguacacaugaaauguauuggguaucuuguggaacuggaaacauugucucagcgguaaacaugacaagccgaaugcuucuuaaucguuucacuauggcucauagaaaaccgacauacgagcgagauguagacuuaggcgcggguacgagacacguagcuguagaaccagaaguugcaaaccuagauauaauaggucaaaggauugaaaauaucaaaaacgagcauaaaagcacauggcauuaugaugaggauaauccuuauaaaacgugggccuaccacggaucauaugagguaaagccaucagguucggcaucaucgaugguuaauggugucgucaaacuacuuacuaaaccgugggauguaauaccaaugguaacacaaauugcgaugacagauaccacaccguuuggccagcaacgaguauucaaagagaagguugacacacgaacgccgcgagcuaaacgaggcaccacgcaaauaauggaaguaacggcuaaaugguuauggggauuuuugucucgaaauaagaaacccaggaucugcacacgagaagaauuuacaagaaaaguaagaucgaacgcugccauaggugcaguuuuuguggacgaaaaccaauggaauagugcuaaagaagcugucgaagacgaaagguucuggaacuuagugcaccgcgaaagagaacuccauaagcaaggaaaaugugccacaugugucuacaacaugaugggcaaacgugagaagaaacucggugaguuuggaaaagcgaaaggaagucgagcgaucugguacauguggcuuggagcucgguuucuugaguucgaagcacuaggauucaugaacgaggaccauugguuuucgcgugaaaauucucuguccgguguugaaggugaaggcuuacauaaauuagguuauauacuucgagacauaagcaaaauuccuggaggcaacauguaugcugaugacacagcuggaugggacacucguauuacggaagaugaucuacagaacgaggcuaaaaucaccgacauuauggaaccagaacaugcuuuguuagccacaagcauuuucaaacuaacuuaucaaaacaagguuguacgaguucaaagaccagcgaaaaaugggacuguuauggauguaaucaguagaagagaccaaagaggaucuggacaggucggaacguacgggcuaaauacguucaccaauauggaaguacagcuaaucagacaaauggaaagcgaaggcauuuucuugccauccgaguuagaaacgccaaauuuggccgagcgaguucuugauuggcuugaaaaacacggggccgaaagacuaaaaagaauggcgauaucgggcgaugauuguguuguaaaacccauagaugaucgauucgcaacagcgcuaacggcacuaaaugacauggguaaaguaaggaaagacauaccacaaugggaaccuaguaaaggauggaacgacuggcagcaagugccuuucugcagucaucauuuucaccaguuaauuaugaaagacggcagggaaauuguuguuccauguaggaaucaagaugaguuaguugggcgagcgagaguaucacaaggagcggguuggagucuaagggagacagcuugcuugggaaaaagcuacgcucagauguggcaacuaauguacuuccaucgucgagaucugagguuggcagccaaugcaauuuguagcgcagugccuguggauuggguucccaccaguagaacgacauggagcauccaugcucaucaccaauggaugaccaccgaagacaugcuuucuguguggaauagaguuuggauagaggaaaacccauggauggaagauaagacgcacguaucaucgugggaagaaguacccuauuuagguaaaagagaagaucaguggugugguucucuaauaggauuaacugcaagagcuacaugggccaccaacauucaaguagcuauaaaccaaguuaggagacuuauugguaaugaaaauuauuuagacuauaugacaagcaugaaaagguuuaaaaacgagagcgacccagagggagcacuaugguga

SEQ ID NO: 21440 - RNA, 9879 nt, Artificial Sequence
  derived and/or modified CDS sequence (opt6) from DENV-1__GU131833__SS-prME
ucagugacuauguuauuaaugcuacugccuacugcgcuggcauuccacuugacuacaagagguggagaaccucacaugauaguaaguaaacaagaaaggggaaaaagucuauuauucaaaacuucagcuggaguuaacauguguacauuaauagcaauggauuuaggagagcuaugugaagacacgaugaccuauaaaugcccacgaauaaccgaagcggaaccagaugauguugacuguugguguaaugccacagauacuuggguaacuuacggaacguguucacaaacgggugaacaccgaagagacaaaaggucugucgcauuagccccacacguuggucugggccuggaaacgcguacggaaaccuggauguccucagagggagcauggaaacaaauacaaagagucgaaacgugggcccugagacacccaggauuuacagucaucgcccuauuucuugcacacgcuauugggacaagcauaacgcaaaaagguauuaucuuuauccuguugauguugguuacuccaucuauggcaaugagauguguaggcauuggcaaccgagauuucguagaggguuuauccggagcaacauggguugacguggugcuagaacauggcucuugcgucacgacuauggccaaaaacaaaccaaccuuggauauagaacuuuuaaaaacugaaguaacaaacccagcuguacuacguaaacugugcauugaagccaaaauaaguaacacgacgacagacagucguuguccuacccaaggugaagcaacucuaguagaagaacaagaugcuaauuucguaugucgacgaaccuuuguggacagagguuggggaaauggguguggacuauucggaaaagggucucuguugacuugcgcgaaauuuaaauguguaaccaaguuagaagggaaaauaguucaauaugaaaaccuaaaauauuccgucauugugacaguacauaccggcgaccaacaccaaguaggaaaugaaacgacggaacacgguacuauagcuaccauuacaccacaagcuccuacaagugaaauacaacuaacagacuacggugcauugacucucgauuguaguccuagaacaggucuagauuucaaugagaugguacuucuaaccaugaaggaaaaguccugguuaguacacaaacaaugguuucuugaucuuccacuaccauggacaaguggagccuccacgagccaagaaacguggaauagacaagaucuacuugugacauuuaaaacugcacaugcgaagaaacaggagguaguuguacuugguagccaagaaggggccaugcauacagcucuaacuggugccaccgagauacaaacuagcggcacaacuacaauauucgccgggcauuuaaaauguagacuaaaaauggacaaauuaacauuaaaagggacaaguuauguaauguguacuggaaguuuuaaacuugagaaggaaguggcagaaacacaacacggaacgguuuuagugcaagucaaguacgaaggaacggaugcacccuguaaaauacccuuuuuaacucaggacgaaaagggcguaacacagaauggacggcuuauaacggcaaacccaaucguaacagacaaagaaaaaccaguaaacauugagacggaaccgccguuuggagaauccuacauuguuguuggagcaggagaaaaagcucuuaaacuaucuugguuuaagaaaggaucaucuauagguaagauguuugaagcgacugcaagaggagcuagaagaauggcaauacucggagauacagcaugggauuuugguucuauuggaggagucuuuacaucagucgguaaacuggugcaccagguauucggaaccgcauacggcguuuuauucucaggcguaagcuggacuaugaaaauuggcauagggaucuuacuuacauggcugggguuaaauaguaggaguacaucacugucgaugaccuguauugcuguugguauggugaccuuguaucucggcguaaugguacaggcagacucuggaugugugauuaauuggaaaggucgugaauuaaaauguggcucgggcaucuucguuacgaaugaggugcauacauggaccgagcaauauaaguuccaagcagacucaccaaaaagauuaagugcagcaauuggcaaggcaugggaagagggaguaugcggaauaagaagugcgacucgccuugaaaacauaauguggaagcaaauuagcaacgaacuaaaucacauauuacuggaaaaugacaugaaauucacugucguagucggagacgcuaacggaaucuuagcacaagguaagaaaaugauacgaccacagccgauggagcacaaguauucuuggaaaaguuggggaaaagccaaaauaauaggugccgauauucaaaauacaacauuuauaaucgacgguccggauacuccugagugucccgacgaucagcgcgcuuggaauauaugggagguagaagauuacggguuuggaauuuuuacaacgaacaucugguuaaaauugagagacucguauacacagaugugugaccauagauuaauguccgccgcgauaaaggacucaaaagccguccaugcagauaugggcuacuggaucgaaucagagaaaaacgaaacauggaaauuggcgcgcgcaucuuucaucgaggugaaaacgugcacauggccaaagucacacacacuauggucuaauggaguacuagaaucagagaugauaauaccaaaaaucuacggagguccaaucucacaacacaacuauaggccaggguauuuuacacaaacugcugggcccuggcauuuagggaaacuagaguuggauuuugaucucugugaggggacaacgguugucguagaugagcacugcggaaaccgaggacccagcuuaagaacaaccaccgugacgggcaagauuauccacgaaugguguugcagaucauguacucuaccaccacuacgauuuagaggcgaagacggguguugguaugggauggaaauccgcccagucaaggagaaagaagagaaucucgugcgaucaaugguuagugcaggcagcggcgagguagauucuuuuucauuagguauauuaugugucucaauuaugaucgaagagguaaugcgcucaagauggagcagaaaaaugcuaaugacaggcacgcuggccguauucuuacuuuuaauaaugggccaacucaccuggaacgacuuaauaagacuauguauaauggucggagcgaaugcuucggaccgaauggggaugggaacaaccuauuuagccuuaauggcaacuuuuaaaaugcggccuauguucgcagucggacucuuauuccgucgguuaacaucgcgugaaguguuauuacucacuauagggcugucacugguagcaaguguagagcuaccgaauagccuagaggaacuuggagauggacuagcaaugggaauaaugaugcuaaaauuacuaacggaauuucaaccacaccaauuguggacuacguuacugucccucaccuucaucaagacuacgcuaucacuagauuacgcauggaagaccacagcuauggcacuuucuauagugucgcuuuucccucucugccucucgacaacaucucagaaaacuacgugguuaccaguccuuuuaggcucauuuggauguaaaccacugaccauguucuuaauaacagagaauaaaaucuggggaagaaaaucauggcccuugaaugaagguauaauggcuauaggaaucgucucaauacuguuaagcucccuacucaaaaacgaugucccccuagcuggaccauuaauagcagggggaaugcucauagcguguuacguaauuagugggaguucugcagauuuaucuuuagaaaaagcugcagaaguaagcugggaacaagaagcggaacauucagguaccucucauaacauacucguugagguacaagaugauggaacuaugaaaaucaaagacgaagaaaaggaugacacgcugacgaucuuacuuaaagcuacuuuauuggcgguuucagggguauacccaaugucuauuccagcaacauuguucgucugguauuuuuggcagaagaagaaacaaagaagcgggguucuaugggacacuccgucuccuccagaagucgaaagggcaguauuggaugacggaauauauagaauacuacaaagagguuuauuaggccguucccaagugggagugggagucuuucaaaacgguguauuucacaccauguggcacguuacuagaggagcuguucucauguaccaagguaaacgacuugaacccagcugggcuaguguuaagaaagaucuaauuucguacgguggugguuggagauuccaagguucauggaauacaggcgaagaaguucaaguaauagcaguagaacccgggaaaaaucccaaaaaugugcagacaacaccugguacuuuuaaaacuccagaaggagaaguuggggcaauagcauuagacuucaagccaggaaccucagggucacccauaguuaauagagaaggcaaaauaguaggguuauaugguaauggcgucgucacaacuuccgguacguauguuucagcgauugcccaagcuaaagcaucgcaagaaggaccuuuacccgaaauagaagacgaagucuucaagaaacgcaaccuaacuauaauggauuuacacccagguagugggaagacuaggcgauauuuaccagcgauaguuagggaagcuauuaaacgcaagcuccgcacucuaauucuugcacccacccguguaguugcaucagaaauggcugaagccuuaaaaggcaugcccaucagguaucaaacuaccgcuguaaaaucagaacauaccggaagagaaauuguagaucuaaugugucaugccacuuuuacaaugagauugcuaaguccagugcgcguaccaaauuacaauaugauaauaauggacgaagcgcauuuuaccgauccagcuucuauagcugcaaggggguauaucucaaccaggguaggaaugggugaagcugcagcgauauuuaugacagcgaccccucccggaucuguugaagcauuuccucaaaguaaugcgguuauacaggacgaggaacgugauauaccggagcgaagcuggaacucuggauacgauuggaucacggauuuuccaggaaagacaguuugguuugugccgucaauuaaaagcggaaaugauauagcuaauuguuugcguaaaaaugguaagagagugauccaacucaguagaaaaacauucgauaccgaauaucaaaagaccaaaaauaaugauugggauuauguuguaaccacugacauaagcgaaaugggcgcaaacuuccgagcugaucgggucauagauccccgcagauguuuaaagccugugauucuaaaagaugggcccgaacgaguaauacuagcagguccuaugcccguuacuguagccucagcagcucaacguagaggccgcaucggaagaaaucagaauaaagaaggagaucaguauguguauaugggacagccacugaauaacgaugaagaccacgcucauuggacugaagcuaaaaugcuauuagacaacauaaauacgccagaaggaaucauucccgcuuuauucgaaccagaaagagaaaaaucggcagcuauugacggggaauaucgacucagaggggaggcucgaaaaaccuuuguagaacuuaugagaagaggugauuuaccuguauggcuaagcuauaagguagcuucagagggauuccaauacuccgaucgaaggugguguuuugacggagaaagaaauaaccaggucuuggaagagaacauggaugucgagaucuggaccaaggaaggggaacgaaagaaacugcgaccgagauggcucgaugcgagaacguauucugauccgcucgcacuccgggaguucaaagaauuugcagcaggcaggcgaucuguauccggugaucuuaucuuagaaauaggaaaacuaccacaacaucuuacauugcgggcacaaaacgcauuagacaauuuaguaaugcuacauaacucugaacaaggagggaaggcuuaccgucaugcuauggaagaauuaccagacacaauugaaacauuaauguugcuagcauugauugccguucuuacaggagggguaacucucuuuuuccuaucaggaaaagggcuaggaaaaacuucaauaggcuugcuuugcguuacagcaucuagugcguuacucuggauggcgaguguugaaccacauuggauugcagcaaguauuauacuagaguucuuuuugaugguauuguugauuccagaaccagaccgucaacgaacaccacaagacaaccaacucgcuuacguaguaauaggauuacuauucaugauauugacaguagcagcgaacgaaaugggucuauuagaaaccacuaagaaagauuuagguaucgggcacguagcagcagaaaaucaccagcaugccacaauguuagauguggaucuaaggccagcaucagcguggacccuguaugcaguagcaacaaccgugauaacaccaaugaugcgucauacaauagaaaacacaacugcuaauauuucacugacggcaauugcgaaucaagcagcaauauuaaugggacuggauaaaggguggccaauaucaaaaauggauauaggaguaccucuuuuagcauuaggcugcuauagccagguaaauccacugacauugacagcagcaguguuaaugcuaguagcucacuaugcaauaauaggaccaggauuacaggcgaaagcaacacgagaagcccagaaaagaacagcagcggggaucaugaaaaauccuacaguagauggcauaguagcgauagacuuagaucccguagucuaugaugcaaaauucgaaaaacaauuaggccagauaauguuauuaauacuuugcacgagucaaauccuacuaaugcgaacaaccugggcauuaugugaaucaaucacacucgcaacagggccacuaacuacguugugggaagggucaccaggcaaguuuuggaacacuaccauagcaguauccauggccaauauauuucgcggaagcuaccuugcgggugccggauuggccuuuucuuuaaugaaaucacuuggaggagggcgaaggggaaccggugcgcaaggagaaacacuuggagagaaauggaaacggcaacucaaccaacuaaguaaaagugaauuuaauaccuauaagagaagcggaauaauggaaguugacagaucugaagcuaaagaaggcuuaaagcguggagagacaacuaaacaugcaguaucacgagggacagccaaauuaagaugguuuguagaacgcaaccuggugaagccagaaggaaaaguaauagaucuaggguguggucgaggaggcuggaguuauuauugugcagguuuaaagaaagugacagaaguaaaaggauacacuaaagggggaccagggcaugaagaaccgauaccuauggccaccuacgguuggaauuugguaaaacuacauucagguaaagauguauucuuuaugccaccugagaaaugcgauacacuccuaugcgacaucggagaaagcaguccaaacccaacuauugaagagggucguaccuuacgaguauuaaaaaugguagaaccuugguuaagagguaaccaauuuugcauuaaaaucuuaaacccauauaugccuagcgucguagaaacacuugagcaaaugcaaagaaagcacgguggaauguuagugagaaauccauuauccagaaauaguacucaugaaauguauuggguauccugcggcacggguaauauuguauccgcggugaauaugaccucacguauguugcucaaccgguuuacaauggcccaucgcaaaccgacauaugaacgcgacguugauuuaggcgcgggcaccagacacguggcaguagagccagagguugcuaauuuagauauaauaggucaaagaauugaaaauauuaaaaacgagcauaaaaguacauggcacuacgaugaagacaauccauacaagaccugggcuuaccauggaagcuacgagguaaagccuagcgggucagcuucuucaaugguuaacggagucguuagacuucuuaccaagccaugggaugugauuccaaugguaacacaaauagcaaugaccgauacaacgcccuucggucagcaacgcguuuuuaaggaaaagguggauacacgcacaccuagggcuaaacgugguaccacucaaauuauggagguaaccgcacgguggcuauggggauuucugucgcguaauaagaaacccagaauuugcacacgugaggaguuuacaaggaaaguacgaaguaaugcggcaauaggagcaguauuuguagaugaaaaucaauggaauagcgcaaaagaagcaguggaagaugaaagguuuugggaucuaguacauagagaacgagaauuacauaaacaagggaagugcgccacauguguauauaacaugaugggaaaacgagagaagaaauuaggagaguuuggaaaagcuaaaggaaguagagcaauaugguacauguggcuaggggcacgguuccuagaauuugaagcauugggauuuauuaaugaagaccauugguuuucaagagaaaauagucuaucagggguagaaggugagggccugcauaagcucggguauauacuccgugacauauccaagauaccuggaggcaacauguacgcagaugauacagcaggcugggauacucguauaacagaagaugauuuacaaaacgaggcaaaaaucacagauauuauggaacccgaacaugcgcuauuggcaacuuccauuuucaaauugacauaucagaacaaaguaguucgcguccaaaggcccgcuaaaaauggcacaguaauggaugucaucucuagaagagaucaaagagguucuggucagguaggcacuuauggacuuaauacuuucacgaauauggaagugcagcuaauuaggcaaauggaaagugaaggcauauuucuaccuagugaguuagagacucccaaucuagccgagcgcguacuagacuggcuggaaaagcacggagcagaacgacuaaagagaauggccauuagcggagaugauugugugguuaagcccaucgacgaucgauuugcuacagcucuuacagcguuaaacgacauggguaaagugcguaaagacauuccgcaaugggaaccaaguaaaggauggaacgauuggcagcaaguaccauucuguagucaccauuuucaccaauugauuaugaaagauggacgugaaauuguugugccuugccguaaucaagaugaauuggucgggagagcaagaguuagccaaggagcaggguggucacuacgugaaacagcaugccugggaaaauccuaugcccaaauguggcaguugauguacuuccacagaagggaccuacgucucgccgcaaacgcaauaugcuccgcagugccagucgacuggguaccaacuucuagaacuacauggaguauccacgcucaccaccaauggaugacuaccgaagauaugcuaaguguauggaaucgcguauggaucgaagaaaacccauggauggaagauaagacacacguaucgucaugggaggagguaccguaccugggaaaaagggaagaucaauggugugggucccuaauuggacuaaccgcgagagccaccugggcgacuaauauucaaguagcaauaaaucaaguaagaagauuaauagggaaugagaauuacuuagauuacauggcuagcaugaaacgauucaaaaaugaaagcgauccggaaggagcucugugguag

SEQ ID NO: 21441 - RNA, 9879 nt, Artificial Sequence
  derived and/or modified CDS sequence (opt6) from DENV-1__GU131834__SS-prME
agugugaccaugcuuuugauguugcugccuacggcauuagcauuccaucuaacgacccgagguggggaaccucauaugaucguaucuaaacaagaacguggcaagagcuugcuauuuaaaacgagcgcagggguuaacaugugcaccuuaauagcuauggaucuuggggaguuaugugaagauacaaugaccuacaaauguccuaggauaacugaagcugagccggaugauguagauuguugguguaacgcuacugauacauggguaacauaugggacaugcucucaaacgggggaacaccgcagagacaaaagaucaguugcacuugcuccacacguagguuuggggcuggagacacgcacggaaacauggaugucaucugaaggagcuuggaaacaaauucagcgaguagaaacuugggcauugagacauccagguuuuacaguaauugcguuguuucucgcucaugcaauaggcacgucaauuacccaaaaagggauaaucuucauacuucuuaugcucguaacaccaucaauggcaaugcguugcgucggaaucggaaauagagauuuugucgaaggacuaucaggagcaacguggguagaugucguacuggaacauggaaguugugucacgaccauggccaaaaauaaaccaacgcuagacauugaacuacuaaaaacagaagugaccaaccccgccgugcucaggaaauuauguauagaagcgaaaauauccaauacgacgacugauagccgcuguccaacacaaggcgaggcuacauuaguagaagaacaagaugcaaacuuuguaugucgacgaaccuucguugauagagguugggguaaugguugugguuuauuuggcaaagguucauuguuaacaugugcaaaauuuaaaugugucacaaaauuagaaggaaaaauaguucaauaugaaaaucugaaauauuccgucauagugacuguacacaccggugaccaacaucagguuggcaacgaaacgacagaacauggcaccauugcaacuaucacaccccaagcaccaacaagugaaauacaacuaacagacuacggcgcauugacccuagauuguagcccccgcacuggcuuagacuucaaugaaaugguguuauuaacuaugaaagagaaaagcuggcuuguacauaaacaaugguuucuggacuugccgcuaccauggacguccggagcuaguacuagccaagaaacauggaauagacaagaccucuuagucaccuucaaaacugcucaugcaaagaaacaagaagucgucguucucggaucgcaagaaggggcuaugcacaccgcacuaacaggagcuacggagauacaaacaucaggcacgacuaccauauuugccgggcaucugaaaugucgucucaaaauggacaaauugacgcucaaagguaugaguuacguaauguguacagguaguuuuaaauuagaaaaagaagucgcagagacacaacaugguaccguauuggugcaaguuaaauaugaagguacugacgcgccguguaaaauacccuuuaguacucaagaugaaaaaggaguaacacaaaacggccggcugauaaccgcaaauccgaucguaaccgauaaagaaaaaccaguaaauauagaaacagaaccaccauuuggugagucuuacauaguugucggagcaggagagaaaacguugaaacuuucuugguuuaagaaagggagcuccaucgguaaaauguucgaagcaacagcaaggggagcuaggagaauggccauccuuggagauacugccugggacuuuggauccauaggugggguguuuacgucuguugggaaauuagugcaccagguguuuggaacagcauacggugucuuauucaguggaguaucauggacaaugaaaauaggcauaggaauccuauuaacauggcugggacuaaauagccgaagcacaucauuaucaaugacuugcaucgcaguagggauggugacacuauauuugggcgucaugguucaggccgauagcggcugugugaucaacuggaaaggccgugagcucaaaugugguaguggaauuuuugugaccaacgaaguucauaccuggaccgagcaguauaaauuucaagcagauaguccaaagagguuaagcgccgccauagggaaggccugggaagaaggaguaugcggaauaagaucagcuacgcgacucgaaaauauuauguggaagcaaauuaguaacgaacuaaaucauauccuucuagaaaacgacaugaaguuuacaguaguagugggcgaugcaaaugguauucuagcccaaggcaagaaaaugauacgcccucaaccuauggagcauaaguauucauggaaaucauggggaaaagcaaaaaucauaggagccgacauacaaaacacaacauucauaauagacggaccugacacccccgagugccccgauggucaacgggcauggaacauaugggaaguugaagacuacgguuuugguauuuucacaacaaacauuuggcuuaaacugagagauuccuauacucaaaugugcgaccaccgccugaugagugccgcaaucaaggauaguaaagcaguacacgcugauaugggauacuggauagaaagugagaaaaaugaaaccuggaaacuagcacgggcgagcuuuauagaagucaaaacauguacauggcccaagucgcacacuuuauggaguaauggagucuuagaauccgaaaugauuaucccaaaaauuuauggagggccuauaucucaacauaauuaucgcccuggauauuucacgcaaacagcagggccguggcaucugggaaaauuagagcuagacuucgaucuuugcgaagggaccaccgugguuguagacgaacacugugguaauagaggaccgagucuacgaacgacaacagucacuggaaaaauaauacaugaauggugcugcagauccugcacccuaccuccuuuaagguuucgaggcgaagauggguguugguaugggauggagauaaggccagugaaagaaaaagaggaaaauuuaguaagaucuaugguaagugcaggauccggagagguagauucuuucagcuuaggaauccuuuguguuaguaucaugauugaagaaguaaugcgaaguagguggucgaggaaaaugcuuaugacaggaaccuuagccgucuuccuucuucucauuaugggacaguugacauggaaugaucuaauaaggcuaugcaucaugguuggcgcaaaugccagugauagaaugggcaugggcacgacuuaccuagcucuaauggccacauucaagaugcgaccaauguuugcaguugguuuacuauuuagaagauuaacaagucgcgaaguucucuugcuuacuaucggauuaagucuugucgcuucuguagaauuaccaaacaguuuagaagaacuaggagacggacucgcuaugggcaucaugaugcugaaacucuuaacugaauuucaaccucaucaacuuuggacaacguuacuauccuuaacauucguaaaaacaacguuaagucucgacuacgcuuggaaaacuacagccaugguacuaucaauagucaguuuauucccuuugugucuuucaacuacgucucagaaaacaacaugguuaccuguguuauugggaaguuucggaugcaagccacuaacuauguucuuuauaacugaaaauaaaauauggggaagaaaauccuggccacuuaaugaggggauuauggcaauuggcauuguuuccauucuuuuauccagucuacugaaaaaugauguaccuuuggcagguccuuuaauugcaggagggaugcugaucgcuuguuauguuaucagugguucaucggcagaccuaaguuuagagaaagcagcugagguuucaugggagcaggaggcagaacacucgggugcuucgcauaauauccuaguagaaguucaggacgauggaacaaugaaaauaaaagacgaagaacgugacgacacuuuaacaauuuuacuaaaagcgacuuuauuagcuguuagcggaguuuaccccaugucaauacccgcaacacuguuuguaugguacuuuuggcagaagaagaaacaaagauccggggugcuaugggacacuccaucuccgccagaagucgaaagagcgguucuggaugauggaauuuacagaauccuucaacguggcuuguuaggacgcucucaaguuggaguuggaguguuccaagauggggucuuucauaccauguggcaugucacaagaggagcuguacuuauguaccaagggaaacgccuugaacccuccugggcauccguaaagaaagaccucaucucauacggaggaggguggagauuccaagguagcuggaacacgggagaggagguacaaguaauagcaguggaaccagguaaaaauccaaagaauguccagaccaccccagguaccuuuaagacacccgagggagaagugggugccauagcuuuggauuucaaaccggguacaucggggagcccuaucgucaaucgugaagggaaaauaguugguuuauaugguaauggaguaguuacaacaaguggaacauauguaagcgccauagcucaggcgaaggcgagucaagaaggaccucuuccagagauugaagaugaaguauuuaagaaaagaaaccucacuaucauggaucuccacccaggcucuggcaaaacucgacgauaccucccugcaauaguccgugaagcuauaaagaggaaacucaggacccuaauauuggcaccuaccagaguaguagcuagugaaauggcagaagcgcuaaaaggcaugccgauaagguaucaaacuacugcuguaaaaucagaacacacaggcagagaaauaguagaucuaaugugccaugcuacauuuacaaugagacuauugagcccuguaagagugcccaauuacaauaugaucauaauggacgaagcucacuucacagauccagccucaauugcagcucgagguuauauaucaacucgugugggcaugggcgaggcugccgcuauuuuuaugacagccacaccuccgggaucuguggaagcauucccucagaguaaugcaguaauccaggaugaggaacgagauauaccugaaagaucauggaacucaggauacgauuggaucacagauuucccggguaaaacuguuugguuuguaccuucaauaaagagcggaaaugauauugcgaauugcuugaggaaaaauggaaaaagaguaauccaauuauccagaaaaacuuucgauaccgaguaucagaaaacuaaaaacaacgauugggacuaugugguuacaacugauauaagcgaaaugggugcuaauuucagagcagauaggguaauagacccccguaggugccuaaaaccgguaauacuaaaagacggacccgaaagaguaauauuagcaggccccaugccaguuaccguugcuagcgcggcacaacggagggggagaaucggacggaaccaaaauaaagagggagaccaguauguauauaugggacaaccguuaaauaaugaugaggaucacgcucauuggacugaagcaaaaaugcuauuagauaauaucaauacacccgagggaauuaucccagcauuauucgaaccagaaagggaaaagucagcugcgauagacggagaauaccgcuugcgaggagaagcuagaaaaaccuuuguagagcuuaugagaaggggagaucuuccagucugguuaaguuauaaagucgcuagugaagguuuccaauacucagaccguagaugguguuucgacggagaacguaacaaucagguauuagaagaaaacauggauguagaaauauggacgaaggaaggcgagcgaaagaaacuucgaccacguuggcuggaugcuagaacguacucagacccacuagcacugagagaauuuaaagaauuugcagcugggaggcggucaguaagcggagaucucauauuggaaaucgguaaacuuccacaacaucucacucugcgcgcucaaaaugcauuagauaaucuaguuaugcuccacaauucugaacaaggcggaaaggcuuacaggcacgcgauggaagaauuaccagauaccauugagacgcuuauguuguuagcauugauagcgguucuuacaggagggguaacucucuucuuuuuaucagggaagggauuagguaaaacauccauaggucuuuuguguguaaccgcuagcucugcacuccuguggauggcuucuguugaaccacauuggaucgcggcauccaucauacucgaauuuuucuugaugguauuauuaauuccugaaccugauagacagcggacaccccaagauaaccaacuugccuaugucgucauugguuuauuauuuaugauucuaacgguugcagccaacgaaaugggucuauuagaaacaacuaagaaagauuuaggaauuggauacguagccgcagaaaaucaccaacaugcuacaaugcucgauguagauuuacgaccggccucugcuuggacgcuuuaugcuguugcaaccacugucauaacaccuaugaugcggcacacaauagagaauacaacagcuaauauaucuuuaacagcaauagcaaaccaagcugccauccuaauggguuuagacaaggguuggccaauuucaaaaauggacauaggaguaccccuguuagccuuaggauguuacucccaaguuaauccauuaacguuaacugcugcgguucuaauguuaguggcucacuacgcuaucauagguccaggacuccaagcaaaggccacucgagaagcccaaaaacgaaccgcagcugggauaaugaaaaaucccaccguagauggaauugucgccauagauuuagauccgguagucuaugacgcgaaguuugaaaaacagcucggucaaauuaugcuacuaauucuaugcacaagccaaauccuauuaaugcgaacaacgugggcuuuaugcgaaucaaucacacuagccacuggaccgcucacuacucugugggaaggaaguccaggcaaauuuuggaacacuacaauugcgguaagcauggcgaacauuuuucgaggaucuuauuuagccggugcagggcuagcauucagucuuaugaaaucuuuaggaggagggcgaagggguacaggagcacaaggggagacccuaggagagaaauggaagcgacagcucaaccaauuaucaaagagugaauuuaauacauacaaaagaagugggauaauggaaguggacagaucugaggcaaaagaaggccuaaagagaggugaaacaacaaaacaugcggucaguagaggaacugcaaaauuaagaugguucguagaaagaaacuuagugaagccagaagguaaagucauagaccuagguugcgguagagggggauggucauacuauugcgcgggucuaaagaaaguuacagaggugaaaggcuauaccaagggcggaccgggacaugaagaaccuauaccuauggcaacauauggcuggaaucuggucaaguuacacucgggcaaagauguauucuucaugccaccagaaaaaugugauacauuacuaugugauauaggggagucaucaccuaacccaacuauagaggaggguagaacuuugcgcgugcuaaaaaugguagaaccguggcuaagaggaaaucaauucugcauuaaaauauuaaacccguauaugccuagcguaguagaaacuuuagaacaaaugcagcguaagcauggaggcauguuaguacgcaacccacugaguagaaacagcacacaugagauguacuggguaucaugcgguacaggaaacaucguaucagccguuaacaugacuucaagaaugcuacuuaauagauucacaauggcacauagaaaacccaccuaugaaagagauguagaucuaggagcaggcacacgccauguugcuguagaaccagaagucgccaacuuggauaucaucgggcaaagaauagagaacaucaaaaaugaacauaaaaguacuuggcauuacgaugaagacaacccuuauaaaacgugggcguaucauggauccuaugaaguuaaaccaagugguagcgcaucaagcaugguaaauggaguuguacgacucuuaacaaagccaugggaugucauaccuaugguaacacaaauugcaaugaccgauacuacacccuucggacaacaaaggguauuuaaagaaaaaguagacacaagaacuccacgugcgaagagagguaccacacagauuauggaagugacagccaaaugguuauggggauuuuuaucuagaaacaagaaacccaggauaugcacuagagaagaguuuacucgaaaagugcguucgaaugcugcaaucggugcggucuuugucgacgaaaaccaguggaacucugcaaaagaagcggucgaagacgaacgauucugggaucuuguacauagagaaagggaacuacacaaacaaggaaagugugcgacuuguguuuauaacaugaugggaaaaagagagaagaaacuaggugaauuuggaaaagcuaaagguaguagggcaaucugguauauguggcugggagcgagauucuuagaguucgaagcacucggcuucaugaacgaggaccacugguucucgagggaaaacucacucuccggaguggaaggugaaggcuugcacaaacuuggguacauucuacgcgacauaagcaaaauaccaggugggaauauguacgcggaugacacggcagguugggauacaaggauaacugaagaugauuugcaaaaugaggccaaaauuacugauauuauggaaccagagcacgcacuuuuagcgacaucaauuuuuaaacuaaccuaccaaaauaagguuguacgcguacaaaggcccgcaaagaacggaacuguuauggaugucaucucaagacgugaucaaagaggaucaggacaaguaggaacuuauggcuuaaauacauuuacuaauauggaaguucaauuaauucgacaaauggaauccgaagggauauuucuaccauccgaacuggagacaccaaaucuugcagagagaguacuagacugguuggaaaaacauggcgcagaaaggcuaaagagaauggccaucucuggagacgauugcguagucaaaccgauugacgaucgauuugcaaccgcgcuaacagcauuaaaugauauggguaaaguacgaaaagauauuccccaaugggaaccgucaaaagguuggaacgauuggcaacaaguuccuuuuuguucacaucacuuccaucaauugauuaugaaagauggacgagaaaucguuguuccuuguagaaaccaagaugagcuagugggacgugcaagagugucucaaggugcaggguggucacucagagaaacagcgugucucggaaaaagcuaugcacaaauguggcaacugauguauuuccauagaagggaucuuaggcuugcagccaaugcaaucugcagcgcugucccugucgacuggguuccaacuucaagaacuacauggagcauccacgcacaccaccaguggaugacaacagaagacauguugagcguauggaacaggguauggauagaagaaaauccauggauggaagacaaaacacaugugucuaguugggaggagguaccauaccuagguaaaagagaagaucaguggugcggcagucucauuggccuaacagcucgcgcuacaugggcuacaaacauucaagucgcaaucaaucaaguccgucgauugaucggaaaugaaaacuaccuugauuauaugaccuccaugaaaagauuuaagaaugaaucagacccagaaggugcuuuaugguaa

SEQ ID NO: 21442 - RNA, 9879 nt, Artificial Sequence
  derived and/or modified CDS sequence (opt6) from DENV-1__GU131835__SS-prME
ucggucaccaugcuacucaugcuucucccuacagcacucgcguuccauuuaacgacuagaggaggugaaccacacaugauagucucaaaacaagaaaggggcaaaagccuguuauucaaaacuucagcagggguaaacaugugcacuuuaauagcaauggaccugggggaauugugugaagauacuaugaccuacaaauguccgcgaauaacggaagcagaaccagaugacguugacugcugguguaacgcaacagauacauggguuaccuacgggacuuguucccaaacuggagaacacagaagggauaaacgauccgucgcacuagcaccacaugugggccucggacuagagacccgaaccgaaacguggaugagcuccgagggcgcauggaaacaaauacaacguguagagacaugggugcucagacacccagguuuuacaguuauugcauucuucuuagcgcacgcaauagguacaaguauuacacaaaaaggaauaaucuuuauacuacuaauguuaguuaccccuucuauggcuaugcgaugcguaggaauuggaaaucgagauuuuguggaaggccuauccggggcaacauggguggacgucgugcuugaacaugguagcugcguaacuacaauggccaaaaauaaaccaacucuagauauagaauugcugaaaacagagguaacuaacccugccgugcuuagaaaauuauguauagaagcaaaaaucucuaacacuacuacugauucacgauguccuacgcaaggcgaggcaacuuuggcugaagaacaagacgcuaauuucguaugucggaggacguuugucgaccgagguugggggaauggcugcggguuguuugggaaagguagcuuguugacgugugcgaaauuuaaauguguaacgaaacuggaaggaaaaaucgugcaauaugaaaacuuaaaauacucuguuauuguuaccguacacacuggagaccaacaucaaguugggaaugaaacaacugaacauggaacaauugcuacuaucacuccucaagcccccacuucagaaauucaacugaccgauuacggagcacugacacuagauuguagcccccgaaccggauuggacuucaaugaaaugguacuauugacaaugaaagaaaaaucguggcuaguccacaaacaaugguuuuuagacuuaccacugccauggaccaguggagcuucaacuucccaagagacauggaaccgacaagauuuacucguaacguucaaaaccgcucaugccaagaaacaagagguagucguuuuaggaucucaagaaggugcaaugcacacagcauuaaccggagcgacugaaauccaaaccagcgggacaacaacuauauucgcaggccacuuaaaauguagauuaaaaauggacaaguuaacauuaaaaggaacaucuuaugucauguguaccggcagcuuuaaacuugaaaaagaaguagcagaaacacaacauggaacaguacuuguucaggucaaauaugaagguacagaugcucccuguaaaauaccuuuuagcacacaagacgaaaaagggguaacucagaauggaagguuaauaacagcaaacccaauaguaacugauaaagaaaaaccaguaaacauagaaaccgaaccuccguucggcgaaucauauauuguaguaggcgcgggagaaaaggcuuugaagcugaguugguuuaagaaaggcaguucgauaggaaaaauguuugaggcuacagcacgcggcgcuaggagaauggcaaucuugggagauacagcaugggauuucgguaguauaggcgggguauuuaccagcgucgggaaacuuguacaccaaguauuuggaaccgcuuauggcguacuguuuucagggguaucauggacuaugaagauuggaauaggcauuuuacuuacuuggcugggcuuaaauucuagaagcacgagccucucaaugacuuguauugcagugggaauggucaccuuauauuuaggagucaugguccaagcagacucuggguguguaaucaacuggaagggcagagaacugaaaugcggguccggcauuuuuguaacaaaugaaguucauacauggaccgaacaauacaaauuccaagcagacuccccuaaacgauuauccgcagcaauugguaaggcaugggaagaaggaguuuguggcauucguagcgcgacucguuuagagaacauaauguggaaacaaaucucaaaugaauuaaaucauauacuauuagaaaaugauaugaaauucacaguaguggucggugacgcaaaugguauccuagcucaaggcaagaaaaugauaagaccacaaccgauggaacauaaauacucauggaaaucuugggguaaggcgaaaauaauaggugcagauauucagaacacaacuuucauaauagauggucccgauaccccugaaugcccugaugaccaacgagccuggaauauuugggagguagaagacuacggcuuugguauuuucacaacaaauaucuggcuaaaguuaagagacagcuacacucagaugugugaccauagauugaugucagccgcaauuaaggauaguaaggcaguucacgccgacaugggauacuggaucgaaagugagaaaaaugaaaccuggaaacuugcaagagcuaguuuuauagaaguaaaaacuuguacauggccaaaaagucauacacuuuggucaaaugguguacucgagagcgaaaugauaauacccaaaaucuacggaggucccaucucacaacauaauuacagaccaggcuauuuuacacagacggcaggcccuuggcacuuaggcaaacucgaauuagauuuugaccugugugaggggacuacaguuguuguugacgaacacugcggcaauagagggccaucucuacgcacaacaacaguuacgggaaaaauaauucaugaaugguguugccguucuuguacucuaccaccacuacgcuuuaggggagaagacgggugcugguauggaauggaaauccgaccggugaaggagaaagaggaaaacuuagugcguaguaugguuagugccgguaguggggagguagauucuuucaguuugggaaucuuaugcgucagcauaaugauugaggaggugaugagaagucgauggucaagaaagauguugaugacaggcacuuuagccguuuuucuccugcugauaaugggccagcuaaccuggaaugacuuaauaagacuaugcauaaugguaggagcaaacgccagugacagaaugggaauggguacaacguaucuugcuuuaauggcaacauuuaaaaugagaccaauguuugccguaggacucuuguuucgaaggcuaacauccagagagguccugcuucuaaccauaggacugagccuaguagcaagugucgaacuaccaaacucauuggaagaacuaggagacggccuagcaauggguauaaugauguuaaaacuuuugacagaauuucaaccucaccagcuauggacaacuuuguugaguuuaacauuuauuaaaacuacauugucacuagacuacgccuggaagacaaccgcuaugguauuaucgauuguguccuuguucccauuaugcuuaucaacaacaucacagaaaacuacaugguuaccaguauuacuuggaucauuuggauguaaaccauuaacaauguuccuuauuacagagaauaaaauauggggaaggaaaaguuggccucuaaacgaagggauuauggcgauaggcauuguuagcauauuacuaucaagucuuuuaaagaacgauguccccuuagcaggaccacuuaucgccggugguaugcuaauagcauguuacguuauaucaggaucgagugcugacuugucucuugagaaagccgcagagguaaguugggaacaagaagccgagcauucggguaccucacacaauauccuagucgaaguucaagaugauggcaccaugaaaauaaaagaugaagaacgcgacgauacacuuacaauacuauugaaagcuacuuuauuagcaguuagcggaguuuauccgaugucaauuccagcgacgcuuuucguaugguauuuuuggcagaagaagaaacaacguaguggaguccuaugggauacccccucuccuccagaaguggaacgugcgguacuggacgauggcauuuauagaauauugcaaagaggauugcuaggaagaucucaagucgguguaggcguauuucaagacggaguguuccauacuauguggcacguuacucgaggagcgguuuuaauguaccagggaaaaagacuggagcccaguugggcuucagugaagaaagauuuaauaucauauggagggggcuggcgcuuucaaggaucauggaacacuggcgaggaaguucaaguaauagcuguagaaccugggaaaaaucccaaaaacguacaaaccacgccagggacauucaaaacuccggaaggcgaagugggagcgaucgcauuagacuuuaagcccggaacauccggaucaccaauuguuaaucgagaagggaaaauuguagguuuauauggaaauggaguaguuacaacuagcgguacauauguuagcgcuauugcucaagcaaaagcaucacaagaagguccacuuccggagauagaggaugaagucuuuaagaaacgaaaucugaccaucauggauuuacaucccgguucaggcaaaacaaggcguuacuugcccgccauaguacgcgaggcaaugaaacgcaaauuaagaacacuaauccuagcgccuacgcgcguuguggcgagcgaaauggcagaagccuuaaaaggaaugccaauaagauaccagaccacagcagucaaaucagaacacacgggucgagaaauagucgaccuaaugugucaugcgacguuuacaaugcgucuguugucaccugugcgugugcccaauuacaauaugauuauaauggacgaagcacauuuuacagauccagcaucuauagcagcuaggggauacauaucuacuagaguggggaugggagaagcagcggccauuuuuaugacggcaacaccaccaggaagugucgaagccuuuccacaaucaaacgcgguuauucaagacgaagagagggacauucccgaaaggagcuggaacucugguuaugaauggauuacugauuucccagguaaaacuguuugguuugucccgagcauaaaaucugggaaugauauagcaaauugucuaaggaaaaauggaaaaagagucauccaauugucgagaaaaacauuugauacagaauaucagaaaacgaaaaacaaugauugggauuacgugguuacaacggacaucuccgaaaugggagcaaacuuucgggcagaccggguuaucgauccgagacgguguuuaaaaccgguuauacuaaaagaugggccugagcgaguaauauuagcaggaccgaugccugugacaguagcaagcgcagcccaaagaagaggacggaucggcagaaaucaaaacaaggagggagaccaguacguuuauauggggcagccuuugaauaacgaugaagaucaugcucacuggacggaagcaaaaauguuauuagauaauauaaauacgccugaagguauuauuccugcuuuauuugagccggaacgcgaaaaaucagcagcaauugauggcgaauaccgauuaagaggagaagcgagaaaaacguucguggaguuaaugcgucgaggugaccuuccuguauggcuuucauauaaaguagcuuccgaaggcuuucaauacagcgaucgaagaugguguuucgacggagaaagaaauaaucaaguauuagaagaaaacauggauguugagauuuggacaaaagagggugaacgaaagaaauuaagaccccgauggcuagacgcacgcaccuacagugacccauuagccuuaagagaguucaaagaguucgcugccgggagacgaucagucuccggagaccucauccucgaaauagggaaacuaccucaacaucuuacucugagagcucagaaugcacuagacaaucuaguaaugcuacauaauagcgaacagggcggaaaagcauauagacacgcaauggaagaacuuccggauacuauugaaacauuaaugcuguuagcacucauugcaguacugacaggagguguaauguuguuuuuccucucuggcaaagguuugggaaaaacaucaauaggucugcugugcguaaccgcgucgucugcucuauuauggauggcaucuguggagccccacuggauugcagcgaguauagugcuggaauuuuuccucaugguucuuuuaauaccagaaccggaucgacagcgaacuccgcaggauaaccagcuggcauacguagucauagguuugcucuuuaugauauuaacaguagcggcuaacgaaaugggauuauuagaaacaacuaagaaagaccucggcaucggucacgcagcagccgaaaaucaccaacaugcaacaaugcuugauguugaccucagaccagcgucagcauggacccuuuaugcugucgcgacaacaguaauaacaccgaugaugagacacacaauugaaaacacuacugcgaauauuucuuuaacggccauagccaaccaagcagccauacuuaugggucuagauaaaggcuggccaaucaguaaaauggacauaggcgugccauugcucgcauuaggauguuauagccaaguuaauccuuuaacuuuaacugcugcugugcuaauguugguagcgcauuacgcaauaauagguccgggucuacaagcuaaagcgacaagagaagcacagaaaagaaccgcugcaggaauaaugaagaacccaacgguugacgguauuguugcgauagaccuggauccugucguauaugaugcuaaguuugaaaaacaauuaggacaaauuaugcuauuaauacuuugcacuucacagauauugcuaaugagaacaaccugggcguuaugugaaucuauaacccucgcuaccgggccacuuaccacgcuuugggagggcuccccgggcaaauuuuggaauaccacaauugcagucucuauggcaaauauuuuccgaggaagcuaucuagcaggggcaggauuagcguuuucccucaugaagagucuaggggguggcagaagagggaccggagcacaaggugaaacauuaggugagaaauggaaaagacaauuaaaccaguugucaaaaccagaauuuaauacuuacaaaagaucuggcauaauggaaguagacagguccgaagcuaaggaagguuugaaacgaggagaaacgacaaaacaugcuguuaguagagguacugcaaaacuucguugguuuguugagagaaaccuggucaaaccugaaggaaaaguaaucgaucuaggguguggaagaggagguuggucauauuacugugcgggacuuaagaaaguuaccgaggucaaaggguacacaaaaggagggccuggacacgaagaaccaauacccauggccacauacggauggaacuuaguuaaguugcacaguggcaaggauguauucuuuaugcccccugaaaaaugcgauacauuguuaugcgacauuggcgagucgaguccaaauccaacaauagaagaaggacgcacuuugcguguguuaaaaaugguggagccguggcuuagaggcaaccaauucuguauuaagauacuaaacccguauaugccuacaguggucgagacacuagaacaaaugcagcgcaagcauggagggaugcuggugaggaauccacuuucuagaaauucgacacaugaaauguacugggucagcugugggacuggcaauauuguuucggcuguuaacaugacaaguaggaugcuucuuaauagauucacaauggcucaccggaaaccaacauacgagcgagauguagacuugggagcugguaccaggcaugucgcuguagaaccagagguugcaaaccuugauauuauuggccagaggaucgaaaauaucaagaaugaacauaagucuacuuggcacuacgacgaggauaauccguacaaaacuugggcuuaucaugguucguacgaaguaaagccgagugguucggcaaguuccaugguaaauggaguuguaagauuauuaacuaaaccuugggacgucaucccuauggugacucaaaucgcaaugacagacacuacgcccuuuggccagcagcguguuuuuaaagaaaaaguagauacaagaacucccagagcuaagcgagggaccacacaaauaauggagguaaccgcuaaauggcuuuggggcuuucucagcagaaacaagaaacccaggauauguacgagagaagaauuuaccagaaaagugcguucgaaugcagcaauaggagcaguauucguggaugagaaucaguggaacucggcuaaagaggcaguugaggacgaaagguuuugggaucuuguucaucgggaaagagaauuacauaaacaaggcaaaugcgccacaugcguauauaacaugauggguaagagggagaagaaacuaggagaguucggcaaagccaaagggagcagagcgauaugguauauguggcuaggugccagauucuuagaguuugaggcccuuggauucaugaacgaggaucauugguuuucacgggagaacagcuuaagcgguguagagggcgaaggguuacauaaacugggcuauauacugcgugauaucucaaggauaccggguggcaauauguacgcugaugauacugcaggcugggacacacggaucacagaagacgauuuacaaaaugaagcaaaaaucacagauauaauggaacccgagcaugccuuauuagcuacaagcaucuuuaaacucacauaucaaaauaaagugguaagaguacaaagacccgccaaaaaugguacuguaauggacgugauuucuagaagagaucaaagagguuccggacaagugggaaccuacggacugaauacauuuacaaauauggaaguacaacuuauuaggcagauggagucagaggggauauuucuaccuagcgaacuagaaacaccuaauuuagccgaaagaguucuagauuggcuagaaaaacauggugcugaaaggcuaaagagaauggcaauaagcggggaugacugcgugguaaagccaauugaugacagauuugcaacaucgcuaaccgcguuaaaugacauggggaaaguuagaaaggacauuccacaaugggaaccaaguaaaggguggaacgacuggcagcagguuccauuuuguucacaucauuuucaucaauugauaaugaaagauggacgagagauugucguaccgugcaggaaucaggacgaguuaguuggacgcgcaagagucagucaaggggcaggaugguccuuacgugaaacugcauguuuaggaaaauccuaugcacaaauguggcaguugauguacuuucaucguagggaccuucgguuggcugcuaaugcuauauguucagcaguaccuguagauuggguaccaacaagccgaacuacuuggucuauucaugcccaucaucaauggaugaccacagaagacauguugagcguauggaacagaguuuggaucgaagaaaauccauggauggaagauaagacccauguaagcucaugggaagaggugccauauuuagguaaaagggaagaucaauggugcggaucauugauuggacugacugcacgagcaacaugggcgacaaacauucaaguagcuauaaaucaagugagaagauuaauugggaaugaaaauuauuuagacuauaugacaucaaugaaacgguuuaagaacgaaucagaccucgagggggcccugugguga

SEQ ID NO: 21443 - RNA, 9879 nt, Artificial Sequence
  derived and/or modified CDS sequence (opt6) from DENV-1__GU131836__SS-prME
uccguaacaauguuauuaauguuauugccaacugcuuuagcauuucaucucacgacucgaggaggagaaccccauaugauaguuuccaaacaggaacgcgguaaaucccuauuguuuaaaacaucggccggagugaauauguguacauuaauugcaauggacuuaggagaauugugugaagacacgaugacauauaaauguccgcggauuacugaagcagaaccugaugacguagauugcugguguaacgcaacagauacuuggguaaccuauggaacgugcucacaaaccggcgaacaccgucgugauaaaaggucaguggcguuggcuccacauguaggucuuggacucgaaacgagaacagaaacuuggaugaguucagagggagcguggaaacaaauacaaaggguagagacaugggcccuuagacacccggguuuuaccguaauagcauuauuucuagcccacgcuauugguacgucuauaacacaaaaagguauaauauucauauuacuaaugcucguaacgccauccauggcaaugcgaugcguagggauugggaaccgugauuucguagaaggauuaucuggggcuacguggguggauguaguauuagaacauggaucauguguuacuacaauggcgaaaaacaaaccaacacuugacauagaacuacuuaaaacagaaguaacgaaucccgcaguccuaaggaaacuauguauagaggcuaaaaucaguaauacaaccacagacucgcgauguccgacucagggagaagcaaccuuaguugaagaacaggaugcaaauuucguaugucggcgcacguucguagaccggggaugggguaauggcugugguuuguucgggaaaggaucguuauuaacgugcgcuaaauucaaauguguaacaaaacuggaaggaaaaauuguacaguacgaaaaccuuaaauauucaguuaucguaacgguacauacgggugaucaacaucagguaggaaacgaaaccacagagcauggcacaauagcaacuaucaccccgcaagcucccacgucagaaauacagcucacagauuauggugccuuaacucuugacuguucaccuagaaccggguuagauuuuaaugaaaugguauuacucaccaugaaagagaaaaguuggcuagugcauaagcaaugguuuuuggaccuaccacugccuuggacuucuggagcaucuacgagccaggaaaccuggaaucgacaagauuuauuggucacauucaagacagcgcaugcgaagaaacaagaaguugugguacuaggaucgcaggaaggcgcaaugcauacugcuuuaaccggugcuacagaaauacaaacaucuggcacuacaacgauauuugcuggucaccuaaagugcagguuaaaaauggacaaacuuacguuaaaaggaacaagcuacgucauguguacugguaguuuuaaacucgagaaagaaguagcugaaacacagcaugggacaguauuaguacagguuaaauaugaaggaacugaugcgccaugcaaaauaccuuuuucaacucaggaugaaaaaggugucacacagaacggaagacuuauaacugcaaauccaauuguaacugauaaagagaagccgguaaacaucgagacugaaccacccuuuggggaauccuauaucguagugggcgcaggggaaaaggcacugaaguugucaugguuuaagaaaggaagcaguauagguaaaauguuugaagcaaccgcaagaggugcaagacgaauggcuauacuaggugauacagcgugggauuuuggaagcaucgggggcguuuucacguccgucgguaaacucgugcaucaaguguuuggcacugcuuacgguguccuauuuucuggcguaagcuggacaaugaaaaucggaauaggaaucuuauuaaccugguuaggacucaauagcaggucgacaucuuuaagcaugacguguauugcggugggaauggucacucuguaccugggaguaaugguucaagcagauagugguugugucauuaauuggaagggaagagaauugaaaugcgguaguggcauauuuguuacaaaugaaguucacacauggacagagcaauauaaauuucaggccgacaguccaaaacgacuaucagcagcgauuggaaaggcgugggaagagggaguuugugguauacguagugcaacacgccuagaaaacaucauguggaagcaaaucucaaacgaauuaaaucauauauuauuagaaaacgacaugaaauucaccgugguagucggagaugcuaacggaauccuaguccaaggaaagaaaaugauaagaccucaaccuauggaacacaaauauagcuggaagucauggggaaaggcaaaaauaaucggugccgacauacaaaacacuacauucaucauagauggcccugacacacccgaaugcccagacgaucaaagggcguggaauauuugggaaguagaagacuaugguuucggaauauuuaccacuaauauauggcuuaagcugagggauagcuauacucagaugugcgaucauaggcuaaugucggccgcaauuaaggauucuaaagcaguccaugcagauaugggcuauuggaucgaaucugaaaagaaugaaacuuggaaacuuucuagggcuuccuucauagaaguaaaaaccuguacguggccaaagagucacacgcucuggucgaauggagugcuugaaagcgaaaugauaauaccgaaaauauauggaggaccaauaucgcaacauaauuaucggccaggguacuucacacaaacugcggggccauggcaucugggcaaacuagaguuagauuucgauuugugugaaggaacgacuguaguaguagacgaacauuguggaaaucgugggccuucgcuuagaacaacaacaguaaccggaaagauaauacaugaaugguguugcaggucuugcacauuaccaccccuuagauuuaggggugaagaugguugcugguacgguauggaaauaagacccgugaaagaaaaagaggaaaauuuaguacggucuaugguaagcgcgggaagcggagaaguagacuccuuuucauuaggaauccuaugcguaucaauaaugauugaagaaguuaugaggucaagauggucacgaaaaaugcuuaugacgggcacacucgcaguauuuuuacuacuuauaaugggucaacuaacauggaacgaccuaauacgacucugcauuaugguaggagccaacgcaagugauagaaugggaaugggcaccacuuauuuagcauuaauggcaacguuuaaaaugagacccauguuugcaguaggacuuuuguucagaagacuaacaaguagagagguccuauugcucacgauuggguugagccugguggcaucaguagaauuaccgaacucgcuagaggaacucggagacgguuuagccauggguauuaugaugcuuaaacuauuaacugaauuucaaccgcaucaacuguggaccacccuauuaucccuuacguuuaucaaaaccacuuuaucucuugauuaugccuggaaaacaacugccauggccuugucuauuguuucauuauuuccacuuugucuaagcacuacuucucagaaaacuacauggcuaccaguccuccuagguaguuuugguuguaaaccuuuaacuauguuucugauuaccgaaaauaagauuuggggcagaaaauccuggccacuaaaugaagggaucauggcaauugggaucguaucaauucuucuuucaaguuugcugaagaacgacgugcccuuagcaggaccucuaauagcgggaggaaugcucauagcaugcuauguaaucagcggcagcuccgcagacuugagcuuagagaaagcagcagaaguuucaugggaacaagaagccgaacauagugggaccagccauaacauuuuaguagaaguacaagacgauggaacaaugaaaaucaaagacgaagaaaaggacgauacacuaacuauuuuauugaaagcaacacuacucgcaguuucggguguguauccgaugagcauaccugccacacuuuuugucugguacuuuuggcagaagaagaaacagcgaucaggagugcuaugggauacuccaucaccgccugaggucgagagagccguauuagaugaugguaucuauagaauacuacaaagaggauuauugggcagaucgcaaguaggggugggaguauuccaagacggagucuuccauacuauguggcacgugacuagaggcgcuguacuaauguaccaagguaagcgccuagagccaucgugggcaucugucaagaaagauuuaauuaguuacggugguggauggcguuuccagggaucauggaauacgggugaggaaguucaaguuauagcgguugaaccaggcaaaaauccgaaaaacguccaaacuacaccaggaacuuucaaaacaccagaaggagaaguaggagcgauagccuuggacuucaaaccaggaacaaguggcaguccaauugugaaucgugaaggcaaaaucguaggauuauacgggaacgguguuguuacgacaucagguacguacguuucagcaauugcccaagcuaaagcaucucaagaaggaccacuaccggaaauugaagaugaaguuuucaaaaagagaaaucucacuauaauggauuuacaucccggcagugguaagacuagacgauaucucccugcaauuguuagggaagcaauaaaacgaaaauuaagaacucuaauacuugcgccuacuagaguagucgcaagcgaaauggcagaagcucuaaaaggcaugcccauuagguaccaaacaacagcugugaaaucggaacacaccggucgugaaauuguagauuuaaugugccaugcaaccuuuacaaugcgacuuuuaaguccaguacgaguaccuaauuacaacaugauuauuauggacgaagcccauuucacagacccggcgagcauagcagcgagaggauauaucucuacucgcguagguaugggggaagccgccgccaucuuuaugacggcgacuccaccuggcuccguagaagcguuuccucaaagcaacgccguuauacaggacgaagagagggauauaccugaaagauccuggaacaguggguaugauuggauaacagauuucccggguaaaacgguaugguucgugccauccauaaaaucugguaaugacauugcaaauugucuacgcaagaacggaaaaagaguaauucagcuauccagaaaaacguuugauaccgaauaccagaaaaccaaaaauaacgauugggacuauguggugacaacagacauaagcgaaaugggugcaaauuuuagagcagauagaguaauugauccgcgucgaugcuuaaaaccaguaauccuuaaggauggaccagaacgggugauacuggcgggucccaugccgguuacgguagccucugcggcccaaaggaggggacgcauuggucgcaaucaaaacaaagaaggugaccaauacguauacaugggacaaccccugaacaacgaugaggaucacgcccauuggaccgaagcgaaaaugcuauuggacaauauaaauacaccagaaggaaucauuccggcacucuucgaaccugaacgugagaagucagccgcaauagacggagaauaucgucuucgaggagaagccaggaaaaccuuuguagaauuaaugagaagaggggauuugccaguauggcuuucauacaaaguugcaucggagggauuccaauauucagaucgaagaugguguuuugauggagaacgaaauaaccaagucuuagaggagaacauggacguagaaaucuggacaaaagaaggggagagaaagaaauuacgcccaagauggcuagaugcuaggacuuacucagaucccuuggcucugagggaguucaaagaauuugcugccggucgaaggucaguuucaggugaucuaauauuagaaauuggaaaauugccucaacaucucacacugagagcccagaacgcacuugauaauuugguaauguuacauaacucagaacaagguggaaaagccuacaggcaugcaauggaagaacuaccagauacuauagaaacacuaauguugcuugccuuaaucgcaguuuuaaccggaggagugacuuuguucuuucuauccgguaagggauugggcaagaccaguaucggacuucugugcguuauggcaucaagugcauugcucuggauggcaucaguagaaccgcauuggauugccgccagcauaauacuugaguucuuucuaaugguucuauugauccccgagccagauagacaacgaaccccgcaagauaaccaguuagccuacguaguaauagguuuauuauuuaugauccuaacaguagcagcgaacgaaaugggucuauuagagacaacaaagaaagauuuggguauagggcauguagcagcugaaaaucaccaacacgcuacaauguuagacguagauuuaaggccagcaucagcauggacauuauaugccgucgccacaacagugauaacucccaugaugcgccauacaauugagaauacaacggcgaauauuucucuaacagccauagcaaaucaggcagcaauucuuaugggcuuggauaaaggcuggccaauauccaagauggauauaggagucccauuacucgcuuuaggaugcuacagccaagucaauccucugacucuaacagcggccgugcuaauguuaguagcucauuaugcaauuaucggcccuggucuucaagcaaaagcaacuagagaagcucaaaaacggacugcagccggcauaaugaaaaaucccacugucgaugguauugucgcuauagacuuagauccuguaguuuacgacgccaaauuugaaaaacagcucggccaaauaaugcugcugauccuuugcaccucccagauccuccugaugagaacgacaugggcgcucugcgagaguauuacacucgcaacuggaccuuuaacuacucuaugggaagguaguccuggcaaguuuuggaacaccaccauugcuguauccauggcaaacauuuuuagaggaucauaccuagcaggggcaggauuggcuuuuagucucaugaaaucauuaggagguggucggcguggcacaggagcacaaggugagacauuaggugaaaaauggaaaagacaguuaaaccaacuaucuaaaagcgaauuuaauacauauaagcgaucagguauuauggaaguagauagaucugaagcaaaagaaggacugaagcgaggagaaaccacuaaacacgcuguaagcaggggaaccgccaaauuaagaugguucgucgagagaaauuugguaaagccagaaggcaaaguuauagaucuaggaugugguagaggaggcugguccuacuauugugcuggauugaagaagguaaccgagguaaagggcuacacgaaaggagggcccgggcacgaagaaccaauaccaauggcaaccuacggauggaacuugguuaagcugcauucagguaaggauguauuuuucaugccacccgagaaaugugauacacuguuaugcgauaucggagaauccucuccaaacccaacaauagaagaaggaagaacacuacgaguauugaaaauggucgaaccaugguuacgugggaaucaauuuugcauuaaaauccuaaauccuuauaugccuagcgucgucgaaacacuagaacaaaugcagagaaagcauggagggaugcuaguacguaauccuuuaucaagaaauuccacacacgaaauguauuggguaucaugcgguacuggaaacaucguaagcgccgugaauaugaccucuagaaugcuccucaauagauucacuauggcgcaccguaaaccaacauaugagcgugaugucgaucucggugcggggacuagacauguagcaguagaaccagaagugccgaauuuggauauuauaggucagcgcauagaaaauaucaaaaaugagcauaaaagcacauggcacuacgaugaggacaauccuuauaaaacuugggcauaucacggcuccuaugaagucaagccgaguggaagugccucuaguauggugaauggaguggugagguuauuaacaaaaccaugggauguuauaccuauggucacccaaauagcuaugacugauaccaccccguucggacaacagagggucuucaaagaaaaaguagacacucgaacgccucgagccaaacguggaacaacucaaauaauggaaguaacggcaaagugguuauggggguucuugucaagaaacaaaaagccucgaauuuguacacgugaggaauuuacuaggaaaguucgaucaaacgcugcaaucggagcgguauuuguagacgaaaaccaauggaacucagcuaaggaagccgucgaagacgaacgauuuugggauuuaguacauagagaaagggaacuccauaaacagggaaaaugcgcuacuuguguauauaauaugaugggaaagagggaaaagaagcuaggugaguuuggaaaagccaaagguucaagagcuauuugguauauguggcuaggugcaagguuuuuagaguucgaagcguuaggauuuaugaacgaagaccauugguucuccagagaaaacaguuuaucgggcguugaaggugaaggacuacauaaauuagguuacaucuuacgagacauuaguaaaauacccggagggaauauguacgcagaugauacagcaggaugggauacucgaauaacagaagaugaucugcagaaugaagcuaagauuaccgacaucauggaaccgggacacgcuuuauuagcaaccaguauauuuaaacuuaccuaucaaaauaaaguugugcggguacaaaggccugcgaagaauggcaccgucauggacgucauaucgagaagagaccagagagguuccggacagguuggaacauauggucucaacacauucacuaacauggagguacaauuaauccgacagauggagucagaagguauauucuuaccuucagaauuagaaacaccuaacuuagcggaaagaguuuuagauugguuagagaagcauggugcagagagauugaagaggauggcaaucucaggagaugauugcguagucaagccaauagaugaucgauuugccacagcucugacugcguuaaaugacaugggaaaaguucgcaaagauauaccacaaugggaacccucaaaaggcuggaacgauuggcaacagguuccuuuuuguucacaucauuuucaccagcuuauaaugaaggauggaagagaaauaguugucccguguagaaaccaggaugagcuaguuggacgagcccgagugagucaaggggcgggguggagcuugagagagaccgcuugucuagggaaaucuuaugcccaaauguggcaacucauguauuuccaucgacgagaccuccguuuagccgcuaacgcuauauguagugcuguaccuguggacuggguaccaacaucacgaacaaccugguccauacacgcucaucaccaauggaugacaaccgaagacaugcuaucaguuuggaacagaguuuggaucgaagagaaucccuggauggaagacaaaacucacguaucaucaugggaggaagugccauauuuaggaaaacgagaagaucaaugguguggaucauugaucggucucacagcaagagcgacaugggcaacgaauauacaagucgcaauaaaucaaguacgaagacuaauuggaaaugaaaauuaucuagacuauaugacauccaugaagagauucaaaaaugaaucagauccugaaggggcguuaugguaa

SEQ ID NO: 21444 - RNA, 9879 nt, Artificial Sequence
  derived and/or modified CDS sequence (opt6) from DENV-1__GU131837__SS-prME
agugugacuauguuguugaugcuauugccgacugcguuagcguuucauuugacuacgcgaggaggggaaccgcauaugauagugagcaaacaagaacguggcaaaucucuuuuauucaaaacuucggcaggagugaauauguguacguuaauagcuauggaucuaggcgaacucugugaggauacaaugacguauaaaugcccacggaucacagaagcugaaccugaugacguagacugcugguguaaugcaacugauacuuggguaacuuacggaacauguucacaaacuggagaacaccgacgagauaaacgcagcguagccuuagcaccacauguaggucuaggacuagaaacaagaacagaaacuuggaugaguagcgaaggagcauggaaacaaauacaaagaguagaaacgugggcgcuaagacacccaggauucacaguuauagccuuauucuuggcacacgccauaggaacaucuauaacacaaaaaggaauuauauucauucuacuaauguuaguuacuccuuccauggcuaugagauguguugguaucgggaaccgagauuuuguagaaggucuaaguggggcaacaugggucgacguaguauuagaacauggaucgugcguuacgacuauggcuaaaaacaaaccaacauuagauauugaacuacugaaaacugaaguaacuaauccggcuguguuaagaaaacuuugcauugaagcgaaaauuaguaacacaacgacagauuccagguguccaacccaaggugaagccacgcuaguagaggaacaagaugcgaacuucguaugucgacgcacauuuguagauagaggguggggaaacggaugcgguuuauuuggaaaaggcucauuacuaacaugugcaaaauuuaaauguguaaccaaguuagagggaaaaaucguacaauaugaaaaucuaaaauacuccgucauuguaaccguacauacaggggaccaacaucaagucggaaacgaaacaacggaacacggcacaaucgcuaccauuacgccucaggcuccaacaagugaaauacaacuaacagauuacggagcccucacucucgacugcucuccuaggacaggacuugauuuuaacgaaaugguucuauuaacgaugaaagaaaaaucauggcuaguacacaagcaaugguuuuuggaucuaccgcuuccuuggacaagcggagccucuacaagucaagaaacguggaacaggcaagauuuauugguuacuuuuaaaacagcucaugccaagaaacaagaagugguaguauuagggucucaagaaggggcaaugcacacagcucuaacaggagcaacggagauacaaacaucugggacaacgacuauauucgcugggcaucuaaagugucgauuaaaaauggacaaacucacguuaaaagggaugagcuacguuauguguaccgguagcuuuaaguuagaaaaagaaguugcggaaacacagcaugguacuguccuaguacaggucaaauacgaaggaacugaugcaccguguaagauccccuucucaacccaagaugaaaaaggagugacacaaaauggacgucugaucacagcuaauccaauaguuacggacaaggaaaaaccaguaaacauagaaacagagccgccauucggggaaucauacauuguaguuggcgcaggagaaaaagcauuaaaauuaucaugguucaagaaaggaucgaguaucggaaagauguuugaggcuacagcacgaggugcaagacgcauggcaauauuaggagauacggccugggauuuuggcucuauaggcggcguauucacauccguugguaaauuagugcaucaaguguuuggaacggcauauggcguccucuucaguggaguaucuuggacaaugaaaauaggcaucggaauauugcuuaccugguuaggucucaauaguaggagcacaagucuuucuaugacguguauagcggucgguauggucacacuuuacuugggcgugaugguucaagcugauaguggauguguuauaaacuggaaaggcagggaacuuaaaugcgggucaggaauuuuuguaacaaaugaaguucauacauggaccgaacaauauaaguuccaagcugauucaccaaaacgguuaagcgcagcuauuggcaaagcaugggaagaaggaguaugcggaauacguucugccaccagguuggaaaauauuauguggaagcaaauaagcaaugaacucaaucacauccuuuuagaaaacgacaugaaauucacgguagucguuggagaugcaaacgggauucuugcgcaaggaaagaaaaugauacggccacaaccaauggagcacaaauacucauggaaaagcuggggaaaagcaaaaaucauaggcgccgauauucagaacacuacauuuauaauagacggaccggacacgccagaaugucccgacgggcaaagagcauggaacauaugggaaguugaagacuauggauuugguauauuuacgaccaacauuuggcugaaguugcgagacuccuauacacaaaugugugaccauagacuaaugucagcugccauaaaagacucaaaggcaguccacgcggauaugggauacuggauugaaagugagaaaaaugaaacguggaaguuagcuagagcaucauuuauagagguuaaaacauguaccuggccuaaaucacauacauuauggaguaacggcguacuugagucagagaugauaauacccaaaauauauggugguccaauuagccaacauaauuaccgaccaggcuacuucacccaaacugcaggacccuggcaucugggaaaacucgaguuagauuucgauuuaugugaaggaacaacagugguaguagaugaacauuguggcaacagaggcccaaguuuaaggaccacuacagugacaggaaagauaauacacgaaugguguugucgaucuuguacucuacccccuuuacgauuccgaggugaagacgguugcugguacggaauggaaauccgacccgugaaagagaaagaagagaaccuuguaagauccaugguaucggcggguucgggagaaguggacucguuuagucuagguauauuaugcguaagcauaaugaucgaagagguuaugcguucuagauggucacgaaagauguuaaugacaggaacacucgcuguauucuugcugcucauuaugggacaauugacauggaaugaccucauaagauuauguauuaugguuggugccaacgcaucugaucggaugggcauggggacaaccuauuuagcacuaauggcaacauuuaagaugagaccuauguucgcagugggauuacuguucagaaggcucacaaguagagaaguucucuuacuaacaauaggauuaucucuuguggccucuguugaguugccaaauucauuagaagaacugggugacgggcuugccaugggcauaaugauguuaaaauuauugaccgaauuucaaccacaccaauuauggacaacgcuacuaucacuuaccuuugugaagaccacuuugucgcuagauuaugccuggaaaacaacggcuaugguguuaagcauuguaagucucuuuccguugugucuaaguacaacaagccaaaagacuacgugguuacccguccuacugggaucguuugguuguaaaccucugacaauguucuugaucacugaaaacaaaauaugggggaggaaaucauggccacucaacgaggguauuauggcaauaggaauaguuucaauauuacucagcucacuacucaaaaacgacgucccuuuagcggggcccuugaucgcuggcgggauguuaaucgcauguuauguaauaagugggucaagugcagaucuaucccuagaaaaggccgcagaaguaucaugggaacaagaagcugaacacuccggagccagucauaauauccuaguagaaguucaagaugaugguacuaugaaaaucaaagacgaagagagagaugauacacuuaccauauuacuaaaagcaacacuacuagcuguaucaggaguauauccuaugucuauaccagccacucuauuugucugguacuucuggcagaaaaagaaacaacguuccggggugcuaugggacacaccaagucccccugaaguagaacgagcuguauuggaugacgguauauacagaauauuacaacgaggccuucuaggacgaagucaaguagggguuggagucuuucaagauggggucuuucauacgauguggcacguaacaagaggagcaguucugauguaccaaggaaaaagauuggaaccuuccugggcaucaguuaaaaaggaccuaauaaguuaugggggcgguuggagguuccaagggaguuggaacaccggugaagaaguacaaguaaucgccguagaaccagggaaaaacccgaaaaauguucagacuacuccaggaacguuuaaaacaccugagggugagguaggagcaauugcuuuagauuuuaaaccaggcacaucaggcaguccaauaguaaauagagaggggaagauagucggguuauauggaaacggcguuguuacaacaagcggcaccuauguuucagcuauagcccaggcaaaggcuucccaggaaggaccauuaccugagauugaagacgagguguucaagaaaagaaauuuaacuauuauggaucuucauccagguucagguaaaacacgcagauacuugccagcgauuguuagggaggcuaucaagcguaaacucagaacacugauacuugcgccaacaaggguuguagcaucggagauggcugaagcgcuaaaaggaaugccaauaagauaucaaaccacugccgugaaaucugaacacacggguagagaaaucguugaccuaaugugccacgcaacuuuuacaaugaggcuccuaucaccuguaaggguaccaaauuacaacaugauaauuauggacgaagcacauuucacugacccugcguccaucgcggcgcgagguuacauaagcacccgugugggaaugggagaagcagcggcuauauuuaugacggccacgccuccaggaucaguugaggcuuuuccacaaucgaaugcagucauacaagacgaggaaagggacauaccagagagguccuggaacucaggauaugauuggauuaccgauuucccuggcaagacuguaugguuuguucccaguauaaagucagggaacgauauagccaauuguuugcggaaaaauggaaaacggguuauucaacuaucucgcaaaacauuugauacggaauaucagaaaacuaagaacaaugacugggacuacguaguuacuacugacauuagugaaaugggcgcaaacuuccgagccgauagaguaaucgauccacgaaggugucuuaaaccgguuauauuaaaagaugggccagaaagggugauacuugcagguccgaugccgguaacgguggcaucagcagcacaaagaagagggagaauugguagaaaucaaaauaaggaaggagaucaauauguuuauaugggacaaccacuuaacaaugaugaagaucaugcucacuggacggaggcaaagauguugcuugacaacauaaacacacccgaagggauaauucccgcgcuauuugagccagaaagagagaagucagcagcaaucgauggagaauaucgauuaagaggugaagcuagaaaaacauucguggaacuuaugagacgcggugacuuaccuguaugguugucuuauaaaguugcaagugagggauuccaauacucagaccggaggugguguuucgauggugaacggaauaaucaaguauuagaagaaaauauggacgucgaaauauggacaaaagaaggggagaggaagaaauuaaggccaagauggcuagacgcaagaacuuauagugauccacuugccuugcgggaauuuaaagaguucgcggcuggccggagaucugugaguggagacuuaauauuagaaauagggaagcuaccucagcaucugacguugcgugcacagaacgcuuuagauaauuugguuauguuacauaauagugaacaaggaggaaaggcauaccggcacgcaauggaagaacucccagacacaauagaaacacuaaugcuguuggcauuaaucgcaguccuaacuggugguguaacucucuucuuuuuaucuggcaaagguuuaggaaaaacuuccauaggacuccuguguguaacagcaucaagugcuuuacucuggauggcgucaguggagccucacuggauugccgcgucuaucauauuagaguucuuucuuaugguccuacucauuccggaaccugaucgccagcggaccccucaagauaaucaguuagcguauguugugauuggccuauuauuuaugauucugaccguagcggccaacgaaauggggcuccuugaaacaacgaagaaagacuuagguauuggauauguggcagcagaaaaccaccagcaugcgacaaugcuagacguugaccugagaccagcaagcgcguggacauuauaugcuguagccacgaccguaauuacuccuaugaugagacacacaauagagaauacuaccgcuaauauaucccuaaccgcuaucgcuaaccaagcagcgaucuuaauggggcuugauaaaggauggccaaucaguaaaauggacauuggagugccauuacuagcauuagguuguuauagucagguaaauccacuaacauugaccgcagccguacuaauguuagucgcacauuaugcaauaauagguccugguuuacaagccaaagccacacgagaagcgcagaaaagaacugcagcuggaauaaugaagaaccccaccgucgacggcauaguagcaaucgaucuugacccaguaguuuacgaugcgaaauuugaaaaacaacugggacaaauuaugcuacuaauucucuguacaagccaaauacuucucaugaggacaacuugggccuuaugugaaaguauaacuuuagcaacaggacccuuaacgacguuaugggagggguccccugggaaauuuuggaauacuacgaucgcgguaucaauggcgaauauauuucgagguagcuaccuagcaggagcagggcuggcguuuucauuaaugaaaaguuugggugguggacggagaggaaccggagcacagggagaaacacuaggugaaaaauggaaacgacaacuuaaucaauuaucaaagagcgaguucaauacguauaaaaggucaggaauuauggaaguagaucguucagaagcgaaagagggauuaaaacgcggagaaacaacuaaacaugcaguaucgcgaggaaccgcaaaacuacgaugguuuguggagcgaaauuuagucaaaccugaaggaaagguaaucgaccugggauguggaagaggaggcuggaguuauuauugugcaggucugaagaaggucacagaaguaaaaggguacacuaaagguggucccggacaugaagaaccuauaccuauggcuacguacggauggaacuuagucaaacuacacucuggaaaagauguguucuuuaugcccccagaaaaaugcgauaccuugcuaugugacauaggugaauccagucccaauccgacgauagaagaaggucguacacuaagggucuuaaaaaugguugagcccuggcuuaggggaaaucaauucuguauaaaaauucuaaaucccuauaugcccagcguaguagaaacguuggaacaaaugcaaagaaagcacggagguauguuagugaggaauccacucucaaggaauagcacgcaugaaauguacuggguaaguugugguacgggaaauauugucucagcaguuaacaugacaagucgaauguuacuaaacagauuuacaauggcgcaucgaaaaccgacuuaugagagagauguugaccugggagcuggaacucgccacguugcgguggaaccggaggaagcuaaccuagauauuauaggucaacgaauugagaacauuaaaaaugagcauaaaaguacuuggcacuaugaugaagacaacccuuauaaaacuugggcuuaucauggaucauaugaagucaagccgucgggcucugcuucgagcauggucaacggcgucguacguuuacuaaccaaaccaugggacguaauaccaaugguuacucaaauagccaugacagacacuacuccauucggacaacaaagggucuuuaaggaaaaaguggauacuaggacuccucgcgcuaagaggggcacaacgcagauaauggaaguaacagcuaaaugguuauggggauuuuuaucaaggaacaagaaaccaagaauuuguacuagggaagaguucacucgcaagguccgaucaaacgcugccauaggagcuguauuugucgacgaaaaucaauggaacucagcaaaagaagccguggaagaugaaagauuuugggauuuaguacaccgcgaacgagagcugcauaaacaaggaaaaugugcgacguguguauauaauaugauggguaaaagagaaaagaaauugggggaguucggaaaagcaaaaggguccagggccauaugguacaugugguuaggugccagguucuuagaauuugaagcucucggcuucaugaacgaggaucacugguucagcagggaaaauucccuauccgguguagaaggagaaggauuacauaaacuugguuauauacuucgagauauuuccaaaauuccgggaggaaauauguaugcagaugacacagcagguugggauacuagaaucacagaagaugaucuucaaaacgaagcaaaaaucacugacauaauggagccugaacaugcacuauuggcgaccucuauauucaaguuaaccuaucaaaacaaagugguaaggguccaacgaccagcaaagaacgguacaguaauggacguuauaucgagaagggaccagcggggaaguggccaaguuggcaccuauggcuugaacaccuuuacuaauauggaaguacaacuuaucagacagauggaaagcgaaggaauauuucucccaucagaauuagagacuccuaaucuggcggaaaggguacuagacuggcuagaaaaacauggcacugaaagacucaaacgaauggcuauuuccggugaugacugcguaguaaaaccuauugacgaucgguuugcuaccgcguuaaccgcacuaaaugauaugggcaaagucaggaaagacauuccgcagugggaaccuaguaaaggguggaacgauuggcagcaagugccauuuugcagccaucacuuccaucaauuaauaaugaaggacggacgagagauaguaguaccguguagaaaucaagaugaauuaguaggccgggcaagaguaucucaaggggcagguuggaguuuacgagagacagcguguuuagggaaaucuuaugcucagauguggcaauuaauguacuuccaucgaagagaccugcgacucgcagcaaaugccauuuguucugcaguacccguagacuggguaccuacaagcaggaccacauggucaauccacgcucaucaucaauggaugacaacagaggauauguuaucaguguggaacagaguuuggauugaagaaaauccauggauggaagauaagacgcacguaaguuccugggaagaaguaccuuaucuuggcaaacgggaagaccagugguguggaucauugauaggacuuacggcuagagccacuugggcuacuaacauucaaguggcgauuaaucagguuagaagauuaauaggaaaugaaaauuaucuagauuacaugacaaguaugaaaagguucaaaaaugagagugaucccgaaggugcgcuaugguga

SEQ ID NO: 21445 - RNA, 9879 nt, Artificial Sequence
  derived and/or modified CDS sequence (opt6) from DENV-1__JN819415__SS-prME
ucaguaacaaugcuauuaaugcugcuucccacggcgcucgcauuucaccuuacaacgaggggaggagaaccgcacaugauugucucaaaacaagaacgagguaagucccuucuauucaaaacuucagcaggaguuaauaugugcaccuuaaucgcaauggauuugggagaacuuugcgaagauacaaugacuuacaaaugucccagaauaacagaagcagaaccugaugauguugacuguugguguaaugcuacggacaccuggguuacauacggcacuuguagccaaacaggcgaacacagaagagauaaaagaagugucgcacuagcaccgcauguuggacuggggcuagaaacucggaccgaaacauggaugucuuccgaaggggcauggaaacaaauucaaagaguagagacaugggcucucaggcauccaggauuuacggucaccgcacuauuuuuagcucacgcgauuggaacaagcaucacacagaagggaauuauauuuauauuacuuaugcuagugacgccgaguauggcgaugcgauguguuggcauugguaaccgagacuucgucgagggccucucuggagcaacaugggucgacgugguacuagaacacgguucguguguuacaacuauggccaaaaauaaaccgacucuugauauagagcuucuuaaaacagaagugacgaacccagcugugcuucguaaauuaugcaucgaagcaaaaauaucuaauacaacgacagacagucguugcccaacccaaggugaggcgacccuaguugaggaacaagaugcaaauuucguaugcagaaggacuuuuguagauaggggauggggcaaugggugcggacucuucgguaaaggaagucuucuaacaugugcuaaguuuaaaugcgugacuaagcuagaagguaagaucguacaauacgagaacuuaaaauacagcguaauagucacaguucacaccggugaccaacaccaaguuggaaaugaaacaacggaacauggaacgauagccacgauaacuccgcaagcgccaaccucagaaauccaauugacagacuauggagcauugacccuugauugcaguccucgcacggguuuagauuuuaaugaaaugguauuauuaacaaugaaagagaaaucuuggcuaguccauaaacaaugguuucuugauuuaccguuaccauggaccagcggugccagcacaucccaagaaacuuggaacaggcaagacuuguugguaacuuuuaagacagcccacgccaagaaacaagaagucgucguucuagggucccaagaaggggcgaugcauacagcacugacaggugcaaccgaaauacaaacaagugguacuaccacaauuuucgcaggccaucuaaaauguagacuaaaaauggacaaauuaacccugaaagguacgucauauguuauguguacagguaguuucaaacuagaaaaagaaguagcugagacccaacaugguaccguauuaguucaaguuaaauacgaagguacugacgcacccuguaaaauacccuuuucaacacaagacgaaaaaggaguuacucaaaauggacgguugauaacagcuaaucccauagugacagauaaagaaaaaccuguaaauauagaaacggaaccaccuuuuggggaaucauacauuguuguaggagcgggcgagaaggcccucaaacuuuccugguuuaagaaaggcaguaguauaggcaaaauguuugaggcaacugcuagaggggcaagacgcauggcuauccucggggauacagcuugggauuuugguucgaucgguggagucuuuaccucaguggggaaauuaguacaucagguguucgguacugcuuacggaguuuuauuuagcggugucucuuggacuaugaagauagggauaggaauacucuugaccuggcugggcuuaaauucccguuccacuagcuugaguaugacguguauugcaguugguaugguaacccuuuauuugggaguuaugguucaggcggauucagguuguguuauuaacuggaagggaagagagcucaaauguggaagcgguauauucgucacaaaugagguucauacuuggacagagcaauauaaauuccaagcugauaguccaaagagacuaucugccgccauaggaaaagccugggaagaaggaguaugcggcauucgaucggccacaaggcuagaaaauauaauguggaaacaaauaaguaaugaauugaaucacauauuacuggaaaacgauaugaaauucacuguaguuguaggagaugcaaacgguauccuugcacaagggaagaaaaugauucggccgcaaccuauggaacacaaguacagcuggaagucauggggaaaagcuaagauaauaggcgcagauauacaaaacacuacauuuauaaucgauggaccugacacuccugaauguccagacgaccaacgugcauggaauauuugggaaguggaagauuacggguuuggaaucuucacaacuaacauauggcuaaaacugagagauucauauacacaaaugugcgaccauagacuuaugagcgcggcaauaaaagacaguaaagccgugcaugccgauauggguuacuggauugagucugagaaaaacgagacuuggaaauuagcacgagccucguucauagaaguaaaaaccugcacauggcccaaaagccauacacuuugguccaacggcguauuagaaucugaaaugauuauaccaaaaauauacggcggcccuauaucacaacacaacuacagaccagguuacuucacacaaacugcagguccuuggcacuuaggaaaacucgagcuagauuuuaaccuaugugaaggaacaaccguugucgucgaugaacauugcggaaacagggguccgagucuccguacuacuacaguuacugguaaaauaauacacgaaugguguuguagaaguuguacacuaccuccgcuccgauuccgaggagaggacggaugcugguauggcauggaaauccgaccaguuaaagaaaaagaagaaaaucucguccgaaguaugguaucagcugguucaggagaaguagacaguuuuagucuugguauauuguguguuucaauaaugauagaagaggucaugcgaucgagauggucaagaaaaauguuaaugacaggaacccuagcgguguuuuuauuauuaauuaugggccaguugacauggaaugauuugauuagacuauguaucaugguaggcgcaaacgcgagugacagaauggggaugggaacuacguaucuagcacuaauggcaacauucaaaaugcggccaauguuugcaguugguuuauuauucaggcgccucacaagccgagaaguguuauuauuaacgauuggacucucacuuguugcuucaguugaacuuccuaauagccucgaagaacugggcgauggguuagcaaugggaauaaugaugcugaaacuacuuaccgaauuucagccucaucaacuguggacuaccuuauuaucuuuaacuuuuauuaaaacaacgcugucauuggauuaugcuuggaaaacuaccgcuauggcguugucuauuguuuccuuauuuccacuuugucuuagcacaacuucccagaaaaccacauggcuucccguccuguugggaaguuuuggauguaaaccccuaacgauguuucuuauuacagaaaauaaaauaugggggcgaaaaucuuggccacugaaugaagguauaauggccauaggcaucgucucaauuuugcuaucaucccuccuaaagaaugacgucccauuagcgggaccguuaauagccggcggaaugcuaauagcaugcuauguaauaaguggcagcucggcagauuugucccuagaaaaagcagcugaaguuaguugggagcaagaggccgaacauuccggcacgucacacaacauucuuguggaggugcaggaugacgggacaaugaaaauaaaagaugaagaaaaagacgacacacucacuauccuucuuaaagcaacacuacuagcaguuagcggcguauauccuaugagcauuccagcaacauuauuuguuugguauuucuggcaaaagaagaaacagagaaguggaguauuaugggauacuccaagcccacccgaagucgaacgagcaguguuagacgauggcauuuauaggauccuacagagaggauuguugggcagaucccagguagguguugguguguuccaagauggcguauuccauacuauguggcacguaaccagaggcgcaguccuuauguaucaagguaagagauuggagccuucaugggccucugucaagaaagauuuaauaucauauggagggggauggcgauuucaaggaaguuggaacaccggcgaggaagugcagguaauugcugucgaaccuggaaagaaccccaaaaauguucaaacaacaccggggacauuuaaaaccccggagggcgaaguaggggcuauagcgcuagacuuuaaacccggaacguccggaucuccaauugucaacagggaggguaaaaucguuggcuuauaugguaacggggucguuaccacgucgggaacguacguaucggcgaucgcacaggcuaaagcaagucaagaggguccacuacccgaaauagaagacgagguuuucaagaaacggaaucuaacaauuauggauuuacacccggguucgggaaaaacaaggagauaccuaccugccauaguacgggaagcaauaaaaaggaagcugagaacccuaauacuagcaccaacgaggguuguggcgagugagauggcugaggcuuuaaaagggaugccaauuagauaucaaacuacagcggugaaaagcgaacacacaggacgggaaauaguagaucuaaugugucaugcuacauuuacgaugagacuguuaucacccguucgaguaccaaauuacaauaugauaauaauggacgaagcgcacuucacagauccugcgaguauagcugcuagaggauauaucuccacuagagucgguaugggcgaggcggcggcuauauuuaugaccgcgacaccaccagguucagucgaggcguuuccacagaguaaugcuguuauucaagaugaagaaagagauauaccugaacgauccuggaauaguggauaugauuggauaacagacuucccuggaaagacuguuugguuuguucccagcauaaaauccgguaacgauauugccaauuguuuaaggaaaaauggcaaacgaguaauacagcuaagcagaaaaaccuucgacacagaauaucagaaaacuaaaaauaaugauugggauuaugucgucacaacggacaucucagaaaugggugcuaauuuccgugcugacagaguuauagauccaagacgcuguuugaagccaguaauucuuaaagacggaccugaacguguaaucuuagcaggaccuaugcccguuacuguggccagugccgcacagaggcgugguagaauuggucgaaaccaaaacaaagagggagaucaauauguauacaugggccaaccguuaaacaaugacgaagaucacgcacauuggacagaggccaaaauguugcuagacaauauaaauacuccagaaggaauaaucccagcacuuuucgaaccugaaagagaaaaaucugcugcaauugacggagaauauagauuacgaggagaagcuagaaaaacuuucgucgaauuaaugcggcguggagacuuaccgguaugguuauccuauaaaguggcaucagagggguuucaauauagugauagacgauggugcuucgacggugaacgaaacaaucaaguacuggaagaaaacauggacguugaaauauggacgaaagaaggagaaagaaagaaauuaagaccacguuggcuggacgcaagaacauauagcgacccgcuggcauugagagaauuuaaagaauuugcagcaggaaggagaagcgucagcggggaucuaauacuugaaauaggaaaacuuccgcaacacuuaacacuacgagcucagaaugcgcuagauaauuugguaaugcuccauaauucugaacaagguggaaaagcauaccgccacgcaauggaagaguugccagauacuauagaaacccugaugcuguuggcucuaauagccgucuuaaccggugguguaacuuuauucuuuuuauccgguaaaggauuaggaaaaacgaguaucggauuauuguguguaacggccucuucggcuuuauuauggauggcauccgucgaaccacauuggauagcugcaucaauaauauuagaguucuuccugauggugcucuuaaucccagaaccggacaggcaaaggacaccucaggauaaccagcuggcuuacguaguaauugguuuguuguuuaugauauuaacaguugcugcuaacgaaaugggguuacuugagaccacgaagagagaucuugguauaggccacgucgcagccgaaaaccaucagcacgcuacaaugcuggacguggaucuaagaccagcaagcgcauggacauuauaugcgguugcgacuacuguuauuacaccuaugaugcgccacacgaucgaaaauaccacugcuaacauuagccuaacagcaauagcuaaucaagcugccauucuaaugggacuagauaaaggauggccgauaaguaaaauggauauaggaguaccacuacuagcacugggauguuacagucaggugaauccccuaacgcuuacggcagccguacuuauguuagucgcucauuacgcaauaauuggaccuggccugcaagcuaaagccacaagggaggcccagaaaagaaccgcugcaggaauaaugaaaaacccgacuguagaugguaucguugcuauagauuuagacccuguaguuuacgaugcuaaguucgagaagcaauuaggccaaauaauguuauuaauuuuaugcacaucucaaauacuacuaaugcguacgaccugggcacucugugagucaaucacauuagcgacuggaccacucacaacacuaugggagggcagcccaggaaaauucuggaacacuacuauugcgguaucaauggccaacauauuuagagggucauaccuugcaggggcaggauuagcauuuagucuuaugaagucuuuaggcggcggucgaagaggaacaggagcacaaggugaaacacucggggaaaaguggaagagacaacuuaaccaguuauccaaaucugaguucaauacauauaaaagauccgguauaauggaaguggaccguucugaagccaaagaagguuuaaaacgaggagaaacuacaaaacaugcgguaucaagaggaacggcuaagcugcgcugguuuguagaaaggaaccucguaaagcccgaaggcaaagucaucgaucucgguuguggaagaggaggauggucauauuacugcgcugguuuaaagaaaguuaccgaggucaaaggauauacaaaaggaggucccggucacgaagaaccuauaccaauggcuacauacggguggaacuuaguaaaauugcacaguggaaaagacguauucuuuaugcccccagaaaaaugugacacacuguuaugugauaucggggagaguagucccaaucccaccauagaagaagguaggacucuaagaguacuuaagaugguugagccauggcuuagagggaaccaauuuuguauuaaaauucuuaauccauacaugcccagcguuguagagacacucgaacaaaugcaaagaaaacaugguggcaugcugguaaggaauccgcucucccgcaacaguacacaugaaauguacugggucaguuguggcacuggcaacauaguaagugcuguaaacaugacaagucgcaugcuauuaaaucguuuuacuauggcacauaggaaaccaaccuacgaaagggauguggaccucggggcgggaacgagacacguagcuguagaaccugagguagcgaacuuggacaucauaggccagaggauagaaaauauuaagaacgaacauaaaagcacauggcauuaugaugaagauaacccuuacaaaacuugggcuuaucaugguuccuaugaaguaaaaccaucaggaagcgccucuucuaugguaaauggaguagugagauuacucaccaaaccgugggacgugauaccaaugguuacccaaaucgcuaugacagauacaacuccauucggacaacaaagaguauucaaagaaaaaguugauaccagaacaccucgagcgaaaagagggacuacacaaauuauggaagucacagcuaaaugguuauggggauucuugucgcgaaacaaaaagccgcggauuuguacucgugaagaauuuacccgcaaagucagaagcaaugcggcaauaggagcggucuuuguugaugaaaaccaauggaacuccgcuaaagaggcaguggaagacgaaagauuuugggaucuggugcacagagaaagggaguuacauaaacaggguaaaugugcuacguguguuuauaauaugaugggcaaacgugagaagaaacuaggugaauuuggaaaagcaaaagggucaagggcuauaugguauaugugguuaggugcacgauuucuagaauuugaggcacuuggauucaugaaugaggaucauugguuuucgagagaaaauagccuaaguggggucgaaggugaagggcuacauaaacuaggcuauauuuugcgagauaucucaaaaaucccugguggaaacauguaugcagaugauacggcuggaugggacacgaggauuacggaagaugaucugcaaaaugaggcgaaaauuacagauaucauggaaccugaacacgcgcuauuagcaaccuccauuuuuaaacuuaccuaucaaaacaaaguaguuagaguucaacguccggccaaaaaugguacuguaauggacgugauuucaagacgcgaucaaagagggucgggccaaguuggcacauacggccucaacaccuuuacgaauauggaaguucaacucauucgucaaauggaaucagaagggauauuccuuccaucugaacuagaaaccccuaacuuggcugagagaguauuggacugguuagaaaaacacggagcugaaagacucaaaaggauggcaauuaguggugaugacuguguaguaaaaccuauugaugaucgauuugcuacagcacuuacagcucugaacgacauggguaaaguucguaaggacauuccgcagugggagccuaguaaaggauggaaugauuggcaacagguuccauuuugcagucaucauuuucaccaauugauaaugaaagauggaagagagaucgugguaccuugucgaaaucaagaugaauuagugggcagagcuagaguaagccaaggugcgggguggagcuugagagaaacggcuuguuuaggaaaaucauaugcacaaauguggcaauuaauguauuuccaccgacgagauuuaagauuggcggcuaacgcuauuuguagugcaguaccuguagacuggguccccacaagucguacgacauggaguauucacgcgcaucaccaguggaugacuaccgaagauaugcugucaguauggaauagaguauggauagaggaaaaucccuggauggaagauaaaacacauguauccucuugggaggaaguaccauacuuggguaaacgggaagaucaguggugcggcagcuugauaggcuuaacggcaagagcgaccugggcuaccaauauacagguagcaauuaaucaaguucgucgucuaauugguaacgagaauuaucucgauuacaugacauccaugaaaagauuuaaaaaugaaagugacccugagggagcgcuaugguaa

SEQ ID NO: 21446 - RNA, 9879 nt, Artificial Sequence
  derived and/or modified CDS sequence (opt6) from DENV-1__GU131838__SS-prME
agugucacgaugcuauuaauguuauuaccaacugcauuggcauuucaccuuacuacucgaggaggagaaccucacaugauugucucgaaacaagaacgagggaaaucuuugcuguucaaaacaucugcaggaguaaacaugugcacucugauagcaauggaccuaggugaacucugcgaagacacuaugacuuacaaauguccgagaauuacagaagcggaaccugaugauguagacugcugguguaaugcuacggacacauggguaacauaugguacaugcagucagacaggugaacauagaagagaaaaacgaucuguagcauuagcuccucaugucggucuaggauuagaaacucggacagaaacguggaugucaagugaaggugcguggaaacaaauccaacgagucgaaacuugggcauugagacauccagguuucacgguaauugcguuuuucuuggcacaugcaauuggaacaucaaucacgcaaaaaggaauaauuuucauacuccuaaugcuagugacgccaucuauggcuaugcguugcgucggaauagguaaucgcgauuuuguagaaggauuaucaggagcuacauggguugaugugguccuagaacacgggucuuguguaacuacgauggcgaaaaacaaaccaacccuagauauagaauugcucaaaacagaaguuacaaacccugcaguacuuagaaaacuauguauugaagcuaaaauaucaaauacaaccacagauucaaggugucccacgcagggagaagcuacauuaguagaagaacaagaugcuaauuuuguauguagaagaacguucguggauagaggaugggggaacggaugcggauuauucgggaaagguagccugcuuacaugugccaaauuuaaaugcguuacaaaauuagaaggaaaaauaguccaauacgaaaauuuaaaauauuccgugaucguaacagugcauacaggugaucaacaucaagucggcaaugaaacaacugaacauggaacaauagccaccaucacaccccaagcuccuacaagcgaaauccaacucaccgacuauggagcauugacauuagauuguagcccacguaccggauuggauuuuaacgaaaugguauuacuuacaaugaaagagaaaaguuggcuagugcacaaacaaugguuucuagacuuaccauuaccauggacaaguggagccuccacuucacaggagacguggaauagacaagaccucuuagucacguuuaaaacggcgcaugcuaagaaacaggaaguagucguucucgggagccaagaaggagccaugcauacagcucuaacaggggcaacagaaauacaaacaucggguacuacuacgauauuugcuggucaucugaaaugucggcucaaaauggacaaacuuacucuaaaagggauguccuauguaaugugcacaggcaguuuuaaacuagaaaaagagguagcugaaacucagcauggcacuguguuaguacaaguaaaauaugaaggcacugaugccccuugcaaaauucccuucaguacacaagaugaaaaaggugugacccagaauggacgacuaaucacagccaauccgauaguaaccgauaaagagaaaccaguuaauauugaaacagaaccuccuuucggcgaaaguuauauagucguaggagccggugaaaaagcauuaaaacuaucaugguucaaaagagggagcucaauagggaaaauguucgaagcaacugcaagaggugccagaaggauggccauacuuggugacacugcgugggacuuugguucuauugguggaguuuucacuucgguuggaaaauugguucaucaagucuucggcacugccuaugguguguuauuuuccggcgugaguuggacaaugaaaauaggaaucggcauccuccuaaccuggcuagggcuaaauucacguucgaccagucuauccaugacauguauagcaguugguaugguaacauuguacuuaggugucaugguacaggcagauucagggugugucauaaacuggaaaggaagggagcuaaaaugcggaucagggaucuucguaacuaaugaaguacacacauggacagaacaauauaaauuccaagcagacaguccuaaacgcuuaucagcggcuauaggaaaagcaugggaagaaggcguaugugguauaagaucggcuacucgauuagaaaauauaauguggaaacaaauauccaaugaacugaaucauauauuauuggaaaacgauaugaaauucaccguagucgugggagacgcuaaugggauacucgcacaaggcaagaaaaugauaaggccgcagccaauggaacauaaauauagcuggaagaguuggggaaaagcaaaaauaauaggagcugacauacagaauaccacguuuauaauugaugguccugauacuccagagugucccgacggacaaagagcauggaauaucugggaaguggaagacuacggguucgguguauucacaacaaacauuugguuaaaacuccgugacuccuauacacaaaugugcgaucaccgacugaugucagcagcaaucaaagauagcaaggcgguacaugcagauauggguuacuggauugaaucagagaaaaaugagacauggaaacuggcacgggcuucguucaucgaggucaaaacauguacuuggccaaaaagccacacccugugguccaacgggguccuagaaagugaaaugauaaucccgaaaauauauggcggcccgaucucucaacacaauuaucgaccagguuacuuuacacagacagcggggccuuggcauuugggaaaauuagagcuagacuuugaucugugugaaggaaccacaguaguaguagacgagcacugcgguaacagaggaccuucacuuaggacgacaaccgugacuggcaaaauuauccaugaauggugcuguagaagcugcaccuuaccuccucuacgauucagaggugaagauggcuguugguaugguauggaaauaagacccgugaaagagaaagaagaaaaucucgucagaucuaugguauccgcaggaaguggcgaagucgauucauuuucucuuggaauacuauguguaucaauaaugauugaggaagucaugcggucuagauggagucguaaaauguugaugacuggcacauuagcgguauuucuguuguuaaucaugggacaacucacuuggaacgaccugauuaggcuauguaucauggucggugcuaaugcauccgaccgaaugggcaugggaacaacauaucucgcacuuauggcgacauuuaaaaugcguccuauguuugccguugguuugcuuuuccgucggcuaacuucacgugagguucuacuacugaccauaggucuaaguuuaguagcaaguguggagcuuccgaauaguuuagaagaacuuggggacggacuagccaugggaauuaugaugcuuaaauuauugacagaguuccagccgcaccaacuauggacaacccuauugucccuaacguuuguaaaaacuacacuaucacuugauuacgcuuggaagacaaccgccaugguguuaagcauaguuucacuuuuuccauuaugucuauccacaacaucccagaaaacaacuuggcuuccagugcuacuaggcagcuucggcugcaagcccuuaacaauguuucuaaucacggaaaacaaaauauggggaagaaaaucuuggccauuaaaugaaggaauuauggcaauaggcauagucucaauuuuacuaagcucgcuccugaaaaaugaugugccccucgcgggcccauuaauagccggcgguauguuaauugccuguuacguuauaaguggaaguucugcagauuuaagucuagagaaaacggcagagguuagcugggagcaagaagcagaacauucuggugcuagucauaacauauuaguugaaguucaagaugauggcacuaugaagauaaaggacgaggaacgugacgauacucucacgauacucuuaaaagccacgcucuuagcuguuagcggcguguauccgaugucuauucccgcuacucuauucguaugguauuuuuggcaaaagaagaaacaacgaagcggggugcugugggacaccccuucuccgccugaaguugaacgagcaguucuugaugauggaauauaccgaauauuacagagaggguuauugggaagaucacaaguuggaguagggguauuccaggaugguguuuuucauacaauguggcacgucacacgcggugccguauuaauguaccaaggcaaaagauuagagccaucuugggcaagugugaagaaagaucugauaaguuacggaggcggcuggagguuucaagggaguuggaauacaggggaagaaguccaaguaaucgcugucgaaccagguaagaaucccaagaauguccaaaccacuccuggaacuuuuaaaacaccugaaggugaagucggugcgaucgcgcuugacuuuaaaccggguacaucuggaucuccuauuguuaacagagaaggaaaaaucgucgguuuguauggaaauggaguggucacuacaaguggcacuuaugugucggcuauugcucaagcaaaagcaagccaagaaggcccguuaccagaaauugaagaugaaguguuuaagaaacgaaaccuaacuauaauggacuugcacccugggucaggaaaaacucguagauaccuucccgcuauagugagagaagcgauuaaaagaaaguuaaggacacuaauacuugcucccacucguguagucgcuucggagauggccgaggcccuaaaagguaugccaauaagauaucaaacuacagcaguaaaaagugagcauacggguagagaaauuguagaucugaugugucacgcaacauucaccaugaggcuucuuucuccuguucguguaccgaacuauaauaugauuaucauggacgaagcacacuuuacggacccugcaaguauagcugcacgagguuauaucucgacacggguugggaugggcgaggcggcagcaauauucaugacugcaacuccacccgguucaguagaggcauucccgcaaucgaacgcuguuauacaagacgaagaaagggacauccccgagagaaguuggaacucuggauaugauuggauuacagacuucccuggaaaaaccgucugguuuguuccaaguaucaaaagugggaaugacauagcaaauugccuaaggaaaaaugggaaaagaguuauccaguuaucaaggaagacauuugauacugaauaucagaaaacuaaaaauaaugauugggauuacguaguaacuaccgauauuucggaaaugggagccaacuuuagagcagacagagugauagauccacgacgcugucuuaaacccguaauucuaaaagaugguccagaacgcgucauauuagccggaccaaugccgguuacuguggccucugcggcacaaagaagaggaagaauaggucgaaaucaaaacaaagagggagaucaauauguuuacauggggcaaccucugaacaaugaugaggaucacgcucauuggacggaggcaaaaauguuacucgacaauaucaacacaccagaagguaucaucccugcacuuuuugaacccgaaagggaaaagucggcugcuauugauggugaauauagacuucguggagaagcaagaaaaacauucguugaacuuaugagacggggagaucugccggucuggcucuccuauaaaguggcaucagaaggauuucaauauuccgaucgccgauggugcuuugauggagagagaaauaaccagguauuagaagaaaacauggacguagagauauggaccaaggagggagaaaggaagaaauugagaccgagguggcuagacgcaaggacguauagugauccucucgcacucagggaauuuaaagaguucgcggcaggcagaagaucuguaagcggagaucuaaucuuggagauagggaaacuaccgcagcauuugacacuaagagcacagaaugcccucgauaauuuaguaauguuacauaauucugaacagggagguaaggcuuaucgccacgcgauggaggaacuuccugauaccauagaaaccuugaugcuucuggcuuuaauagcuguccuaacgggugguguaacucuauucuuccucagcgggaaaggacuaggaaaaacuucaauuggucuacucuguguaaccgcuucaucagcuuuacuguggauggcaucaguagaaccgcauuggauugccgcgucuauaauacuugaguucuuuuuaaugguacuacuaauuccugaaccagacagacaacgaacgccucaagauaaucaacuugcauauguaguaauugguuuacuauucaugauacugacgguagcugcaaaugagauggguuuauuagaaacuacgaagaaagaucucggcauuggauauguggcugcugaaaaccaucaacaugccacaaugcucgauguagacuugcauccagcauccgcuuggacuuuauaugccguggccacgacagugauaaccccaaugaugagacacaccaucgaaaacaccacggcuaacauuucgcuaacagcaaucgcaaaccaggcagcgauauuaaugggcuuggauaaagguuggccaaucucgaaaauggauauagggguaccucucuuagccuuaggauguuauucacaaguaaauccuuugacacuaaccgcagcggucuugauguuaguugcacacuacgcuaucauaggacccggguuacaagcaaaagccacccgagaagcacagaaaagaacagcagcugggauuaugaagaaccccacgguugacggcaucguugcaauagaccuugacccgguuguguaugacgcuaaauucgaaaaacaacuaggucaaauaaugcuacucauauuguguacgagucagauucuacugaugaggacgacaugggccuugugcgaaucgauaacauuagccacgggcccacucacaacucuaugggaaggcucaccagguaaguuuuggaacaccacuauagcaguaucaauggcaaauaucuuuaggggcucguacuuagcuggcgcgggucuagccuucucacucaugaaaucauuaggcggcggcagacgaggaacaggcgcccaaggugaaaccuuaggugaaaaguggaaacgacagcuuaaucaauuaucuaaaagugaauuuaauacuuauaaaagaagcggaaucauggaaguagauagaucugaagcgaaggaaggucucaaaagaggagagacaaccaaacaugcgguaucaagaggaacugcaaaguuacgaugguuuguagaaaggaauuugguaaaaccugaaggaaaagugauagauuuggggugugggaggggaggaugguccuacuacugcgcugguuugaagaaaguuacugaaguaaaagguuauacgaaagggggaccaggucacgaagaaccaaucccaauggcaacuuacggcuggaaccuugucaaacuacauucuggaaaagauguguucuuuaugccacccgaaaaaugugauacacuauuaugcgacauaggugaaaguucaccuaauccaacuaucgaagaagguaggaccuugagaguuuuaaaaaugguggaaccauggcugagagggaaucaauuuugcaucaaaauauuaaauccauacaugccaaguguuguggaaacucuugaacaaaugcaaagaaaacacggaggcaugcuaguacguaauccuuuaagcagaaauucuacacacgagauguauugggucucaugugguacagggaauauaguaucugcgguaaacaugacaucaagaauguugcucaacagguuuacaauggcacauagaaaaccaacguaugaaagagauguagaccuaggggcaggcacuagacauguagccgucgagccagaagucgcaaacuuggauauuauuggacaacgcauagaaaacauaaagaaugaacacaagucaacauggcacuacgacgaagauaauccauacaaaacaugggcuuaucauggcucuuacgaaguuaagccgucggguagcgcaagcaguaugguaaacgguguuguuagacuuuuaacaaaacccugggauguaaucccaaugguaacacaaauagcaaugacagauacuacaccguucggacaacaacggguuuuuaaagagaaagucgauaccaggaccccacgagcaaaacguggcacuacucaaaucauggaggugaccgccaagugguuguggggguuuuuaucaagaaauaagaaaccgaggauuuguacaagggaagaguucacaagaaaagucagaucaaaugcagcuauaggagcaguauuugucgacgaaaaccaauggaacucagcuaaagaagcuguagaggaugagcguuuuugggaucuaguacaucgggagagagaacuccauaaacaaggaaagugugccacaugcguauauaacaugaugggaaaacgagaaaagaaauugggagaguuuggaaaagcaaaagguagucgugcaauuugguauaugugguuaggagccagauuucuugaauuugaagcguuaggauuuaugaacgaagaccauugguucucaagagagaauagccuaucgggaguggaaggcgagggauugcauaaauugggauauauucuacgagacaucaguaaaauaccgggaggaaauauguaugcugaugacacugcuggcugggacacgcguauuacugaagacgaucuacaaaacgaagcgaagauaacugauaucauggaaccggaacaugcacuauuagcuacuagcaucuucaaacugaccuaccagaacaaaguuguaagagugcagagaccagcaaagaacggaaccguaauggaugugauaagcaggagagaucaaagaggcucugggcaaguggguaccuacggacuuaauacauuuacgaauauggaaguucaauuaauaaggcaaauggaauccgagggaaucuuuuuaccuucagaguuagaaacaccaaauuuagcagaacgagcguuggacuggcuugaaaaacauggugcugagcgucuuaaaagaauggcgauaaguggagaugacugcguggucaagccaauagacgacagguuugccacugcacuuacugcauuaaaugauaugggcaagguaaggaaggauauaccacaaugggagccgaguaagggcuggaaugauuggcaacagguacccuuuuguagucaccacuuucaccaacuaauuaugaaggauggaagagaaauagucguaccgugccgaaaucaggacgagcugguaggcagagcccgugucagucagggggcaggauggucguugagggaaacggcuugccucgggaagaguuaugcacaaauguggcaguuaauguacuuucacagaagagauuuacgccuagcagcaaacgcgaucuguagugcagugcccguagacuggguacccacaaguaggacuaccuggagcauacaugcgcaucaucaauggaugaccaccgaagauauguuaucaguguggaaccgcguauggauugaagaaaauccauggauggaagacaaaacacaugugucgucaugggaagagguaccauauuuaggaaaaagagaagaucaaugguguggaucgcuaauaggacuaacagcucgcgcaaccugggcaacgaauauacaaguugcaaucaaucaaguaagacgccucauaggaaacgaaaauuaccuagacuauaugacaaguaugaaacguuuuaaaaaugaaucugacccagaaggggccuuaugguaa

SEQ ID NO: 21447 - RNA, 9879 nt, Artificial Sequence
  derived and/or modified CDS sequence (opt6) from DENV-1__GU131839__SS-prME
ucaguaaccaugcuguugaugcugcuuccgacugcacuugcauuucacuuaacgacuagggguggggaaccgcacaugauagucaguaaacaagaaagagggaaauccuugcuuuucaaaacgucagcuggaguaaacauguguacucuaauagcuauggauuuaggagaauugugugaagauacuaugacauauaaauguccucgaauaacagaagcagaaccagaugauguggacugcugguguaaugcuacagauacauggguuaccuaugguacauguucgcaaacaggugaacacagacgcgagaaaaggucggucgcacuagccccacacguuggacuaggacuugaaacaagaaccgaaacauggaugucgagugaaggagcguggaaacaaauacaacgcguagaaacaugggcccuacggcauccaggauuuacgguaauagcguuuuucuuagcacaugccauuggaacgucuauaacccaaaaaggaauaauuuuuauuuuacuuauguuagugacaccaucaauggcgaugagguguguggguaucggaaaucgugauuuugucgaaggacuuucaggagccacauggguugaugucguacuugagcaugggucuugugucacuacaauggcuaaaaacaaaccgacauuagauauagaacuacuaaaaacagaagucacaaauccagcagucuugaggaaacuuugcaucgaagcaaaaauuucaaauacaacaacagacaguagaugcccaacacaaggggaagcaacccuuguagaagaacaagaugcuaauuucguguguagaagaacguuuguugaucgaggauggggaaaugggugcggacuguuuggaaaaggaucacuauuaacaugugccaaauuuaagugugucacgaaauuagaagguaagacaguacaauacgaaaaucuaaaauauucaguuauaguuacaguacacacgggggaccaacaucaagucggaaaugaaacuaccgaacauggcacaauugccacuauuacaccacaagcaccaacaagugaaauacaacuuacagauuauggcgcgcuaacguuggauugcucuccaaggacaggacuagauuuuaaugaaaugguacuucuuaccaugaaagaaaaaucaugguuagugcauaaacaaugguuccuagauuuaccguuaccguggacaagcggcgcaucaaccucgcaggagacuuggaauagacaagaccuuuuggugacauucaaaacugcacaugcuaagaaacaggaaguuguaguacuaggaucacaagaaggugcgaugcauaccgcacuaacuggagcaacugaaauacaaacaagugguacaacaacgauuuuugcaggacaucuaaagugccgucuuaagauggauaaauuaacauuaaaaggcaugagcuacgucauguguacuggcucguucaaacucgaaaaagagguagcagagacccaacacgggacaguacucguacaaguuaaauacgaaggaacugaugcgccuugcaaaauuccuuuuucaacgcaagaugaaaaaggcgugacccaaaacgggagacuuaucacggcuaauccuauugugaccgauaaggagaaaccgguaaacauagaaacugagccgccauuuggcgagaguuauauaguuguaggagcuggagaaaaagcacugaaacuuucgugguuuaaaagggggagcagcaucgguaaaauguucgaagcaacugcucgcggcgcaaggaggauggcgauucucggugauacggcaugggacuuugggucuauuggagguguauucacaucugugggaaaguugguucaucaaguuuuugggacagcguacggcguacuauucagcggcguaucauggacuaugaaaauagguauaggaauacuauugacuugguugggucuaaauucucguagcacaucauuaucaaugaccugcauugcagugggaaugguaaccuuauaucuagggguaauggugcaagcagauagugguugcguuauuaacuggaaaggacgugaacugaaauguggaucggggauuuucguaacaaaugaggugcauaccuggaccgagcaauacaaguuucaggcggauucaccuaaaagauuaagcgcagcaauaggcaaggcuugggaagaaggaguaugcgguauccguagugcaacaagacuagaaaauaucauguggaaacaaauaagcaacgaguuaaaucacauauuacuggagaacgauaugaaauuuaccguuguugucggugacgcaaaugguauacucguacaaggcaagaaaaugauacgaccccaaccuauggaacacaaauacuccuggaaaucauggggcaaggcaaaaauaauaggugccgauacgcaaaacaccacauucauuaucgacggaccggacacaccugaauguccagacgggcagcgagcauggaauauuugggagguagaagacuauggguuuggagucuucacuacaaauauuuggcuaaaacuacgugauaguuacacccaaaugugugaucaccggcuaaugagcgcagcaauaaaagacagcaaagcaguccaugcagauaugggcuauuggauagaauccgagaaaaaugaaacuuggaagcucgcaagggcaucguuuauugaagucaagacauguacguggccgaaaucucauacauuguggucaaacggaguucucgagagcgaaaugauaauuccuaaaaucuacgguggaccgaucucacaacacaauuaucgcccaggguacuucacgcaaacagcuggcccauggcaucuuggaaaauuagagcuggauuucgauuugugugaaggaacuacagucguaguggaugagcacugcggaaaucggggccccucguuaagaacaacaaccguaacgggaaaaauaauacacgaguggugcugccgaaguuguacccuaccgccguugagauucagaggugaagacggcugcugguaugggauggagauacgacccguuaaagaaaaggaagaaaauuuaguaaggaguauggucucagccggcuccggcgaagucgauagcuucucucuuggcauucucuguguuagcaucaugauugaggaaguuaugagaaguagauggagccgaaaaaugcucaugacuggaacgcucgcgguuuuccuuuuacugauaaugggacaauugacuuggaaugaucuuaucagguugugcauuauggucggagccaacgcaucugaccgcauggggaugggaacuacuuauuuagcccuuauggccacuuuuaaaaugaggccuauguuugcugucggcuuacuuuuucgaagacucacuucgagagaaguacuauuacuuacuauaggacuuucacucgucgcaucaguggagcuaccuaauagccucgaagaauuaggugauggacucgcuaugggaauaaugaugcucaaacuucuaacagaguuucaaccgcaccaauuauggacgacucugcuuucccuuaccuuuguaaaaacagcacugucguuggauuaugcauggaaaacuacugcuaugguucuuaguauaguaagccuuuucccacuaugucuuuccacaacaagucagaaaacgaccugguuaccugugcuccuuggaucauucgggugcaaaccgcuaacaauguuccugauuacggaaaauaaaauuuggggucgaaagucuuggccccuaaacgaagguauaauggcuauugguauuguuagcauucuucuuuccucgcuacucaaaaaugacgugccccuagcagguccuuuaauagccgguggaauguuaauugcauguuacguaauuagcgggucuagugcugaccuaucgcucgagaaagcagcagaaguuucgugggaacaagaggccgagcauagcggugccucacacaacauacuuguggaaguucaagacgacggaaccaugaagauaaaagaugaagaaagagacgauacacuuacgauuuugcugaaagcuacguugcucgcaguaucaggagucuaucccaugucaauucccgcuacgcuauucguuugguauuuuuggcaaaagaagaaacaacguucaggaguguuaugggauacaccaucucccccggaaguagagagagcaguauuagauaaugggaucuaccggauacuacaacgaggacuuuuaggucguucacaaguaggaguuggcguauuucaggauggaguuuuucauacuauguggcacgucacuagaggugcgguauugauguaucaaggaaaaagacucgaaccuucgugggcuucugugaagaaagauuuaauuaguuauggaggcggguggagguuccaaggcucguggaacacaggcgaagaaguacaaguuaucgccguggaaccgggcaaaaauccuaaaaauguacaaacgacuccagggacuuucaaaacuccugaaggagaaguuggugcgauagcauuagacuucaaaccgggaacaagcggaucaccuauuguuaauagagaagggaagauagucggacuuuaugguaauggaguuguaaccacaaguggcacauauguaucugccauugcccaagccaaggcgagucaagaaggaccacuaccugaaauagaagaugaaguauucaaaaagagaaaccuuacaauaauggauuuacauccaggcucuggaaaaacaaggagauaccuacccgcuaucguccgcgaagcgauaaaaagaaaacuucgaacguugaucuuagccccgacuagaguaguagcuucugaaauggcagaggcucuaaaagggaugccgauaagauaucagacaacugcgguuaaaagugaacacacaggaagagaaaucguagaccuuaugugucaugcuacuuuuaccaugagacuacugucaccagugagaguuccaaacuauaacaugaucauuauggacgaagcacacuuuacggacccagcaaguauugcugcaagaggauacaucucaacaagaguaggaaugggcgaggcugcagccauauucaugacagcaacgccaccaggaagcgucgaagcauucccgcagucuaacgcugugauucaagaugaagagagagauauacccgaaaggagcuggaacuccggguacgauuggaucacugauuuucccggaaaaaccgugugguucguuccaucaaucaaaagugggaaugacauagcaaauugccuaaggaaaaacggcaaaagaguaauacaguuaucaagaaagaccuucgauacagaguaucagaaaacgaaaaauaaugauugggacuauguaguuacuaccgauauaagcgaaaugggggcuaauuuucgagcagauagagugauagauccuagaaggugcuuaaaaccagugauacugaaagauggucccgaacgaguaauacucgcagguccaaugcccguaacaguagcuucugcagcacaaaggagagggcgaauaggccguaaucaaaauaaggaaggggaccaauauguuuauaugggucaaccccucaacaacgaugaagaucacgcucauuggaccgaagccaaaaugcuucuagacaauauaaacacaccugaggguauuaucccugcauuguuugaaccagaacgcgagaaaagugcugccauugauggggaauacagauugcgaggggaggcgagaaaaacauucguugaguugaugcgaagaggggacuuaccugugugguuauccuauaaaguggcauccgaagguuuccaauauucggauaggcguuggugcuuugacggagagcgaaacaaucaaguauuagaagaaaauauggacguagagauauggacuaaagaaggagagcguaagaaacugcgaccccgaugguuagacgccaggacguacucugacccacuugcucuacgugaauuuaaagaauuugcugcaggacgaagaagcguuaguggggacuuaauacuggaaauagguaaacuuccacaacaucuuacauuaagagcacaaaacgcgcuagacaauuuaguaauguuacacaauucagaacagggugguaaagcauacagacaugcuauggaagaauuaccggacacuauagaaacuuugaugcuucuugcguugauagcaguucugacaggaggcguuacuuuauucuuucuuaguggaaagggccuagguaaaacaucgauaggccuucuaugcguuacugcgucaucggcacuucuguggauggcaagcguugaaccccauuggauagcugcuaguauuauccuagaguucuuucuaaugguacuacuaauaccugaaccagauagacaaaggacaccacaagauaaccagcuagcauaugucguaaucgguuuauuauucaugauucucacaguagcagcaaacgaaaugggacuauuagaaacgacuaagaaggaccuaggaauaggcuauguggccgccgaaaaucaccaacaugcuacgaugcuggauguagaccuacauccugcaucugcauggacacuuuacgcaguggcgacgacgguaaucacuccgaugaugcgccauacuauagagaacacaacugcuaauauuaguuuaacagcuauugcgaaccaggcagcgauucuuauggggcuagauaaagguuggcccauaucaaagauggacauuggcguuccacuguuagcauuagguuguuauagccaaguuaacccauuaacuuuaacgagugccgucuuaaugcuaguagcucacuaugcaauaauuggaccugggcuacaagccaaagcuacgagagaagcgcaaaagagaacugcagcuggaauaaugaaaaauccuacagucgaugguauuguugccauugauuuagauccaguagucuaugaugcuaaauucgaaaagcagcuagggcaaaucaugcuacucaucuuaugcacuucacagauucuucuaaugaggacaacaugggcucuaugugagagcauuacauuagcuacaggaccacucacaacucuuugggaaggaagcccaggaaaguucuggaauacaacaauugcaguaucuauggcaaauauauuccgagguaguuaucuagccggugcggguuuagcauuuucccugaugaaaucguuaggaggaggaagaaggggcacuggcgcucaaggagagacacucggagaaaaauggaaaaggcagcuaaaccaauuaucuaaaagugaauuuaacacguauaagcgaucaggaauaauggagguagauagauccgaagcaaaagaaggucuaaagagaggugaaacgacgaaacacgcaguuucacgagggaccgcgaaacuucguugguucguggaaaggaaucuaguuaaaccugagggcaaaguaaucgacuugggaugcggacguggugguuggagcuauuacugugcaggucuaaagaaaguuacugaagucaaaggauauacaaagggagguccagggcacgaagaaccuauuccaauggcuacguaugguuggaauuuaguaaaacuacacucaggaaaggauguauucuuuaugccaccagaaaaaugcgauacauuacuaugugauauaggcgaaucuucaccuaauccgacaauagaggaaggacguacguugaggguacuaaagaugguugaaccuugguugagggguaaccaauucuguauuaaaauauugaauccguauaugccaucagugguggaaacguuggaacaaaugcagcgaaagcacggaggcauguuaguacgaaacccccuaaguagaaauagcacucaugagauguauuggguaucuuguggcacaggaaacauuguaagugcgguaaacaugaccaguagaauguuguuaaaccguuucaccauggcccaccgcaaaccaacauacgaaagagauguagaccucggcgcaggcacccgucacguagccguagaaccagaggucgcgaauuuagauauaauugggcagagaaucgaaaauaucaaaaacgaacacaagagcacguggcauuacgacgaagauaacccguacaaaacuugggcauaucacgggucauacgaaguaaagcccuccggaucagcgucgucuaugguuaauggggugguacggcuacugacaaaaccgugggauguaauaccaaugguaacacaaauagcaaugacagauacaaccccauuuggccaacaacgagucuuucgagaaaaaguagacacacgaacaccgagagcuaagagaggaacaacucagauaauggaagugacggcaaaauggcuuuggggauuuuuaagccguaauaagaaaccuagaauuuguacucgggaagaauuuacacgcaaaguacgaucuaacgcggcuauuggagcuguauucguagaugaaaaucaauggaauagcgcaaaggaagcagucgaggaugaacgguuuugggaccuuguccacagagagagggaauuacauaagcaggggaaaugcgcuacuugugucuauaacaugaugggaaagagggagaagaaacuaggagaguucggcaaggccaaaggaucgagagcuaucugguacaugugguuaggagcuagguuucuagaauuugaagcauuggguuuuaugaaugaagaucauugguucagccgugaaaauagccuaaguggcguagaaggagaagguuuacauaagcuaggauauauccuaagagauauaucuaaaauaccaggagggaaugucuacgcagaugauacagcgggaugggauacucggauuacagaggacgauuuacaaaaugaagcgaaaauaacagauauaauggaaccagaacaugcauuacucgcaaccucaauuuuuaaguuaacauaucaaaauaaaguaguacguguccaaaggccugcuaaaaauggcacaguaauggaugugauaaguaggagagaccaacgcgguagcggacaaguuggaacguacgggcucaacacuuuuacaaacauggagguccaauugauaagacaaauggaaagcgaaggaauauuccuaccuucggaauuagaaacuccaaaccuugccgagagggcacucgauuggcuugaaaaacauggugucgaacgucuuaaaaggauggcgauuucaggcgacgauugugucguaaagccuaucgaugauagguucgcuacagcacucacagcucugaaugacaugggaaaaguaaggaaagacauuccacaaugggagccaucuaaaggauggaacgacuggcaacaaguaccauuuuguagccaccauuuucaccaacuuauaaugaaagacggaagggaaauaguggucccuuguaggaaucaagaugagcuaguuggucgagcgagggucagucaaggcgcgggauggaguuuaagagaaacugcaugucuaggaaaaucauaugcacaaauguggcaacuuauguauuuccauagaagagauuugcguuuagccgcaaaugcuaucuguagcgcuguaccaguagauuggguuccuacaagccgaacuacauggagcauacacgcacaccaccaguggaugacaacagaagacaugcuuucuguguggaacagggucuggauugaagaaaauccuuggauggaagacaagacgcacgucucgagcugggaagagguaccauacuuaggaaagagagaagaucaauggugcgguucucuaauuggauugacagcucgagcaacaugggcuacgaacauucaggucgcuauaaaucaaguacguagacugauugguaacgaaaacuaucuagacuauaugacaucaaugaaacgguucaaaaaugaaagugauagcgaaggagcuuuaugguaa

SEQ ID NO: 21448 - RNA, 9879 nt, Artificial Sequence
  derived and/or modified CDS sequence (opt6) from DENV-1__GU131841__SS-prME
ucaguuacgaugcuuuuaaugcuguugcccaccgcuuuagccuuucacuuaacuacacguggaggagaaccacauaugaucguuuccaaacaagaaagagggaaaucgcuauuguucaaaacaaguguuggcguaaauauguguacguuaauagcaauggaucugggagaauuaugcgaagauacaaugacuuauaaauguccacgaauaaccgaagccgaaccugacgacguugauuguuggugcaaugcaaccgauacaugggucacuuacgguacuuguucacaaacaggagaacacagaagagaaaagcgaaguguugccuuagcgccacacguaggacuaggguuagaaacaagaacugaaacauggaugucgucagaaggcgccuggaagcagauccagagaguugaaacuugggcucuccgucauccuggguucacaguuauugcauuuuucuuagcuuacgcaaucggaacaucaauaacucaaaaaggaauuauuuuuauacuguuaaugcuuguuacuccaagcauggcaaugagguguguuggcaucgguaauagagauuuuguggaaggauugaguggagcuacuuggguggaugucguacuagaacauggcucaugcguuacuaccauggcuaagaauaaaccaacacuggacaucgaacuguuaaaaacugaaguuacaaauccugcaguacuaagaaaacuaugcauagaggcuaaaauaagcaauacaacuacagauucucgcuguccaacacaaggugaggcuacauuaguagaagaacaagaugcaaauuucgugugccgacgcacauucguagaucgagguuggggaaauggaugcgguuuauuugguaaggggucgcuauuaacaugcgcaaaauucaaaugcguaacgaaauuggaagguaaaaucgugcaauacgaaaaccuuaaauauaguguaauaguaaccgugcauacaggcgaucagcaucaaguagguaaugaaacaacagaacacgguacaauugcuacaauuacaccgcaagcacccacaagugagauacaacugacggauuauggagcacugacuuuagauugcagcccacggacgggcuuggauuuuaaugaaauggugcuacuuacuaugaaagaaaaauccuggcuaguacauaaacaaugguuccuagauuuaccauugccuuggaccucaggugcauccaccucacaagaaaccuggaaccgccaagaucugcuagucacauuuaagaccgcacaugcgaaaaaacaagagguggucguguuagguagucaagagggcgcaaugcauacagcguuaacuggagccacugagauccaaaccucgggcacgacgacaauauuugcaggccaccugaaguguagguuaaaaauggauaaauugacguugaaaggcaugucuuauguaauguguacaggaucauuuaaauuagaaaaggaaguagcggaaacacaacauggcacuguguuggugcaaguuaaguaugaaggaacugaugcaccgugcaaaauaccguuuaguacccaagacgaaaaaggagucacgcaaaauggcagacuaaucacugcaaauccaauuguuacggauaaggagaaaccaguaaauauagagacggaaccaccuuucggcgaaucguauaucguaguuggagcaggagaaaaggcacuuaagcuaucaugguuuaaacggggauccagcauugguaagauguucgaagcaaccgcacgaggcgcgagacgaauggcaauacuuggcgauaccgcaugggacuucgguucuauuggagggguauucacgucagucggaaaacuugugcaccaaguuuuugggacagcguacggaguauuauuuucugggguuagcuggaccaugaagauugguauuggcauccuauuaaccuggcuaggccuuaacucuaggagcacuucauuaucgaugaccugcauugcuguuggaauggucacacuguacuugggugugaugguucaggccgacaguggauguguuauaaauuggaaagguagagaauugaagugcggaagcgggauauuuguaacaaacgaagugcacacauggacugagcaauauaaauuccaagcugacuccccaaagcggcuuagugcagcuauuggaaaagccugggaggagggaguaugcggaaucagaucugcgacaagacuagaaaacaucauguggaaacaaaucuccaaugaauuaaaccauauccuccucgaaaaugacaugaaguucacugugguugugggcgacgcaaacgggauacuagcccaaggcaaaaaaaugauacgaccucagccaauggagcacaaauacaguuggaaaagcuggggcaaagcgaaaauaauuggugccgauauacaaaauacaacauuuauuauugaugguccggacacaccagaaugcccggauggacagcgugcguggaauauaugggaagucgaagacuacggcuuuggcguuuuuacaaccaacaucugguuaaaacucagggauucauauacacagaugugcgaccaccgauuaaugagcgcugcaauuaaagacucaaaagcgguccaugcagauaugggauauuggauugaaagugaaaaaaacgaaacuuggaaacucgcacgugcgucauuuauagagguuaaaacuuguacauggccuaagucucacacacuuuggagcaauggugucuuagaaagugaaaugauaauaccaaaaauuuauggcggaccaauaagucaacacaauuaccgaccaggauacuuuacccaaacugccgguccauggcacuuaggcaaauuagaauuggacuuugaucugugcgaagggacaacuguaguuguugaugagcauuguggaaaucgaggaccuucccuaagaacgaccacagucacugguaaaaucauacaugaaugguguuguagauccuguacguugccuccgcucagauuccgaggcgaagacggauguugguaugggauggaaauacgaccgguaaaagaaaaggaagaaaaccuaguuagaucuaugguaagugcaggaucaggagaaguagauucauucagcuuaggcauccuuuguguuagcauuaugauugaagaaguaaugagaucuagauggucuagaaaaaugcuuaugacuggaacauuggccgucuuuuuauugcuuauuaugggccaacuaacguggaaugacuugauucgauuauguauaaugguaggagcuaaugcgagcgacaggaugggaaugggcacuacguauuuagcauugauggcaacguucaaaaugagaccgauguuugccgugggauuacuguuccguagauugacuucgagggagguuuuauuguuaaccauagggcuaucguuaguggcgagcguagagcuuccaaauagcuuagaagaacucggcgacgguuuagccaugggaauaaugaugcuuaagcugcugacagaauuucaaccucaccaacuauggacaacauuacuaucucuaacuuuugugaaaaccacacuaucuuuggauuaugcauggaagacaacagcaaugguccucucuaucgucucacuuuuuccuuuaugcuugaguacuacaucucagaaaacaacaugguugccaguuuuacuugggucauuuggguguaagccacucacuauguuucucaucaccgaaaacaaaauauggggacgcaaguccuggccacuaaaugaagguauaauggcgauugggauuguauccauccuucuaucuuccuugcugaaaaaugauguaccauuggcaggcccguuaauugcagggggaaugcuaauugcauguuauguaaucucagguagcucagcggaucuuucacuggaaaaagcagcugagguuucuugggagcaggaagccgaacauuccggagcuagucacaauauauugguugaaguacaggaugaugggacgaugaaaauaaaagaugaagagagagaugauacacuuacaauccuucuaaaggccacuuuacuagcaguaucuggaguauacccuaugaguauaccagcgacgcuauucguaugguacuuuuggcaaaaaaaaaaacaaagaucaggcguacuaugggauaccccuucaccuccagaagucgaaagagcgguauuggaugauggcauuuacagaauauuacaaagagggcuacuuggacgcucgcaaguuggaguugguguauuccaagaugggguguuccauacaauguggcacguuacaaggggagcggucuuaauguaccagggaaaacgauuagagcccucgugggcgucaguuaaaaaagauuuaauuucauaugggggcggcuggcgauuccaggggucauggaauacuggagaagaaguucagguaauugcaguagagccaggaaaaaauccaaagaauguucaaacaacuccaggaacauucaaaaccccagagggagaaguaggugcaauugcgcucgauuucaaaccaggaacaucaggaucuccgauuguaaaucgggaaggcaaaauaguagggcuuuacggcaauggcguaguaacaacuucuggcacauaugucucagccauagcgcaagcaaaagccucgcaagaagggccacuaccugaaauagaagacgaaguauucaagaagagaaaccugacuaucauggaucuccauccuggaucagggaagaccaggcgguaucuuccggccauaguucgggaagcuauaaagagaaaacuaagaacucuaauuuuagcaccaacaaggguaguagcuucugaaauggcggaggcuuugaaggggaugccaaucagauaccagacuacugcuguuaaaagcgaacauacaggacgcgaaauagucgaccuuaugugccaugcgacauuuacgaugagauuauuaucgccaguccgaguaccgaacuauaauaugauaaucauggaugaagcccacuuuacggauccugcaucuauagcggcacgaggauauauauccacuagagucggcaugggagaagcugcugcaauuuuuaugacagccacuccucccggaagcguagaagccuuuccacaaagcaaugccguaauccaggaugaagagcgcgauauaccagaaagaagcuggaauaguggguaugacuggaucacagacuuuccagguaaaacaguaugguucguacccaguauaaagagugguaaugacauagcuaauuguuugcguaaaaauggcaaaagagugauucaacugucgagaaaaacguuugauacagaauaucaaaaaacgaaaaauaacgacugggacuauguaguaacgacugacauuagugagaugggugccaauuucagggcagauaggguuauugaucccaggagaugcuuaaaaccugugauuuuaaaggacggcccagagagagucauacuagcaggcccuaugccagucacuguugcaagcgcugcacaacgacgcggaagaauagguagaaaucaaaacaaagaaggugaucaauacguauauaugggucaaccauuaaacaaugaugaggaccacgcucauuggacagaggcaaaaaugcuacuagauaauauaaauacuccugaagguauaauaccggcacuauuugagccugagagggaaaaauccgcugcaauagacggagaauaccgacugagaggggaggcucgaaaaacauuuguagaacugaugcgaaggggagacuugccaguuugguuaagcuauaaaguagcaagcgaaggauuucaguauucagauaggagauggugcuuugauggcgaacgaaacaaucaagucuuagaggagaauauggauguggaaauauggacaaaagagggagaaaggaaaaaauuaagaccaaggugguuggaugcacgcacauacagugauccacuagccuugagagaauuuaaggaauucgcagcgggucgucgaucgguuucaggagaucuaauuuuggaaauaggaaaguuaccccaacaccucacgcuuagagcucaaaacgccuuggauaacuuagugaugcuucauaacuccgagcaaggagguaaggcguaucgacaugcaauggaggaacuuccugauaccauagaaacauuaauguuauuggcauuaauagcaguacuuacuggaggaguaacauuauuuuuccucagcgggaaagguuugggaaagacaucgauuggccugcuuugugucacagcgucaucugcgcuguuguggauggcaucgguagaaccccauuggauugcggccuccauaauauuagaauucuuucuuauggucuuacuuaucccagagccagaucggcaaagaacuccacaggacaaccaacuagcauaugugguaauagggcuuuuauucaugauucuuacuguggcugcaaacgagaugggacuucucgagacuacaaaaaaagacuugggaauaggguaugucgcggcagagaaccaccaacacgcaacaauguuagacguagaucuacacccagcaucagcauggacacuauaugcaguugcaaccacaguaauaaccccaaugaugaggcauacaauagaaaacacaacagccaauauaagccugacugcuauugcaaaccaagcagcaauacugaugggauuagacaaaggauggccaauuucuaaaauggauaucggcgucccacuauuggcguuaggaugcuauagucaaguaaacccacugacuuugaccgcagcgguucuuauguuaguagcacauuaugccauaaucggaccuggguuacaggccaaagcgacaagggaggcacaaaaaagaacugcugcugguauuaugaaaaauccgacaguugacgguauugucgcaaucgauuuggacccaguuguuuaugacgccaaauuugagaaacaguuggggcagauuaugcuucuuauacuaugcacaucucaaauauugcuaaugcguaccaccugggccuugugugaaucaauuacauuagcuacugguccuuugacaacccuaugggaggguucaccgggaaaguuuuggaacaccacuauagcaguuucuauggcgaacauauucagaggaucauauuuagccggggcagggcuggccuuuucccuaaugaaauccuugggaggugguagacgaggcacaggugcacagggugaaacgcuuggggaaaaauggaaacgacaguuaaaccaacuaucuaaaucagaauuuaauacuuauaaaagguccggaauaauggaaguagaucgaucagaagcaaaagagggacuuaaaaggggagagaccaccaagcaugccgugucgagaggaacagcuaaacugagaugguucguagaaagaaacuuaguaaaaccagaggguaaaguuauugaccuaggguguggaaggggaggcuggucguauuacugugccggauugaaaaaaguuacugagguaaaaggguauacgaaagggggaccgggacaugaagagccgauaccaauggcuaccuacgguuggaauuuaguuaaacuacauucaggaaaagacguauuuuucaugccuccggagaaaugcgacacguuauugugcgacauuggugagucaucuccaaacccgacaauagaggagggacguacuuuacgaguuuugaaaaugguggaaccuuggcuaagggguaaucaauuuuguauuaaaauauuaaacccuuauaugcccagcguuguagagacuuuagaacaaaugcaacgaaaacacggcggaauguuaguacguaaccccuuaucccgaaauucuacccaugagauguauugggugagcuguggaacugguaacaucguauccgcaguaaauaugacaucccgaaugcuuuugaauagguuuaccauggcacacaggaaaccaacauacgagagagacguagauuuaggagcgggcacgagacauguugcuguagaaccugaaguagccaaucuagacauaauaggucaaaggauugaaaauauuaaaaaugaacauaaaagcacguggcauuaugacgaagauaauccauauaaaacgugggcauaccacggaaguuaugaagucaagccgagugguucagcaucauccaugguaaauggugugguacgauuacuuacaaaaccaugggauguuauaccaaugguaacacaaauugcaaugaccgauaccacgccuuuuggucaacaaaggguauuuaaggaaaaaguugauacgcgaacccccagggcgaaaaggggaacaacucaaauaauggaaguuacagcuaaauggcugugggguuucuuaucucguaacaagaaaccuagaauauguacaagggaagaauuuacucggaaagugagaaguaacgcugcuauaggagcaguauucguggaugaaaaccaauggaacagugcgaaagaagccguagaagaugaaagauuuugggauuugguucaucgcgaaagagaauuacauaaacaggguaagugcgcuacaugcguauauaacaugauggggaaacgagaaaaaaaauuaggugaauuugggaaggcaaaaggcagucgggcuauaugguauauguggcuuggugcaagauuccuugaauucgaagcacuaggauuuaugaaugaagaucauugguuuucgagagagaacucccucagcggugucgagggcgaagggcuacauaagcuaggauauauacugcgcgacauuaguaaaauuccgggcgggaauauguaugcagacgacacugccggaugggauacaagaauuacugaagaugacuuacagaaugaggcgaagauaacagauauaauggaaccagagcacgcacuacucgcaacaucuauauuuaaauugacauaccaaaacaagguuguucguguccaaagaccggcaaaaaaugguacagucauggacguaauaucgcgacgagaccaacguggcucgggccaaguaggaacuuacgggcugaacacauucaccaauauggaaguacaauuaauuagacaaauggaaucugaagggauauuccuaccgucggaauuagaaacaccuaauuuggcagagagagcacuagauuggcuugagaaacacggcgcagaaagacuaaaacguauggcuauaucuggagaugacugcguaguaaaaccuauagacgaucgguuugcaacugccuuaacagcauugaacgauaugggaaaaguccgcaaagacauaccccaaugggagccaucaaaggguuggaaugacuggcaacaagugccguuuugcucacaucauuuucaucaacuaauuaugaaagauggaagggagaucgugguaccgugcaggaaccaagaugaacugguaggccgggcaagaguaucucagggagcggguuggaguuuacgugaaacagcuuguuuaggaaagucuuacgcacaaauguggcaacugauguauuuccaucggcgagaucuuaggcuggcagcaaaugcgaucugcagugcugugccuguagauuggguaccaacuagcagaacaacuuggagcauccacgcgcaccaucaauggaugacaacggaagacaugcuaucaguauggaaccgaguguggaucgaggagaauccuuggauggaagauaaaacccauguuucaucuugggaagaaguacccuauuuagguaaaagggaggaucaaugguguggcucauuaauuggucuaacagcacgagcuacaugggcgacgaauauacaagucgccauuaaccagguacgcagacucauugguaaugaaaauuacuuagacuacaugacaucaaugaaaagauucaagaacgaauccgacccugaaggagcuuugugguaa

SEQ ID NO: 21449 - RNA, 9879 nt, Artificial Sequence
  derived and/or modified CDS sequence (opt6) from DENV-1__GQ868601__SS-prME
agcguaaccaugcuacuaauguuauuacccacugcauuagcguuucaucuaacuacucguggaggagaaccacauaugauaguaucaaaacaagaacguggaaaaagccuauuauuuaagaccaguguaggcguaaacaugugcacucuaauagcaauggaccuuggcgaacuaugcgaagacacuaugacuuauaaaugcccucguauuacggaagcagaaccagaugacgucgauugcuggugcaacgccaccgauacauggguaacguacggcacaugcucccaaacuggagaacaccgcagggauaaaagaucaguagcuuuggccccacacguagguuuaggccuagaaacucgaacugaaacauggaugagcucagaaggcgccuggaagcaaauccaaaaaguagagaccugggcauuacgccauccaggcuucaccguaauagcauuauuccuagcgcaugcgauagggaccuccauuacacaaaaaggaauuauuuucaucuuguuaauguuaguuacgcccucuauggccaugagaugugugggaauagguaaccgagacuuuguagaaggauuauccggggcaacuugggucgacguaguucuugaacacggguccuguguuaccaccauggccaaaaacaaaccaacauuagauauagaauuacuaaaaaccgagguaacaaacccagccguguuaagaaagcuaugcauagaagcaaaaauuucaaauaccacaacggauagcagaugcccgacacagggagaagccacauuaguagaagaacaagaugcuaacuuuguaugucgucgaacauucguggacaggggcugggguaauggaugcgggcuauucggaaaagguucacuuuuaacaugcgcgaaauuuaaaugugucacaagauuagaggggaaaauagugcaauacgaaaaccucaaauauaguguaaucguaaccguacauacgggggaucagcaucaaguaggcaacgagacaaccgaacacggaaccauagccacaauuacuccucaagccccgacgucugaaauacaacugacggacuacggugcuuuaacucuggauugcuccccgcguacaggacucgacuuuaacgaaaugguucuauuaacaaugaaagagaaaagcuggcuuguacacaagcaaugguuccuagaccuaccguuaccauggacaaguggagcaucaaccucucaagaaacuuggaacagacaagaccuauuggugacauucaaaacugcccaugcuaaaaagcaagagguaguaguauuaggaucacaagaaggugccaugcacacugcauuaacaggggccacggaaauacaaacuucgggaacaaccacaauuuucgccggucaccuaaaauguagguuaaaaauggacaaauuaacacugaaaggcaugaguuacgucaugugcacgggaaguuuuaaauuggaaaaggaaguggcugagacacaacacggaacuguccuagugcaaguaaaguaugaaggcacagaugcuccauguaagauaccuuuucugacacaagacgagaaagguguuacucagaacggccgauuaauuacugcgaacccgauaguuacagauaaagaaaaaccaguaaauauagaaacagaaccacccuucggcgaaucuuacauaguuguaggagcuggugagaaagcacuuaaauuaaguugguuuaagaaaggaucaaguauaggaaaaauguucgaggcgacggcaaggggagcgaggaggauggcuauauugggagauacagcaugggacuucgguaguauaggggguuuauucacaucaguuggaaaguuaauucaucagguuuucgguacugcauacggcguacuauuuucaggugugucauggacaaugaaaaucgggauaggaauccuacuaacuugguuggggcuuaacagcagaaguacaagucuaucuaugacguguauagcaguuggaaugguuacccuauaccuuggugugauggugcaagcagauucuggauguguuauaaauuggaaaggccgugaacuaaaguguggcagugggauuuuuguaacaaaugaggugcauacuuggacggaacaauacaaauuucaggcagacucuccaaaaagacuaucagccgccauuggaaaggcgugggaagaaggagucugcgguauucguucagcuacacgacuagaaaacaucauguggaaacagauuagcaaugaacucaauuacauacuacuagaaaacgauaugaaauucacaguaguaguuggagacgcaaacgggauccuagcacagggcaagaaaaugauaagaccgcaaccgauggagcacaaguauucauggaagaguuggggcaaagcaaaaauaauuggugcugauauucaaaauaccacuuucauaauugauggaccggacacaccugaguguccggaugaucaaagagcauggaacauaugggagguugaggacuacgguuuuggaauauucacuacgaauauuuggcuaaaauugcgagacucauauacacaaaugugugaccauagguuaaugagugcugcaauaaaagauagcaaagcuguucaugcggacaugggguacuggaucgagucagagaaaaaugaaacauggaaacuagcgagagccucauucauugaagucaagacgugcauuuggccaaagucucacacccuguggaguaacgguguguuagagucugagaugauuauaccaaaaauauacggagguccgauuucacaacacaauuacagaccugguuacuucacacaaaccgcaggaccuuggcaucucggaaaacuugagcuagauuucgacuuaugcgaagggacgacuguagucguagaugaacauuguggcuauagagggcccagcuuaagaaccaccacagucacaggaaaaauaauacaugaguggugcugcagaucauguacucucccgccuuugcgguuuagaggcgaagacgggugcugguaugguauggaaauacgcccagugaaggaaaaggaagaaaaccuuguacgcucgaugguaucugcgggaucaggugaaguagauuccuucucccuggggauucuaugugucucaauacuaauugaagaaguaaugaggucucgauggucaagaagaaugcuaaugacagguacacuagcaguuuucuuacuauuaauaaugggacaguugacauggaaugauuuaaucagguuaugcauaaugguaggugccaacgcuucagacagaaugggcaugggaacuaccuaucuagcucuaauggcgaccuuuaaaaugcguccuauguuugcaguaggcuuacuuuucaggcgauuaaccucaagagaaguacuucuguuaaccauaggacuaucacuuguagcaucaguugaauugccaaacagucuagaagaacucggagauggacuagcuaugggaaucaugauguuaaaacuccuaacagauuuucagccacaccagcucuggacaacccuucucagcuuaacguuuauucguaccacucuuucacucgacuacgccuggaaaaccauggcaauggcuuugucaaucgugucauuauuuccauuaugccugaguacuacaagucagaaaacaacaugguugccagucuugcugggaucauucggcuguaaaccucuaaccauguucuuaauaacagagaacaaaauauggggucgcaaaaguuggccuauaaaugaggggauuauggcaguugguauuguaucuauacucuuaucaagucuccucaaaaacgacguuccucucgcaggaccacucauagcaggaggaauguugaucgcauguuacgugauuucuggaucaucagcugacuuaucacuggagaaggcugcugagguaagcugggaggaagaagccgaacauuccggaaccucacauaauauccuaguugaagugcaggaugauggcacaaugaaaaucaaagacgaagaacgagacgauacgcucacaaucuugcuaaaagcuacgcuacuugcaguuagugguguauacccuaugagcauuccugccacucuuuucguaugguacuucuggcagaagaagaaacagcgaagugguguucugugggacacuccuucgcccccagagguggaacgggcgguacuugacgauggaauauacagaaucuuacaacgaggguuacuuggcagaucgcagguuggugugggcguguuucaagauggaguuuuucauacaauguggcacguaacacgaggcgccguucuuauguaccaagggaagagacuugagccaucgugggcaagcgucaagaaagacuuaauuucguacgguggaggauggcguuuccagggaucguggaacaccggggaagaaguacaggucaucgcuguagagccggggaaaaaucccaaaaacguccaaaccacgccugguaccuuuaaaacaccagaaggagaaguaggagccauagcucuagauuuuaagccggguacgucugggucucccauaguuaaucgagaaggaaaaauagugggucuuuaugguaauggugucguaacaacuucaggaacuuacgucagugcaauagcccaagcaaaggcaucacaagaaggaccacucccagaaaucgaagacgaaguauuuaagaaacggaaucucacaauaauggauuugcacccagguuccggcaagacgagacgguaucucccagcgaucguuagggaagcaauaaaaagaaaguuaaggacccucauccuugcucccacuaggguaguagcaucugaaauggcggaggcacuaaaaggaaugccaauaagauaccaaacaacugcaguuaaaucugaacauacuggaagagaaaucgucgacuuaaugugucaugcaacguuuaccaugcgucuccuaucgccgguucgagugcccaauuauaauaugauaauuauggacgaagcccauuuuacagacccugccagcauagcagcccgaggauacauuucgacaagaguuggcaugggagaagcagcugcgauauucaugacagcaacgccucccgguuccguagaggcauucccacagucuaaugcaguaauucaggacgaggaaagggacaucccagaaaggucauggaacagugguuaugauuggauuacagauuuuccagguaagacuguaugguucguaccaucaauaaaaagcgguaaugacauugcuaauugucuuaggaaaaauggcaaaagagugauacagcuaagccgaaaaacauucgauacugaguaucagaaaacgaagaauaaugauugggauuauguuguaacgacugauauaucagaaaugggagcaaauuuuagagcagaccgaguaauagauccuaggcgaugucuaaaaccgguaauuuuaaaggacggcccugaaaggguaauuuuagcggggccgaugccaguaacuguugcaagugcagcucaacggagagggcguauugggagaaaccaaaauaaggaaggugaccaauacauuuauaugggacaaccacuaaauaacgacgaggaucacgcucauuggacagaagcaaaaauguuauuagacaauauaaauacccccgaggguauuaucccugcgcucuuugaaccagaaagggagaaaagcgcagcaaucgauggugaauauagacuaaggggagaggcuagaaaaacuuuuguggaauuaaugcgaagaggggaucuccccgucuggcugaguuauaaagucgcuagugaaggguuucaauauagcgauaggaggugguguuuugauggugaaagaaacaaucaagugcucgaagagaacauggacguagagauauggacaaaagaaggugaaagaaagaaauuaagaccaagguggcucgacgccagaaccuauuccgacccuuuagcauuaagagaauuuaaagaauuugcugcagguagaagaagcguaucgggagaucuaauauuagaaauugguaaacuuccgcaacaccuaacauuaagagcucaaaacgccuuagauaaccuuguaauguugcauaauucugaacaaggagggaaggccuacagacaugcuauggaagaauuaccagacaccaucgagacacugauguugcuugcguugauagcaguuuugacaggagggguaacucucuucuuucuaucaggcaaaggauugggaaagacaaguauuggucuacuauguguuauggcuucaagugcacucuuguggauggcaucggucgaaccacauuggauagcugcaucuaucauucuagaguucuuuuugaugguccuuuuaauaccggaaccagauagacaaagaacaccacaagacaaucaacuggcauauguugucauaggauugcucuuuaugauacuaacgguagccgcaaaugaaaugggucucuuagaaacaacuaagaaagaccucgguauagggcacguagcagcagaaaaucaucaucaugcaacaauguuagacguugaucuucgccccgccuccgcuuggacauuguacgcgguugcuaccaccgucaucacaccaaugaugagacauaccauugagaacacgacagcaaacauuagcuuaacggcgaucgcgaaccaagccgccauucuaaugggacuagauaaaggguggccgaucucaaagauggacauaggaguuccuuuacuugcauuagggugcuacucucagguaaacccauugacuuuaacugcagccguguuaaugcugguggcacauuacgccauaaucgggccaggacuucaagcuaaggcuacacgagaagcacaaaagagaacugcugccgguauuaugaaaaaucccacaguggauggaauuguuacaauagaucuagauccaguuguguaugacgcaaaauuugaaaagcaauuaggacaaauaauguuacuaauacuauguacaagccaaauucuccucaugagaacaacuugggcccuaugugaaucaaucacacuagcaacgggaccuuuaacaacacucugggaagggucaccuggaaaguucuggaacacaacuauugccguuucuauggcaaauauuuuuagagguuccuaccuagcaggagcaggcuuagcauucucccuuaugaaaucacucgggggaggccgccgugguacaggagcacaaggcgaaacucucggagaaaaauggaaaagacaacuaaaucaauuaucgaagucagaauuuaauacguauaagcguucggggauuauggaagucgaucggucagaggcaaaagaaggauuaaagcgcggugaaacuacaaaacacgcgguaagucgagguacugcuaaguuaagaugguuuguugaacgaaaccuggugaaacccgaaggaaaagugaucgaccuugguugcgguagaggcgguuggaguuauuauugcgccggauugaagaaaguuacugagguaaaaggauauacuaaaggagggccaggacacgaagaaccaaucccaauggcuacuuauggguggaauuuggucaagcuacauagcggaaaagacguauucuuuacuccacccgaaaagugcgauacguuacuuugcgauauuggagaaaguucaccuaauccuacgauugaggaagguaggacgcuuagaguauuaaagaugguugaaccauggcuucgaggcaaucaauuuugcauaaaaauacucaacccauacaugccaucagucguagaaacguuagaacaaaugcaacgaaagcaugguggaaugcucguacgaaauccacuuucgcggaauagcacgcacgagauguacuggguuagcuguggcacaggaaacaucgucagcgcuguaaacaugacaaguagaaugcuacuaaaucgauuuacuauggcacaucgaaagccaacauaugagcgugauguagaccucggggcugggacaagacacguagcggucgaaccggaagucgcgaauuuagauauuauuggccaaagaauagaaaauauuaaaaacgagcacaaauccacauggcauuaugaugaagacaauccauauaagacgugggcguaucacggaucguaugaagucaaacccagcggcucagcaucuaguaugguuaauggaguaguacgacugcucacgaaaccaugggacgugauaccgauggucacgcaaauagcaaugacugauacaacacccuucggacaacagcggguauuuaaagagaaaguggauacaagaaccccacgagcuaagagagguaccgcacaaauaauggagguaacagccaaauggcuuuggggguuucugucucgaaacaagaaaccgcgcauauguacaagagaggaguucacacguaaaguacggaguaacgcugcaauaggagcaguuuuuguggaugaaaaccaauggaacucagcgaaggaagcaguggaagaugaacgauucugggacuuaguucaucgcgaacgcgaacuacauaagcaaggcaaaugcgcaacauguguauauaauaugaugggcaaacgagagaagaaacuaggagaguucgguaaagcaaaagggagccgggccauaugguacaugugguugggagcgcguuuucuagaguucgaggcucuagguuucaugaaugaagaucauugguuuucacgugaaaauucucuaucuggcguggaaggagaaggauugcacaaauugggauauauauuaagagacauaucaaaaauuccugguggaaauauguaugcagacgacacagcuggaugggacacaagaauaacugaggaugaucuacaaaaugaagccaaaaucacggacauaauggagccugagcacgcccuucuugccacauccauauucaagcugacauaucaaaacaaaguaguacggguacaaagacccgcuaaaagugguacgguaauggaugucauaucuagaagagaucagagagguaguggucaaguagggacauacggcuugaacacuuuuacuaauauggaagugcagcuaauaagacaaauggagagugaggguauauuuaguccaucugaacuagaaaccccaaacuuagcaaaaagaguauuggauuggcuagaaaagcaaggagcagagagacuaaaaagaauggcuauaagcggugacgauuguguaguuaagccuaucgaugacagauucgccaccgcuuugacugcuuugaaugacaugggaaaaguaagaaaagauauaccgcaaugggagccaucuaaaggauggaacgauuggcaacagguuccauuuuguucccaccacuuucaccaacuaauuaugaaagacgguagagaaauuguagugccuugcaggaaccaagaugagcuaguuggaagggcaagagugagucagggagcaggcuggucguugagagagaccgcaugucuagguaaaucauaugcucaaauguggcaacugauguauuuccauagaagagaccuccgucucgcagcaaaugcaauuuguagugccguaccuguggacuggguaccaaccucucgcacgacauggucuauacaugcacaccaucaauggaugacuacugaggauauguuaaguguauggaaucgaguuuggaucgaggaaaauccuuggauggaagacaagacacauguuucauccugggaagaaguucccuaucuagguaaaagggaagaccaaugguguggaucauuaaucggacuaacggcucgcgccacaugggcaacaaauauccaagucgcuauuaaucagguaagacgacuuauagggaacgaaaauuaucuugacuacaugacaucaaugaaaagguuuaaaaaugaauccgacccagagggagcgcuaugguga

SEQ ID NO: 21450 - RNA, 9879 nt, Artificial Sequence
  derived and/or modified CDS sequence (opt6) from DENV-1__EU660390__SS-prME
ucagugaccaugcuauuaauguugaugccaaccgcacuagcauuccaucucacgacucgcggaggagaaccucauaugauaguaucaaaacaagaaagaggaaaaagucuguuauuuaaaacaagugcaggaguuaauauguguacacucauugcuauggauuuaggugaauugugugaagauacaaugacguauaaaugcccaagaaucacagaagcagaaccagacgaugucgacuguugguguaacgcaacagacacuuggguaacguacgggacauguucacaaacgggagaacaucgcagggacaaacgauccgucgcuuuagcaccgcauguagggcuuggucuagaaacuagaacagaaacauggaugaguuccgaaggcgcauggaaacaaauacaaagggucgaaacaugggcucugcggcauccaggauucacgguuauagcgcuauuccuugcacaugcaauagguacaaguauuacacaaaaaggcauaauuuuuauacuacuuauguuaguaacaccuaguauggcaaugagaugcgucggaauagguucaagagacuuuguagaggguuugucaggugcgacaugggucgacgucguucuagagcacgguaguuguguuacuaccauggcaaaagacaaaccgacguuagauauagagcuacuuaaaacugaaguaacuaacccagcaguacuacggaaauuaugcauugaagcuaaaauuaguaauacgacaacagauaguaggugcccaacacaaggagaggccacguuaguugaagaacaagaugcaaacuuuguuugccguagaacuuuuguagaucgaggguggggcaauggcugcgggcuauucggaaaagguagucucauuacaugugcaaaauuuaaauguguaacuaaauuagaagggaaaaucguccaauacgagaauuugaaauauuccguuauaguaacaguacacaccggcgaccaacaccagguaggaaacgaaucgacggaacauggcacaacagcgacaauuacuccacaagcuccaacgacggaaauccagcucacggacuacggagcgcugacgcucgauuguucaccacggacugggcuagacuuuaacgagaugguguuauuaaccaugaaagaaaaauccugguuaguacauaaacaaugguuucuggaucuaccacuaccauggacuucaggagcuagcaccagccaagagaccuggaaccgacaagaccugcuaguuacguucaaaaccgcacacgccaagaaacaagaaguugucguguuagguagucaagagggugcuaugcacacagcuuugaccggcgcuaccgagauucaaacuucaggaacaacgacuauauucgcaggacauuuaaaaugcagauugaaaauggacaaacugacccucaaagguaugaguuauguuauguguacuggaucauucaaauuagaaaaagaaguggcagaaacgcaacauggaacuguauuaguucagauuaaguacgaaggaacugaugccccauguaaaauuccguucucgacacaagaugagaaaggaguuacccaaaacggcaggcuuauaacagcaaauccgauaguuacggauaaagaaaagccgguaaacauagaagcugagcccccauucggagaaaguuacauaguaaucggagcaggcgagaaagcacuaaagcucucaugguuuaagaaagguucgucaauuggcaaaauguuugaagcgacggcaagaggugcgagacgaauggcaauacugggugauacagcgugggauuuuggaucaauuggaggugucuuuaccucaguuggaaaauuagugcaccaaauuuucggaacagcuuacggaguguuauucaguggcguuucuuggacaaugaaaauuggcaucggggucuuguugaccuggcucggguugaacucgcgaucuacaagccuaucuaugacuugcauugcaguaggcuuaguaacguuguaccucgggguuaugguacaggccgacucagguugcgucauuaacuggaagggcagagaauugaaaugugguucgggcauauuuguuacaaacgaaguccauaccuggacggagcaauacaaauuucaagcugauagcccaaaaaggcugucugccgcuauaggaaaggcuugggaagaagggguaugugguauacgcucagcaaccaggcucgaaaauauaauguggaaacaaauuaguaaugaacucaaucauauuuuauuagaaaaugauaugaaauuaacagucauagucggagacguagcugguauacuaggacagggaagaaaaaugauuaggccacagccuauggaauauaaguauucuuggaaaucguggggaaaagcuaagaucauuggagcagaugcccaaaauacuacuuuuauaauagacggccccaauacacccgaauguccggaugaucaaagagcuuggaacauaugggaaguagaagauuaugguuuuggaauuuucacaacaaacauuugguugaaauugagagauucauauacccaaguaugugaccauagacucaugucggcugcgauaaaggauagcaaagcaguucaugccgauauggguuauuggauagaaagugagaaaaaugaaacauggaaacucgcaagggccagcuuuauagaagugaaaaccuguauauggccuaagucccauaccuuguggucuaacggaguccucgaaucugagaugauaauucccaagaucuauggcggaccaauaucccaacauaacuauagaccuggguauuuuacucaaacagcagggccuuggcauuugggaaaguuagaguuagauuuugaucuaugugaaggcacaacuguaguaguggaugaacacugcggcaaucgaggacccagcuugaggacaacaacuguaacagggaagaucauucaugaaugguguugcagaucauguacauuacccccacuucgauucagaggcgaagaugguuguugguauggcauggaaauuagaccaguaaaggagaaagaagaaaaccuuguuaagagcaugguaucugcuggaucaggagaaguagacucauucucgcuaggccucuuguguauaucaauaaugauagaggagguaaugagaagucguuggucccgcaaaaugcuaaugacaggcacauuagcaguauuuuuccuacucauaaugggucaacucacauggaacgaucugaucagauuaugcauuaugguuggagccaaugcgucugacaggaugggcaugggaacuacauaucuugcucuaauggcaacauuuaaaaugagaccaauguuugcaguaggcuuguuguuuaggagauugacauccagagagguucuguuauuaacuaucggucucucgcuaguagcuagugucgagcuaccuaauucucuugaagaauuaggagacggcuuggcgauggggaucaugauacucaaacuuuuaaccgauuuccagucacaccaacugugggcaacacuucugagcuuaaccuucauaaaaacaacuuucucacuacauuaugccuggaaaacaauggcaaugguacucucaauaguuucauuguuuccccucuguuugucaacgacuucucagaaaacuacaugguuaccuguucuauuagguucauuagguuguaagccguugacuauguuuuuaauagcggagaacaagauuuggggacguaaaucauggccauugaacgaaggaaucauggcuguggguauaguguccauauuguuaucaucguuacuuaaaaaugauguuccacuagcugggcccuugguugccggaggaauguuaaucgcauguuacguaauauccgggucuuccgcugaucucucccuugaaaaggccgcugaaguaagcugggaagaagaagccgagcauagcggagccagucacaauauauuagucgaaguucaagacgauggaacgaugaaaauaaaagaugaagaaagagacgauaccuuaacgauuuuauuaaaggcgacacuuuuggcaguuagugggguuuauccguugucaaucccugcuacccuauucguuugguacuuuuggcagaagaagaaacaacgaucuggcguacucugggacacuccgucgccaccggaaguagaacgagcaguucuagaugauggaauauauagaauaaugcaacguggauuacuuggaaggagucaaguaggaguagggguuuuucaagagaauguauuucauaccauguggcauguuacacggggagcaguauugauguaccagggaaagcgauuagaaccgucuugggcaucgguuaagaaggaucuaauaucauacggaggagguuggcguuuacgagggaguuggaacacaggagaagaaguucagguaauagcugucgaaccaggcaaaaauccgaagaauguccagacggcgcccgguaccuucaaaacuccugaaggagaagucggcgccauagcauuggauuuuaaacccggaacuucuggcucucccauagucaauagagaaggaaaaauagucggcuuauauggaaacggggucguaaccacaucuggcacuuauguaucagcgaucgcacaagcuaaggcuucucaagaagggccguuaccagagauagaagaugagguauucagaaaaaggaacuugacaauaauggaucuucauccaggaucuggaaagacucggagguacuugcccgcuauuguaagagaagcgaucaaacguaagcugagaacccugauauuagcuccuacgaggguaguagcuagcgaaauggcggaagccuugaaaggaaugccaauuagguaccaaacuacugcagucaagagugagcauacagguaaagagauaguagauuuaaugugucaugcuacauucacuaugagacuacuuaguccggucagaguaccaaauuacaauaugaucaucauggacgaagcacacuuuacagauccaaguaguauugcggcgcgcggcuacaucaguacuagaguuggaaugggagaagcagcugccauuuuuaugaccgcuacuccuccgggcucugucgaagcguucccgcaaaguaacgcuguuauucaagaugaggaacgcgauaucccugaaagaucguggaauagugguuacgaauggaucacugacuuuccaggaaagacaguaugguucguaccaaguauuaaaucaggcaaugauaucgcuaauuguuugaggaaaaacggcaaacgugugauacagcuaagcagaaaaaccuucgauacugaauaccagaaaaccaagaauaaugauugggacuaugucguaacaacggacauauccgagaugggagccaauuuucgagcagacagaguaauagauccgcgaagauguuugaaaccgguuauacugaaagauggaccagagagagucauucuugcuggacccaugccugugacuguagcuucugcugcgcagagacgagggagaauagguagaaaccauaacaaagagggagaccaauauauuuauaugggccaaccuuuaaauaaugaugaggaucaugcucauuggaccgaagcaaaaauguuauuagauaacauuaacacuccagaaggaauuaucccggccuuauuugagccggagagggaaaagucugcugcaguagauggcgaauauaggcuacguggugaagcaagaaaaacauucguggagcucaugagacguggagauuugccagugugguuaaguuauaaagucgcuuccgagggauuccaguauagcgauagacguugguguuuugauggugagagaaacaaucaaguacuagaagaaaauauggacguagaaauuuggaccaaagagggagaacggaagaaauuacggccuagaugguuggacgcaagaacauauagugauccguuagcauugagggaguucaaagaauuugcugcgggacgcagaucugugaguggugaccuaauauuagaaauagguaaacucccccaacaccuaacacaacgagcucagaacgcauuagacaaucugguuauguuacacaauucugagcaagguggcagagcuuaccgccaugcuauggaagaauuaccagauacaauugaaacucuaauguuacuugcccuuauugcaguacuaacugguggugucacauuauuuuuccugucugggagagggcuaggcaaaacuuccauaggucuauugugcguuauggcuuccaguguauugcuauggauggcuucaguugaaccacacuggauugccgccaguauaauccucgaauuuuucuugaugguauuauuaauaccagaaccugaucgacaacguacaccacaggacaaccagcuugcuuacguagucauuggccuccuuuucaugauacuaacaguggcggcaaaugagaugggacuauuagaaacuaccaagaaagaucuugguauagggcaugucgcagucgaaaaucaucaucaugcagcgaugcuggacguagauuuacaucccgcaagugcauggacauuauacgcuguugcuacaaccauaauaacgccuaugaugaggcauacaauagagaacacuacugccaacauuagucugaccgcaauugcaaaucaagccgcaauucuaaugggacucgauaaaggauggccuaucucaaaaauggacauagguguaccgcuucuugcauuaggcugcuacagucaagucaauccacuaacuuuaaccgcagcaguuuuaauguuaguagcacauuaugcuaucauaggaccgggauuacaagcgaaagcuacaagggaagcccagaaacgaacagccgcaggaauaaugaagaaucccacuguggaugguauuguggcuauugauuuggacccagugguuuaugacgccaaguucgaaaaacaacugggacaaauuaugcuucugauauuguguaccagucaaauucuucugaugcgaacaacaugggcauuaugugaaaguaucacccuagcgacagguccacuaaccacauugugggaagguaguccagguaaauuuuggaacacuacuauugccgugucuauggcaaacauauuuagaggaagcuaucucgccggugcaggucuagccuuuucauuaaugaaaucauuaggagguggacgucgaggaacaggcgcacaaggggaaacuuuaggagagaaauggaaaaggcaacugaaccaacucucuaaaucugaguuuaacaccuauaagagaagcggcaucauggagguagacagauccgaggcaaaggagggacuaaaacggggagaaacuacaaaacacgcgguaaguagagguacugccaaauuaaggugguuuguagagaggaaucuagucaaacccgaagguaaggucauagauuuaggaugcggacgggguggaugguccuacuauugcgcgggucuaaagaaagucacugagguaaaagguuauacuaaaggugguccuggacacgaggaaccuauuccgauggccacguaugguuggaacuuagugaagcuacacucagguaaagacguauucuucauaccaccagaaaagugcgauacccuauuaugugacaucggagaaucuucucccaauccaacaauagaagaaggacgaacucuacgaguacuaaaaaugguagaaccaugguuaagagguaaucaguucugcauaaaaauacuuaaucccuauaugccaucaguaguggaaacuuuggaacaaaugcaaagaaaacauggggguauguugguucgaaacccguuaucacgcaacucuacccacgaaauguauuggguuaguugcggaacuggcaauauaguuucggccguuaauaugacaagucgaauguuacucaaucgauuuacaauggcucauagaaaaccaacauacgagcgcgauguagacuuaggaacuggaacaagacacguagcuguugaaccagaaguagcuaaucuagauauaauuggccaacgaauagaaaauauuaaacaugaacauaaaucgacauggcauuacgaugaggauaauccauacaaaacuugggcuuaucauggaucguaugaaguaaaaccaucagguucagcaagcucaaugguaaacggcgucgugaaacugcuuacuaaaccaugggacguaaucccuaugguuacccaaauagcuaugacagacaccacgccuuucggacaacagcgaguuuuuaaagaaaaagucgauaccagaaccccaaaagcuaagaggggcacugcgcaaauaauggaggugacagcgcgcugguuguggggcuuuuuaucgcgaaacaaaaagccacgaauuugcacuagagaagaguuuacacgaaaaguacgcucuaaugcugcgauuggagcagucuucguagaugaaaaucaguggaacagugccaaagaagcaguugaagaugaacgguucugggauuugguucaucgggaaagagaauugcacaaacagggaaagugugcaacuuguguauacaauaugaugggcaagagagaaaagaaguuaggagaauuuggaaaagcuaaaggcuccagggcaauaugguacaugugguuaggugcacgauuccuugaauuugaggcacuaggcuucaugaacgaagaucauugguuuagucgagaaaauaguuugucugggguagaaggggaaggucuacauaaacucggauauauauuacgagacauaucaaagauucccggcgguaacauguaugcagaugauacggcagggugggauacuagaauaacagaagacgaccuucaaaaugaggcuaaaauuacggacaucauggagccggaacacgcacuucuugcuaaagccauauuuaaauuaaccuaccaaaauaaaguuguaagaguacagagaccagcuaaaaacgggacuguaauggaugugaucucuagacgggaucaaaggggaucgggacaaguuggaacauacggacuuaacacuuuuacgaauauggaggcacaguuaauccggcaaauggaaucugaaggaauuuucaguccaucugaauuagagacuccuaaccuagccgaaagagcauuggacugguuagaaaaauauggaguagaacgacucaagcgcauggcaauaucgggagaugacuguguaguaaaaccaauagaugacagauuugccaccgcacuuaccgcucucaaugauaugggcaagguccgaaaagauauaccacagugggaaccauccaaagguuggaaugacuggcaacaaguuccauucugcucucaccauuuucaucaauugauaaugaaggauggacgagaaauagucguaccauguagaaaucaagaugaguuaguaggaagggcucguguuucccagggagcagguuggucccugagggaaaccgcaugcuuagguaagaguuaugcucagauguggcaguuaauguacuuucauagacgggauuuacgcuuggcagcaaaugcuauauguuccgccguaccuguagacuggguuccaacgucucguacuacguggucuauacaugcacaucaccaauggaugacaaccgaagauaugcucucgguauggaacagaguuuggauugaagaaaauccuuggauggaggauaaaacucacauaagcucgugggaagauguacccuaccugggcaaaagagaagaccaauggugcggcagccuaauagggcugacagcgagggcuacaugggcaacuaauauacaagucgcuauuaaccagguaagacggcuaauuggaaaugaaaauuaucuugacuauaugacgagcaugaaaagauuuaaaaaugagagugauccagagggagcgcuaugguaa

SEQ ID NO: 21451 - RNA, 9879 nt, Artificial Sequence
  derived and/or modified CDS sequence (opt6) from DENV-1__EU660391__SS-prME
ucagucacuauguuauuaaugcucaugccgacggcacuugcuuuccauuuaacuaccagagggggagaaccccauaugauuguuagcaaacaagaacgaggaaaaucguuauuauuuaaaacgagcgcagggguaaauaugugcacuuuaauagcuauggaucuuggugaauuuugcgaagauacaaugaccuacaaaugcccaagaaucacagaagcggaaccggacgacguagacugcugguguaacgcaacagauacguggguaacauaugggacauguucccaaacgggugaacaccgacgagauaaaaggucgguagcacuugcaccucauguagggcuugggcuagaaacuagaacagaaacauggaugucgucggaaggagcauggaaacagauacaacguguugaaacaugggcauuaagacacccuggauucacuguaauagcacuuuuucuugcacaugcgauugguacauccauuacacaaaagggaauaaucuuuauacuacuaaugcuaguaacaccgagcauggcgaugcgaugcguagguauaggaucuagagauuuuguggaaggcuuaagcggugcgacauggguagauguaguguuggagcacgguucaugcguaacaacuauggccaaagacaaaccaacauuagacauugaauuacucaaaacugaagucacaaaccccgcaguucuucggaaauuaugcauagaagcaaaaauaagcaacacgacgacagacucacgguguccaacacaaggcgaggcaacucuugucgaagaacaagacgccaauuucguuuguaggcgaacuuuugucgaucgaggauggggaaacgguugcggacuguucggaaaaggaagccugauaacuugcgcaaaauuuaaaugcguaacgaaauuagaagguaaaauuguccaguaugaaaaucuuaaauacucagugauuguaacuguacauacuggugaucaacaucagguagguaaugagucuaccgaacaugguacaaccgcgacgauaacaccacaagcaccguccacagagauacagcuaacugauuauggagcauuaacgcuggauuguuccccacgcacgggacuugacuucaaugaaaugguacuacuaacaaugaaagaaaaauccugguuaguacacaaacaaugguuccuggaccuuccacugcccuggaccuccggggcaaguacuucgcaagagaccuggaaucgcaaagaccuccuaguaaccuucaaaacugcacaugcgaagaaacaagaaguagucguacuagguucacaagagggggcuaugcauacggcucugacaggagcaacagaaauacaaaccuccggaacaacuacaaucuuugccggucaccuaaaaugcaggcuaaaaauggauaaacucacuuugaaagggauguccuacguuauguguacuggcagcuuuaaacuagaaaaagaggucgcugaaacccaacaugggacaguauuaguccagaucaaauacgaaggaacagacgcaccauguaaaauaccauuuucuacgcaagacgaaaaaggcguaacccagaauggaagguuaauaacggcuaauccgauagucacggauaaagagaaaccaguuaauauugaggcggaacccccguucggcgaaucguacauugucaucggggccggcgaaaaagcacuuaaacugaguugguucaagaaagguaguucuaucggcaaaauguuugaagcaaccgcgagaggagcuagacgaauggcaauacuuggugauacggcuugggauuuuggcucgauaggagguguauuuacaagcguugguaaauuaguacaucaaauuuucggaacagcguacggaguacuguuuaguggcguaucguggacgaugaaaauagguauagguguucuguuaacaugguugggcuuaaacucaagauccacaaguuuaucgaugacuuguauagccguugggcuuguaacccuguaccugggaguuaugguacaagcggauucuggaugcgugauuaacuggaaagguagagagcuuaaaugcggaucuggaauuuuuguuacuaaugaaguacauacauggacagaacaauacaaauuucaggcagauuccccaaaaaggcuaagcgcggcaaucggcaaagcaugggaagaaggaguuugcggaauacgaucagcaacaaggcuagaaaacauaauguggaaacaaaucucaaaugaauuaaaucacauauuguuagaaaaugauaugaaauuuacagucguaguaggagauguagcagguauauuagcacaaggcaagaaaaugauacguccgcagccaauggaauauaaauauucuuggaaaucaugggguaaagcuaaaauaauaggugcagauguccagaauacaaccuucauuauugauggaccuaacacaccagaauguccggacgaucaaagggcauggaacauaugggagguugaagacuaugguuuuggcauauuuacaacaaauauauggcuaaaacuucgagauucuuacacucaagucugugaucaccggcuuauguccgcggcgaucaaagacucaaaagcaguacaugcagauauggguuacuggauagagucugaaaagaaugaaaccuggaaacuagccagagccuccuuuauugaaguuaaaacuuguauauggccaaaaucgcauacauuauggagcaaugggguccuagagucugaaaugauaaucccaaaaauuuauggcggaccgauaucgcaacacaauuaccggccuggcuacuuuacucaaacagcaggcccguggcauuuggggaaacucgaacucgauuucgacuugugugaagggacgacagugguaguggacgaacacugcggaaaccgcgguccaagccuuagaacgacaacaguuacggguaagaucauucaugaaugguguugccgaucuuguaccuuacccccuuugcgguuuaaaggggaagaugguugcugguacggaauggaaauacgaccaguaaaagagaaggaagaaaaccuugugaaaucgauggugucagcaggaucaggugaagucgauucauuuuccuugggcuuauuauguauuaguauuaugauugaagaagugaugagaucgcgaugguccagaaagauguuaaugaccgggacauuggcaguauucuuucuguugauuauggggcaguuaaccuggaacgacuuaauucgauuguguaucaugguuggggccaacgcaucggacagaaugggaauggguacaacauaucuugcuuuaauggcaaccuuuaaaaugcgaccaauguucgcaguugguuuacucuuuagaagguuaacaagucgagagguauuauuacugaccauuggauuaucccuagucgcgagcguugaacuaccaaauucgcucgaagaauuaggggaugggcuggcaaugggcauaaugauucuaaaguuacuuacagauuuucaaucccaccaacugugggcuacauugcuauccuuaacguuuauaaaaacuacuuuuagucuacauuaugcauggaaaaccauggcaaugguauuauccauagucagucucuucccuuuauguuugaguaccacuucgcagaaaacaacuuggcuaccugucuuauuaggaucgcuagguugcaagccucuuacaauguuucuuauagcagaaaauaagauauggggccgaaaaucuuggccgcuuaaugaaggaaucauggcaguuggaauagucuccauauuacucucaaguuuacuuaaaaacgacgugccuuuagcugguccgcuaaucgcugggggaauguuaauagcuuguuacguuauaucagguagcucugcugaccuaagucucgaaaaggccgcggagguaucaugggaagaagaggcagagcacucuggggccucucacaacaucuuaguagaggugcaagaugacggcaccaugaaaauaaaagacgaagaacgcgaugauacccugacaauauugcugaaagcaacacuccucgcagucucagggguauauccauuguccauuccugcaacguuauucguaugguauuuuuggcagaagaaaaagcaacgaucugggguuuuaugggacacccccucuccacccgagguagagcgagccguccuagacgauggcauuuauagaaucaugcagaggggccuucucggucgaagucaaguggguguuggcgucuuucaagagaacguguuucacaccauguggcacguuacaaggggugcuguguuaauguaucagggaaaacgauuggaaccaaguugggcaucaguaaagaaagauuuaauuucauaugguggugguuggaggcuacaaggcaguuggaacacaggugaggagguacaggucauagccguagaaccaggcaaaaacccuaaaaauguacaaacggcacccgguacauuuaaaaccagugaaggggaaguuggagcuauagcauuggauuuuaaacccgggacgaguggaucaccuauuguuaaccgagaaggaaaaauuguaggcuuauauggcaauggagugguaacaaccucugguacauaugugucagccauagcacaagccaaagcaucacaagacggaccguuaccagaaaucgaggaugaaguauuucgaaaaagaaauuuaacuaucauggaucuacaucccggaagcggaaaaacacggagauacuuaccggcaaucgugcgagaagcgauaaaaagaaaauuacguacccugauccuagcaccaaccaggguaguagcuucggaaauggccgaggcucucaaagguaugccaauuagauaucaaacuacagcaguaaaaucagaacauacaggaaaggagauaguagaucuaaugugucaugccacauuuacaaugcgauugcucucaccuguccgcguuccaaauuacaacaugauaauaauggaugaggcccauuuuacugaucccagcaguauagccgcaagaggauauauuucaacaaggguaggcaugggugaagcggcugcuauuuuuaugacugccacuccaccgggaucggucgaagccuuuccucaauccaaugcgguaauacaagaugaagagagagauauaccugaacgcuccuggaauaguggauaugaauggauaaccgauuucccagggaagacgguaugguuuguuccaagcaucaaaagcgguaaugauauagcuaacugucuucgcaaaaacggaaagagggucauucaacuaucuaggaaaacauuugacaccgaguaucagaaaacgaaaaauaacgacugggauuauguuguuacuacggauaucucagaaaugggcgcuaacuucagggcagaucgugucauugacccgaggaggugcuuaaagccagucauucuuaaggacggcccggagcgagucauacuagcagguccaaugccugugacaguagcuucagcagcacaacgccguggaagaauaggcaggaaccacaacaaggaaggagaucaauacauuuauaugggccagccuuugaauaaugacgaggaccacgcacauuggaccgaagcaaaaaugcugcucgacaauauuaauacuccagaaggaauuaucccggcgcuuuuugagccagagcgagaaaaaucagcggcgauagauggagaauaccgccuacgaggcgaagcgcguaaaacauuuguggaacugaugagacgcggagacuuaccaguuuggcuaucuuauaaagucgcaucugagggauuucaguacagugaucguagauggugcuucgacggcgaacgcaauaaucaagugcuugaggagaacauggacguagaaaucuggacgaaagagggagagcguaagaaacugcgaccuagaugguuggacgcuagaacuuauuccgacccccuagcacuacgagaguucaaggaguucgcggcuggucgaagaucgguaucgggcgaccucauacuagagauaggcaaauugccacagcaccuaacccaaagagcucagaaugcauuagauaaucugguuaugcuucauaauagugaacaaggaggcagagcauaucgacaugcuauggaagaacuccccgauacaauagaaaccuuaaugcucuuagcauuaauagccguuuugacaggugggguaacucuauucuuuuuaagcgggcgcggcuuagguaaaacaaguauuggccuacuuugugucauggcgagcaguguacuauuauggauggccucaguagaaccccacuggauagcagcauccaucauacuagaguucuuucuaaugguacuguuaaucccggagcccgauagacagagaacaccucaagauaaccaacuagccuauguaguaauaggacugcuauuuaugauucuaaccguugcagcgaacgaaaugggccuacuugagacaacaaagaaagaucuagguauuggacaugucgcaguagaaaaccaucaccaugccgccauguuagauguugaccuacauccagcuagugcauggaccuuauaugcaguugcaacaacuaucauaacgccuaugaugcggcacaccauagaaaacacaacggcuaauauaaguuugaccgcgauugcaaaucaagcugccauauuaaugggucuugacaaagguuggccuauaucgaaaauggauaucggcgucccacuccuagcacucggcuguuauagccaaguaaauccgcuaacacugaccgcugcuguucuaaugcuugucgcacauuaugcaauuauagggccggggcuacaagcaaaggccacaagagaagcccaaaaacguacugcugcaggaauaaugaaaaaccccaccguagaugggauaguagcaauagacuuggacccaguggucuaugaugcaaaguucgaaaaacaacuaggccaaauaauguuauuaauuuuaugcacaagucaaauacuguuaaugcguacaacuugggcacucugugaaucaauaacacucgcaacaggaccccuaaccacccucugggaaggcucuccaggaaaauucuggaauacgacgauagcgguuaguauggcgaacaucuucaggggaucguaucuggcuggagccgguuuggcauucucgcuuaugaaaucauuaggcggagggcgacggggcaccggagcucaaggcgagacacuaggggaaaaauggaaacgccaauuaaaucaacuaaguaaaucagaauuuaacacauauaaacgcuccgguauaauggagguggaucgaucggaagcaaaagaagguuuaaaacgaggagagacaacaaaacacgcaguaucccgcgguacagcuaaacugagaugguuuguggaaagaaaucuagucaaaccagaggggaaagucauagaucuaggaugcgggagagguggguggagcuacuacugugcgggacuaaagaaaguaaccgaagucaagggcuauacuaaaggaggaccaggacaugaggagccaauaccuauggcaacauaugguuggaaucuaguuaaauuacacagcgguaaagacguuuucuuuauuccacccgaaaagugugauacacuauuaugugauauaggcgaaaguucucccaacccgacaauagaagaaggacggacccuacgcguacuaaaaaugguagaaccauggcugcgaggaaaucaauucuguauuaagauccugaauccuuacaugccgagcgugguagaaacccuagaacagaugcaacguaaacauggcgggauguuaguccguaacccgcuaucaagaaauucaacgcaugaaauguacugggucucuugugguaccgggaauauaguuagugcaguaaacaugacgucacgaaugcuccuuaacagauucacuauggcgcaucgaaaacccacguacgaacgagacguagaccuuggggccggaaccagacauguugcaguggagccugaaguagcaaaucuugauauuauaggacaaaggauugaaaauauaaaauaugaacauaaaucaacuuggcauuaugaugaagacaacccauauaaaaccugggcguaucacgguucuuaugaaguuaaaccaagugggucugcgaguagcaugguaaacggaguagugaaacuucucacuaaaccuugggaugugauaccgauggucacccagauagcuaugacagauacuacacccuuugggcaacagcgcgucuucaaagaaaaaguagacacacgaacacccaaagcaaaacgcggaacagcucaaaucauggaaguaacagcuaaauggcuauggggauuccuaaguagaaauaaaaagcccagaauaugcacaagagaagaauuuacuagaaaaguacgaucuaaugccgcuauaggagcuguguuuguugaugaaaaucaauggaacucagcuaaggaagcugucgaggacgagagauuuugggaucugguucaccgagaaagggagcuacacaagcagggcaaaugcgcuacguguguauauaacaugaugggaaaacgugagaagaaacuaggagaauuugguaaagcgaaagggaguagggcaaucugguacauguggcuuggugcgagauuuuuagaauuugaagcucuaggguuuaugaaugaagaucacugguucucuagggaaaacucacuuucuggaguugaaggggagggauugcacaaacuagguuauaucuugagggauauuagcaaaauccccggaggcaauauguaugccgaugacacagcuggaugggacacaagaauuaccgaagaugaccuucaaaaugaggcuaaaauaacagauauuauggaaccagaacaugcuuugcuugcgaaaucuaucuuuaaguugacuuaccaaaacaagguugucagaguucagagaccagccaaaaacgguacggucauggauguuaucucgaggcgagaucaacggggcagcggacaggucggaacuuacggccucaacacauuuacaaacauggaagcccaacuaaucaggcaaauggaaucagaaggaauauuuuccccaucagaauuagaaacaccaaauuuggcaggaagaguguuagauuggcuagaaaagcacggugucgaacgguugaaaagaauggcaauuaguggggaugauugcguagugaagccuaucgaugauagauuugcaaccgcuuuaaccgcacuaaacgacaugggaaaaguccgcaaggauauaccucaaugggaaccuuccaaagguuggaacgacuggcaacagguuccauuuuguagccaccacuuucaccaacucauuaugaaagaugggagggagauuguugucccauguaggaaccaagacgaauuagucggcagggcuagagucucucaaggagcagguuggaguuuacgcgaaaccgccugccugggaaaaucuuaugcgcaaauguggcaauugauguauuuucacagacgugaccucagauuagcagccaacgcuaucuguagugcaguaccgguagauuggguuccgacaagcaggacuacauggucaauacaugcgcaucaucaauggaugaccacugaagacauguuaaguguguggaaucguguguggaucgaagagaauccauggauggaagauaaaacacacauuucuucuugggaagacguaccauaccuugguaaaagagaagaccaaugguguggaucucugauugguuuaacugcuagagcuacaugggcaacgaauauacaaguagcaauaaaccagguccgaagauuaauaggaaacgaaaacuauuuagauuauaugacaaguaugaaacguuucaagaaugaaucugacccugaaggagcauuaugguaa

SEQ ID NO: 21452 - RNA, 9879 nt, Artificial Sequence
  derived and/or modified CDS sequence (opt6) from DENV-1__EU660393__SS-prME
ucagucacaauguuauuaauguuaaugccuacagcacuagcauuucauuuaacuacgcgaggaggggaaccacauaugauaguaucaaaacaagaaagagguaaaagucuacuauucaaaacuucggcuggagugaauaugugcacacuuauugcaauggauuuaggagaauugugugaagauacaaugacauacaaauguccgcggauuaccgaaacagaaccggaugacgucgauuguuggugcaaugccacagacacaugggucacguaugguacuuguucgcaaacuggagaacauagaagagauaagaggucaguagcccuugcaccacaugugggauuaggcuuagaaacaaggacugaaacauggaugaguucagaaggggcauggaagcaaauucaacguguugaaacaugggcauuaagacauccugguuuuacuguuauagcucuauuccuagcccaugccauuggcaccaguauaacacaaaaaggcauaauuuuuauucuucucaugcuugucacccccucaauggcgaugagauguguuggaauugggucaagagauuucgucgaaggacugucuggagcaacauggguggaugucguccucgaacacggcucguguguaaccaccauggccaaagacaaaccuacguuagacauugaauuacuuaaaacagaaguuacuaauccagcuguauugagaaaacuauguauagaagcaaaaauuuccaauacgacuacagauuccagaugccccacccaaggagaagcuacgcuaguagaagaacaagaugcuaacuucgucugucguaggaccuuuguugaucgagguugggggaauggaugugggcuguuuggaaaggguucccuaauuacuugugcgaaauucaaauguguaacaaaauuagaggguaaaauagugcaauaugaaaauuuaaaauauucuguaauagugacaguacauacaggugaucaacaccaaguagggaacgaaucgacggaacauggaacgacagcaacaaucacgccccaagcaccgaccacugaaauucaacuaacagacuauggagcguugacacucgauugcucaccacgaacaggauuggauuuuaaugaaaugguuuuauugacuaugaaagaaaaaucaugguugguucauaaacaaugguuucuagauuugccuuuaccuuggacaagcggugcuucaaccucacaggagaccuggaacaggcaggacuuauuaguaacauuuaagacugcacacgcgaagaaacaagaagucgugguauuaggcucacaggaaggagcaaugcauacagcgcucacaggcgcgacagaaauacaaacuagcgguacaacuacaauauuugcuggccaucucaaaugucggcuaaaaauggauaagcuaacgcuuaagggaaugucguacguuaugugcaccggaucauuuaaacuugaaaaagagguugcagaaacacaacacggaaccgugcuaguccaaauaaaauacgaaggaacggacgcgccaugcaaaauuccauuuuccacacaagacgaaaagggcauaacacaaucaggaagauugaucacugcaaacccgauaguuacagacaaagagaaaccugucaauauugaagcagagccuccuuucggcgaaucguacaucauuauaggcgcuggcgaaaaagcccuuaaacuuucaugguuuaagaaaggcucuagcaucggaaaaauguucgaagcaacagccagaggugcgcggaggauggcaauacuaggggauacugcaugggauuucggcucgaucggugguguauuuaccucaguagggaaauugguucaucaaauuuucgguaccgcuuaugggguuuuauuuucaggggugagcuggacuaugaaaauagguauaggcguucuguuaacuuggcuugggcuaaauagucgcaguacaucacuuucuaugacgugcauugcgguagguuugguaacgcuauacuuaggagugaugguacaggcagauagcggauguguuaucaacuggaaagguagggaauuaaaaugugguaguggaauauucguaacaaaugagguacauaccuggacagaacaguauaaauuucaagcugauucaccaaaacgguuaucagcggcuaucggaaaggcuugggaagaggggguaugugggauccgaagugcuacacgacuugaaaacaucauguggaagcaaaucaguaaugaauugaaucacauacuauuggaaaacgacaugaaauuuacgguaguaguuggggacguagcugggauauuagcucagggaaagaaaaugauaagaccacaaccgauggaauauaaauacucauggaaaaguugggggaaggcaaaaauuauuggagcagacguucagaauacgacuuucauaauugaugguccuaacacuccagaauguccagacgaucagcgagcauggaauauaugggaaguagaggacuauggauucggaauuuuuacaacuaauauauggcucaagcuaagggauagcuauacccagguuugcgaccauaggcugaugagugcugcaaucaaagauucuaaggcaguacaugccgauaugggcuacuggauugaaucagagaaaaaugagacguggaaacuagcucgugcaucuuuuauugaagugaaaacuugcauauggccaaagagucauacacuguggucgaaugggguauuagaaucagagaugauuauccccaaaaucuauggagguccaaucagccaacacaacuacagaccgggauacuucacacaaaccgccgguccauggcauuuaggaaaacuugaauuagauuucgauuugugugaaggcacaacaguaguaguggaugaacacugcggaaaccggggccccagcuuacggacgacaacagugacugggaaaaucauacaugaguggugcugccgcucauguacacucccgccacuaagauuccggggagaagacgggugcugguaugggauggaaauucggccggucaaggaaaaagaagaaaaucucguaaaaucuaugguaucugcagggucaggugagguugacucguucucgcucgguuuacuaugcaucucgauaaugauagaagaaguuaugcgaucucgaugguccagaaagauguuaaugacaggaacauuagcgguuuucuuuuuauuaauaauggggcaauuaacauggaaugaucucaucagauuauguauaauggugggggcaaaugcuucugaccggaugggaaugggaaccacauaccuagcuuuaauggcaacauuuaagaugaggccaauguuugcaguuggucuucuauuuagacggcuuacaagccgagaaguccuauuacuaaccauaggucuaucucucgucgcaucgguggaacugcccaacucucuagaggaacuaggggacggauuagcgauggggauaaugauccugaaacuucuaacggacuuccaaagccaucaacugugggcgacguuauuaucacuaacguucauaaaaacaacuuuuaguuuacauuaugcauggaaaacgauggcaaugguacuaaguauugugaguuuauuuccacuauguuuguccacaaccagccagaaaacuacauggcuccccgucuuacucggcucuuuagguugcaagccauuaacaauguuccucauugcugaaaacaaaauaugggguagacgaagcuggccuuuaaaugaaggcauaauggcaguaggcauuguauccauacuuuuaaguagcuugcuaaagaacgauguuccguuagcuggaccacucauagccgggggaaugcugauagcuugcuauguuauaucaggcuccagcgcggaucuuuccuuagaaaaagcggcggaaguaucgugggaagaagaagcugaacauagcggugccucucacaacauacucguagaaguacaagacgauggcacaaugaagauaaaggacgaagaacgagaugauacgcugacaauuuugcuuaaagcgacauuguuagcaguuucaggaguuuacccguuaucaauaccggcuacacuauucgugugguacuucuggcagaagaagaaacagcgaucgggugucuuaugggauaccccuucgccuccugagguagaacgagcugucuuggaugauggaauauaccggaucaugcaacgcgguuuacuagggagaucacagguugguguaggaguauuucaagaaaauguuuuucacacaauguggcaugucacacgaggagcaguacuaauguaucaaggcaaaagacucgaaccuaguugggcaucggucaagaaagaccuaauaagcuacgguggcgguuggagguuacaggguucauggaacaccggugaagaaguucagguuauagcuguugaaccaggcaaaaauccuaaaaauguacaaacagcaccaggaacauuuaaaacuccagaaggcgaaguaggagcaaucgcgcuggauuuuaaaccagggacaagcgguucaccaaucgugaacagagaaggcaaaaucgucggacuauauggaaaugguguagucacuacaagugguacauacgugucugcgaucgcucaagcaaaggcgucacaggagggaccauuaccagagauagaagacgagguuuuuagaaaacgcaauuuaaccauuauggaccuucacccagggagugggaaaacacguagguaccuacccgcuauuguacgcgaagcaauaaaaagaaaacucagaacgcuuauauuagcuccgacaagggucguggcaucugaaauggcggaagcucugaaagguaugccaauaagguaccaaaccacagccgucaaguccgaacauacgggaaaggaaauuguugaucuuaugugccaugcaacuuucacgaugcgacuauuaucgccgguucggguucccaacuacaacaugaucauaauggacgaagcacauuucacggaucccaguagcauugccgcgcgaggauacauaucaacacgugucggaaugggugaagcugccgcaaucuuuaugacagcaacaccgccaggaaguguagaggcauuuccccagagcaaugccguaauacaagacgaagagagagacauuccugaaagaucauggaacaguggguaugaauggauaacagacuucccggggaagacggucugguucgugccgucgauuaagagcggaaacgacaucgcuaacuguuuaaggaaaaauggaaaaagagucauucaacuaucacguaaaacuuuugacacagaguaucaaaagacuaaaaauaaugauugggacuauguugucaccacagauauaucagaaaugggagcaaauuuucgcgcagacagaguuauugacccacgaagauguuuaaaacccguuauacucaaagaugggccugaaagaguaauccuagcaggcccuaugccuguuacaguggcaagcgcagcucaaagaaggggacgcauaggacgaaaccauaacaaagagggcgaucaguauauauacaugggacaaccucuaaacaacgaugaagaucaugcucauuggacugaggcaaagauguuguuggacaacauuaacacuccagaggguauuauucccgcucuauuugaaccagaaagagaaaagucagccgcuauugauggagaguaccgauuaaggggagaagcgagaaagacauucgucgaguuaaugagaagaggggaccucccaguauggcucucguauaaagucgcaucagaaggauuccaauauucagaccgacgauggugcuuugacggagaacgaaauaaucaaguauuggaagaaaacauggacguagagauuuggacaaaggagggcgaaagaaagaaauugcguccacgaugguuagaugcucgcacuuauucggaucccuuagcgcuaagagaauuuaaggaauuugcagcugggaggcguucgguuaguggggauuuaauucuagaaaucggaaaguuaccacaacauuugacucagcgagcgcaaaaugcuuuggauaauuuggugauguuacacaauagugaacaaggagguagagccuaccgacaugcaauggaagaauugccagacacaauugaaacauugaugcuauuagcucuaauagcuguacuaacaggcgguguuacauuguucuuccucaguggacgaggauuaggaaagacaucuauuggauuacuaugcguuauggcaucaucgguacuauuauggauggcaucgguugaaccucacuggauagcggccucuaucaucuuagaguucuuucugaugguuuugcucauucccgagccggauagacagcgaacuccccaggauaaucaacuugcauauguuguaauuggauuauuguuuaugauacuuacugucgccgcuaaugagauggggcuacuugaaacaacuaagaaagauuuaggaauugggcauguagcaguugaaaaucaccaucaugccgcaaugcuugacguugaucuccauccagcaagugcauggacauuauaugcaguugcaacaacuaucaucacgccgaugaugaggcauacgauugaaaacacuacugcuaauauaucuuugacugcaauagcaaaucaggcagcuaucuugaugggcuuggacaaaggcuggccuauaagcaaaauggacauagggguuccauuauuagcacuaggaugcuacucccaaguaaauccccuaacccuuacugcugcgguacuaaugcuaguggcucacuacgccaucauagguccagggcuacaagcgaaggcaacuagagaagcccaaaaacggaccgccgcaggcauaaugaagaacccaacaguugauggaauuguugcuauugauuuagauccaguuguauaugacgccaaauucgagaaacaacuagggcaaaucaugcuguuaauucuuugcacuucacaaauacuauugaugagaacuacaugggcauugugugaaagcaucaccuuagcaaccggaccucuaacaacguuaugggagggcucgccagggaaauuuuggaauacaacaauagcuguaaguauggcuaauauauuucguggaaguuauuuggccggggccgggcucgcuuucucacucaugaaaucucucggcggaggcagaagagguacgggagcucagggagaaaccuuaggagaaaaguggaagagacaacuaaaucaacucagcaaguccgaauuuaauaccuauagaagaagcgggauaauggagguagauagaucagaggcaaaagaaggauuaaaaagaggugagacgacgaaacacgcuguaucgagagggacagcgaaacuucguugguuuguagagcgcaaucuagucaaaccugagggaaaggucaucgaucuuggaugcggucguggggguuggucauacuacugugcaggauugaagaaagucacagaagugaaaggguauaccaaaggaggaccugggcaugaagaaccuauacccauggcaacauaugguuggaauuuaguaaaacuccacaguggcaaagacguauucuuuauaccacccgagaaaugcgacacauuacuuugcgacauaggcgaaaguucgccaaacccaaccauagaggaaggccgaacuuuaagaguacuuaaaaugguagaaccguggcuaagagguaaucaauucuguauuaaaauucuaaaccccuauaugccaaguguagucgaaacuuuagaacagaugcaacgaaagcauggaggaauguuaguacgaaacccgcugucaagaaacagcacacaugagauguacuggguaucauguggaacugggaauauuguauccgccguaaauaugacuucgaggauguugcuuaauagauucacaauggcucauagaaagccaacauaugaaagagacguagaucugggcgcagggacuagacaugucgcgguagaaccagaaguagcaaaucuagauauaauuggucaacguauagagaauauuaaacacgaacauaagaguacauggcauuaugacgaagacaauccuuauaaaacgugggccuaccacgggagcuacgaaguaaaaccuagugggagcgcauccucuaugguuaauggaguuguuaaacuuuuaacuaaaccuugggacgucauuccuaugguaacucaaauagcgaugaccgauaccacacccuuuggucaacaaagaguguucaaggaaaagguugacacuagaacaccuaaggcuaaacguggcacagcucaaauuauggagguuacagccaaauggcuaugggguuuucuaucuagaaauaagaaaccacgaauauguacacgcgaagaguucacacgaaaaguaagaaguaacgcugcuauaggggcaguauucguagacgaaaaucaauggaacucugcuaaagaagcgguagaagaugaaagguuuugggaucuuguacaucgagagagggaguuacauaaacaaggaaaaugugccacuuguguuuacaacaugauggggaaaagagagaagaaacucggggaguucgggaaggcaaaggggagccgagcuauaugguauauguggcuuggagcucgguuucuagaguuugaagccuuagguuuuaugaaugaagaucacugguuuaguagagaaaauucucuuucagguguagagggggagggacuucacaaacuggguuauauacugcgugauaucucuaaaauacccggagguaacauguaugcagacgauacggcaggaugggauacuagaauuacugaagacgaccuacagaaugaagcuagaauuacagauauaauggagccagaacacgcacuccuagccaaaucuaucuuuaaauuaacguaucaaaauaaaguuguacgcgugcagaggccggccaaaaacggcaccguuauggaugugauaucaagacgcgaucaacgugguuccgggcaagucgguacauacggauugaacacauucacaaauauggaagcacaacucauaagacagauggaaagcgaagguauauucaguccaucugaauuagagacaccuaaucuagcugaacgaguucuagauugguuagaaaaauacggggucgaacgguuaaaaagaauggcaauuuccggagaugacuguguugucaaaccaauagaugaccguuucgcgacugcuuugacugcauugaaugacaugggcaaagugaggaaggauauaccccaaugggagcccuccaagggauggaaugacuggcaacaagugccauucugcucucaucauuuucaucagcuuauaaugaaagacggcagagagauugucguaccaugccgcaaucaggaugaguuagucggaagggccagaguaucacaaggagcuggauggucucuacgggaaacggcuugucuugguaagucauaugcacaaauguggcaguuaauguauuuucauagacgagaucuacgguuagcagcgaaugcaauuuguucagcgguaccuguagauuggauacccacuuccaggacuaccuggucaauucaugcucaccaucaauggaugaccaccgaggauauguuaucgguguggaauagaguauggauagaagaaaauccauggauggaagacaaaacacauaucaguucauggggagacguuccguauuuggguaaacgugaagaccaguggugcggcucccuaauaggcuuaacugcuagagccacaugggcgacaaacauacaaguugcgauaaaccaagucaggcgacuuauuggaaacgaaaauuaccuagacuacaugacaucaaugaaaagauuuaaaaaugagagcgauccugaaggugcuuuaugguaa

SEQ ID NO: 21453 - RNA, 9879 nt, Artificial Sequence
  derived and/or modified CDS sequence (opt6) from DENV-1__EU660401__SS-prME
ucagugacaaugcugcuuauguugaugccuacugcacuugcauuucacuugacaacucgugggggugaaccacauaugauuguaucaaaacaagaacgagggaaaucauugcuauuuaaaacuucagcaggagugaauauguguacguuaaucgcaauggacuuaggggaacuaugcgaagacaccaugacuuauaaaugccccaggauaacggaaacugaacccgaugaugucgacugcugguguaacgcaaccgauacauggguuacuuauggaacauguucacaaacaggugagcaccgccgagauaaacguucggucgcguuagcaccucaugucggucuggguuuggagacaaggaccgaaacuuggaugucguccgaaggugcauggaaacaaauccaacguguugaaaccugggcacuaagacauccggguuucacaguuauagcgcucuuucuagcucacgcaauaggaacgucuauuacacaaaaaggaauuauauuuauuuuguuaauguuaguaacuccauccauggcaaugcgcugugucggaauaggaagcagggacuuuguagaaggauuaucaggagcaacauggguagauguaguucuagagcacgguagcugcgucacuacgauggcaaaagacaaaccgacucuugauauagaguuacuaaagacggaagugacaaacccggcagugcuacgcaaacuaugcauugaagcuaagauaucuaauacaacuaccgacagccgaugccccacucaaggagaagcaacguuagucgaggaacaagaugcuaauuuuguauguaggagaacauuugucgaucguggaugggguaacggcugcggccuuuuuggaaagggaucguuaaucacuugugcuaaguuuaaauguguuacaaaacuagagggaaaaauugugcaauaugagaaucucaaauauucugucauugucacaguucacacaggugaccaacaccaaguagggaaugagucaacagaacauggaacaacugcaacgauaacuccgcaagccccuacuaccgaaauacaacuaacugacuauggggcacucacauuagacuguagcccgcguacagguuuagauuuuaaugagaugguauuauuaacaaugaaagaaaaauccuggcucguucacaaacaaugguuucuggauuuaccgcuaccuuggacuucaggagcaucaaccagucaagagacuuggaaucggcaagacuuauuaguaacguuuaagacggcucaugcuaagaaacaggaaguaguaguucuaggaucacaagaaggagcaaugcauacagcacuaacgggagcuacggaaauucaaaccucugguacaacuacuaucuuugcgggccaucuaaaauguagacucaagauggauaagcucacgcucaaggguaugucuuauguaaugugcacuggaucuuucaaauuagaaaaggagguagcagaaacgcagcaugguacggucuuaguucaaauaaaauacgaagguacagaugcgccauguaagauaccauuuucuacucaggacgaaaaagguguuacacaaaacggacguuuaauaacagcaaacccaauagugacggauaaagagaaaccaguaaauaucgaagccgaaccacccuucggugaaagcuauauuauuaucggagccggugaaaaagccuuaaaauugucaugguuuaaaaagggaucuaguaucgguaaaauguuugaagccacagcucgaggagcaagacgcauggcuauuuugggagauacagcaugggauuucggcagcauaggagggguuuucacaaguguaggaaagcuaguucaccaaaucuuugguacagcuuacgguguacuauuuagugguguaucauggacaaugaagauaggaauaggaguauuauuaaccuggcuaggucuaaauucaagaaguacgagcuugucaaugacuuguauugcaguaggucuagucacuuuauaccuaggagucaugguucaggccgacucagggugcguaauuaauuggaaaggacgugaacugaagugugggagcggaauauucguuacuaacgagguacauacauggaccgaacaauacaaguuucaggcagauucgccgaaacgauugucagcagcuauugguaaagcgugggaagaaggcguauguggaauaagauccgcuacucgacucgaaaacauaauguggaaacaaauaucaaaugagcuuaaccauauccuucuagaaaaugacaugaaguucaccguugucgucggcgauguagcagguauccuagcucagggcaagaaaaugauacggccgcaaccaauggaguacaaauauuccuggaaaucauggggaaaggcaaaaauuaucggugcagauguacagaacacaacuuuuauaauagauggaccaaauacaccggaauguccagacgaucaaagagcguggaauauaugggaaguagaagacuauggcuucggaauauuuacuacgaauauuuggcuaaagcucagagacucacacacucaaguuugugaucacagacuuaugagcgcugccauaaaagacagcaaagcuguacaugccgauauggguuauuggauagaaagugaaaagaacgaaaccuggaaacuugcucgugcuagcuuuauagaaguaaagacgugcauuuggcccaagagucacacgcuauggaguaauggggucuuagagucagaaaugauuauucccaaaauauauggaggaccuauaucacaacauaacuacagaccugguuauuucacgcaaacagcagggccuuggcauuuagggaaacuugaguuagauuuugacuuaugcgaaggcacuaccgugguggucgacgaacacugcggaaacagaggcccuucuuuacgaacaacaacaguuacgggcaaaauaauacaugaguggugcugucgaaguuguacguugcccccacucagauuuagaggggaggaugguuguugguacggcauggagauuaggccaguaaaggaaaaagaggaaaauuuaguuaagagcaugguaucagcagggagcggugaaguugacucauucucacucggauugcucuguauuuccauaaugauugaagagguaaugcguuccagauggucgcguaaaaugcuaaugacuggcacauuagccguauucuuucuacuaauaaugggacaacuaacauggaaugauuugauacgcuuauguauuauggugggugcaaaugcuucugaucgaaugggcauggggacaacauaucuagccuuaauggcaacauucaaaaugaggccaauguucgcugucggguuacuauuucgacguuugacgagccgugaaguguugcuacuuacaauuggacuaucacucguagcgucugucgagcuaccaaauucucucgaagaacugggcgacggccuagcaauggguauaaugauauugaaacuccuaacagauuuucaaagucaccagcuaugggcgacguuauuaucauugacuuucauaaaaaccaccuuuucauuacauuaugccuggaagacaauggcgaugguucuaucaaucguaucacuauuuccuuuaugucuaucuacuacaucacagaaaacaacguggcucccgguacuguugggcagcuugggauguaaaccucuaacuauguuucuaauagcggaaaacaaaaucugggggcgacgaaguuggccauuaaaugaagguauaauggccguugguauagucuccauccuucuuaguucauuacucaaaaacgauguaccucuagcagggccucuaauugccggcggaaugcucauagcauguuaugugauaucagguagcucggcugauuuaagccuagaaaaggcggcagaaguaucuugggaagaagaagccgaacauucaggcgcgucucacaacauacuuguagaaguacaagaugacgguaccaugaaaaucaaagaugaggaacgggaugauacacuuacaaucuuauuaaaagcuacuuugcuugcgguuaguggaguuuauccacuuucaauuccugcaacuuuguuuguaugguauuuuuggcagaagaagaaacagagaucagggguacuuugggauacaccaucaccuccagaggucgaacgugcgguauuagaugauggaauauauaggauuaugcagagaggucuuuuaggacgaucccaaguagguguaggcgucuuucaagaaaacguauuucauaccauguggcacguaaccaggggagcaguacuuauguaccaaggcaaaagauuggaacccucuugggcuucuguaaagaaagaucugaucucuuauggaggagguuggagacuucaaggaucauggaauacaggagaagaaguucaaguaauagcagucgaaccuggcaaaaaccccaaaaacguacagacagcgccaggaacauuuaaaacuccugagggagaaguuggagccaucgcccucgauuuuaaaccuggaacgucgggaucgccuauuguuaaccgagaaggaaaaauuguagggcuauauggaaauggagucgugacaacgucaggaacauauguuagugcgauugcgcaagcaaaggcuucccaagaaggaccguuaccagaaauugaagaugagguauuuagaaaaagaaaucuuacaaucauggacuuacauccaggaagcggcaaaacucgaagguauuuaccagcgaucguucgugaggcgaucaaacgaaaacuacgaacucuaauauuagcgccuacuagaguuguugcuuccgaaauggcagaggcauuaaaagggaugcccauaagauaucagaccacggcagucaaaucggaacauacugguaaagaaaucguugauuuaaugugccaugcuacuuuuacaaugcgccuauuaagucccgucagaguuccaaauuauaacaugaucauaauggaugaagcacauuucacugauccaaguucuauagcagcgagaggauauaucucgacaaggguuggaaugggugaagccgcugcuauuuuuaugacugccacaccucccggauccguagaggccuucccccaauccaaugcaguuauucaagacgaagaaagagauauuccagaaagauccuggaacaguggguaugaauggauaaccgauuuccccggcaaaaccguaugguuuguaccuucaauaaaaucugguaaugauauagcgaacugcuugcguaaaaauggaaaaagagucauucaacucucgagaaaaacuuuugacacggaauaccagaaaacgaaaaacaaugauugggauuauguagugacaaccgauauuagugaaaugggcgccaauuuucgagcggacagaguaauagacccacgacgaugcuugaaacccguuauacuaaaagaugguccugaacgggucauccuagcaggaccuaugccaguaacgguugcaagugccgcucaaagacguggccgaauaggacgaaaccacaacaaagaaggagaucaauauauauauaugggacaaccacucaauaaugacgaggaucaugcgcacuggacagaagccaaaaugcuacuagauaauauaaacacaccugagggcauaauuccugcauuauuugaaccggaacgugagaagucugcagcaaucgauggcgaauacagauuaaggggugaggcucgcaaaaccuuugucgaguuaaugagacguggcgaucugccaguaugguuauccuauaaagucgcaagugaaggguuccaauacagcgaccgaagauggugcuuugacggugaaagaaacaaccaaguauuagaggaaaauauggauguagaaaucuggacaaaagagggagaacggaagaaauuaagaccccguuggcuugaugcaagaacguauucagauccauuagcauugcgugaauuuaaagaauuugcugcaggcaggagaucugugaguggcgauuuaauacuggaaauuggaaaguuaccgcaacacuuaacacaacgagcacagaaugcgcuugauaauuugguaaugcuucacaauagugagcaagggggccgagccuaucggcaugccauggaagaacuuccagacacgauugaaacauuaauguuguuagcgcuaauagcuguacucacugguggaguuacucuguucuuuuuaucggguagaggauuagggaagacaucaauuggauuacuauguguaauggcuagcaguguucugcuauggauggcuucaguugaaccucacuggaucgccgcaaguaucauccucgaguuuuucuuaaugguauuacucauaccagaaccugacagacaaaggaccccucaagauaaucagcuggcguauguaguuauuggucugcuguuuaugauuuugacaguggccgcaaaugaaauggguuugcucgaaacaaccaagaaagauuuagguauuggacacguugcaguugagaaucaccaucaugcugcuaugcuagacgucgaucugcauccagcaucagcauggacucuauaugcaguugcaacgacgaucauuacuccaaugaugcgucacacaauagaaaacacgacagcgaauauaaguuugacugcgaucgcaaaccaagccgcaauucuaaugggacuagauaaaggauggccgaucucaaaaauggacauagguguuccccuguuagccuugggaugcuauucccagguaaacccauuaacauugacagcagcugucuuaaugcuuguggcgcacuaugcaauuaucgggccaggacuucaggcuaaagcaacaagagaggcacagaaacgaacugccgcaggaauaaugaagaacccaaccgucgauggaauagucgcgauagauuuggauccaguggucuacgacgcuaaauuugaaaagcaacuuggacaaauaaugcuacucauacucuguacaagucagauccuucuaaugaggacaacuugggcauuaugcgagaguauuacucucgcuacaggcccacuaacaacguuaugggaagguaguccggguaaauucuggaacaccacaauagcgguguccauggcuaacaucuuuaggggcucguaucucgcuggagcuggacucgcauucucccugaugaaaaguuugggcggugggagacguggcacaggcgcgcagggggaaacucugggcgaaaaauggaaacgacagcuaaaucaacucucuaaaagugaguucaacacuuauaagcggucagguaucauggaagucgauagauccgaagcaaaagaaggucugaagcgaggcgaaacaacaaagcacgccgucuccagaggaacagccaaacugagaugguucguagaacgcaacuuaguuaaaccugagggaaaaguaauugaccucgggugcgguagaggaggcuggagcuauuacugugcagggcuuaagaaagucacagaggugaaaggcuauaccaagggugggcccggacacgaggaaccaauuccaauggcaacauauggauggaaucuuguaaaauuacauuccggaaaagauguguucuuuauaccaccagaaaaaugcgauaccuuacuaugcgauauuggagagagcucuccuaaucccacgauagaagaagguagaacuuuaagaguccucaaaaugguugaaccguggcuacgagguaaccaauucuguauaaaaauucucaacccauauaugccaagcguuguugaaacacuggaacaaaugcaaaggaagcauggagguaugcucguucgaaacccccuuucuaggaacaguacacaugagauguacugggugucuugcggcacugguaauauuguaagugcuguaaauaugaccucacgaaugcuauuaaauagguucacgauggcacaccgcaaaccuacuuacgaaagagauguagaccuaggggcaggaaccagacauguagcgguggagccggaaguagcaaauuuagauaucauuggacaacgaauagaaaacauuaagcacgaacauaaaaguacauggcauuaugaugaagacaacccauauaaaaccugggcguaccauggaucauaugaaguuaagccuuccggaagcgcuucaaguaugguaaauggcgucgugaaacuacuaacaaaaccgugggacguaauaccgaugguuacacaaauagccaugacggauacuacaccguuuggccaacaaagggucuuuaaggaaaagguggauacgaggacgccaaaagcuaaaagaggcacagcccaaauuauggaaguaacagcgaaaugguuauggggauucuuaaguagaaauaagaaaccccgcauauguacaagggaagaauuuacgcgaaagguucgaagcaaugcugcaauuggagccgucuuugucgaugaaaaucaguggaacagugcaaaagaagccguugaagaugagcguuucugggaucugguucacagagaaagagaacuacauaaacaggguaaaugugcaacauguguguauaacaugaugggcaagcgagagaagaaacuaggcgaauuugggaaagcaaaggggaguagagccauuugguauaugugguugggcgcaagauuccuggaguuugaggcguugggauuuaugaacgaagaucauugguuuucaagagaaaacucgcuaucagggguugaaggugaaggccuacauaaacuaggguauauccuucgagacauuagcaaaauaccuggcggaaacauguaugccgaugauacagcaggaugggauacuagaauuacagaagaugauuuacagaaugaggcacggauaaccgacaucauggaaccagagcaugcauugcuugcaaaaagcauauuuaaacuuaccuaucagaacaaagugguuagaguacaaaggccggccaaaaauggaacugucauggauguaauaucaagaagagaccaaaggggaucagggcaaguagguacauacggguugaacacauucacaaauauggaagcucaauugauacgacaaauggagucagaaggcauuuuuagccccagcgaacuagagacaccgaaccuagcagaacgcguauuagauugguuggaaaaauauggagucgaaagacucaaacggauggccauaagcggugaugauuguguggucaaaccuaucgacgaccgauucgcgacagcuuuaaccgcacuuaaugauauggguaaaguuagaaaggacaucccccaaugggaaccaucaaagggcuggaacgauuggcagcaaguaccuuuuuguucacaucacuuccaccaauuaauaaugaaagauggaagagaaaucgucguuccuuguagaaaucaggaugaauuaguagggagagcuagggucagccagggagcaggauggucauuacgggaaacagcaugcuuagguaagucuuacgcccagauguggcaacuaauguauuuucauaggcgagauuuacgucucgcggccaaugcaauauguagcgccguuccaguagacuggauuccuacuucuaggacaaccuggagcauacacgcccaucaucaauggaugacaacggaagauauguugagcguauggaacagaguauggauagaagagaacccauggauggaggauaagacacauaucagcaguuggggagauguaccauaucuaggaaaaagggaagaucaguggugugggucacucauaggcuuaacagccagggcaacaugggcuacaaauauucaaguagcaauaaaucaggucagaagacugauagguaaugaaaacuacuuagacuauaugacaaguaugaagcgauuuaaaaaugagggcgauccagaaggagcauuaugguaa

SEQ ID NO: 21454 - RNA, 9879 nt, Artificial Sequence
  derived and/or modified CDS sequence (opt6) from DENV-1__FJ373305__SS-prME
uccguuaccaugcuacugauguuaaugccgacggcauuagcguuucaucucacuacuagaggaggcgaaccccauaugauaguaaguaaacaagaacgugguaagagcuuacucuucaaaacuuccgcuggggucaauaugugcacguuaaucgcuauggacuuaggggaacuuugcgaagauacuaugaccuauaaaugcccacggauuaccgaaacugaaccagacgauguagacugcuggugcaaugcaacugauacauggguuacuuauggaacgugcucacaaacgggagaacaccggagagacaagcgcagcguagcucuugcaccacaugugggacugggucuugaaacccguacagaaaccuggaugucuagcgaaggcgcuuggaaacaaauucagagagucgaaacuugggcauugagacauccgggcuucacuguaauagcuuuguuccuggcucaugcaauugggacuucgaucacacaaaaagguauuaucuucauacuacugaugcuuguaacucccagcauggcgaugagauguguaggcauaggcaguagggauuucguugaaggacuuucaggcgccaccuggguagauguaguacuagaacacggaucuugcguaacuacaauggccaaagauaaacccacccuugacauagaacuacuuaaaacagaaguuaccaacccagcuguacugcgaaaauuaugcauagaagcaaaaauuagcaauacaaccacagauucgagauguccaacacaaggugaagcaacucucgucgaagaacaagacgcgaauuuuguuugccgacguaccuuuguggaucggggcuggggaaacggauguggacuuuucgggaaagguucuuugauaacuugcgcgaaauucaaauguguaacgaaauuagaagggaaaauaguucaguaugaaaacuugaaauauuccgucauuguaaccguccacaccggugaucagcaucaggucggaaacgaaucuacagaacauggaacaacagcuacuaucacuccucaagcaccgacaacggaaauacagcuuacugauuacggagcuuuaacucuagacuguaguccccgcacaggauuagauuuuaaugaaaugguauuacuaacaaugaaagaaaaaucaugguugguucauaaacaaugguuuuuagaccuaccucuuccauggacuucaggcgccuccacuagccaagaaaccuggaauaggcaggaucuguuaguuacuuuuaagacugcacacgcgaagaaacaagaagucguugucuuaggcucacaagagggagcgaugcacacugccuuaacaggagccacugaaauccaaaccagcgguacuacuacaauuuucgcagggcauuuaaaauguagguuaaaaauggacaaacuuacgcuaaagggcaugucuuaugugaugugcaccggaucauucaagcuagaaaaggaaguggcagaaacacaacauggcacgguacucguucagaucaaguaugaaggaacagacgcgccauguaaaauuccauuuuugacucaagaugaaaagggcgugacucaaaauggaagauugauaacagcgaacccuauaguaacggauaaagaaaaaccagucaauauagaagcagaaccuccauuuggcgagaguuauauaauaauaggagccggugaaaaggcacuuaaacuaucaugguucaaaaagggaucaaguauuggaaaaauguucgaagccacugcgagaggagcacgucgaauggcuauccucggagauacagcuugggauuucgguagcauaggcgguguguuuacaagcgucgguaaacucguacaucagauuuuuggaacagcauaugguguucucuuuaguggcgucagcuggacgaugaaaauaggaauaggaguauuauuaaccuggcuuggacuaaacagucggucaacaagucuuucaaugacuugcauagcuguuggacucguaacucuauacuuagguguaaugguccaagcagacucaggaugcgugauuaauuggaaaggaagagaacuaaaaugugguucaggaauauucguaacgaaugaaguacauacauggacagaacaauacaaauuccaagcagauagucccaagcgacuuucagcagcaauagggaaggcuugggaagaaggaguauguggaauaagauccgcgacccgucucgaaaauaucauguggaaacaaauaucaaaugaacuaaaccauauauuacuagagaaugauaugaaauucaccguagucguuggggacguagcuggcauacuggcacaaggaaagaagaugauucguccccaaccuauggaauauaaauauucauggaaaucguggggaaaagccaaaaucauaggagcggauguucaaaauacaacguucauaaucgacgggccuaauacuccagaaugucccgacgaccagcgagccuggaauauuugggaggucgaagauuauggguuuggaauauuuacgaccaauaucuggcuuaaacuuagagauaguuauacacaaguaugugaccaucgguuaaugucggcagcaauuaaggacucaaaagccguucaugcagacauggguuauuggauugaaagugaaaagaacgaaacauggaaacuugcaagagcuaguuuuaucgaaguuaaaacuuguauauggcccaaaagucacacauuauggucaaacggaguccuugaaucggaaaugauaauaccuaaaaucuacggaggaccuauuagccagcacaacuacagaccuggguauuuuacccaaacagcaggaccuuggcauuuaggaaaacuagaauuagauuuugaucucugugaaggaacuacagugguaguagaugaacauugcgguaauaggggaccaaguuuaagaacgacaacagucacaggaaagauuauucaugaguggugcugccggagcugcacucuaccuccauugagauucagaggggaagaugguugcugguaugggauggagauaagaccuguaaaagaaaaagaagaaaaccuggugaaaucgaugguuucugcgggaaguggagaaguagacagcuuuaguuuaggacuacuauguauuuccauaauaauugaggagguaaugagaaguagguggucuaggaagaugcuuaugacuggcacuuuagccguauuuuucuuacuaauaaugggacaauuaacauggaaugaucuaauacgcuuguguauaaugguaggagcgaaugcaucagaccgaaugggaaugggaacuacguauuuagcuuuaauggcgacguucaaaaugaggcccauguuugcuguaggccuacucuuuagaagauugacaaguagagaaguacuuuugcuaaccauuggccuaagucuaguagcgagcgucgagcuuccuaacucgcuggaagaauugggugauggauuagcuauggggaucaugauauuaaaauugcuaaccgauuuccaaagccaucaguuaugggcuacucuguugagcuugacuuuuauaaagaccacaguuucccuucacuaugcuuggaaaaccauggcuauggugcugaguauagucucacuauuuccucuaugcuugucaacuacaucucagaaaaccacauggcuaccugugcucuuaggcagccuuggcuguaaaccacuuaccauguuccugaucgcugaaaauaaaauaugggggcguagauccuggccauuaaaugaagguauaauggcggugggaauaguaucaauacuuuuaagcagcuugcuuaaaaacgauguaccacucgcaggcccccuuauagcagggggcaugcucauugcguguuauguaaucucuggcagcucagcugaucuaucacuagaaaaagcagcagagguauccugggaagaagaggcagaacacaguggugcuucucauaacauauuagucgaaguacaagaugauggaacaaugaagauaaaggacgaggagagagacgacacguuaacuauacuacucaaagcuaccuugcuggccguaaguggaguuuaccccuuaaguauuccagcgacguuguucguuugguacuuuuggcagaaaaagaagcagaggucaggaguacugugggacacaccgagcccaccugaaguagaacgugccguacuugacgauggaauauaccggauaaugcaaaggggauuacuuggcagaagucaagucggaguagggguguuucaagagaauguauuccauacaauguggcaugugaccagaggagcaguccucauguaccaggggaaaagauuggagccaucuugggcaucugugaagaaggaucuaaucaguuacggcggcggauggcgucuucaaggaucauggaauacuggggaggagguucaaguaauugcaguggagccggguaaaaauccuaaaaaugugcagaccgcaccgggaacguucaagacgccugaaggggaaguuggggcaauagccuuggacuuuaaaccaggaacaagcggaagucccauaguaaauagagaaggaaagauagugggacuuuacggaaauggggugguaacuacaaguggaacauauguaagcgcaauagcacaagcgaaagcaagccaagaaggaccccuuccugagauagaggaugaaguuuuccgaaaacgcaaccucacaauuauggauuuacacccuggcucgggcaagacgagacgcuaccugccagcuauaguaagagaagcaauuaaacgaaaacugagaacgcugauacuggcgccuaccagaguuguagcaagcgaaauggcggaagcucuaaaaggaaugcccauacgauaccaaacgacagcugugaaauccgaacacacagguaaagaaaucguagaccuaaugugucaugccacauuuacgaugcgauuguugagcccgguucgagugccaaacuauaauaugauuauuauggacgaagcacauuucacugacccgucaaguaucgcggcuagggguuacauauccacucgcguuggaaugggggaagcagcugccauuuuuaugacugcuacuccaccugggucaguagaggcuuuuccgcaaucaaacgcagucauucaagaugaggaaagagauauaccagaaagaaguuggaacucaggcuaugaguggaucacagauuucccaggaaaaacaguaugguucguucccaguauaaaaucugguaacgacauugccaauugcuugaggaaaaauggcaaaagaguaauccaacuuucuaggaaaacauucgacacagaauaccaaaagacgaagaauaacgacugggauuacguaguaacuaccgauauuucagagaugggagcuaauuuucgagcagaucgggugauagauccucggagaugucuaaaaccagucauauuaaaagacgguccagagcgaguaauauuagcggguccaaugccagugacuguagcaucagcagcacagaggcgaggcagaauaggacggaaucacaacaaagaaggggaucaauauauauauaugggccaaccacucaauaacgacgaagaucacgcacacuggacugaagcuaagaugcuauuagacaacauaaauaccccugaggggaucauaccagcauuguuugaaccagagagagaaaagucggccgcaauagauggggaauaucggcuuagaggagaggcacggaaaacauuuguggaguugaugcgaagaggcgaucuaccuguuuggcuaaguuacaaggucgcaucagaaggcuuccaauacucggaccgacguugguguuuugauggagagcgcaacaaucaaguauuagaagagaacauggacguagaaauuuggaccaaagaaggagagagaaagaaauuacggccccgaugguuagaugcacgaacuuauagcgauccauuagccuugagagaguucaaagaauuugccgcaggccgcagaaguguaucuggugaccugauauuagagaucggcaaacuuccacagcacuuaacacaacgcgcccaaaacgcacuugauaaccuaguaauguugcacaauucugaacaaggcggucgugcuuauaggcacgcuauggaagaauugccggauacaaucgagacacucaugcuacucgcccuaauugcuguacuuacagguggagugacuuuauucuuccuuaguggacguggacuuggaaaaacuucgaucggucuauuguguguuauggcuucuucaguauuauuguggauggccucuguagaaccgcauuggaucgcagcaaguauuauucuugaguucuuuuuaaugguuuuacuaauaccugagccagauagacaacgaacgccccaagacaaucaauuagccuacguagugauaggauugcuguuuaugauccugacaguggcagcgaacgaaaugggccuccuugaaacaacgaagaaagacuugggcauuggccauguagcaguagagaaccaccaucaugcugcuaugcuugauguagauuuacauccagcuagugcauggaccuuauaugcgguagcuacgacgauuaucacuccaaugaugagacauacaauugaaaauacgacagcaaacauaagccuaacggcaaucgcaaaucaagcagcuauauuaaugggauuggauaaaggauggccaauauccaaaauggauauaggaguaccucuauuggcauuagguugcuauucccaaguaaauccucugacacugaccgcagccguccuaauguuaguagcacauuaugcuauaaucggaccgggacuacaggcaaaagcuacgagagaggcgcagaaacggacagcugccggaaucaugaaaaaccccacgguagacggcauaguugcaauagauuuagaccccguaguuuaugaugcaaaauuugagaaacaacuaggucagauaaugcucuuaauauuauguaccucccaaauucuuuugaugagaacuacaugggcauuaugugaaucaauuacauuagcaacuggcccuuuaaccacauuaugggaggguucaccaggcaaguuuuggaauacuacaauagcaguaucaauggcgaauauauuccgaggauccuauuuagcgggcgcgggccuggcuuucucacuaaugaagucacuagguggaggcaggagaggcaccggagcccagggcgaaacuuuaggagaaaaauggaaaagacaacuuaaucaauuaucuaaauccgaguucaauacauacaaaagaucugguauaauggaaguagaucguucugaagcuaaagaaggucuaaagcgaggagaaacaacgaaacaugcuguuucgagagggaccgccaaauuaaggugguuuguagaaagaaaucuuguuaaaccugaaggaaaaguaaucgaucucggaugugguagaggugguuggagcuauuauugugcaggacuaaagaaagugacggaaguaaaaggauauacaaaaggaggcccaggccaugaggaacccauucccauggcaacauauggauggaaccuaguuaaacuacauucgggcaaggacguauucuuuauaccaccugagaaaugcgacacucuccuaugcgauauuggagaaaguagcccgaauccaaccauagaagagggacgaacuuuacgcgugcuaaaaaugguagaaccaugguuacggggcaaucaauucuguauaaaaaucuuaaauccuuauaugccaagcgucgucgagacguuagaacagaugcagaggaaacauggugggaugcuuguacgaaauccccuaaguagaaacucaacucacgagauguacuggguaaguugcgggaccggaaauauaguaucggccguaaauaugacaaguaggauguuauuaaauagauuuacuauggcccacagaaaacccaccuaugaaagggauguagaucuuggcgccgguacacgacaugucgcgguggagccugaagucgcuaaucuugacauaauaggucaacgaauagagaauauuaaacaugagcauaaaagcacauggcacuaugaugaggacaacccauauaaaacaugggcuuaccaugguagcuaugaaguaaagcccagugggucugcaaguucaauggucaacggugugguuaaacucuuaacaaaacccugggacguuauacccauggucacacaaauagcuaugaccgauacaacuccauucggacaacaaagaguuuuuaaagagaaagucgacaccaggacgcccaaagcgaaacgagguaccgcacaaaucauggaggugacugcaaaguggcuauggggcuuccuuucucguaauaagaaaccacgaaucuguacaagggaagaauuuacucgaaaaguccgaucuaaugccgcaauaggagcuguauucguagaugagaaucaguggaauagugcuaaagaagcaguggaggacgaacgauucugggaucuaguucauagggaacgugagcugcacaaacaagggaaaugugcgacaugcguuuacaacaugauggguaaaagagagaagaaacugggagaguucggcaaggcuaaaggcagcagggccauuugguacaugugguuaggcgcucgcuuccuggaguucgaggcuuugggguucaugaaugaagaucacugguuuucaagggaaaauucguugucggguguagaaggagagggucuccacaagcuggguuauauacuucgagacaucucaaagauuccugggggcaauauguaugcagaugauacggcugggugggauacuaggauaacggaagacgacuuacaaaacgaggcccggauuaccgauauuauggaaccagagcaugcauugcuagcuaaaucaauauuuaagcuaacauaucaaaauaaaguuguuaggguacaaaggcccgcuaagaauggaacaguuauggacgucaucaguagacgggaccaaagaggauccggacaaguuggaacguauggacuaaacacuuucacgaacauggaagcgcaacuaauaagacaaauggaaucagaggggauauuuagcccaucagaacucgaaacgccaaacuuagcggaacguguuuuagauuggcuagagaaguacggcguggagagacuuaaaagaauggcuauaaguggagacgacuguguugugaaacccauagacgaucgcuucgcaacagcuuuaacagccuugaaugacaugggaaagguuaggaaggacauaccccaaugggaaccaucaaaaggauggaacgacuggcaacaaguuccauuuuguagccaucacuuucaucaguuaauaaugaaagauggucgagaaauuguaguuccuuguaggaaucaagaugaguuagugggucgagcgagaguuagccaaggagccggguggagccuacgagagacagccugcuugggcaagucauacgcacagauguggcaacuaauguacuuccaucggcgugacuugagauuagcagcaaacgcgaucuguucagcuguaccuguagauuggauaccaacaaguagaacgacuuggucaauccacgcacaucaucaguggaugacaacagaagauauguugucgguuuggaaucgaguuuggaucgaagaaaacccguggauggaagauaaaacacauauuucaagcuggggagacguaccuuauuugggcaaaagagaggaucaaugguguggaagucuuauuggacuaacggcgagagccacaugggcaacuaauauacaaguugcgaucaaucaggucagacgacucauugguaacgagaacuaucuugauuacaugacaaguaugaaacgauuuaaaaacgaaggagacccagaaggggccuugugguaa

SEQ ID NO: 21455 - RNA, 9879 nt, Artificial Sequence
  derived and/or modified CDS sequence (opt6) from DENV-1__EU660402__SS-prME
ucaguaacaauguuacugaugcugaugccaacagcucuagcguuucaucugacuacacgaggaggagaaccucacaugaucguauccaaacaagaacgaggaaaaaguuugcuuuuuaaaacuuccgcaggcgucaauauguguacucuaauugcaauggaccugggcgaauuuugugaagauacaaugacauauaaauguccacgaauaacugaagcagaaccugaugauguagauugcuggugcaacgcaaccgauacauggguuacauacggcacauguucacaaacgggcgaacacaggcgugacaaacgcucaguagcccuagccccacaugucggcuuaggucuugaaacucguacagaaaccuggaugaguagugagggcgcuuggaaacaaauacaaagaguagaaaccugggcacuaagacauccaggauuuacaguaaucgcacuuuuucuugcacacgcaauuggcacaucuaucacccaaaaaggaaucauauucauucuacuuauguuagucaccccuucaauggccaugcguugcguagguaucggaaguagagacuucguugagggguuaagcggagcuacuuggguagauguugucuuagaacacgggucuuguguuacaacuauggccaaagacaaaccuacacuugauaucgaacuccugaaaaccgaggugaccaacccagcaguucugcgcaaauuaugcauugaagcuaaaauuuccaauacgacaacagacagcagaugcccuacacaaggugaagcaaccuuaguagaagaacaagaugccaauuucgugugucgcagaacauucguugaucguggcugggguaaugguugugggcuauuuggaaaaggcagcuugauaacgugcgcaaaauuuaaauguguuacuaaauuagaaggaaaaauuguccaauacgagaaucucaaauauucuguaauaguaacaguccacacaggagaccaacaccaagucgguaaugagucuacggaacacggaacaacggcgacaaucacgccucaggccccaucaacagaaauccagcuaaccgauuacggagcauuaacacuagauuguucaccacgcacaggcuuggacuucaaugaaaugguauuguuaacgaugaaagagaaaucguggcuuguacauaaacagugguuucuagauuugccuuugcccuggacuucuggggcuucaacaucgcaggaaacauggaauagacaagaucuuuuagucacauuuaaaacggcucaugcaaagaaacaagaagugguaguacuuggaucccaagaaggagcaaugcacaccgcacuaacuggagccacagaaauucaaacaucuggaacaacgacgauauuugcaggacaucucaaaugucgucucaaaauggauaaacuaacguuaaaagggaugucauacguaauguguacagguucuuuuaaauuagaaaaggagguagcggaaacgcaacacggaacaguucucguacaaauaaaauaugagggaaucgacgcuccuuguaaaauaccauuuucaacacaggaugaaaaagguguaacacagaauggaagauuaauuacagcuaauccgauuguaacagauaaagaaaaaccaguaaacauagaggcggaaccacccuuuggcgaaucauacauagugaucggagcgggagaaaaggcuuuaaaauuaagcugguuuaagaaaggaucauccauugggaaaauguucgaagcgacagcucgaggagcgcgacguauggcuauacucggagauaccgccugggauuucgggucaauuggcgggguguuuacaucaguagggaaacuuguccaucagauauuuggaaccgccuacgggguacuuuuuaguggcgugucauggaccaugaaaaucggcauuggaguguuacuuacguggcuaggauuaaacagcaggagcacuucacuuagcaugacauguauagcaguggguuugguaacauuauacuuaggggucauggugcaggcagauuccggaugugucauuaauuggaagggaagggaauuaaagugcggcagcggaauauuugugacaaaugaagugcacacuuggaccgagcaguauaaauuucaagcagacucaccaaaaagacuuagugcugcuaucgggaaggcaugggaagaggguguauguggaaucaggucggccacaagauuggagaauaucauguggaagcagaucaguaaugaacuaaaucauauauuauuagaaaaugacaugaaacuaacuguuguaguaggggacguagcagguauauuagcccaaggaaagaaaaugauuagaccacaaccuauggaguacaaauacagcuggaaaauauggggaaaagcgaaaaucauuggugcagaugugcaaaacacuaccuuuaucaucgacggaccaaacacuccagaauguccggacgaccaaagagcguggaauauaugggaaguagaagacuauggauuuggaauuuuuacgacaaacauauggcuuaaacuacgcgacucauauacucaaguaugcgaccauaggcucaugucggcggcgauuaaggauagcaaggcaguucacgcggauaugggguauuggaucgaaagcgagaaaaaugagacguggaaacuggccagagccaguuucauagagguaaagacauguaucuggccgaaaucacacacuuuauggucuaauggaguauuagaaagcgaaaugauaauaccaaagaucuacgguggacccauaucucaacacaauuacagaccaggguacuuuacacagacugcuggaccuuggcaucuugggaaacuggaguuagauuuugaucucugcgaaggcacgacaguagugguugaugaacacugcggcaauagaggccccucauuacgcacaaccacagugaccggaaaaaucauacacgaaugguguugccguucaugcacccugccaccgcuuagguuuaaaggugaggauggauguugguaugggauggaaauuaggccuguaaaagaaaaagaagagaauuugguuaaaaguaugguuucagcuggcucaggagagguagauucguucucuuuggguuuauugugcauuucgauaaugaucgaagaaguaaugcguagcagauggucgcguaaaaugcuuaugaccgguacacuagcggucuuuuucuuacuaaucaugggucaacuaacauggaaugacuuaauaagauugugcauaaugguaggagcaaaugcauacgaucgaaugggcaugggcacgacguacuuagcccuuauggcuaccuuuaaaaugaggccgauguucgccguagguuuacuguuuagacggcucacgucgagagagguucuacuauuaacuauaggacucagcuuaguagccucuguagaacuaccuaacaguuuggaagaacugggagacggauuggcgauggguaucaugauacugaaacuauuaacugauuuucaaucucaccaauuaugggcuacacuuuuaucacuaaccuucauacgaacuacauuuucucuacauuaugcuuggaaaacaauggcuaugguguuaucgauagucagcuuauucccuuuauguuuaaguacaacuagccagaaaacuacguggcuuccaguccuacuaggaucgcuaggauguaaaccauuaacgauguucuugauagcggaaaauaaaauuugggggaggaaaucauggccucugaaugaggguaucauggccguagguauaguaucgauucuacuaucaucacuacucaaaaacgacguuccauuggcagguccuuuaauugcuggcggaaugcuaauugcaugcuacguaauaucaggcagcagcgccgauuugucauuggaaaaagccgcggagguuucaugggaagaggaggcagagcauaguggggcgagucauaauauuuuaguagaaguucaggacgacggaacaaugaaaaucaaggacgaagaacgggaugauacacugaccauacuauuaaaagcgacgcuacuagcuguaagcgguguauacccauuaucgauuccggccacccuuuuugucugguauuuuuggcagaagaagaaacaacgaucgggaguguuaugggauacuccuaguccaccggaagucgaaagggcaguauuagaugacggcaucuaccgcauaaugcagcguggauugcuggggagaagucaaguugguguagguguauuucaagaaaauguauuucacacaauguggcacgugacaagaggcgcuguacuaauguaccaggguaaaagguuagagccaagcugggccucaguuaagaaagaccuaaucucuuaugguggaggauggaggcuacaggguucauggaacacaggugaagaaguucaagugauagcuguugaaccugggaaaaaucccaaaaaugugcaaacugcuccuggcacuuucaaaacaucagaaggagagguuggagcuauagcacuagacuuuaaaccuggcacuagcggaagucccauagucaacagagaaggaaaaaucgugggcuuauacggcaauggcguggugaccaccucaggaacauauguaagcgcaauagcacaagcgaaagcuagccaagagggaccgcuccccgaaaucgaagacgaaguuuuccgaaaacgcaauuuaacuauaauggauuuacacccaggcagcgggaagacaagacgauaucuacccgcaauagucagggaggcuaucaaacgcaggcuaagaacacuaauauuagcaccaacaagaguaguugccagugaaauggccgaagcauugaaaggaaugccaauacgcuaucaaacgacggcagugaaaagcgaacacaccgguaaagaaauaguagaucuaaugugccaugcuacuuuuacuaugagauuacucagccccguaagggugcccaauuacaacaugauuaucauggaugaagcacacuuuacggauccauccucaaucgcagcuagaggcuauaucucaacuagaguagggaugggagaagccgcggcgauauuuaugacggcaacacccccugguagcgucgaagcauucccgcagucgaacgcuguaauacaagaugaagaaagggacaucccugagcgcuccuggaauagugguuaugaauggauaaccgauuuuccaggaaaaacuguaugguuuguuccuucaauaaaaaguggaaacgacauugcaaauuguuuaaggaaaaaugguaaaagaguuauacaguuaaguagaaagacauuugacacagaauaucagaaaacgaaaaacaaugacugggacuauguaguaacuacagauauuucagaaaugggcgcuaacuuuagagccgacagaguaauugacccacgcagaugucuaaaaccugucauccuaaaagauggcccagaaagaguaauuuuagcggguccaaugccuguaacaguugcaucagcagcacaacgccgagggcguauaggcagaaaccauaacaaggaaggcgaccaauauauauauaugggacaaccacuaaauaaugacgaagaccacgcacauuggacagaggccaaaaugcuguuagauaauauuaacacaccagaaggaauuauuccggcacuguucgaaccagaacgugaaaaaucagcagcgauagacggagaauauaggcuaagaggggaggcucgaaaaaccuuuguagaacuaaugagaagaggagacuugccugucuggcuaucucacaagguugccagcgaaggauuccaguacagugaccgaagaugguguuucgauggagagagaaacaaccaaguacuugaagaaaacauggauguagaaauauggacuaaagagggagaacggaagaaauuacguccacgauggcuagacgcgcgaacuuacagugauccauuggcacuucgagaauuuaaagaauuugcagcaggacgaagaagcgugucgggcgacuuaaucuuagaaauaggaaagcuaccacaacauuuaacacagagggcacaaaaugcguuagacaaucuugugauguugcauaacucagaacaagggggucgugcauaucgacaugcaauggaagaauugccugauacaauagaaacacuuauguuguuagccuuaaucgcaguacugaccggcgggguaauguuguucuuuuuaagugguagaggauuagggaaaacaucuauaggacuauuauguguuauggcuucgucaguauuauuauggauggcgagugucgagccacacuggauagcugcuucuauaauuuuggaguucuuucuaauggugcugcuaauuccagaaccugacagacaaagaacaccacaggacaaccaauuagccuauguagugauuggacuauuauucaugauauugacgguagcugcaaacgaaaugggauuacuagaaacuaccaagaaagaccuuggaauaggacacguggcaguugagaaucaucaucacgcagcgaugcucgauguagacuuacauccagcuucagcauggacuuuauaugccguagccacgacgauuaucacaccaaugaugagacauacgauagaaaacacaacugcaaauauaagccuuacagcaauagcuaaucaagcggcaauauuaauggggcucgauaaaggauggcccaucucaaagauggacauaggagucccauuacuggcucuaggguguuacucacaaguuaacccgcuuacacuaacagccgcaguuuuaauguuagucgcacauuaugcaauaauagggcccggcuuacaagcuaaagcgacaagagaagcucaaaagagaaccgcggcuggaauuaugaagaacccaaccguagaugggaucgucgcaauugaccuggaccccgugguauacgaugcuaaauuugagaaacaacugggacaaauuaugcuccuuauccuaugcacaagucaaauauuauuaaugcgcacuacaugggccuuaugugaauccauuacccuugccacuggaccacucacaacacuaugggaggguucuccgggaaaguucuggaacaccacaauugcugugucuauggcaaauaucuuccguggaucuuauuuagcuggagcgggauuagcauucucuuuaaugaagucacuaggcggaggacggagagguacuggugcccagggugaaacacuaggagaaaaauggaaacgacaauuaaaucaguuaucaaaaagugaguucaacacguauaaaagaaguggaaucauggaaguagaccgaagcgaggcaaaggaaggcuugaaacguggagagacuaccaagcaugccgugucccgcgggacggcuaagcuacggugguuuguggaaagaaauuuggugaaacccgaaggcaagguaauagauuuagguugcggaagaggagguuggagcuacuauugugcaggacuaaagaaagugacagaagucaaagguuacaccaagggugguccaggacacgaagaaccaauaccuauggcaacuuauggguggaauuuggucaaacuucacucgggaaaagauguauucuuuauaccuccugaaaaaugugauacacuacuaugugauauaggugagucaucaccaaauccaacgaucgaagagggaagaacucuucggguccucaaaauggucgagccaugguuaagagggaaccaauuuuguauaaaaauuuuaaauccguauaugcccaguguagucgaaacauuagagcagaugcaacguaaacaugguggaaugcucguuagaaacccuuuaagcagaaacucaacccacgaaauguauuggguaucuuguggaacagggaauauuguuucagccguuaacaugacgucaagaauguuguugaaucgauuuacuauggcacauagaaaacccacguaugaacgugauguggaucugggugcgggcacacgucauguugcuguagaaccagagguagcaaaucucgacaucauagggcaacguauagaaaauaucaaacacgagcauaagagcacauggcauuaugacgaggacaauccuuacaagaccugggcuuaccauggaucauaugaaguaaaaccaagcggcagcgccucuaguaugguaaauggaguaguuaaguuacuaacaaaaccaugggauguuaucccaauggucacucaaauagcaaugacggauacaacaccauuugggcagcaaagaguauuuaaggaaaagguagauacaaggacaccgaaagcaaaaaggggcacggcucaaauuauggaggucacugcgaaauggcuauggggguuucuaucaagaaauaagaaaccacgcauaugcacacgagaagaguucacgcgaaaaguaagguccaaugcagcaauuggagcggucuuugucgaugaaaaucaguggaacucagcgaaagaagcagucgaagaugaaagauuuugggaucucgugcaucgagaacgagaguugcauaaacagggaaagugcgcaaccuguguuuauaacaugaugggcaagagagagaagaaacugggggaguuuggcaaagcaaaagggucuagggcgauaugguauaugugguugggagccagauuccuagaguuugaagcguuaggcuuuaugaaugaggaucauugguucagcagagagaacucccuauccggaguagaaggcgagggauugcauaaacuaggauauauacuacgagacauauccaaaauucccggugggaauauguacgcagacgauacugcugggugggauacgcguauaaccgaagaugaucugcaaaaugaagcaaaaauuaccgauauaauggaacccgaacaugcacuauuggcaaaaucgaucuuuaaacugacauaucaaaauaaaguggucaggguucaacgaccagcuaaaaauggaaccgugauggauguaaucucaagaagggaccagcgugguaguggucaaguuggaacguacggauuaaauacauucacaaacauggaagcucaacuaaucagacagauggaaucagaagggauauuuucgccaucagaauuagaaacaccgaaccucgcuggcagaguauuagacuggcuagagaaacacggcguugagagacugaaaaggauggcaauauccggcgaugauugcguggugaaaccuauagaugaccgauuugcuacagcacuaacagcgcuaaacgauauggguaaaguaagaaaggauaucccccaaugggaaccaagcaaaggauggaaugauuggcaacaggugccguuuuguagccaccauuuccaucaguuaaucaugaaagauggcagagagauaguuguaccguguagaaaccaagacgaauugguagguagagcuagaguuagccaaggugcggguuggagucucagggaaacugcuuguuuaggaaagagcuaugcgcaaauguggcaauuaauguacuuucaccgaagggacuugcgacucgccgcaaaugcuauaugcagugcgguuccgguggauuggguaccuacgagcaggacaacuuggaguauacaugcccaucaucaauggaugacgaccgaagacaugcuuucuguauggaauagaguauggauagaagaaaacccauggauggaagauaaaacacaugucaguucauggggugauguacccuaccuugguaagcgggaagaucaguggugugggucacuuauaggguuaacagcgagagcuacaugggcgacuaauauucagguugcuauaaaccagguucggcguuuacuaggaaaugaaaauuauuuagauuacaugacgucaaugaaaagauucaagaacgagucggaucccgagggggcgcuaugguag

SEQ ID NO: 21456 - RNA, 9879 nt, Artificial Sequence
  derived and/or modified CDS sequence (opt6) from DENV-1__EU660403__SS-prME
agugugaccaugcuucuaaugcuuaugccgacugcacuugcauuucaucuaacuacacgagguggggaaccacacaugaucguaucaaaacaagagagagggaaaucucuauuauuuaaaacaagugcgggcguuaauauguguacguugaucgcaauggaccuaggggaacuaugugaagauacuaugaccuauaaaugcccaagaaucacagaaacggaacccgaugacguagauugcugguguaaugcuaccgacacauggguuaccuauggaaccugcucucaaaccggggaacauaggcgugacaaaaggucuguugcccucgccccucauguugguuuggggcuagaaacccgaaccgagacguggaugucuuccgagggcgcauggaaacaaauacaacguguggaaacaugggcccuacgacacccagguuucacgguaaucgcauuguuucuugcgcacgcgauaggaacaucuauuacacaaaaaggaauuauauuuauucuucucauguuagucacgccuaguauggcuaugagaugugucgggauugggucuagggauuuuguugaaggguuaaguggagcgacuuggguugacguggucuuggagcaugggucauguguaacaacuauggcuaaagauaaaccaacacuggacauugaacuucuuaaaacagagguaacuaacccugcaguacuucgaaaacuaugcauagaggcuaaaauuuccaacacgacuacggauucacgauguccgacacaaggugaagcgacccuuguagaagaacaagaugcuaacuucguaugccgcagaacauuugucgacaggggaugggguaacggaugugggcucuuugggaaaggaucacuaauaaccugcgcuaaauucaaaugugucacaaaacuagaagggaaaauaguacaauacgagaaccuaaaauacucgguaauagugacgguacauacaggugaccaacaucaagugggaaaugaaaguacggaacauggaacgacagcuacaauuacuccacaagcaccaacaacagagauacaauuaacggauuauggugcguuaacgcucgacuguagucccagaaccggucuagacuuuaaugagaugguucuacuaacuaugaaagagaaaaguugguuaguccacaaacagugguucuuagaucugccgcuaccuuggaccucuggggcaucaacaagucaggaaacuuggaaucgacaagaucuccuaguaacauuuaaaacugcacaugcaaagaaacaagaagucgugguauuaggcucucaggaaggggccaugcacacugcucugacuggagcaaccgaaauacaaacgucagguacaacuacuauuuuugcuggacaccuuaagugucguuuaaaaauggacaaacuuacacucaaggggaugaguuacguaaugugcaccggcaguuuuaagcuagaaaaagaaguagcagaaacccagcauggaacuguacugguacaaauuaaauaugaagggacggaugcacccugcaaaauccccuuccuaacgcaagaugagaagggaguaacgcagaaugguagguugauaacagcuaauccgauagucacugauaaagaaaaaccuguuaauauagaagcagaaccaccauuuggagaaucauauauuauuaucggggcuggcgaaaaggcauuaaaauuaucuugguuuaagaaaggaagcucaauuggcaaaauguucgaagcuacugcuagaggugcuaggcgaauggcaauauugggagacacagcuugggacuucggaucuauaggaggaguuuuuacaaguguuggaaaguugguacaucaaauauuugguacggcauacgguguacuauucaguggggugaguuggacuaugaaaauagggauuggaguacugcuuacuuggcugggauuaaauucuaggucaaccucccuuucaaugacaugcauagcaguaggcuuaguuacauuauacuuaggaguuaugguucaagccgauagcgggugugucauaaauuggaaagguagggaauugaagugcggaagugguaucuucgucaccaacgagguacacacauggacagaacaauacaaauuucaagccgacagcccaaaacgucuaucggcggcaauuggaaaggcuugggaagaagggguaugcgggauacgaucugcuacacgauuagaaaauaucauguggaaacagaucaguaaugaacugaaucauauuuuacuagagaaugauaugaaguuuacaguuguggugggugauguugcagguauacuagcacaagguaaaaagaugaucagaccccaaccgauggaauauaaauacucguggaaaaguugggguaaagcgaaaauaauaggggcugauguucaaaauacaacguucaucauagaugguccgaauaccccagaaugcccagaugaucaacgugcauggaauauuugggaagucgaagauuacgguuuugguauuuucacgacuaauaucuggcuuaaacuuagggauucguacacacaaguaugcgaucacagauuaauguccgccgcaauaaaggauuccaaagcuguacacgcagacaugggguacuggaucgagagcgaaaagaaugaaacauggaaguuagcaagggcauccuuuauagagguaaagaccuguauauggccgaaaucgcacacuuuauggaguaacgggguuuuggaaucagaaaugauaaucccaaagauauauggcgggccuauaucacaacauaauuaccguccaggcuacuucacccagacagccggcccauggcacuuagguaaacuugagcuggacuucgaccuaugugaaggcacgaccgugguaguagaugaacauuguggcaaucgaggaccgaguuuaaggacuacaacuguuacagguaaaauuauacaugaaugguguuguagauccugcaccuuaccaccauuaagauuuagaggggaagauggaugcugguauggaauggaaauccguccaguaaaggaaaaagaagaaaacuuagucaagaguaugguuuccgcagguagcggugaaguagauaguuuuucauugggguuacuauguauaucuauaaucauagaagaaguuaugagaucccgauggucucguaagauguuaaugacagggacauuagcaguauucuuuuuauuaaucaugggccaacuuacuuggaaugaccuaaucagauuaugcauaaugguaggggcaaaugcuagugacagaaugggaaugggcacgacauaucuagcucuaauggccaccuuuaaaaugagacccauguucgccguaggucuccuauuuagaagacugacgaguagggaaguccuauuacucaccauuggacuaucacucguugcgucgguugaacuacccaauaguuuggaagaauugggcgauggguuagcgaugggaauaaugauauuaaaacucuuaaccgauuuccaaagucaucaauuaugggcuacacuuuuaucgcugacuuuuauuaagaccacguucucacuacauuaugccuggaaaacuauggccaugguauuauccauuguaucguuauuucccuuauguuugagcacaacuucccaaaagacaaccuggcucccaguauuacuaggcucacuagguuguaaaccacuuacuauguucuuaaucgcggagaauaaaauaugggggagacgaucauggcccuuaaaugaagggaucauggcugucgguauaguaagcauuuuacuauccagucuuuuaaagaaugacgucccucuggcaggaccgcuaauagcaggggguauguuaauugcaugcuacguaauaagcggguccucggcggacuuaucguuagagaaagcugcugaagucucaugggaagaagaggcggaacauagcggagcaucacacaacauauuaguagagguccaagaugauggaacaaugaaaauaaaagacgaagaaagagacgacaccuuaacaauauuauugaaagccacauuauuagccguauccgguguauauccuuuaaguauucccgcaacauuauuugugugguacuucuggcagaagaagaaacaaaggaguggcguccuuugggacacacccaguccuccagagguggagcgggcaguccuagacgaugguauuuauaggauuaugcaacgaggucuacuuggaaggucacaaguuggaguugguguguuucaggagaauguauuccauacaauguggcaugugacgaggggagcaguguugauguaccaggguaaaagauuagagccaaguugggcuagcguuaagaaagaucucaucucuuacgggggaggauggcgacuccaagguucauggaauacuggugaagagguacaagucauagcaguagaaccaggcaaaaauccuaaaaaugugcaaacagccccgggaacauucaagacaccggagggagaggugggagcaaucgcauuggacuucaaaccuggaacuucuggcagcccuauaguaaauagagaaggcaaaauuguuggacuauauggcaacggaguugucacaaccucaggaacuuacguaucagcaauagcacaagcaaaagccucccaagaaggcccacucccagaaauagaggaugaaguguuucggaaaagaaauuuaacaaucauggaccuacauccaggaagcggaaaaacaagacgauauuuaccggcaauaguucgggaagcuauuaaacgaaagcucaggacauuaauauuagccccaacgagagugguagcaucagaaauggccgaggcguuaaaaggcaugccgauccgauaucagacaacggcgguuaaaucggagcauacagguaaagaaauuguagauuuaaugugucaugccacguuuacgaugagauuguuaaguccugucaggguuccaaauuacaauaugauaaucauggaugaagcucauuuuacagaucccaguuccauugcagcaaggggauacauauccaccagaguagguaugggagaggccgcggcaauauucaugaccgcaacgccacccggaagcguagaggcauuuccgcaauccaacgcagucauucaagaugaagaaagggauauuccagaacggagcuggaacucugguuaugaauggauuacagacuuccccgguaaaacuguuugguucgugccgaguaucaaaagcggcaaugauauugcuaauugcuuaaggaaaaauggaaaaagaguaauucaacuaucuagaaaaacauucgacaccgaguaucagaaaacuaaaaauaacgauugggacuaugucguaacuacggacauauccgagaugggcgcgaauuucagagccgauagaguuauugauccacggagauguuuaaagccaguuauacuuaaagauggaccugagagagugauccucgcagguccuaugccaguaacuguagccucugcggcgcaaagacgaggaaggaucggcagaaaucauaauaaagagggugaccaauauauuuauaugggucaaccgcucaauaaugacgaagaccacgcacauuggacagaagcaaaaaugcuauuagacaacauuaacacaccagaaggaauuauaccagcacucuuugagccggaaagagaaaaaucugccgcaauagacggggaauacagacuacgcggugaagcaagaaagacguucguagaauugaugagaaggggugauuugccaguaugguuaucauauaagguugcgagugaaggauuucaauauucagacagaagaugguguuucgauggagagcggaauaaucaaguacuggaagaaaacauggacgucgagauauggacaaaggagggugagaggaagaaacugagaccacggugguuggacgcccgaacauauucagaucccuuagcacuucgugaauuuaaagaguucgcugcuggaaggagaagcgucucaggagauuuaaucuuagaaauaggaaaacucccacaacacuuaacacaaagagcgcaaaaugcuuuagauaaccucgucaugcugcauaacucugaacaaggagggcgugcguacagacaugcaauggaggagcuuccugacacaauagaaaccuugauguuacuggcuuuaauugcaguauuaacagguggaguuacacuuuucuucuuaucagggagaggucuuggaaagacaagcaucggauuauuauguguuauggcaucaucgguacuauuguggauggcuucaguagaaccccacuggauagccgcaaguauaauauuggaguucuuucugaugguccuacuaauaccggaaccagacagacagcgaaccccacaagauaaccaauuggcuuaugucguaauuggacuucuuuuuaugauauuaacaguggccgcgaaugagaugggacuacuagagaccacgaagaaagaucuaggcauuggucacguagccguagagaaccaucaucacgcugcuauguuagacguugauuuacauccugccuccgccuggacacuauaugcuguugcgaccacuauuauaacaccaaugaugagacauacaauagaaaacacaacggcaaacauaucacugaccgccauagcaaaucaagcagcaauccuaaugggcuuggacaaaggcuggccuauaucaaaaauggauauagguguuccguugcuugcuuuaggcugcuauagccaagucaauccucuaacacuaaccgcggcaguuuuaauguuaguagcucauuaugcgauuaucggaccaggucuacaagcuaaagccacaagagaagcucagaaacggacagcagcgggaauaaugaaaaauccuaccguggacggaauaguugccauugacuuggauccuguuguguaugaugccaaguuugaaaagcaauuaggucaaaucauguuacuaaucuuauguacaucacagauacuuuuaaugaggacaacaugggcucugugcgaaaguauaaccuuagcaacaggaccauuaaccacuuuaugggaaggaagucccgguaaauuuuggaacacgacaaucgcgguaucaauggcuaacauuuuucgcggaucguaucuagcgggcgcaggacuagcauuuucacuaaugaaaagucuuggagguggcagacguggaacaggagcacaaggcgaaacccuaggagaaaaauggaaacgccaacuaaaccaauugucaaagucagaauuuaacacauauaaacgaucagguauuauggagguugacagaagugaggcuaaagaaggccuaaaaagaggugaaacuacgaagcaugccguaucaagggguacugcaaaauuaagaugguuuguggagcgcaaucuuguaaaaccagaagggaaaguaauugauuuagguugcggacgaggaggauggaguuacuauugugcuggacuuaagaaagugacagaaguaaaaggauacacuaaaggcgguccaggucaugaggaaccuauucccauggcaacuuauggauggaauuuggucaaacuucacuccggcaaagauguauucuuuauaccucccgagaagugugauacauuguuaugugauauaggcgagucauccccuaaucccacuauagaagaagguaggaccuugcgggucuuaaaaauggucgaaccuugguuaagagguaaccaauucuguaucaaaauauuaaauccauauaugccaucuguaguagagacuuuagaacaaaugcaacgaaagcaugguggcauguuaguuaggaauccucuaagcaggaacaguacccaugaaauguacuggguaucaugcgguacugggaacauuguauccgccgucaauaugacaucaagaauguuacuaaaucguuuuacaauggcacauaggaagccaacuuaugagagagauguagacuuaggcgcuggaacacggcauguagcgguugaacccgaaguagcaaauuuagauauuauagggcaaagaauugaaaauauuaaacacgagcacaaaaguacauggcauuaugaugaagauaauccuuacaaaacaugggcauaccauggaucuuaugaaguaaaaccaucgggaucagcuucaucaaugguuaaugguguaguuaaguuguuaacuaaaccgugggacguaaucccuaugguuacccaaauagccaugacugauacuaccccguuuggccaacaacguguauuuaaagaaaagguagacacacggacaccaaaggcgaaacgaggaacagcucaaauaauggaaguuaccgcuaaauggcucuggggguuccuuucgcguaauaagaaaccaagaauuuguacuagagaagaauuuacaaggaaaguacgaucaaaugccgcuaucggagcaguguucguagacgaaaaccaauggaacucagcuaaggaggcaguagaagaugagcgguuuugggacuuaguacacagggagagagagcuccacaaacaaggcaaaugugccacauguguauacaacaugaugggcaaacgagagaagaaacucggugaauuugggaaagcuaaggggucccgagcgauaugguauauguggcuuggagcccgguuccuugaguucgaagcauuagguuuuaugaacgaagaucauugguuuagcagagaaaauuccuuaaguggaguggaaggugaaggcuuacauaaauuaggauacauauuaagagacauuucuaaaauuccaggagguaauauguaugcagacgauacggcaggaugggacacacguauuacugaagaugaccugcaaaaugaagcccgcaucacagacauaauggaaccugagcaugcguuacuggcaaaaaguauuuucaaacuaacauaccagaauaaaguaguucgaguacaacgaccggccaaaaaugguacuguuauggaugugaucucucgucgcgaucagagaggcagcggucaggucgggacguacgggcuaaauacauuuaccaacauggaggcccaguugauacgacaaauggagagugaagggauauuuucaccuuccgaacuggaaacaccgaauuuagccgaacgcguccuugauuggcuugaaaaauauggcguugagcgacugaagcgcauggcaauuuccggcgacgauuguguaguaaaaccaauugaugaucgauuugcuacggcacucaccgcccuaaaugauaugggaaagguaagaaaagauauaccgcaaugggaaccaucaaaaggauggaaugacuggcagcaagugccauucuguagucaccauuuucaucaacugauaaugaaggacggucgcgaaauuguaguaccaugucgaaaccaagaugagcuaguaggucgugcaagagugagccagggagcgggcuggagccucagagaaacugcaugccugggaaaaucauacgcacaaauguggcaauuaauguacuuucaccggcgagauuuacgacuugcugcaaacgccauuuguagcgcugucccuguugacuggaucccaacgagcagaacuacauggucaauacacgcccaucaccaauggaugacgacagaagacauguuaucuguauggaaccguguauggauagaagagaauccuuggauggaagauaagacacacaucucgucauggggagaugugcccuaccuagguaaaagggaggaucaguggugcggaucccucauagguuuaacagcacgggcaacuugggcaacaaacauacaaguagcaauaaaccaaguuaggagacuaauuggcaacgaaaacuaucuggacuauaugacuucaaugaaacgauucaagaaugaaggugacccagaaggggcccuuugguag

SEQ ID NO: 21457 - RNA, 9879 nt, Artificial Sequence
  derived and/or modified CDS sequence (opt6) from DENV-1__EU660397__SS-prME
uccguaacaaugcuauuaaugcuaaugccaacagcacuagcuuuccaccuaacuacuagggguggggaaccucacaugauagucucaaaacaagaacggggaaaaagccuuuuauuuaaaacaucugcaggaguaaauauguguacuuuaaucgcaauggaccucggcgagcuaugcgaagacacaaugacguauaaauguccacgaaucacggaaacagaaccggacgacguagacugcugguguaacgccacugacacauggguaacguaugguacuugcucgcaaacaggcgaacaccggagagacaaacgauccguugcucuagcuccacacgugggacuaggguuagagacacgaacagaaacuuggaugucaucugaaggagcauggaaacaaauccaaagaguugaaacaugggccuugcgccauccagguuuuaccguaauugcauuguuuuuggcacacgcaauagggacaaguaucacacaaaaagguauaauuuucauauuauuaauguuaguaacuccuucaauggcuaugagguguguagguauagguucacgcgauuuuguagaagggcuaucgggugcuacauggguagauguagucuuagaacauggauccugcgucacaacuauggcgaaagacaaaccaacgcucgauauugaacugcugaaaacggagguaaccaaccccgcaguucuaagaaaacucugcauagaggcuaaaauaagcaacacuacuacugauucacgguguccuacacaaggcgaggcgaccuuaguagaagaacaagaugcuaauuucguaugucguagaacuuucguugaccgagguuggggcaauggcugcggccuuuucggaaaaggaaguuuaaucacaugcgcaaaauuuaaauguguuacaaaacucgaaggaaagauaguacaauaugaaaauuugaaauacucggucaucguaacuguacacacuggagaucaacaucaagucgguaacgaaucaaccgaacacggcacuacugcaacgauaacaccacaagccccuacaacagagauacaacucacggacuacggagcauugacgcuugauuguaguccuagaacuggucuugauuuuaacgaaaugguauuacuaacaaugaaggagaagucaugguuaguucauaagcaaugguuuuuagaucuaccguuaccguggaccagcggagcaucaacaucccaagaaacuuggaaccgccaggauuuacuuguaacauuuaaaacagcacaugcgaagaaacaggagguugucguacucgguucacaagaaggggccaugcacacugcuuuaacuggagcgacagaaauccaaacaagugggacgacuacuauauuugccgggcaucuuaaaugucgucugaaaauggacaaguuaacacuccgaggaaugucauauguaauguguacagggucauuuaaguuagagaaggaagucgcagaaacucaacauggcacaguccucguacaaauaaaauacgaaggaacggacgcgccaugcaaaauuccuuuuucuacucaagaugaaaaaggggugacucaaaauggucgucuaaucacagcuaacccuauagugacagauaaggaaaaaccaguaaauauugaagcagaaccuccuuuuggagagaguuacauaguuauuggggcaggggaaaaagccuugaaacucuccugguuuaagaaagguucuucgauuggaaaaauguuugaagcaaccgcuagaggagcaagaagaauggcaaucuuaggagacacggcaugggacuucgggucaauagguggcguguucacuagcguagguaaacuuguacaccaaauauuuggaaccgcguauggcguacuguuuaguggaguaucuuggaccaugaaaauuggaauuggaguauuacuuacaugguuaggacuaaauucaagguccacaucacuaucaaugacguguauagcgguaggucucgucacucuuuauuugggaguuaugguccaagcagauucugguugugucauaaacuggaaaggaagggaauuaaaauguggcucugguauuuuuguaacaaaugaaguacauacauggacugagcaauauaaauuucaagcggauucaccuaaaagacuaagugccgcaauugggaaagcaugggaagaaggcguaugcgggauacguucagccacgaggcuagagaauauaauguggaaacagauaaguaacgaacuuaaccacauacuucuugaaaaugacaugaaauuuaccguaguugugggagacguugcagguauucucgcacaagguaagaaaaugauaagaccccaaccuauggaauauaaauauucauggaaaucauggggaaaagcuaaaauuauuggagccgacguccaaaacacaacauucauaauagacggaccaaauacaccagaauguccugaugaucagagagcuuggaauauuugggagguagaagauuacggcuuugggauauucaccacaaauauauggcuaaaacuuagggauaguuauacacaagucugugaucauaggcuuauguccgcagcgauuaaagauucaaaagccguucaugccgauauggguuauuggauagaaucagaaaagaacgaaacguggaaauuggcaagagcuucauucauugaaguaaaaacaugcauauggccuaaaagucacacucuauggagcaacggaguacuugaaucugaaaugauuauuccgaaaauauauggcggaccuaucucccaacacaauuacagaccggguuacuucacacaaacagcggguccuuggcauuuagggaaacuagaacuggauuucgacuuaugcgaaggaacuacuguaguaguugacgagcauuguggaaauaggggccccagccuuagaacuacgaccgucacuggcaagauuauacacgaauggugcugucguucgugcacuuuacccccucuaagguuccgaggagaggacggauguugguaugggauggagauuaggccaguaaaggagaaagaagaaaaucugguaaaaucaaugguuuccgccggcucaggagaaguagauaguuuuucacuuggguuauuauguauaaguauaaugaucgaagaggugaugagaucacgcuggucaaggaaaaugcuaaugacagggacguuagcuguuuucuuccuacuaauuaugggccaacuaacguggaaugaucuuauacgauuauguauaaugguaggagccaaugccagcgaccgaauggguaugggaacuacauacuuagcacuaauggcgacuuucaaaaugcgaccgauguucgcugucggacuguuauucaggagauuaacuagccgagaaguauugcuacuaacgaucggguugagcuugguugccagugucgaauuaccuaauucuuuagaagaacuaggagauggccuagcaauggguaucaugauauuaaaauuauugacagacuuucagagucaccaauugugggcuacacugcugucauuaacauucauuaaaacgacuuucagucuacacuaugcauggaaaacgauggcuaugguccuuucaauuguaucauuauuuccucuuugucuuuccacaacgucucagaaaacuacaugguugccaguauuacuaggaagccuugguuguaaaccacuaacaauguucuugauagcugaaaacaaaauauggggaagaagaaguuggcccuuaaacgaaggaauaauggcagugggaauaguuagcauacuguugagcucauuacuuaaaaacgauguuccucuagcuggaccccuaauugccgguggaaugcuaauagcguguuauguaauaucggggucuagcgccgaccuaucgcuagaaaaagcagcugaaguaaguugggaagaagaagcugaacauagcggggcuucacauaauauauugguggaaguacaagaugacggaaccaugaaaauaaaagacgaagaacgugaugauacucuuacgauauugcuuaaggcaacucuacuugccgucucugggguauacccacucucaauaccagcuacuuuauuugugugguauuucuggcagaagaagaaacaacguaguggaguauuaugggauacccccagcccaccagaagucgaaagagcuguucucgacgacgggauauauagaauaaugcaaagaggccuuuuggggagaucgcaaguaggaguugguguuuuccaagagaacguguuucacacaauguggcauguaacuagaggagcuguauuaauguaccagggaaaaagguuagagccuucaugggccucuguuaagaaagauuugauaucuuauggaggcgguuggcgacuucaagggaguuggaauacuggggaggaagugcaaguuauugcaguagagcccggaaagaaucccaaaaauguacaaacagcgccaggaacauuuaaaaccccagaaggagaaguaggagccaucgcauuagauuucaagccugguacaagcgggagcccuauaguaaacagagaaggaaaaauaguuggauuauacgggaauggaguaguaacaacaucaggaaccuauguuucugcuauagcccaagcaaaggcaucacaagagggaccauuaccagaaauugaggacgaaguguuuagaaagagaaaccuaaccauuauggauuuacaucccggaucgggcaaaacccgaagauaccuaccagcgauaguaagagaagcgaucaaaaggaaacuacgaacccuaauuuuagcgcccacacguguaguggcuucugaaauggccgaagcucuaaaaggcaugccgauaagauaccaaacuaccgcuguuaaaagcgaacacaccgguaaggagauuguagauuuaaugugucaugcaaccuucacaaugagguuauugaguccuguaagaguucccaauuauaacaugaucauaauggacgaagcgcauuuuaccgauccgaguucaauugcggcucgugguuacauaaguacgcgagucggaaugggugaagcagccgcgauauucaugacagccaccccaccggguuccguagaagcauuuccacaaucuaacgcggugauucaggaugaagaaagagauauaccagaaaggagcuggaauaguggauaugaauggauaacugacuuuccaggaaaaacaguuugguucgucccuuccauaaaaucuggaaaugauauugcaaacugcuuacgaaagaaugggaagcgagucauccaguugucccgcaagacguuugauacagaauaccagaaaacgaaaaauaaugacugggauuauguuguuaccacagauauauccgaaaugggcgcuaauuuuagagcugacaggguaaucgacccccgaagguguuugaaacccguuauauuaaaagauggcccugaacgugucaucuuagcuggacccaugccagucacuguugcaucagcugcucaacgucgcggacgcauuggccgaaaucacaacaaggaaggagaccaauauaucuauaugggacagccuuuaaauaacgaugaagaucaugcacauuggaccgaagcgaaaaugcuacuggacaacauaaauaccccagaggguaucauuccagcgcuuuucgagccggaaagggaaaaaucggcagcaauagauggagaauauagacuaaggggcgaagcaagaaagaccuucgucgagcuaaugcgaagaggagaucuucccguauggcuuaguuauaaaguagccucugagggcuuucaguauucugaucgaagauggugcuucgacggcgaaagaaacaaucaagugcuugaggaaaacauggauguugaaauauggacgaaggagggcgaaagaaagaaacuacgaccucgguggcucgaugcaagaaccuacagugacccgcuagccuuacgcgaauuuaaagaauuugcagcugggagacgaucuguuucgggagauuugauacuagaaauagguaaacuuccucaacacuuaacacaaagagcgcaaaacgcacuagauaaucuaguuaugcuccauaacucagaacaagguggcagagcuuacagacacgcuauggaagaacuaccggauacuauagaaacguuaauguuauuggcucuaauagcaguccugacuggaggugugacacuauucuuucucagcggucgcgggcucgggaagaccucaauaggcuugcuaugcguaauggccucauccguacuacuauggauggcaaguguagaaccacauuggaucgcagcuucaauaauucuagaguucuuucucauggugcucuuaauaccugaaccagaucgacaacgcacuccacaggauaaucaauuagcuuauguugucauaggacugcuauuuaugauauuaacaguugcggcuaaugagaugggguugcuggaaacaaccaagaaagaucuugggauaggucacguagcgguagaaaaucaucaucaugccgcaaugcuagauguagaccuucauccugcgagcgcguggacguuauaugcaguggcaaccaccauuauaacaccuaugaugagacauacaauagagaacaccacagcgaacauuaguuuaacagcgauugcaaaucaagcagcaaucuuaaugggccuagauaaaggguggccgauaucaaaaauggacauuggaguacccuuguuagcgcuggguuguuauucacaaguaaauccacugacucuaacggcagccguucuaaugcuaguggcucacuacgcaaucauuggaccgggauuacaggcaaaagcaacacgagaagcgcaaaaacgaacagcugcaggaauaaugaaaaauccgacuguagauggaauaguagcuauugaccucgauccagucguuuaugaugccaaauuugaaaaacaauuagggcaaauuaugcucuuaauauuauguacgucucaaauuuuguugaugcgaacaacaugggcuuuaugcgagucaaucacacucgcuacagggccccugaccacguuaugggaaggaagcccggguaaauucuggaacacgacuauugcuguauccauggcaaacaucuuucgaggcucguauuuggcaggagcagguuuagccuuuucuuuaaugaaaucccuugggggaggacgacguggcaccggugcucagggagagacccugggagaaaaauggaagagacagcuuaaucaauuaaguaaguccgaguucaacacguauaagcguucgggcauuauggagguggaccgaucugaggcaaaagaaggcuuaaaacgaggagaaacuacgaaacacgccgugagucgaggaacagccaaauuacguugguuuguugaacgcaaucuaguaaaacccgaagguaaagucaucgacuuaggaugcgggcguggugguuggaguuauuauugugcugggcucaagaaagucacagaagugaaaggauauacaaaaggagguccaggacacgaagaaccuaucccuauggcuacauauggauggaacuuaguuaaacuacauucugguaaagauguauucuuuauucccccugaaaaaugugauacacuccucugugacauaggugagucgagcccaaauccaacgauugaagagggaagaacacuaagaguacuuaagaugguagagccuuggcuucgaggcaaucaauuuuguaucaaaauucuaaacccauacaugcccucagugguagaaacucuagaacaaaugcagaggaagcacggaggcauguuagugaggaacccguuaucuagaaacuccacgcacgagauguauuggguaaguugcggaacggguaauaucgucagugcgguaaacaugacaagucgaaugcuuuuaaaucgauuuacuauggcccacagaaaaccaacauaugaaagagaugucgauuuaggcgcugguacccggcacgucgcaguggagccugaaguagcaaaucucgacauaauuggacaacgaauagaaaacauaaaacacgaacacaaaucgacuuggcauuaugaugaagauaacccguauaaaacaugggcauaucaugguaguuaugaagucaaacccuccgguucugcaucaucuaugguaaaugggguuguaaagcuacuaacuaaaccaugggacguuauccccaugguuacacaaauagcgaugacugauacaaccccuuuuggacaacagcgaguuuuuaaagaaaaaguagacacaagaaccccuaaagcaaaaagaggaacggcucaaauaauggagguaacagcaaagugguuauggggauuuuuaucuagaaauaagaaaccacgaauauguacacgugaggaauuuacacguaagguaaggucgaaugccgcaaucggagcgguuuuuguugacgaaaaccaauggaacucagcaaaagaggccgucgaggaugaacgauuuugggacuuaguucauagagaacgggaguuacauaaacaaggaaagugcgcaacaugugucuauaauaugauggguaagcgggagaagaaacuuggagaguucggaaaagcaaaaggaucaagagcuauaugguacaugugguuaggugccagauuucuugaguuugaggcucuaggauuuaugaaugaagaucacugguucucccgcgaaaauucacuaagcgggguggaaggagaagggcuccacaaacuaggcuacauuuuaagggacauuucgaagauucccggaggaaacauguaugccgaugacacagccgguugggauacuagaauaacagaagaugaucuccaaaaugaagcuaggauaacugacauaauggaaccggaacaugcacuauuagccaaaaguauuuuuaaacuaacauaucaaaauaaagugguacgcguucaaagacccgccaaaaauggaacagucauggacguaauuucaagaagagaucaacgagguagcggacaaguugguacguaugguuuaaauaccuucacaaacauggaagcacaauuaaucagacaaauggaaagugaggguaucuuuucaccaucagaauuagaaacaccuaaccuagcagaacguguauuggacugguuggaaaaauacggaguugaaagacuaaaacgaauggccauuagcggcgacgauugcgugguuaaaccaauugaugaccguuucgccacugcauuaacugcuuugaaugauaugggaaaagugagaaaagacauaccacagugggagccgucaaagggcuggaaugauuggcaacaaguaccauuuugcagucaccauuuucaccaauuaauuaugaaggacggaagggaaaucguagucccaugcagaaaccaggacgagcuaguuggucgagcuagaguaucacagggugccggauggucauugcgagagacugcauguuuaggaaaaagcuaugcccaaauguggcaacuaauguacuuccaucgaagggauuuacgacuugcagcaaaugcaauauguagugcuguuccuguugauuggauaccuacaagccgcacaaccuggaguauccaugcacaucaucaguggaugacaaccgaagacauguuaucaguguggaauagagucuggauugaggaaaacccauggauggaggacaaaacccauauaagcucuuggggagacgucccuuaccuaggaaaaagggaagaucaauggugcgggucuuuaauuggacuuacagcccgagcgacuugggcaacgaauauacagguagcuauuaaucaggugaggagguuaauagguaaugaaaacuaccuugacuauaugacuucaaugaaacguuuuaaaaaugaaucagauccagaaggugccuugugguaa

SEQ ID NO: 21458 - RNA, 9879 nt, Artificial Sequence
  derived and/or modified CDS sequence (opt6) from DENV-1__EU687247__SS-prME
aguguaacaauguuacuaauguuaaugccgacagcccuugcauuccauuugaccacaagggguggagaaccccacaugaucguauccaaacaagaacggggaaaaagucuauuguucaaaacaucugcuggaguaaauaugugcacauugauagcaauggacuuaggggaauuuugcgaagauacuaugacuuauaaauguccgaggauaacagaagccgagccagaugacguagauugcugguguaaugcaaccgauacauggguaaccuauggaacauguagucaaacaggagagcaucguagagauaaacguucuguugcuuuagcuccacacgucggacugggacuagaaacucgaacugagacauggaugaguagugaaggagcuuggaaacagauacaacgaguagaaacgugggcccuacgacaccccggauucacgguaauagcgcuguuuuuggcccaugcuauagguacaagcauaacucaaaaagggauuauuuuuauacuacuaaugcugguuacaccuaguauggcgaugcguuguguuggaauaggcuccagggauuuuguugagggccuaagcggcgcaacuuggguggacgugguauuagaacauggaucaugcguuacuacuauggcaaaagauaaaccaacguuagauauagaacuauuaaaaaccgaggugaccaauccagcaguuuuaagaaaauuaugcaucgaagcgaaaauaucuaacacaacaacagacaguagauguccuacgcaaggcgaagcuacucucguagaagaacaagacgcuaauuucgucuguagaagaacuuuuguagauagaggcuggggaaaugggugcgggcuuuucggaaaaggcagcuuaauuacgugcgcaaaauucaaauguguaacuaaacucgaaggaaaaauuguucaauaugagaaucuaaaguauuccguuauaguuacugugcauaccggagaccaacaccaaguggguaacgagucgaccgaacauggaacaacggcuacuauaacaccacaagcgcccucaacggagauacaacugacugauuauggagcacuuacucuugacuguuccccuagaacgggccuagacuucaaugaaaugguguuacuaacaaugaaagaaaaauccugguuaguccauaaacagugguuuuuagaccucccauugccuuggacaucaggugcuucaacaagccaagagaccuggaaucgacaagaccuauuaguaacuuuuaaaacagcccaugccaagaaacaggaagucguuguccuaggaagucaagaaggugcaaugcacacugcacugacaggagcaacggagauacagacaagcggaacuacaacgauauuugcaggacaucuuaaaugcagacuaaaaauggacaaguugaccuugaaagguaugucauauguaauguguacuggcagcuuuaaauuagaaaaagaaguagccgaaacacaacauggcacuguucucguccaaauaaaguacgaaggaacagacgcgccauguaagauaccauucucaacgcaggaugagaagggggugacucaaaacggacgccuaauaacugcgaaucccauuguuacagauaaggaaaagccaguuaacauugaagcagaaccaccuuucggggaaaguuauauugucaucggagcuggggagaaagcauugaaauuauccugguucaagaaaggaaguucgaucgguaaaauguucgaggcgacagcacgaggagcaaggaggauggcaaucuuaggagacacagcuugggauuucggcucaauuggaggaguauuuacuucugucggaaaauuaguacaucaaauuuuuggcacugcauacggcguucuguucucagggguuagcuggacaaugaagauuggcaucggaguccuauuaacauggcuagggcuaaacucaagaagcacaaguuuaaguaugaccuguauagcuguggggcuuguaacauuauaccuggguguuaugguucaggcagauucaggcugcguuaucaauuggaaaggucgcgaacucaaaugcggaucuggaaucuuugugacuaaugaaguucacacauggacagagcaauauaaauuucaagcugacucucccaaacguuuaucagcagcaauuggaaaggcuugggaagaaggcguaugcggaauaaggucagcuaccagauuagagaacauaauguggaaacaaaucucgaacgaauuaaaucacauacuauuagaaaaugauaugaaacuaacugucguaguuggagacguagcuggcauucuggcacaaggcaagaaaaugauaaggccucaacccauggaauauaaauauagcuggaaaauaugggguaaagcgaaaauaauuggugccgaugugcagaacacuacuuucauaauugacggaccaaauacaccagaaugcccugacgaccaaagggcauggaacauuugggaaguagaagauuacggauucgggauuuuuacgacgaauauaugguuaaaacuuagggacagcuacacacaaguaugugaucauagacugaugucagcagcuauaaaagauaguaaagcaguucacgcggacaugggcuacuggauagagucugaaaagaaugaaacuuggaagcuagccagagccaguuuuauagaaguuaaaacauguauuuggccuaaaagccauacucucuggucaaauggaguauuagaaucagaaaugauaauaccgaaaaucuacggaggaccgauaagccagcacaauuacaggccuggcuacuucacccaaaccgcagguccuuggcaucuugguaaguuagaacuagauuuugaucuaugugaaggaacgaccguaguuguagacgaacauugcggaaaucguggaccuagucuaaggacuacaacggucacugguaagauaauacacgaaugguguugccgaucauguacacuaccgcccuuacgguuuaaaggggaagaugguuguugguauggaauggaaauaaggccagugaaagaaaaggaggaaaauuuggucaagagcaugguaucagcuggaaguggcgaaguagacaguuuuagccugggucugcuuuguauuucaauaaugauagaagaaguaaugcggagucgauggagucgcaaaauguugaugacaggaacauuagcaguguuuuucuuacuaaucaugggacaacucaccuggaaugaccuaauaagauuaugcauaaugguaggcgcuaacgcuagugaucgaaugggcaugggaacgaccuacuuagcacuuauggcuacauuuaagaugaggccaauguucgcggucggcuuguuguuucgaagguuaacaucaagggagguccuucuucuuacaauuggacucagcuugguagcgaguguagaguuaccaaauucuuuagaagaacucggcgaugguuuagcgaugggcauuaugauacuuaaauuguuaacggacuuucaaucacaccaacucugggcgacucuacucucacugacuuuuauccgcacgacauucagccuacauuaugcauggaagacuauggcaaugguacuguccaucgugucuuuguuuccacuuugucuuaguaccaccagucagaagacgacaugguuacccgugcuacuugguucauuaggauguaagccgcuuaccauguuuuuaauagcugagaacaaaauauggggaaggaaaagcuggccguugaacgagggaauaauggcugucggaaucgucaguauacuauuguccaguuuauugaaaaaugacgucccacuagcaggucccuuaauugccgguggaaugcuaauagccuguuacguuauaagcggcaguuccgcggaucugagcuuagagaaggccgccgagguaucuugggaggaagaagcugaacauaguggugcaucacauaauauacucguagaaguacaggacgacgguacuaugaaaaucaaggaugaagaacgugaugauacacuaacgauauuauuaaaggcaacacuguuagcaguaagugguguuuauccccucucuauaccugcaacauuauuuguuugguauuucuggcaaaagaagaaacaaagaucaggagucuugugggauaccccaaguccaccggagguugaacgagcaguacucgacgacgguaucuaccguauuaugcaacgagguuugcuaggcagaucacaagugggcguaggugucuuucaagaaaauguuuuucacacuauguggcauguuacaagaggugcaguguuaauguaucaaggcaagagauuagagccuucaugggcuuccgucaagaaagaucuaaucagcuacggaggggguuggaggcuacaaggauccuggaauacgggagaggagguacaaguaauagccguagaaccuggcaagaauccgaaaaauguacaaaccgcuccagggaccuucaaaacgagugagggagaaguuggagcaauugcauuggauuucaaaccaggcacuucuggaucucccaucguaaaucgagaaggcaaaaucguaggguuauacgguaacgguguaguaacuacauccggcacauauguaucugcaauugcacaggcuaaagcaucacaggaagguccacuuccagaaauagaagaugaaguuuuuagaaaaagaaaucuuacgauuauggauuuacauccuggaucagguaaaacaaggagguauuuaccggcuauuguuagggaagcaauaaaacguagacuucgaacucuaauacuagccccgacuaggguuguagcaucagaaauggcugaagcccuuaaaggcaugcccauacguuaucaaaccacagcugucaagucagaacauacuggaaaggaaauuguggauuugaugugccaugcuacguuuacaaugcgauuauugagcccagucagaguaccuaacuacaauaugauaauuauggaugaggcucauuucacagauccgagcagcauagccgcaagggguuacauauccacgcgaguugguaugggcgaagccgccgcaauauucaugacagcgacaccaccgggcagcguugaagcauucccccaaucaaaugcagugauacaagaugaggagcgagacauaccugagaggaguuggaacucagguuaugaguggauuacagacuuuccgggcaaaacaguaugguucguaccaucuauuaaaucagggaaugauauugcuaauugucuaaggaaaaauggaaaacgcguuauccaacuaucacgcaaaacauuugauaccgaguaucagaaaacuaaaaauaaugauugggauuacguaguaacuacugacaucucggaaaugggggccaacuucagagcagaccguguuauagacccaagaagguguuuaaagcccgugaucuuaaaagacgggccggagagaguaauuuuggcaggcccaaugccagucacaguggcauccgcggcccaaagaagaggaagaauaggaagaaaucauaacaaagaaggagaucaauauauuuauaugggccaaccacuaaacaaugaugaagaucaugcccauuggaccgaagccaagaugcuacucgauaacaucaauacucccgaaggaauuauaccagcuuuauucgaaccagagcgugagaaauccgcagcgauagauggugaauacagauuaagaggagaagccagaaagaccuuuguggaacugaugcggagaggggaucuaccaguaugguuaucauacaaaguagcaucagagggauuucaguacucagauagacgcugguguuuugauggagaaagaaauaaucaaguccuugaagaaaauauggacguugaaauauggacaaaagaaggcgaaaggaagaaacugagaccucgaugguuggaugcuagaacauacuccgauccacuugcacugcgggaauuuaaagaauuugccgcugggcgacguuccguuaguggugauuuaauacuagaaauugggaaacuaccacaacacuuaacccagcgugcccagaaugcuuuggacaaccuugucauguugcacaauuccgaacaaggaggucgcgcauaucgucaugcaauggaagaauuaccugacacgaucgagaccuugaugcuccuagcucucaucgcaguacuaacugggggugucaccuuauuuuucuuaucuggacgaggacuagggaaaacaaguauagguuuacuaugcgucauggcgaguucaguauuguuguggauggccucaguagaaccucacuggauagcggccucuauaauacucgaguucuuuuuaaugguacuuuuaaucccugaaccagauaggcaaagaaccccacaagacaaccaguuagcuuauguaguaauugguuuauuguucaugauucuaacuguagcugcaaaugaaauggggcuacuagaaacgacuaagaaagaucuggggauaggacauguagcaguagaaaaucaccaucacgcagccaugcuggauguggaccuacacccagcuucggcuuggacacuuuaugcgguugcaacaacgauuauaaccccgaugaugcgccacacuauugaaaauaccacggcaaacauaucacuuacagcuauagcgaaccaagcugcuaucuuaaugggcuuagauaaaggauggccuauauccaaaauggauauugggguaccacuacuggcguugggaugcuauucccaaguaaacccacucacacucacugcugcaguucuaauguugguggcucacuacgcuaucauugggccugggcuccaggcaaaagcaacgcgggaagcacagaaaagaacagccgcagguauaaugaaaaaucccacuguugaugggauugucgcuauugaucuugaccccguugucuaugacgcaaaauuugaaaaacaacuaggccaaauuauguuguugauucuauguacaucccagauacuuuuaaugcgaacuacaugggcccuaugugaauccauaacucuugcaaccggaccuuuaacaacauugugggaagggucaccaggaaaauucuggaacacgacaauagcuguuucuauggcgaauauuuuuagaggaaguuauuuagccggagcaggucuagcauuuucuuuaaugaaaucauuaggcgguggaagacgggggacaggagcgcaaggcgaaacucuaggagaaaaauggaaacgucaacuuaaucaacugaguaaguccgaauuuaacacuuacaaaagaucaggaauaauggaaguugacagaucagaagcgaaagaaggacuuaaacgaggggaaacgacuaaacacgcuguguccagagguaccgcuaagcugcgaugguucguagaaagaaauuugguaaaacccgaagggaagguaauagauuuaggaugcgggcgcggaggauggucauauuacugugcaggcuuaaagaaaguaacggaagugaaaggguacacuaaagggggucccgggcacgaagaaccgauaccaauggccacauauggauggaacuuaguuaaauuacacuccggaaaagacguauucuuuauaccgccagagaagugugacacuuugcugugcgauauuggagagucaucuccuaacccgacuauugaagagggaagaacacugagaguacuuaaaaugguggagccauggcugcgcggaaaucaauucugcaucaaaauacuaaaucccuacaugccaucagugguagaaacucuugagcaaaugcaaagaaaacauggcggaaugcuuguucggaauccauuguccagaaauucgacacacgaaauguauuggguaucauguggcacgggaaauauaguaucagcaguaaacaugaccaguagaauguuacuaaaccgcuucacuauggcacauaggaagcccacauacgaaagagaugucgacuuaggggcagguacgagacauguagcgguagaaccagaagucgcuaacuuagacauaauuggacaacgaauugaaaacauuaaacacgaacauaagaguacauggcauuaugacgaagacaaucccuauaaaacuugggcauaucacgguucauaugaaguuaagccaucagguagugcaucaaguaugguaaauggugugguuaaauuacuuacaaaaccuugggacgucauaccaaugguaacucaaauagccaugacggacacuacaccguuuggacaacaacguguuuucaaagaaaagguugauacuaggaccccaaaggccaaaagggguacagcccagaucauggaagugaccgcaaaguggcuuuggggauuuuuaucucgaaauaagaaaccaagaauuuguacaagagaggaguuuaccaggaaaguccgcaguaacgcugcgauaggugcaguauucguagacgaaaaucaauggaacucagcaaaggaagcaguagaggacgaacguuuuugggacuuaguacauagagaaagagaacuccauaagcaagggaaaugcgcaaccuguguguauaauaugauggguaaaagagagaagaaacuuggugaguucggaaaagcuaagggcucacgcgccaucugguauaugugguugggcgcaagauuucuagaauuugaagcacuaggauuuaugaacgaagaccacugguucaguagagaaaauucucuuucgggaguugagggcgaaggguugcauaaacuuggauauauuuugcgagacauaucaaaaauuccaggagguaauauguaugccgacgauacagcggguugggauaccagaaucacagaagaugaucugcaaaacgaggcuaaaauaaccgauauaauggaaccagaacaugcacuauuagccaaaaguaucuucaaacuaacuuaucaaaacaagguugucagaguucaaagacccgcgaaaaacgguacuguuauggauguuauuucaagacgagaucaaaggggcucaggacagguggggacguacgguuuaaacacuuucacuaauauggaagcccaauuaauucgacaaauggaauccgaagggauuuucuccccaucagaacuugaaacaccuaauuuggcaggaaggguauuaaacuggcuggagaagcauggaguagaaagacuuaaaaggauggcaaucaguggugacgauugcgugguuaaaccaauugaugacagauuugcaacugcgcuuacagcgcuaaacgacauggguaaaguuagaaaggacaucccccaaugggaaccaucaaagggauggaaugauuggcaacaggucccauucugcucccaucacuuccaccaacuaauuaugaaagacgggcgggaaauuguaguaccauguaggaaucaggacgagcuaguagguagagcacgaguuagccaaggagcaggcuggaguuugagagaaacagcaugccuagguaaauccuaugcacaaauguggcagcuaauguacuuucauagacgagacuuacgacuagcagcaaaugcuauuuguucugcuguccccguagauuggguaccaacaagcagaacaacauggucaauacaugcccaccaccaauggaugacaacggaagacauguuaucaguguggaauagagucuggauagaagaaaacccguggauggaagacaaaacacauguuucaucuuggggugauguaccauauuuagguaaacgagaagaucagugguguggaagccucauaggacuaaccgccagagcaacaugggccacuaacauacagguugccaucaaucaagugagaagacuuuugggcaacgaaaauuaccuugacuauaugacuucuaugaaacguuucaagaacgagucugacccagagggagcguugugguag

SEQ ID NO: 21459 - RNA, 9879 nt, Artificial Sequence
  derived and/or modified CDS sequence (opt6) from DENV-1__EU660412__SS-prME
agugugacuaugcuauuaaugcucaugccgacagcccuugcauuucaccuaacaacuaggggcggugaaccacacaugauaguuagcaaacaagaaagagguaaaucccugcuguuuaaaacaagugcuggggucaacauguguacguugauugcgauggauuuaggugaauuaugcgaagauaccaugacuuauaaaugcccgaggaucacagaagccgaaccugaugacgucgauuguuggugcaacgcuaccgacacuugggucacauacggcacguguagccaaacgggagaacaucgaagggauaaacguaguguagcauuagcaccucacguaggacugggauuagaaacacgaacggaaacguggaugucaucggaaggggcauggaaacaaauccagaggguggaaacaugggcacugcgacacccaggcuuuacaguaauagcacucuuuuuagcacacgccauuggaacaagcauuacucagaaaggaauaauauuuauacuauugaugcuagugacgccauccauggcgaugagguguguggggauugggucgagggacuuuguggaaggacuuucgggagccacauggguagauguaguccuagaacauggaucauguguaacaacaauggcuaaagacaaaccaacacuugauauugaacuacuaaaaacugaagugacaaauccugcaguccuacgaaaacucuguauugaagcgaaaaucagcaauacuacgaccgacucaagaugcccgacucagggagaagcaacucuaguggaagaacaggacgcuaacuucguuuguagacguacauuugucgauagaggguggggaaauggaugcggacuuuucgguaaaggaucacuaauuacaugugcaaaauuuaaauguguaacaaaacuggaagguaaaauaguacaauacgaaaauuugaaauauagcguuauugucacgguccacacaggagaccagcaucaaguaggaaacgaaaguaccgaacauggaacuacagcuacaaucacaccacaagcuccaaccacggaaauacaacucacugacuacggagccuugaccuuagacuguaguccacggacgggccuggacuuuaaugaaauggucuuauuaacuaugaaagaaaaaucaugguugguucauaaacagugguuucuugaucuaccauuaccuuggacgucaggugcuucuacuucgcaagaaacuuggaaccgacaagaccuucuaguaacguuuaaaacagcacacgcaaagaaacaagaagugguuguucuaggaucucaggagggagccaugcauacugcauuaacuggcgcuacagaaauacaaacuagcggcacaacaacuauauuugcggggcaccuaaagugccgauuaaagauggauaaacuuaccuuaaaagggauguccuacguuaugugcacaggaucauucaaacuagaaaaagaaguugccgaaacccaacacgguacaguauuaguucagauaaaauaugaaggaacagacgcaccuugcaaaauucccuuuaguacucaagaugaaaagggaguuacacaaaauggacguuuaauaacugcaaauccaauugugacugauaaagagaaacccgugaacauugaagcugaaccuccuuuuggagagaguuauauugugaucggggcuggagagaaagcucugaaguuaaguugguuuaagaaaggaucuucaauaggaaagauguucgaagcgacugcaagaggagcgcguaggauggcaaucuuaggagauacugccugggacuucggaucaauuggaggaguuuucacuucaguggguaaguuaguucaccagauauucggaacagcauacggugucuuguuuucuggcguaaguuggacaaugaagauagguauagguguacuguuaacauggcuaggguugaauaguagaagcacuagcuugucgaugacauguauagcugucggguuggucacucucuauuugggugucaugguucaagcagacagugguugugucauaaauuggaaaggaagagaauuaaaguguggaagugggauuuucguuacaaacgaaguucauaccuggacagaacaauauaaguuccaagcggauagucccaaaaggcuuuccgcggcaauugguaaggcaugggaagaaggaguaugugggauccgaucugcaacccgguuagaaaauauaauguggaaacaaaucaguaaugaacucaaccacauccuuuuggagaaugacaugaaacuaacaguagugguuggcgauguagcuggaauacugggacaggguaaaaagaugaucaggccgcaaccuauggaauauaaauacucauggaaaucuuggggcaaagcuaaaaucauuggagcagaugcccaaaauacaacuuuuauaauagacggaccgaacacaccagaauguccugacgaccagagagcauggaauauuugggaaguagaggacuaugguuuuggcaucuuuacaacaaauauauggcuaaaauuaagagauucguauacacaaguuugugaucaucgacucaugucagcggccaucaaagauucuaaagccguccacgcugauaugggguauuggauagaaucagagaaaaaugagaccuggaaacuagcuagggcuaguuuuaucgagguaaagacauguauauggcccaaaucccauacucucuggaguaaugguguuuuagaaagcgaaaugaucauuccaaagauuuauggcggacccauaucacaacauaacuaccguccuggauacuucacacagacagcugggccauggcacuuaggaaaacuugaauuagauuucgauuuaugugagggaacaacugucguaguugaugagcauugugguaauagaggcccaagucuaaggacaacuacugucacuggcaagauaauacaugaauggugcugucgaucauguacauuaccaccacuaagauuucgaggagaagauggauguugguauggaauggaaauaagaccaguaaaagagaaagaagaaaauuugguaaagaguaugguaucggcggggucgggggaaguagacucuuucagccuuggauuauuauguaucuccauuaugauagaggaaguaaugcggucuagauggagccggaaaaugcugaugacugggacucuugcgguauuuuuccuauuaauuaugggccagcucacauggaacgauuuaauccgacucugcaucaugguaggagcgaaugcaagcgaccgcauggggauggguacaaccuacuuagcgcuuauggcuacuuuuaaaaugaggccuauguuugcaguaggacuccuuuucaggcggcuaacuagccgggaaguucuauuauugacaauugguuuaagccuggucgcuucaguggaacuuccaaauagucuggaggaguugggugacggguuggcaauggguauaaugauauugaaacuguuaacugauuuucaaucccaccaacuaugggcgaccuuauuaucauuaacauucaucaaaaccacauuuucacuucacuaugcauggaaaacuauggcaaugguacugucaaucguaagucuuuucccuuuguguuuaagcacaaccucccagaaaacaacauggcuaccuguauuguuagggagucuagggugcaaaccucuuacaauguuucugauugcggaaaacaaaauuugggguagaaaaaguuggccuuuaaaugaagguauaauggcuguuggaauuguaucaauacuacucagcucgcuacugaaaaacgauguaccacuggcagguccucugaucgcaggggguaugcuaauugcuugcuauguaauaucaggaaguagcgccgauuugucauuagaaaaggcagcagaggucaguugggaggaagaagcugaacauucuggagcaagccacaauauuuugguagaaguacaagaugauggcacaaugaagaucaaagaugaggaacgugaugauacacucacaauauuguuaaaagcgacuuugcuagcgguauccggaguuuauccccuaagcauuccagccacuuuguuuguaugguauuuuuggcagaaaaagaaacaaagaucgggggucuugugggauaccccuuccccacccgagguugaacgcgcgguauuagaugacgguauauaccgaauuaugcagaggggucugcugggucgaagccaaguaggagugggaguuuuccaagaaaacguauuucacaccauguggcauguaacaagaggugcgguauuaauguaucaaggaaaaagacuagaacccucuugggcuagcgucaagaaagauuugaucagcuauggagguggcuggcgacuaagaggcagcuggaacacuggcgaagaaguccaaguaauugccguagaaccagguaaaaacccuaaaaauguacagacagcgccaggaacauucaaaacuccggagggagaaguuggugcaaucgcuuuagacuuuaaaccaggaacuucaggaucaccgauuguuaacagagaaggaaaaauaguaggccuguacggaaacggcguuguaacaacgucaggcacauauguuucagcuauugcucaagcaaaagcaucacaggaaggaccgcuaccggagauagaagaugaaguuuuucgaaaaagaaaccuaaccaucauggaucuacauccaggaucaggcaagacaagacgguauuugccugcuauuguaagggaagcuauaaaaagaaaacuaagaacuuuaauauuagcaccuaccagaguaguagcaagugaaauggcagaggcuuugaaagguaugcccauacgauaucagacaacggcggugaaaagugaacauacggguaaagaaauaguagaucuuaugugccaugcaacuuuuacaaugagauuacuaagcccggugaggguaccgaauuauaauaugauuauaauggaugaagcucauuuuacugauccaaguucaauagcggccagagguuacauaucaacacggguaggaaugggcgaagccgcagccaucuucaugacagcuaccccaccagguaguguagaggcguuuccacaaagcaacgcaguaauccaagaugaggagcgagauauuccugaacgaaguuggaacagugguuaugaauggaucaccgacuuucccggaaagacaguuugguuuguuccuagcauaaagaguggaaacgauauugcaaauuguuuaaggaaaaauggaaaacggguuauacaacugucaagaaaaacauuugauacugaauaccagaagacgaaaaauaaugacugggacuacguaguuacaaccgauauaucugagaugggcgcaaauuuccgcgcggacagaguaauagacccuagaagaugcuugaaaccaguaauauuaaaagacggaccagaaaggguaauauuggcgggaccgaugccuguuaccguagcgagugcagcgcagcggagggggagaauuggacgaaaccauaauaaagaaggggaucaauauauauauaugggacaacccuuaaauaacgacgaagaucaugcacacuggacagaagcaaagaugcuuuuagauaauauaaacacaccggaagguaucauaccggcacucuucgagccugaacgugagaaaucggcagccgucgacggugaauauagguugaggggugaggcaagaaaaacauuuguagaacuaaugcgacgaggggacuuacccguauggcuuucuuacaaaguugcaucugagggcuuccaauacucggauagaaggugguguuucgauggagaaagaaauaaucaaguguuagaagaaaauauggacguugaaauuuggaccaaagaaggagaacgcaagaaauuacgcccacgauggcuugaugcccgaacauauagugaucccuuggcucuccgcgaguucaaagaguuugcagcagggcgcagguccgucucuggagaucucauucuagaaauagguaaacucccccaacacuuaacacagagagcucaaaacgcgcuagauaaucuuguaaugcugcacaauagugaacaaggaggaagggcuuaccgucaugcaauggaggaauuaccggacacgaucgagacgcugaugcuguuagcauuaauagcggugcucacugggggagucacauuguuuuuccucaguggaaggggcuuagguaagaccaguauugggcuauuauguguuauggcaucaagcgugcuuuuguggauggcaagcguagaaccacauuggauugccgcguccauaauauuagaauuuuuccuuaugguauuacucaucccagaaccagacaggcaaaggacaccucaggauaaucaacucgcguacguagucauaggauuguuguuuaugauacuuacuguagcagcaaacgaaaugggacugcuagagacgaccaagaaagacuugggaauaggucauguugcagucgagaaucaccaucaugcagcuauguuagacguggauuuacacccggccucagcauggacacuuuaugccguugcuaccacuaucauuacacccaugaugagacacacgauugagaacacaacagcgaacauuucguuaaccgcuauugcaaaccaagcagcuauauuaaugggacuagacaaaggcuggccaauaucuaagauggacauaggcgugccucuccuugcauugggauguuauucccagguuaacccacugacucuaacagcugcgguacuuaugcuaguagcacauuaugcaauuauuggaccgggacuacaggcgaaagcaaccagagaagcccaaaaacgcacagcugcugguauuaugaaaaauccgacaguagacggaauuguagcaauagaucuugacccaguuguguaugaugcaaaauuugaaaaacaauugggacaaauaaugcuuuugauuuuauguacgucacaaauucuauuaaugcguacgacuugggcccuuugcgaaaguauuacacuagcuaccggaccacuuacaacccuaugggaaggaaguccagguaaauuuuggaauaccaccauagcgguaucaauggcaaacaucuuuagagggucuuacuuagccggugcaggccuagcauuuaguuuaaugaagucguuagguggaggaagaagagggacgggagcgcaaggggaaacacugggggagaaauggaaacggcaacuuaaccaacuaagcaaaagugaguucaauacauauaaacgaagcgguaucauggagguagaucgaagcgaagcaaaggagggucucaaaaggggagaaacgaccaaacacgcagugucgagaggaacagcaaaauuaaggugguucguagagagaaaucuggugaagcccgaaggaaaagucaucgaucuugguugcgguagaggggguuggucuuauuacugugccggacuaaagaaagucacagaaguuaaaggauacaccaaaggcggaccuggacaugaagaaccaauccccauggcaacauacggguggaauuuaguuaaauuacauuccgguaaagauguuuucuuuauuccaccugaaaaaugugauacucuauugugugauauaggagaaaguucuccgaacccaaccaucgaagaggggagaacacuaagagucuuaaaaaugguagaacccuggcuacggggaaaccaauucugcauaaagauauuaaacccguauaugcccaguguagucgaggcuuuagagcaaaugcagcgaaagcauggaggaauguuagugcgaaauccgcuaucaagaaacaguacacacgaaauguacuggguuucauguggaacagggaauauaguaagcgcgguaaauaugaccagcagaaugcuguuaaaucgcuuuacaauggcgcaucggaaaccaacauacgaaagagacguagauuuagggacaggcacaagacauguugccguugaaccugaaguagcaaaccucgauauuauaggacaacgaauagaaaauauaaaacaugaacauaaaaguacuuggcacuaugaugaagauaacccauauaaaaccugggccuaucaugguaguuaugagguaaaaccuucugguucugcgucgaguauggugaauggaguggugaaauuguugacuaagccuugggauguuaucccuauggugacgcagauugcaaugacugauacgacaccguuuggacagcaaagaguauucaaagaaaaaguggauacacguacaccgaaggcgaaaagaggcacagcccagauuauggaaguuaccgcuaggugguuauggggguucuuaagcaggaauaagaaaccacgaaucuguacuagggaagaguucacaagaaaaguaagaucuaacgcggcaauaggcgcagucuuugucgaugaaaaucaguggaacagcgccaaagaggcggucgaagacgagcgauuuugggaccucguacauagagaaagagaacuacacaaacaagguaagugugcgacaugcguauacaauaugaugggcaagagggagaagaaauugggggaauuuggaaaagcaaagggaucgagggcaauuugguacauguggcuaggagccagauuuuuagaauuugaagcauuaggauucaugaacgaggaucauugguuuuccagggaaaacucuuugucuggcguugaaggggaaggccuacauaaacucggcuacauacugagggauauaaguaaaauccccggcggaaauauguaugcagaugauaccgcagguugggauacucgaauaacugaggacgaucuucaaaacgaagcaaaaauaacagauauaauggaaccugaacaugcauuguuagcgaaagcaauuuucaaauugacuuaucaaaauaaaguaguucguguacagagaccagcgaagaauggcacaguuauggacgucauaucucgcagagaccaaagaggcagcgggcaagucggaacauacggccuaaauacuuucacgaauauggaagcucaacucauucgacaaauggagagcgaggguauauuuaguccaucggaguuagagacaccuaaucuggcugaacgggcgcucgacugguuagaaaaauauggcgucgaaagauuaaagaggauggccauaucgggcgaugauuguguugugaaaccaaucgaugauagauuugcaaccgcgcucacagcacuaaaugauaugggaaaaguucgaaaggauauaccacaaugggaaccaucaaagggauggaacgacuggcaacaagugccauucugcucacaucacuuucaccaacucauaaugaaggauggaagggagauuguagucccuugucgaaaccaagaugagcuaguaggccgugcccgaguuagucaaggagcaggauggucgcuacgggaaacagcuuguuuggggaaguccuacgcacaaauguggcaguuaauguacuuucaccgucgagaucugcgucuugcugcuaaugcuaucuguagugcggugccaguagauuggguacccacaucacgaacgacauggucaauccaugcacaucaucaauggaugacuacagaagacauguuaagcguauggaaccggguauggaucgaagaaaauccuuggauggaagacaaaacacauauaucaaguugggaagauguucccuauuuggggaaacgugaggaucagugguguggaucacuaauaggguuaacugcacgugcaacaugggccaccaauauacaaguagcgauaaaucaaguaaggcgccugauuggcaacgaaaacuacuuagauuacaugaucucuaugaaaagauucaaaaaugagagugacccagaaggcgcacuuugguaa

SEQ ID NO: 21460 - RNA, 9879 nt, Artificial Sequence
  derived and/or modified CDS sequence (opt6) from DENV-1__EU660418__SS-prME
agugucaccaugcuucuaauguuaaugcccacugcucuugcauuccaccuaacgacuagagguggggaaccacauaugauaguaagcaaacaagaaagagggaaaucuuuacuauucaaaacgagcgcaggagucaacaugugcacucuaaucgcaauggacuuaggagaacuaugugaagacacuaugaccuauaaaugucccagaauaacugaaacagaaccugaugaugucgacuguugguguaaugcgacagauacguggguaaccuacggaacguguucucaaacaggugagcauagaagagauaaacgaucaguggcauuagccccgcauguuggauuagggcucgaaacaagaaccgaaacauggauguccuccgaaggagcguggaaacaaauacaacguguagaaaccugggcacugagacaucccggauuuacuguaauagcguuauuuuuagcccacgcaauaggaacuucaaucacgcagaaaggaauaauauucauucuacuuauguuaguaacaccaucgauggcaaugagaugcguagggauaggauccagagacuuuguagaaggguuaucuggugccacauggguugacguaguccucgaacaugguagcugcgugacgacuauggcuaaagacaaaccaacacuagacaucgaacuauugaaaacugaagugacuaacccagccguuuuacgaaaauuauguauagaagcaaaaauaucaaauacaacaacagacagcagauguccaacacaaggggaagcaacccuggucgaagaacaagaugcuaacuuuguuugucgaagaacauucguggaccgaggaugggguaauggaugcggacucuuugggaaaggaucacuuauaacaugugcaaaauucaagugcguuacaaaacuugaaggcaagauaguacaauaugaaaauuuaaaauauucgguaaucguuaccguucauacuggugaucaacaucaagucgggaaugaaucaacagaacauggcaccacagcuacgauaacgccucaagcacccaccacagaaauccaguuaaccgauuauggagcacucacucuugacuguucgccacgaacuggauuggauuucaacgaaaugguuuuauugacaaugaaggagaaaagcugguugguacauaaacaaugguuuuuggacuugccauuacccuggacgucaggagcgucuacaucacaagaaacuuggaauaggcaagaucuauuaguaacuuuuaagacagcacaugccaagaaacaagaagucgucguauuagguucucaagaaggcgccaugcacacagcauugacuggagcaacggaaauacaaacgaguggaacaacaacgauuuucgcugggcacuuaaaguguagacuuaagauggacaaacugacauugaaaggaauguccuacguaauguguaccgguucauuuaaacuagaaaaagagguagcagaaacacaacaugguacuguccuagugcaaauuaaauaugaagguacagacgcaccaugcaaaaucccauuuucgacucaagacgagaaaggaguaacacaaaacggaagguuaauaacagcgaauccgaucgucacagauaaggaaaaacccgugaauauagaagcugaacccccauuuggagaaaguuauauaguuauuggggcgggcgaaaaggcuuuaaaacucucuugguucaaaaagggauccagcauaggaaaaauguuugaagcaacugcccgaggcgcaagacgaauggcaauucugggugacaccgcuugggauuucggcaguauaggagguguauucacaucagucggaaaauugguucaccaaauauuuggaaccgcauaugguguuuuauucagcggaguaaguuggacgaugaagauaggaauaggaguauuacugaccuggcugggucuaaauucaaggucuacuucucuuucuaugacauguauugcagugggauugguuacucuuuaccucgggguaaugguacaagcggauagcgguuguguuauaaauuggaaaggcagagaauuaaaaugcggaucgggaauauucgucacaaacgaaguacauacuuggacagaacaguacaaauuucaagcugacaguccuaaaagauugagugcagcaauuggaaaagccugggaagaagguguuugugggauuagaagcgcuacgcgccuagaaaacaucauguggaaacaaauaaguaaugaauuaaaccauauacuauuagagaaugacaugaaauucacuguaguaguaggagauguggcuggcauuuuggcccaaggcaagaaaaugauccgaccucaaccgauggaauauaaauacagcuggaaaucgugggguaaagccaagauaauaggggcagacgugcaaaauacaacauuuauuauagaugguccaaacacuccagaauguccggacgaccagagagcuuggaauauaugggaaguagaagacuacggauucggaaucuuuacaaccaacauaugguuaaaacuuagagacucauauacacaaguaugcgaucacagacuuaugucugcggcuauuaaagauucaaaagcaguucacgcugauaugggauauuggauagaaucugaaaagaacgaaaccuggaaauuagcucgugccagcuuuauagaaguaaaaacauguaucuggccuaaaagucauacauuauggaguaauggcguauuagaaagugagaugauaaucccaaaaauuuacgggggacccauuucgcaacacaauuacaggccuggauacuucacccaaaccgcagguccguggcacuuaggaaaguuagaauuagauuucgaucuaugugaggggacaacaguaguaguagaugaacauuguggaaacaggggaccaucauuaaggacaacaacgguuaccgguaaaauaauacaugagugguguugucgaucuuguacacuaccaccucuccgguuucgaggagaggauggaugcugguacgggauggaaauuagaccuguaaaggagaaagaagaaaacuuagugaaauccaugguaagugcagggaguggagaaguugauaguuuuucauuaggccuccucugcauauccauaaugaucgaagaagugaugcgcucaagauggucucggaagaugcuuaugaccggaacgcuggccguauuuuuccuccuuaucauggggcagcuaaccuggaaugacuugauaagacuauguauuaugguaggggcgaaugccagugauagaaugggaaugggcacgaccuauuuagccuuaauggcaacuuuuaaaaugcgaccaauguucgccguaggacuuuuauuccggagauuaacaagucgcgagguccuccuguugacuauuggacuuucacuuguagcuaguguugaacuaccuaacagcuuagaagaauugggagacggauuagccaugggcauuaugauacuuaaauuacuaacugauuuucagucacaccaauuaugggcaacauuguuguccuuaacuuuuauuaaaacuacauuuucauuacacuaugcauggaagaccauggcgaugguccucagcauagugagucuuuucccacucugccuaucgacaacaagccaaaagacuacguggcuacccguauuacuagggagucuaggcugcaaaccacuaacgauguuucuaauugcggaaaacaaaauuugggggcgcagaagcuggccgcugaacgaaggcauaauggcaguagguauuguaucuauacuacugagcucacuacuuaagaaugaugugccguuagcugguccacuaauagcgggagguauguugauugcuugcuauguaauuagcgguuccagcgcagaccuaucacucgaaaaagccgcugaaguuucaugggaggaagaggcagaacauagcggagcuucacauaauaucuuaguggaaguucaggacgauggaacgaugaaaauaaaagaugaggagagagaugauacacuaacaauauuacugaaagcgacuuuauuagcugugucugguguauauccuuugagcauaccugcuacucucuucgucuggcacuuuuggcaaaagaaaaagcaacguucugguguuuugugggacacucccagcccaccugaagucgguagagcgguguuagaugacgguauauaccgaauaaugcaaagaggacuccuagguagaagccaaguaggcguuggagucuuucaagaaaaugucuuccacacuauguggcaugugacccggggagcaguacuaauguaucaggguaaacgauuagaaccaaguugggcaucaguuaagaaagacuuaauaucauauggugguggauggagacuacaagggagcuggaacaccggcgaagaaguucaaguaauagccguugaacccggaaagaauccuaagaacguucagacggcccccgggacauuuaaaacaccugaaggugaagucggcgcaauagcauuagauuucaaacccggaacaaguggcucaccaauagucaauagagagggcaaaauugugggacuauacgggaacggaguggucacaaccuccgguacguaugucagcgcaauugcccaagccaaagcaucucaagagggaccauuaccggagauagaagacgaaguuuucaggaagagaaacuugacuauaauggauuuacauccaggaagcggaaaaacaaggagauaucucccggcuaucguccgcgaggcaauaaagagaaaguugaggacuuuaauacuugcaccaacaagaguuguugcgucggagauggccgaggcuuuaaaagguaugccuauuagauaucagacuacagcggugaaaucugagcacacggggaaggaaauuguagauuuaaugugucaugcuacauuuacgaugagauuauuaucuccgguuagaguaccaaauuauaacaugauuaucauggaugaagcucauuucacggauccuucuucgauugcagccagagguuauauaagcacacgcgucggaaugggcgaagcggccgcaauauuuaugacagcgacaccgcccgggucagucgaagcauuuccacagucgaacgcaguaauucaagaugaggaacgagauauaccagaaagaagcuggaacucuggguacgaguggauaacagauuuccccggaaaaacgguuugguucgucccguccaucaaguccgggaacgauauagcaaauugcuuaaggaaaaauggaaaacgcguaauacagcuaucuagaaaaacauucgauacagaauaccagaaaacuaaaaacaacgauugggauuauguuguaaccacagacaucagugagaugggagcaaauuuucgugcagauagaguuaucgauccaaggcggugcuuaaaacccguaauuuuaaaagauggucccgaaagaguuauauuagcaggaccuaugccaguuacggucgcuucagcggcacaaaggcggggacguauaggucgaaaucacaauaaggaaggugaucaauauaucuauaugggucagccauuaaauaaugaugaggaccacgcacacuggacugaagcuaaaauguuauuagacaacaucaacacuccugaagguauuauaccagcacuguucgagcccgagcgugagaaaagcgcagcaauagauggagaauacagauuacgaggagaggcacgcaaaacauucguagaacucaugcggaggggcgaccuuccaguuugguuaucauauaaaguagcaagugaggguuuccaauauucagaccguagguggugcuuugacggcgagaggaauaaccaaguacuugaagaaaauauggacgucgagauauggacaaaggaaggagaaagaaagaaacuaagaccaagaugguuagacgcgaggacuuauucagauccauuagcguugcgugaauuuaaagaguucgcugcuggucgaaggucaguaucgggagaucuaauacuugaaauaggaaaacuaccacaacaccuaacucagcgggcacagaaugcacucgacaaucuggucaugcugcauaacucggaacaaggagguagagcguacaggcaugccauggaagaauuacccgauacuauagaaacuuuaaugcuuuuagcacuaaucgccguccugaccggaggagucacguuguuuuuccugucuggccggggacucgguaaaacaucaauaggacuacucuguguaauggcaaguucuguuuuguuguggauggcuaguguggaaccacauuggauagcggccucaauuauuuuggaauuuuuccucaugguccuccuaauaccugagccggaucgccagagaacuccacaggauaaucaguuagcauacguaguaauuggauuauuauuuaugauucuuacuguugccgccaacgaaauggggcuauuggaaacuaccaagaaagaucucgggauaggacauguggcgguugaaaaccaccaccaugcagcuaugcuagauguagaccuccauccggcaucugcuuggacguuauacgcaguggcuacgacaauuaucacgccuaugaugcgucacacaauugaaaacaccacggcgaauauuucucuuacugcaauugcgaaucaagcugcuauauugaugggacuugauaagggauggccuauuucaaaaauggauauuggugugccuuuacuagcucuagggugcuauagucaaguuaacccacuuacguuaacugcagcgguacugauguuaguagcacauuacgccauaauaggaccaggccuacaagcaaaggcaacacgagaggcucaaaaacggacggcagcagguauaaugaaaaauccaaccgucgacgguaucgucgcuauugauuuagacccaguaguuuaugacgcuaaauuugaaaaacaacuggggcaaauaauguuguuaauauuauguacaucacagauauuacucaugaggaccacaugggcacuaugugaaucaauaacguuagcaacaggacccuugaccacguugugggaaggcagcccuggcaaguuuuggaauacuacaauagcaguaaguauggcuaauauuuuuagagguaguuaucucgccggagcuggacucgccuuuagcuugaugaaaucacugggaggaggacgucguggaacuggagcucaaggcgaaacuuuaggggaaaaauggaaacgccaauuaaaucaacuuuccaagucagaauuuaauacguauaagagaagcgguauuauggagguugauagaagcgaagcuaaagaaggacuuaagagaggagaaacuacaaaacacgcggugucucgcgggacggcuaaauuacgcugguucguugaaagaaauuuaguaaaaccggagggaaaaguuaucgaucuaggaugcggaaggggagguuggaguuacuacugugcugguuuaaagaaaguaacagagguaaaagguuacacuaaaggaggccccggucacgaagaacccaucccaauggccacauacggguggaaucuagucaaguuacacucaggaaaggacguguucuuuauuccgcccgagaaaugugauacgcucuuaugugauauuggggaguccucaccaaauccuacaauugaagaagguagaacguuacggguacuuaaaauggucgaaccauggcuaaggggaaaucaguucuguauuaaaauauuaaauccauacaugccaagcgucguggaaacacuagaacaaaugcaaaggaagcacggugguauguuggugcguaacccacuaucacgaaacagcacucaugaaauguauugggugaguugugggaccgguaauauaguaagcgcuguuaauaugacgucacguaugcuacuaaaucguuuuacuauggcacaucggaaaccuacauacgaaagagauguagaucugggugcugguacacgccauguggccguugaacccgaaguggcaaaccuagacauaauaggccaaagaauugaaaacauaaagcaugaacauaaauccacauggcauuaugaugaagacaauccauauaagacgugggcauaucauggaucguaugaggugaaaccaagcgguucagccuccagcauggucaauggaguggugaaacuacucaccaaaccgugggauguaaucccgaugguaacacagaucgcuaugacugacaccaccccauuuggucaacaacgcguuuuuaaggaaaaaguagacacacgaacuccuaaagccaaaagaggaacagcacaaauaauggaaguaacugcaaaaugguuauggggauuuuuaucuaggaacaagaaaccuagaauuuguacacgcgaagaauuuacacggaaaguuagaucgaaugcugcgaucggagcaguuuucguggacgagaaccaauggaacagugcuaaggaagcgguagaagaugagagauucugggaccuaguucacagagaacgcgaauuacauaaacaaggaaagugugcaacaugcguauauaacaugauggguaaacgugagaagaaacugggugaguucggcaaagcuaaaggaagcagagccauaugguauaugugguuaggcgccagauuucuagaguucgaagcguuaggauucaugaacgaggaucacugguuuucucgagaaaauaguuuaucgggggucgaaggugaaggguuacauaagcuaggcuauauauuaagagacaucucaaauauaccaggcggcaauauguaugcagaugauaccgcugguugggacacuagaaucacggaagacgacuuacaaaacgaggcgaggauaacagacaucauggagccagaacaugcacuacuugccaagucaauauuuaaacuaaccuaucaaaauaagguagucaggguacaacggccagccaaaaaugguacaguuauggaugucauuucucguagagaccaaagaggaucaggacaaguagggacuuacggcuuaaauacuuuuaccaacauggaagcacaauugauaagacaaauggaaagcgaaggcauauuuagccccagugaacuggaaaccccaaaucuagccgaaaggguuuuagacugguuagagaaauaugguguagaacguuuaaaacgaauggccauaucaggagacgacugugucgugaaaccaaucgaugauagauucgcaacugcuuugacugcucuuaaugauaugggaaaaguacgaaaagauauaccccaaugggaaccgucaaaaggauggaacgauuggcaacaggugccuuuuugcagccaucauuuucaucaacuuauuaugaaagacggcagggaaaucguaguaccaugcagaaaucaagaugagcucgugggaagggcaagaguaagccagggagcaggauggagucugcgagaaacugcgugccuugguaagagcuacgcacaaauguggcaauuaauguauuuccauaggagagaucuaagacucgcagccaaugccaucuguucagcaguuccgguagacuggauuccaacaagucgaacuacauggagcauucaugcgcaucaccaauggaugacaacggaggauauguuaucagucuggaacaggguuuggaucgaagagaacccguggauggaagauaagacacauauaagcagcuggggagacguaccauaccuuggaaagcgugaagaucaauggugugguucuuuaauuggacuaacagcacgagcaacuugggcaacgaacauacaaguggcuauaaaccaaguaagaagacucaucgggaacgaaaauuauuuagacuacaugacauccaugaaaagguuuaagaaugaaucugacccugaaggagcucuaugguga

SEQ ID NO: 21461 - RNA, 9879 nt, Artificial Sequence
  derived and/or modified CDS sequence (opt6) from DENV-1__EU677151__SS-prME
ucgguaacgaugcuauugaugcuaaucccuacggcauuagcauuucaucugacaacccgcgguggggaaccgcacaugauuguaucaaaacaggaacgaggaaaaucguuacuauucaaaaccagugccggagugaauauguguacauugauagcuauggacuuaggagaauuaugugaagauacuaugacauacaaauguccaagaauaacugagguggaaccugaugacguugauugcugguguaauacaacagauacuuggguaacauaugguacauguucgcagacaggggagcaccgaagggauaaaagaagugucgcgcucgccccacauguuggacugggacuagagaccagagcagaaacauggaugagcagcgaaggugcauggaaacagauccagaaagucgaaacuugggcauuaagacaucccggauuuacuguaauagccuuguuucuagcgcacgcgauaggcaccagcaucacucaaaaagggauaaucuuuauccuacuaaugcuagucacucccucaauggcaaugagaugcgucgggauuggaagccgugauuuuguggaaggucuuagcggggcaacauggguagauguaguuuuagaacauggcagcugcguaacuacaauggcaaaagauaaaccgacccuggacauagaauuguuaaaaacagaagugacgaauccagcgguauuaagaaaauuauguaucgaagcgaagauuuccaauacaacuacagacucgagauguccaacacaaggagaagcuacccuaguugaagaacaggacgcaaauuucgugugccgcaggaccuucguagaucgagguuggggaaacgggugcggauuguucgguaaaggcucucuaauaacaugugcgaaauucaaauguguaacgaaauuggaggggaaaauagugcaguaugaaaacuuaaaauauucaguuauugugacuguacauacaggcgaucagcaucaagucgguaaugaaucaaccgaacauggaacaacagcaacgaucacaccccaagcaccuacaucagaaauacagcucacugauuacggcgcucucacccuugauuguucuccgcgaacaggauuagacuuuaacgagaugguguuguuaacuaugaaggaaaaaucgugguugguccauaaacagugguuuuuggauuuaccucuuccguggacuucaggcgcuagcaccucccaagaaaccuggaaccgacaagaucuccuugucacauucaaaacugcccacgccaagaaacaggagguagucguacuaggaagucaagaaggagcaaugcauacagcauuaacuggagcgacagagauccaaacgucaggaacaacaaccauuuuugcuggccacuugaaaugcagacuuaaaauggauaaacucacucuaaaaggaauguccuacgugauguguaccggcaguuuuaaacucgaaaaggaagucgcggaaacacaacacgggacaguacuuguacaaauaaaauaugaaggaacagaugccccuuguaaaauuccuuuuuccacacaagacgagaaaggagucacucaaaaugguagacuaaucacagcaaauccgauuguaacugacaaagaaaaaccugucaacauagaagcggaaccuccguucggagaaucauauauaguuaucggcgcuggagaaaaagcacuaaaacuaaguugguuuaagaagggaucaagcaucgggaaaauguucgaggcuacugcaaggggagcgcgacgcauggcuauauuaggggauacugcuugggacuucgguagcaucgguggaguuuucacgucagugggaaaauuaguucaucagauauucgguacugcuuaugguguacuuuuuaguggaguaucuuggacaaugaaaaucgguauagguguacuuuugacauggcucggacuaaauagucgaucaacuucauuaagcaugaccuguauugcaguaggacugguaacgcuauaccuagguguuaugguacaggccgauucaggaugcguaauaaacuggaaggguagagaacucaaauguggaagugggauuuucgugacaaaugagguccacacauggacggaacaauauaaguuucaagcagacaguccaaaacgucuaucggcagcgauaggaaaagcgugggaagaagggguuugugggauaagaucggcaaccagauuagagaauaucauguggcgacaaauuaguaaugaauugaaucacauacuccuggagaacgauaugaaguucacugucgugguaggggacguaguuggaauccuagcucaagguaagaaaaugauccgaccucaaccuauggaacauaaauacucauggaaaaguugggggaaggcuaaaauaaucggugccgacguucagaauacuaccuuuaucauugacggucccaacacaccugaaugcccugacgaucaaagagccuggaauaucugggagguggaagauuauggauucggaaucuuuacgacuaacauuuggcucaaacuaagggauucauauacacaggugugcgaccauagauuaaugucagcagcuauaaaagacucgaaagcuguucaugcagacaugggauauuggauagaaucugagaaaaaugaaacauggaaauuggcaagagcaucguuuauugaaguaaagacauguaucuggccgaaaagucauacacuauggagcaauggaguauuggaaagcgagaugauuauucccaaaauuuacggaggaccaauuagucaacacaacuaucggccagguuauuucacgcaaacugcagguccuuggcacuuggguaaauuggaacucgauuucgaccucugugaaggaacuacuguagucguggacgaacauugcggaaaucgaggagcaucauuaagaaccacgacagugacugguaagauaauucaugaguggugcuguagaaguuguacuuugccaccuuuacgcuucaaaggagaagacggcuguugguauggaauggaaauuaggccgguaaaagaaaaagaagaaaaccuaguaaaaaguaugguuagugcuggaucuggugaaguagauucuuuuucauugggcuuacuuuguaucaguauaaugaucgaggagguuaugcguaguagguggaguagaaaaaugcuaaugacugguaccuuggcaguguucuuccuccugauuaugggacaguuaacauggaaugaucucauuagaaguugcauaauggucggagcgaacgcuuccgacaggauggguaugggaacaacauacuuagcauugauggccacuuucaaaaugcgaccuaugguugcaguaggauuacucuuuagacgauuaacgucgagggaaguucuacucuuaacuauaggucuuuccuuaguagcaucgguagaauuaccuaacucguuagaggaacuuggugacggccuagcgaugggcaucaugauuuugaaacuauuaacugauuuucaaucuuaccaacuuugggcuacauuauuaucguuaaccuuuauaaaaacuaccuuuucgcuccauuaugcuuggaagacaauggccaugguacuaucaauaguaagucuacuaccucucugucuuaguacaacuagccaaaagaccacuugguuaccuguauugcuaggaagccuggguuguaaaccacuaacgauguuucugauagcggaaaauaagaucuggggaagaaaauccuggccacuuaaugaaggaaucauggcagucggaaucguaucaauccuucuuaguaguuuguugaaaaacgacgucccacuggcggggccccuaauagcuggagguaugcugauagcauguuacgugauuagcgguaguucagcugaccuaucacuagagaaagcugcagaaguaaguugggaagaggaggcagaacacaguggcgcaagucauaauaucuuaguagaaguccaagacgauggcacaaugaaaauaaaagaugaggaacgagaugauacccuaacaauucuguuaaaagcaacucuacuugcaguaucaggcguuuauccuuuaagcauuccagcgacccuguucguuugguacuuuuggcagaaaaagaaacaaaggagcggggugcuuugggauacuccaucuccaccagaaguagaacgagcgguccuagacgaugguaucuauagaaucaugcaacgggguuuauuaggcagaucccagguaggagucggaguuuuccaagagaacguuuuucauacuauguggcaugugacaagaggugcuguacuaauguaucaaggcaaacggcuagagccgaguugggcaucugugaagaaagacuuaauuucauacggcggggguuggagacuacaaggaagcuggaacacuggagaagaaguucaaguaauugcgguagaacccggcaaaaauccaaagaaugugcagacagccccgggcaccuucaagacuccagaaggagaagucggugcaaucgcauuggacuuuaaaccagggacuagcggaucaccuauuguuaauagagaagggaaaauagugggauuauauggcaauggaguuguaacaacuuccgggacauauguaagugcaauugcucaagcaaaggcuucucaagaaggaccucugccugaaauugaggaugaaguguuucgaaaaaggaauuuaacuauaauggaucuacaucccgggucaggaaaaacacguagauacuuaccggcuauagugcgagaagcaauaaaacguaaacuacguacguuaauucuugcaccgacucgagucguggcauccgaaauggcugaggcguuaaaagggaugccaaucagauaccaaaccacugcaguaaaaucggaacacacagguagagaaauaguagacuugaugugccacgcaacguuuacuaugagacuauugucucccguuagagugccaaacuauaauaugaucauuauggaugaggcgcacuucacagauccuucuagcauagcagccagagguuacauaaguaccagaguagggaugggcgaggcagcagccaucuucaugacugccacaccuccggguaguguggaggcuuuuccucaaucgaaugcuguuauucaagaugaagaacgagauauaccagaacgcucauggaacagcggcuaugaauggauaacugauuuccccgggaaaacuguaugguucguaccaucaauaaagucaggaaacgacauugcaaacugucucagaaagaauggcaagcguguaauucaauuaucaagaaagacuuuugacacagaauaucagaaaacgaaaaauaaugacugggacuacguugucacaacagacauaagugaaaugggugcgaauuuuagagcagaucguguuauugacccuagacgcugcuuaaaacccguaauacuaaaagauggaccagaaaggguaauacuagcaggccccaugccuguuacaguagcuucugcugcacaaagaagagguagaauagggcgaaaccacaauaaagagggcgaucaauauauauauaugggucagccauuaaacaacgacgaggaccacgcacauuggacagaagcuaaaaugcuacuugacaacauaaauacaccggaagguauaauuccggcacucuucgagccagaacgagagaagucugcagcaauugacggugaauauagacuaagaggcgaagcgcguaaaacuuucgucgaauugaugagaaggggugaccuuccuguuuggcucaguuacaaagucgccucagaaggauuucaauauucggacagacgaugguguuucgacggugaaagaaauaaucaagucuuagaagagaacauggauguagagauauggacuaaagaaggagaaaggaagaaacuuagaccgaggugguuagaugcgagaacauauucugauccacuagcuuuacgugaauuuaaagaguucgcugcuggucggcgcuccgucucuggcgaucucauauuagaaauuggcaaguuaccccagcacuugacacaaagagcccagaacgcguuagauaaucucgugaugcuacacaauagcgaacaaggaggaagggcuuauagacaugcaauggaagaacuaccggauacaauagaaacucuaauguuacuggcauuaauugcaguacuaacaggaggaguaacauuguuuuucuuguccgggagaggacuaggcaaaaccaguaucgggcuauuauguguuauggcuaguucggcccuuuuauggauggcaucaguagaaccucauuggauugcagcaucgauaauuuuagaguucuuuuuaauggucuuguuaauaccugaaccggaucgccaaagaacuccgcaagacaaccaacuagccuacgucgucaucgguuuacuguucaugauauugacgguugcugcgaacgaaauggguuuacuugaaacgacgaagaaagacuuaggaaucggucauguagcgguagaaaaucaucaccacgcuacaauguuagauguagauuuacaccccgcaagcgcauggacacuauacgcaguagcaacuacgauaauaacgccuaugaugagacacaccauugagaacacgacagcuaauauuucguuaacagcaauagcaaaucaagcugccauauuaauggggcuggacaaaggauggccaauaaguaaaauggacauugggguaccccuuuuagcacuugguuguuacucacagguaaauccccuaaccuuaacugcugccguauuaaugcugguagcucacuacgcgauaauugguccaggacugcaagcaaaagcaacuagagaggcucagaagcgaacggcagccggaauaaugaaaaaucccacaguagacggcauaguagcaauugaccucgauccaguaguguacgaugcaaaauuugaaaaacagcuugggcaaaucauguuacucaucuuauguacgucucaaauacuauuaaugagaacuacaugggcacucugugaaucuauaacacuggcuacagggccacuaacuacuuuaugggaaggaucgccuggaaaauucuggaauacuacgaucgccgugucaauggcgaauauuuuuagaggcagcuauuuagcuggugccggauuagcuuuuagccucaugaaaucauuaggcggugggagaagagguacaggcgcacagggcgaaacucuaggcgagaaauggaaaagacaacugaaccaguuaaguaaaagcgaauuuaauaccuacaaacggucggguauaauggaaguagaucgaucugaagccaaagaaggauuaaggagaggagaaacaacaaagcaugccguuucacgaggcacggcuaaacugaggugguuuguggaacgaaaccuaguuaaaccugaagggaaagucauagacuuaggcugcgguagaggaggauggucuuacuauugcgcaggguugaaaaaggugacagaagucaaagguuacacuaaaggcggcccgggacacgaagaaccaauucccauggcaacauauggauggaauuuagugaaacugcauaguggaaaggauguuuucuucauaccacccgagaaaugugauacucuccuuugugacauaggcgaauccagccccaauccaacuauagaagaaggaagaacccuacguguauugaaaaugguagagccgugguuaaggggcaaucaauucugcauaaaaaucuugaauccuuacaugccauccguagucgaaacauuagaacagaugcaaagaaaacacgggggaaugcuaguaaggaacccccuuucccggaacucaacucaugaaauguauuggguuucaugcggaacagguaauauagucucugcaguaaauaugacaucuaggaugcuacuaaaucguuucacuauggcacauagaaaacccacauacgaaagagauguagauuugggugcagguacuagacaugucgcuguggaaccugaaguugcuaacuuggauauuauaggacaaaggauagaaaauauuaaacaugaacacaaaucaacguggcauuacgaugaggauaauccauauaaaacuugggcuuaccacggaucuuaugaggucaaaccaucuggaucagcgagcaguauggucaaugguguaguaaaauuacuuacuaaaccaugggaugugauaccaaugguuacacaaauagcuaugacagacacuacuccauuuggacagcaaaggguuuuuaaggaaaagguugauacaaggacgccaaaagcuaagagaggaacagcucaaaucauggaaguuacggcaagauggcuuuggggauuccuuagcagaaacaagaagccgaggaucuguacacgagaagaauuuacucguaagguacgaucgaacgcugcgauuggagcuguauuuguugaugaaaaccaauggaacucagcgaaagaagccguagaggacgagcguuuuugggauuugguucaccgagaaagagaacuccauaaacagggaaaaugugcuacaugcguauauaacaugauggguaaaagggagaagaaauuaggcgaguucggaaaggcaaagggcuccagagcaauaugguauaugugguuaggagcuagguuuuuagaauuugaagcauuaggcuuuaugaacgaagaucauugguucucacgagaaaacagucuuucuggaguagaaggcgaaggauugcacaaauugggguauauauuaagagauauuuccaaaauuccaggagguaauauguaugcugacgauacagcuggcugggacacacggauaacagaagaugaucuucaaaaugaggccaagauaacagauauaauggaacccgaacacgcgcuucuggcaacauccauauucaaguugacuuaucaaaacaagguuguaagaguacaaagaccagcccggaauggcacuguaauggauguuaucaguagacgggaucaacgagggagcggucaaguugggacauacggccuuaauacguucacaaacauggaagcccaauuaauacgccaaauggaaucagaagguaucuuuaguccuuccgagcuagaaacaccgaaccuugcugaaagaguguuagauugguuagaaaaacacgggguagaaagacuuaagagaauggcgauaucaggcgaugacugcguggucaaaccuaucgaugacagauuugccacagcauugagugcucuuaaugacauggguaaggugcggaaggacauaccucaaugggaaccaucaaaaggauggaaugacuggcaacagguaccuuucugcagccaccauuuccaucagcuaauaaugaaggaugguagggagaucguagucccguguagaaaucaagacgaauugguagggcgagcucguguaucacaaggagcaggauggagccuucgagaaacugcgugucugggaaaauccuaugcgcagauguggcagcuuauguauuuucacagaagagauuugagguuggcagcuaacgcuauaugcucagcaguaccuguggauugggugccuacaaguaggacaaccuggagcauacacgcucaccaccaauggaugacuacggaagauaugcugaguguauggaaccggguauggauugaggagaauccguggauggaggauaaaacacacauuaguaguuggggagauguuccguaccuagguaaaagagaggaccaauggugcgguucauugaucggcuuaaccgcaagagcuacgugggcaacaaacauccaaguagccauuaaucagguucgaaggcuaaucggaaacgaaaauuauuuagauuacaugacaaguaugaaaagauucaaaaacgagucggauccugagggcgcguugugguga

SEQ ID NO: 21462 - RNA, 9879 nt, Artificial Sequence
  derived and/or modified CDS sequence (opt6) from DENV-1__EU677152__SS-prME
uccguaacgaugcuacuaaugcugaugccaacggcucuagcguuucauuuaacuacgcgugggggugaaccccauaugaucgucaguaaacaagaacgaggaaagucucucuuauuuaaaacuucggcugggguaaacauguguacuuugauugccauggacuuaggcgaauuuugcgaagauacaaugacuuacaagugcccaaggauaacugaagcugaaccagacgauguggauuguugguguaaugcaacagauacauggguaacuuaugggacgugcagccaaacaggagagcaucguagggauaaacgaaguguagcucuugcaccucaugucggcuugggucuugaaacuagaacugagacuuggaugaguucggaaggcgccuggaaacaaauccagcgaguggagaccugggcauugaggcauccaggauuuacagugauugccuuguuuuuagcacaugcgauagggacaucaauaacacaaaaaggaauaauauuuauauuacuaaugcucgugacaccuuccauggcaaugaggugcguaggaauugguucacgagauuuuguagaaggucugucaggagccacauggguugacguaguuuuagaacaugggagcugcgugacaacuauggcaaaggauaaaccgacucuggauauagaacuacuuaaaacagaaguaacaaauccagccguccuuagaaaacuguguaucgaagcuaaaauuucuaauacgacuacagauucaagauguccaacacaaggagaagccacccuaguggaagaacaagaugcuaacuuuguaugcagacguacuuucguugaucgugguuggggcaacgggugcggucuauuugguaaaggcucguugauaacuugcgcuaaauucaaauguguuaccaaguuagaagggaaaacgguacaauaugaaaacuuaaaauacuccguaauuguuaccgugcauacaggagaucaacaucaagugggaaaugaaucaacagaacacgguaccacugcgacaauuacaccucaagccccgaguacagaaauccaauuaaccgauuacggagcgcuaacgcucgacugcagcccuagaacugguuuagacuucaacgaaaugguccuacuaacuaugaaagaaaaauccuggcuuguucacaaacaaugguuucucgaucuuccgcuuccauggacuagcggugcuucuacaucacaagagacguggaauagaaaagauuuauuaguaacuuucaagaccgcgcacgccaaaaagcaagaagucgucguacuaggaagccaggagggagcaaugcacaccgccuugacaggggccacugaaauucaaacguccggaacaaccacaauauuugcaggucauuugaaaugucgccuuaagauggauaaacuaacacuaaaggggaugaguuacgucaugugcacagguagcuucaaguuagaaaaagaggucgcagagacccaacacggaacuguccuugugcaaauaaaauaugaggguacagaugcccccugcaaaauaccauuuucaacucaagacgagaaaggagucacgcaaaaugggaggcuuauuacagcgaacccgauaguaacugacaaagagaaaccagucaauauagaagcugaaccgccauuuggagaaagcuauauagucauaggcgccggugaaaaagcauuaaaacucucaugguucaagaaaggaucaaguauugguaagauguucgaagcuacagcaagaggggccagaagaauggcuauuuuaggugauacggcuugggauuuugguuccauugguggcguauuuacaaguguagguaagcuaguacaccagauauuuggaacagcuuacgguguacuguuuucugguguuagcuggaccaugaagauaggaauaggaguacuauuaacuugguuaggucuuaacaguaggaguacaucacuaaguaugacauguauagcuguaggguuagucacuuuauaccugggaguaaugguucaggccgacagcggcugugugaucaauuggaaggguagagaauuaaaguguggaagcgguauuuuugugacaaacgaagugcacaccuggacugaacaauauaaauuccaggcagacucgccaaaacgauuauccgcagccauaggaaaagcaugggaggaagguguaugugguauacgaucugccacuagauuagaaaacauuauguggaaacaaauuaguaaugaauugaaccauauccuuuuggaaaaugacaugaaguuuacuguaguugucggagacguggcaggcaucuuagcacagggcaagaaaaugaucaggccacaaccgauggaguacaaauacucguggaaaucuugggguaaagcaaaaaucauaggcgcagauguacaaaacacaaccuuuaucauagacggcccuaacacaccggaaugucccgaugaccaacgagccuggaacauaugggagguagaagauuauggguucggcauuuucacuaccaauauuuggcuaaaacucagagacucauacacccaggucugcgaucacagauugauguccgcggcaauuaaagauucgaaagcuguucaugcagauaugggcuauuggauagaaucggagaaaaaugaaaccuggaaacuggcaagagccucuuuuaucgaagucaaaacgugcauauggcccaaaagucacacucucuggaguaacgguguacucgaaagugaaaugauaauucccaaaauuuauggaggaccuauaagccaacacaacuaccgacccggauauuuuacgcaaacagcgggacccuggcaucuggggaaacuugaacuagauuuugacuuaugugaaggaacgacuguaguaguagacgaacauugcgggaauagaggcccaucucugcgaaccacgacagucacaggcaaaauuauacaugaaugguguugccguucuuguacauuaccaccguuacgcuuuaaaggcgaagauggcuguugguacggaauggaaauacgccccguaaaagaaaaagaagagaaucuagucaagucgaugguuagugcaggguccggagaaguagauucuuucaguuuaggucugcugugcauaagcauaaugauugaagaaguaaugcggucuagguggucucgaaaaaugcuaaugacuggaaccuuagcaguguucuuucuauugauuaugggucagcucacguggaacgauuuaauacgauugugcauuaugguuggugcaaacgccagcgacagaaugggcauggguacuacuuauuuggcauuaauggcuacuuucaaaaugagaccaauguuugcugugggauugcuauuucgcagauugaccucucgugaaguccuacuccuaaccauugguuuaagucugguagcgagugucgagcuacccaacagccuggaggaacuaggagauggucuugcaaugggcauuaugauauugaaguuacucacagauuuucaaucccaucaauugugggcgacccuucuaagucuaacauucauaaaaacaacauucagcuugcauuaugcguggaaaacuauggcuaugguguuaucaauaguaucucuguucccccuuugcuuaucaacaacaucccagaaaacaaccuggcuaccuguauugcuuggaaguuuaggauguaaaccacugacaauguuucucauagcggagaacaagauuuggggaagaaaaucguggccucuuaaugagggaaucauggcuguaggcaucguuucaauccuccuuucaucacuucugaagaaugauguaccauuagcaggaccucucaucgcaggggguaugcugauagcaugcuaugugauuucagggucaagcgcagauuuaucucuggaaaaagcugcugaaguaaguugggaagaggaggcagaacacucaggggcuagucacaacauuuuaguggaaguucaagaugauggaacgaugaagauuaaagaugaagaaagggaugacacacuuacaauacuauuaaaagcaaccuuauuggcaguaucaggaguauaccccuuguccauccccgcuacacuuuucguuugguacuucuggcagaagaagaagcaaaggucuggaguacuaugggacacaccaucgcccccagaaguagagagggccguuuuggaugaugguauauaucguauaaugcaaagaggguuacuaggccggagccaggucggaguugguguuuuccaagagaauguauuccacaccauguggcauguaacuagaggcgcuguacuuauguaucagggaaaaagauuagagccaucuugggcaaguguuaagaaagaucuaauuaguuauggaggaggguggcgauuacaaggaucuuggaacacuggugaagaaguacaggugauugcuguagagccagggaaaaaucccaaaaacguucaaacagcaccuggaaccuuuaaaacaucugaaggugaaguaggagccauugcguuagauuuuaagccagguacgucaggcucuccaauaguaaacagagaaggaaaaauaguuggauuguacggaaacggagugguaacgacaagugguacauacguaagugcaauagcucaagcuaaagcaagucaggaaggaccacuaccugagauagaggaugaaguuuuuagaaagaggaaucuaacuauaauggaccugcauccuggcucagguaaaacgcgucgauaucucccugcuaucguacgugaagccaucaaacgaaagcuaagaacuuugaucuuagcaccgacccgaguuguugccagugaaauggccgaagcucuaaaaggcaugccaauacgauaucaaacuacagcgguaaagucagaacacaccggaaaggaaaucgucgaucugaugugucaugcaaccuuuaccaugagauuauuaucuccugugagaguaccuaauuauaacaugauuauaauggaugaagcacauuucacagauccgaguucaaucgcagcaagaggauacauuagcacgagagucggaaugggagaagcugccgcaaucuucaugacagcgacaccaccggguucagucgaagcauuuccucagucuaaugcuguuauucaagaugaagaaagagauaucccagagcgaucuuggaacagcgguuaugaguggauuacugauuuuccgggaaaaacugugugguucgucccaagcauaaaguccggaaacgauauugcgaacuguuuaaggaaaaaugggaaaagaguaauucaauugaguagaaaaacuuucgauacggaauaucaaaagacuaaaaacaaugacugggacuacguagucacaacggauauuucagaaaugggagccaacuuuagagcagauagaguuauagacccaagacgaugccuuaagccagucauacuuaaagauggaccagaacgagucauauuagccggaccaaugccgguuacgguugcuagcgcagcacaaaggcgcggacguauaggacgaaaccacaauaaagaaggagaucaauauaucuauaugggucaaccauuaaauaaugacgaagaucaugcacacuggacggaagcgaaaauguuacuugauaauaucaacacucccgagggaaucauuccugcauuauucgaaccagaaagagagaaaagcgcagcaauugacggcgaauaucgacucagaggagaggcuaggaaaacauuuguggaacuuaugagacguggugaccuaccaguuuggcucucauacaagguagcuucugaaggcuuccaauauagugaucgucguuggugcuucgacggagaaagaaacaaucaaguacucgaggaaaacauggacguagaaauuuggacuaaagagggcgaaaggaagaagcuaaggccgcgaugguuagacgcaagaacauacagcgacccacuagcacugagagaguucaaagaguuugcugcugggcgucgaagugugucaggagaucuaauuuuggaaauaggcaaauuaccccaacacuuaacccagcgagcccaaaacgcucuagacaacuuagugaugcugcacaacucagagcagggaggcagagcguauaggcaugcaauggaagaacuaccugauacuaucgagacgcuuaugcuauuggcguugauagcuguauuaacuggugggguaacuuuauucuuucuuucugguagaggauuaggcaaaaccucuauaggauugcuaugugucauggcuaguagcgucuuacuauggauggcuucaguugaaccccacuggauugcggccaguauaauacuugaguucuuucuaaugguacuuuuaauaccggaaccagacagacagcgaaccccacaggauaaucaauuagcguaugugguaauaggucugcuuuuuaugauauuaaccguugcggcgaaugaaaugggacuucuggaaacuacuaagaaagaucuagguauuggacacgcggcaguagaaaaucaccaucaugcggcaauguuagacguugaccuucauccugcaagcgcuuggaccuuauaugcaguggcuacuacgaucauuacuccuaugaugcggcacacaauugaaaauacaacggcuaacauaaguuugacagcuauugcaaaucaggcugcaaucuuaauggguuuagauaaggguuggcccauuucaaaaauggauauuggcguuccuuuguuagcucuaggcugcuacucccaaguaaacccgcuaacccucacggcugccguguuaaugcuaguggcacauuaugcgauaauagguccuggucuacaagcuaaagcgacacgagaagcgcagaaaaggacugcagcaggaauaaugaaaaauccuacgguagauggaauuguugcaauugauuuagauccgguaguuuaugaugccaaauuugaaaaacaauugggucagauaaugcuauugaucuuauguaccucacaaauuuugcugaugaggacuacuugggcauugugcgaaagcaucacccuagcaacuggaccacuaacaacauugugggagggaucgccagguaaguuuuggaacacaacgauagcagucaguauggcgaauauauuccggggaucauauuuggcgggggcuggacucgcuuuuucacuaaugaaauccuuaggagggggaagacgagguacuggcgcacagggagaaaccuugggugaaaaauggaagagacaguugaaccaauuaaguaaaagugaauuuaauaccuauaagcgaucaggaauaauggaaguagauaggucagaagcuaaagaagguuuaaagaggggagaaacuacaaagcaugcuguaaguagagggacagcaaaauugcguugguuugucgaacgcaauuuaguuaagccagaagggaaagugauagaucuaggauguggaagaggagguuggucuuacuauugugcagggcucaagaaagucacagaaguaaaaggauauacuaaaggcggaccaggccacgaagaacccauaccgauggcgacauauggauggaaucuuguuaaacuucauucagggaaagauguauucuuuauaccaccugaaaaaugcgauacgcuacuaugcgauauuggcgagucauccccaaaccccacaauagaagaagguagaacauuacggguacuaaagaugguagaaccauggcuaagaggaaaccaauucuguauuaaaauauuaaauccauacaugccaucuguaguagaaacauuggaacagaugcaaagaaaacacggagguaugcuuguccguaacccccuaucacguaauuccacacaugaaauguauuggguguccuguggaacgggaaacauuguaagugcuguaaauaugacgagccgaauguuauuaaauagauucacaauggcacauagaaagccaacauacgaaagagauguggaccuaggugcugguacaagacauguggcgguugagccggaaguugcgaaucuggacauuaucgggcaaagaaucgaaaauaucaaacacgaacacaagaguaccuggcauuaugacgaagauaacccuuauaaaacgugggcguaucauggaagcuaugaaguaaaaccuucaggaucagcuagcagcaugguaaaugguguggugaaguuguuaacuaagcccugggauguaaucccgauggucacccaaauagcaaugacagauaccacaccuuuuggucaacagcgcguuuucaaagaaaaagucgacaccagaacuccaaaagccaaacgagggacagcacaaauaauggaggucacggcuaaauggcucuggggcuucuuaucacgaaauaagaaaccaaggauauguacaagagaagaauuuacacguaaaguacguucuaacgcagcgauaggagccguuuucguugacgagaaucaguggaauagugcuaaagaagcaguagaagacgaacgauuuugggaucuaguccaccgagaaagagaacugcauaagcaaggaaaaugcgcgacgugcgucuauaauaugauggggaaacgagagaagaaauugggagaguuugguaaagcaaaaggauccagagcaauaugguauauguggcuaggagcacgauuucuugaguuugaagcauuaggcuucaugaaugaagaucauugguuuagcagagagaauaguuugagcgguguagagggugaagguuuacauaaauugggauacauacuuagagauauaagcaaaauaccaggaggaaauauguaugcugaugauacagcuggaugggauacgagaauuacagaagacgauuuacaaaacgaagcaaaaauaaccgauaucauggaaccagaacacgcuuugcuagcaaaaucaauauucaaauugacuuaucagaauaaaguaguuagaguccaaaggccagcuaaaaaugggacuguaauggauguuauuucacgaagagaucaaagagguaguggacagguugguaccuacggucuaaauacauuuacgaauauggaagcacaauuaauaagacaaauggaaucagaaggcauauuuuccccgagcgaauuggaaacuccuaauuuagcugguagggugcuagauugguuagagaaacacgguguagaaagauuaaaaagaauggccauaucaggagacgacugcgucgucaaacccauagacgacagauucgccacggcauuaacagcacuaaaugacauggggaagguaagaaaagauaucccccaaugggaaccaucaaaaggcuggaacgacuggcaacaaguaccuuucugcagccaccauuuccaucagcuuauaaugaaggacgggagggaaauaguagugccauguaggaaucaagacgaauugguuggccgugcaagagucucccaaggggcgggauggagccuaagagaaacagcauguuuggguaagucuuaugcucaaauguggcaauugauguauuuucauagacgagaucuaagacucgcugcuaaugcaauauguucagccguaccaguggauuggguaccgacaagcagaaccacuugguccauucaugcucaucaccaauggaugacaacugaagacauguuauccguguggaaucgagucuggauagaagaaaacccauggauggaagauaaaacacauauaucaagcuggggagauguuccauauuuagguaagcgugaagaucaaugguguggaagccugauagggcucacggcgagagcuacuugggcuacaaacauacaaguugcuauaaaccagguaagacgccuaaucgguaaugaaaauuaccuagacuacaugacuucuaugaaaagguuuaaaaacgaaagcgacccugaaggcgcacucugguaa

SEQ ID NO: 21463 - RNA, 9879 nt, Artificial Sequence
  derived and/or modified CDS sequence (opt6) from DENV-1__EU677155__SS-prME
ucgguaacuaugcuguuaauguugaugcccacugcacucgcuuuucauuuaacuacacgggguggagaaccucauaugaucguaaguaaacaagaaaggggaaaauccuuauuguucaaaacaucagcaggaguaaacauguguacccuuaucgcaauggacuuaggagaacugugugaagauacuaugaccuacaaauguccacgaauuaccgaaaccgaaccggacgauguggacugcugguguaacgcgaccgacacguggguaaccuacgggacaugcucccagacuggcgaacaucggcgugauaaacgaaguguagcauuagcaccucaugugggauuaggccuagaaacgcguacagaaaccuggaugucuucagaaggagcauggaaacaaauacaacguguagaaacgugggcauugcggcauccaggguuuacagugauagcucuguuuuuagcucaugcuauagguacaaguauaacgcaaaaaggaauuaucuuuauacugcuaaugcuuguaaccccuucgauggcaaugagaugugugggcauuggaucgagggacuuuguagaaggacuuagcggugcaacauggguagacguaguguuagaacauggaaguuguguaacgacuauggcaaaagacaaaccaacauuggauauagaauuguuaaaaaccgagguaacaaaucccgcgguucuacgcaaacugugcaucgaagccaaaauuaguaacaccacgacugauucgagauguccaacucaaggugaagccaccuuagucgaagaacaggaugcaaacuuugucugucguagaacauuugucgauagaggcuggggaaauggaugugguuuauuugguaaagggaguuuaauaaccugcgcaaaauuuaaaugcguaacaaaacuagaagguaaaauaguucaauaugaaaaccuaaaauauucaguaauaguaaccguacauacaggcgaccaacaccaagucggcaacgagucgacagagcacgggacaacugccacaauuaccccucaagcaccaacaacagaaauacaauuaacugacuacggugcucucacuuuagacugcaguccacgcacgggacuggauuucaaugagaugguccugcuuacaaugaaagaaaaaucuugguugguacauaaacaaugguuucuagacuuaccacuuccauggacaaguggagcgucaacaagucaggaaaccuggaaucgucaggaucuauuagugacuuuuaaaacggcacaugccaagaaacaggaaguaguuguucuaggaucacaggaaggagccaugcacaccgcacugacgggggcuacggaaauacaaacuucuggcacuaccacaauuuuugcuggacacuugaaauguaggcugaaaauggauaaacucacucuaaagggaaugagcuauguaauguguacaggauccuuuaaacucgaaaaagaaguagcggagacccaacacggaacaguucugguccagauaaaauaugaggguacugacgcuccaugcaagaucccuuuuucaacucaagacgaaaaggggguuacucaaaacggaaggcuuaucacggcgaacccuauuguuacugacaaagaaaaacccgugaacauagaagcagaaccuccguuuggugaaucguacauaguaaucggagcaggggaaaaagcccuaaaacugucaugguuuaagaaagguaguagcauaggcaaaauguucgaggcuacugcaagaggggccagacgaauggcgauauugggagauacugccugggacuucggaaguauagggggaguuuuuaccucgguggguaagcuggugcaucaaauuuucgguaccgccuauggaguccucuuuagugggguuucuuggacaaugaaaauugguauaggaguguuauuaacgugguugggucuaaauucacgaaguacuucccuuaguaugacauguaucgcaguuggccuaguaacucuauauuuaggaguaauggugcaagcagauagcgggugcguaauaaacuggaaagggagagaauugaaauguggaucaggcauuuuugucacaaaugaaguacauacguggacagaacaguacaaauuucaagcggacuccccuaaacggcuuucggcugcaauaggaaaagcaugggaggaaggugucugugguauuagaagugcgacaagauuagagaauauuauguggaaacagaucucuaaugaacugaaucacauuuuacuagaaaaugauaugaaauuuacuguuguaguaggugacguggcagguauacuugcucaaggaaagaagaugauccgaccucaaccaauggaauacaaauacaguuggaaauccugggguaaagccaagauaauuggagcagauguccagaauacuacauuuauaauugauggaccgaacacacccgaauguccggaugaucaacgagcauggaauauaugggaagucgaagauuacggauuugggauuuucacgacuaauauuuggcuaaaauuaagggauucauauacccaaguuugcgaucaucgacuaaugagugcagcaauuaaagauuccaaagcaguucacgcagacaugggauauuggauugaaagugagaagaacgaaacauggaaauuagcuagggcuaguuuuaucgaagucaagacauguauauggccaaaaucucauacuuuauggaguaacggaguacuggaaucugaaaugauaauuccaaaaauuuaugggggacccauaucacaacacaauuaccgcccuggauacuucacccaaacugcagguccauggcacuugggaaaauuagaauuagauuucgacuuaugcgaaggaacaacuguaguaguggaugaacacugcggaaacagagggccaucauuaaggacaacaaccguaacugguaaaauaauacaugaauggugcugucgaucauguacccuacccccgcuccgcuuccgaggagaagacggaugcugguacgguauggagauaaggccaguaaaagaaaaggaagagaauuugguuaaaucuauggucagugccgggucaggagaaguugacuccuuuucacugggccugcugugcaucuccauuaugauagaggaaguaaugcgaucucgauggagccgcaaaauguuaaugaccgguacucuggccguauucuuccuauuaaucaugggacaacugaccuggaacgaucuuaucagauugugcaucaugguaggggcgaacgcgucugaucgaaugggaaugggaaccacauauuuagcucuuauggcaacguuuaaaaugcgaccuauguuugcggucggauuacuuuuuaggagacugaccucccgugaaguccuucuguugacaauagguuuaaguuuaguagcaucaguagaauuaccaaauaguuuagaagaacuuggagauggauuggcuauggggaucaugauucucaaauuauugacagacuuccaaucgcaucaauuaugggcaacccuucuaagucuaacuuuuauaaaaacuacauucaguuuacacuacgccuggaaaacaauggccaugguccuaucaauuguuucccuguuuccacuaugucuauccacaaccagccagaaaacuacuugguuaccaguacuucuuggaucauuagggugcaaaccccuaacuauguuuuuaaucgcagagaauaaaauuugggggcgaagaaguuggccauugaacgaaggaaucauggcaguaggaaucguaaguauauuacuaucuucauuacuuaaaaaugacgugccauuagcgggaccacuaauugccgguggaaugcugaucgcauguuauguaauuucaggguccuccgcagacuuaucacuugagaaagccgcugaaguaucuugggaggaagaagccgaacauagugggaccucacacaauaucuuagucgaaguacaggaugauggaacaaugaaaauaaaagaugaagaaagagacgauacguugacgauuuuguugaaggccacauuauuagcaguauccggagucuauccgcuuucuauacccgcaaccuuauuuguuugguacuuuuggcagaagaagaaacagcgaagcgguguguuaugggauacgccaagucccccugaggucgaacgagcaguucuagaugacgguauuuaucguauuaugcaaagggguuuacuaggacguucacaaguaggaguagguguauuucaagaaaauguuuuccacacgauguggcacgugacaaggggagccguacuaauguaucaaggaaaaagguuagagccuaguugggcgagugucaagaaagauuuaauaucauauggaggcggguggagauuacaaggaagcuggaauacaggagaagaaguacaagucauagcaguugagccgggcaagaacccuaaaaauguccaaaccgcaccaggaaccuucaaaacaccugagggagagguaggugcuauugcauuagacuuuaaaccggguacauccggaagcccuauagugaaccgagaggggaaaauuguuggacuauacgguaauggaguaguaaccacaaguggaacguacguaucggcgauugcgcaagccaaagcaucacaagagggaccccuacccgagauagaagacgagguauuuaggaaaagaaacuugacaauuauggacuuacauccggguucagguaagacucgaagauaccuacccgcuauagugcgagaagcaauaaaaagaaaacucaggacccucauauuagcucccacuagagucguagcuagcgaaauggccgaggcacuaaaaggcaugccgauaagguaccagacuacugcagucaaauccgaacacacaggaaaagaaauuguagaucucaugugucacgcaacuuucaccaugcggcuuuuaucaccgguuagagucccuaauuacaacaugauuauaauggaugaagcucauuuuaccgauccaucaaguaucgcggcuaggggauauauuaguacaagaguaggaaugggugaagcugcagccaucuuuaugacagcaacaccaccugggucgguggaggcguuuccucaaaguaacgcgguuauccaagaugaagagagagauauaccugaacgcucauggaacaguggauaugaauggauuacagauuuuccagguaagaccguaugguucguaccgucaauuaaaucaggaaaugauauagcgaauugucuacguaaaaaugguaaaagggugauucaacuuaguagaaaaaccuucgacacugaguaucagaaaacuaaaaacaacgacugggauuacgucguaacaacugacaucucagaaaugggagcgaauuuuagagcugaucgggucaucgauccgagaagauguuuaaagccugugauuuuaaaagacggaccugaacgggucauacuagcagggcccaugccgguaacaguggcgagugcggcacaaaggagagggcgcaucgguagaaaucacaauaaggagggagaucaauacauauauauggggcaaccgcuaaauaaugacgaagaucaugcgcacuggacggaggccaaaaugcuacuagauaauaucaacacuccagaaggcauuauaccugcccuguuugagccagaacgugaaaaaucagcagcaaucgauggagaguacagauugcguggggaagcacgcaaaacuuuugucgaacuaaugcguagaggugaucucccagucuggcugucuuauaaaguagcaagugaagguuuccaauacucagauagaagaugguguuucgacggugagagaaauaaucaggugcuagaagaaaauauggaugucgaaauauggacaaaagaaggagagagaaagaaauugagaccacgauggcuagacgcacgcacauacagugacccucuagcacugcgugaguucaaagaauuugcagcagguaggagaucuguuucaggagaucucauuuuagaaaucgggaaguuaccccaacauuuaacacagagagcacaaaaugccuuagacaaucucgucauguuacauaauucugagcaagguggcagggcuuaccgccaugcgauggaagaacuucccgacacaauugaaacauugaugcuucuagcacuaaucgcagugcuuacaggcggcguuacucuguucuuuuuaaguggaaggggccuaggaaaaacauccauaggucuccugugcguaauggcaaguagcguauuguuauggauggccaguguugagccucacuggauagccgcgucgaucaucuuggaguucuucuuaaugguucugcugauaccagaaccagacagacaaagaacuccucaagauaaucagcuagcauauguaguaauaggacuuuuauuuaugauacuuacaguagcugcuaacgaaaugggacuccuggaaacaaccaagaaagacuuaggaauaggccauguagcgguagaaaaucaucaccacgccgcaauguuagacguugacuuacacccugccucugcguggacuuuauacgcaguggcuacuacaauaauuacaccuaugaugagacauacgauagaaaauaccacagccaauauuucgcuaacggcuaucgcaaaucaagcugcuauauuaaugggucuagacaaagguuggccgauuucuaaaauggacaucggagucccuuuauuagcucucggguguuauucacagguaaauccacugacucuuacagcugcaguacuaauguugguagcgcauuaugcuauuauagguccagguuuacaagccaaagcaacacgugaagcucaaaagcgaacagcugcaggcauuaugaaaaacccuacaguagauggaaucguagcaauagaucucgauccuguagucuaugacgcaaaauucgagaaacaguugggacaaauaaugcuucuaauauuauguaccucacaaauacuuuugaugaggacuacaugggcuuuaugcgagaguauuacccuagcaacuggaccuuuaacuacccucugggaggggucgccgggaaaguuuuggaauacaacgauagccguaaguauggcaaacaucuucagaggcucauaucuagcgggugcagggcuagcauuuucucugaugaaaucccuaggcggagggcgacgaggaacuggagcacaaggagaaacguuaggagaaaaauggaaacgucaauuaaaccaacuuucaaaaagcgaguucaacacauacaaaagaaguggaauaauggaagucgacagaucggaggcgaaggagggacuaaaaagaggugagacgacaaaacacgcgguaucuagagggacagcaaaguuaaggugguuuguagaacguaaccuuguuaagcccgaaggcaaaguaauugacuuggguuguggaagagguggauggucauauuauugcgcaggacugaagaaaguaaccgagguuaaaggauacacuaaaggagggccaggucaugaagaaccaauuccgauggccaccuauggauggaacuuaguuaaacuacauaguggcaaagacguguucuuuaucccgccagaaaaaugugacacauuauuaugugauauuggugaaucaaguccgaauccaacuauugaagaaggacguacacuaagaguauuaaaaaugguugagccguggcugaggggaaaucaauucuguauaaagauacugaacccauacaugcccucggucguugaaacccuagaacaaaugcaacgcaaacacggagggaugcuggugagaaacccauuaaguaggaacaguacgcaugaaauguacugggugucaugugguacugguaacauuguaucagcaguuaacaugacuagccgaauguuguugaauagauuuacuauggcacauagaaaaccgacuuaugaaagagauguugaucuaggagcuggaacacgccacguugcaguagaaccggaaguagcgaauuuagacauaaucggucaaagaauagaaaauauaaaacacgaacauaaauccacuuggcacuacgaugaagauaaucccuauaaaacgugggcuuaucacgggaguuaugaaguaaaaccaucggggucagccaguucaaugguaaacggaguaguaaaguuauuaacuaaaccaugggauguaauuccuaugguaacgcaaauagcuaugaccgacacaacuccuuuuggacagcaaagaguuuuuaaagagaaaguggauacgcggacgccaaaagcuaagcgaggcacagcccagauaauggaaguuaccgcuaaauggcuauggggauuuuuaaguaggaacaaaaagccucggauuugcacaagagaagaguucacucggaaaguucgaucuaaugcagcuauuggagcagucuucguagacgaaaaccaauggaauagcgcaaaagaagcuguagaagaugaaagauuuugggauuugguacacagggaaagagaacuacauaaacaaggaaaaugcgcgacgugcguauauaauaugauggggaaaagagagaagaaauugggugaauuuggcaaagcaaaagguagccgggcaauaugguauauguggcuuggagcacgauucuuagaguuugaggcauugggauuuaugaaugaagaucacugguuuucgagggaaaacagcuuaagcggcguggagggcgagggguuacauaaacugggguacauucuaagagauaucucuaaaauacccggaggaaacauguaugcagaugauacggcugguugggauacccgaauaacagaagaugaccuucagaaugaagcucggauuaccgacauaauggagccagaacacgcacuucucgccgguaguauuuucaaacuaacauaccagaauaaaguuguucguguacaaaggcccgccaaaaauggcacaguuauggauguaaucagcaggcgagaucaaagagguagcggucagguuggcacauauggacuuaacacuuucacuaacauggaagcacaacuaauucgacaaauggaauccgaagguauuuuuagcccgagcgaacuagaaacaccaaaucuagccgagaggguccucgacuggcuggaaaaauaugggguagagcgauuaaaacgaauggccauaucaggggaugacuguguuguuaagccaauagaugaucgcuuugcgacagccuuaacagcauuaaacgauaugggaaaaguuagaaaagauauaccccaaugggagcccucaaaagguuggaaugauuggcaacaaguaccauuuuguucucaucacuuucaccaauugauaaugaaggauggacgcgaaauaguaguucccuguagaaaccaggaugaacucgucggaagggcaaggguuucucagggcgcuggauggagucuaagggaaacagcgugcuuagguaagucauacgcucagauguggcaauuaauguauuuucaucgaagggaccuaagguuggccgcgaacgcaaucuguucagcaguaccaguagacuggauaccgaccucacgaacuacguggagcauucaugcucaucaucaguggaugacgacggaagacaugcuaucaguuuggaacaggguauggauagaagaaaauccuuggauggaagacaaaacgcauauuucuuccuggggcgaugugccuuaucucggaaaacgugaagaccaguggugcgggagcuuaauaggacuuacugcuagagccacuugggcaacaaacauucaagucgccauuaaccaaguacgaagacuuauaggcaaugaaaacuaucuagauuauaugaccagcaugaaaagguuuaagaaugaauccgacccggagggagcgcucugguag

SEQ ID NO: 21464 - RNA, 9879 nt, Artificial Sequence
  derived and/or modified CDS sequence (opt6) from DENV-1__EU677157__SS-prME
ucaguaaccaugcuauugaugcuaaugccaacugcauuagcguuucaucuaaccacaagaggaggagaaccucauaugauuguaaguaaacaagaaagaggaaaaucucucuuguucaaaaccucagcuggcguuaauauguguacguuaauugcuauggacuuaggagaacucugugaagauacuaugacauauaaaugcccaagaauaacagaaacagaaccggacgacguugauuguuggugcaaugcuacugauacauggguaacauauggaacuuguucccaaacuggugaacaccgacgggauaaaaggucaguagcgcuugcuccacaugugggguugggacuagaaacacgaacagaaacguggaugaguagugaaggggccuggaaacaaauucaaagagucgaaacuugggcccugcgacauccaggcuucaccguuauagcucuuuuucucgcucaugcaauaggaacgagcauaacacaaaaagggauuaucuuuauacuacugaugcuuguaacaccaucuauggcaaugagaugcguuggcauagguucuagagacuucguggaaggacuuucaggagcaacuugggucgaugugguacuggagcacggcaguugcguaacaacuauggcuaaagauaaaccaacacuugacauagaacucuuaaaaacagaaguuacaaacccagcgguacuacgaaaacugugcauagaggcuaaaauaaguaacacaacaacugauucacguugcccaacacaaggugaggccacauuaguggaagaacaagacgcgaacuuugugugcaggaggacuuugguugauagggguugggguaacggaugcgguuuauucggcaaaggaucauugaucacaugcgcaaaguuuaaaugugucaccaagcuggaggguaaaauuguacaauacgagaaucuuaaauauagugugauagucaccguucacacaggugaucaacaucaaguaggaaaugaaaguacagaacauggcacaacggcaacaaucacaccccaagcuccaaccacugaaauacaauuaacggacuauggagcccuuaccuuggacuguagcccacguaccggacucgauuucaacgaaauggugcuuuuaacaaugaaggaaaagaguuggcuaguacacaagcaaugguucuuagaccuaccucuacccuggacuucuggagcaaguacgucccaagaaacauggaauagacaagaccuccuaguaacuuucaaaacagcucaugcgaagaaacaagaaguaguuguccuuggcagccaagaaggagcuaugcacaccgcccuaaccggagcaacagaaauccaaacgaguggaaccacgacaaucuucgcgggacauuuaaaaugcagacuaaaaauggauaaacuuacuuugaaagguaugucuuacguuauguguaccggcagcuucaaacuugagaaagaauuggcagagacacaacacgggacuguucuaguucaaauuaaauaugagggaacagaugcuccaugcaaaauuccguuuucaacgcaagacgaaaaaggaguaacccaaaaugggagauugaucacugcgaauccaauugugaccgauaaagaaaaaccaguaaauauagaggcugaaccaccuuuuggcgagucuuacaucgucauaggagcuggagaaaaagcucuuaaacugaguugguuuaaaaagggaucauccauaggaaagauguucgaagcaacagcccguggagcucgacgaauggccauucugggagauaccgcaugggacuuugguucaaucggcggagucuuuacaucuguaggaaaauugguucaucaaaucuuuggcacagcauacgguguacuauucucgggcguuagcuggacaaugaagauugggauugguguauuguuaacguggcucggucuuaauagccggucaacaucacuaaguaugacaugcaucgcggucggauuaguuacauuguauuuagggguaauggugcaagcggauucaggaugcguuaucaacuggaagggucgugagcuuaaguguggaagcgguaucuuugucaccaacgaaguccacacauggaccgaacaauacaaauuucaggccgauagcccaaaacgucucucugcugcaauuggaaaagcaugggaagaaggugucuguggcauucgcucagccacaagauuagaaaauauuauguggaagcaaauuucgaaugagcucaaccacauucuucuagaaaaugacaugaaauuuacggugguagucggagacguugcuggaauauuagcacaggguaagaaaaugauacgcccccaaccaauggaauauaaguauucauggaaaaguugggguaaggcuaaaauuauuggagccgauguucagaauaccaccuucauaaucgauggaccaaacacaccugagugcccugaugaucaacgggcuuggaacauuugggagguugaagacuauggauuugggauuuuuacaacuaauaucuggcuaaagcuccgagauaguuauacccaaguuugcgaucaucgacuaaugucugcagccauuaaggauucaaaagcgguacaugcagauaugggguacuggauagaauccgagaaaaaugaaacauggaaacuagcuagagcuaguuucauagaaguaaaaacuuguauauggccuaaaagccacacauugugguccaacggaguucucgaaagugaaaugauuauaccuaaaauauacggaggaccgaucucucaacacaacuacaggccagguuauuuuacacaaaccgcuggcccguggcaccuugggaaacuugaacuggauuuugacuuaugugagggcacaaccguaguugucgacgaacacugugggaaucgugguccgucucucagaacaacuacuguaacaggcaaaauaauccaugaaugguguuguagaucguguacacuuccacccuugagauuuagaggagaggacggaugcugguauggaauggagauacgaccagugaaggagaaagaagaaaauuuaguaaaguccauggucucagcaggaagcggagaaguagacaguuucaguuuaggacuucucugcauauccauuaugauagaagagguaaugagaaguagauggucaagaaagauguuaaugacagguacuuuagcaguguucuuucuacuaauuaugggccaacucaccuggaacgaccuuauuagguuaugcaucauggucggugcuaaugcaagugauagaauggguaugggcaccacuuacuuagcauuaauggcaacguuuaaaaugagacccauguucgcagugggacugcucuuuagaagacucacaucgcgcgagguacuacuccuuacaauaggcuugucauuaguagccuccguagaauuaccaaauuccuuagaggagcuuggcgacggucuagcuaugggaaucaugauuuuaaaacugcuaacagacuuccaaucucaucaauuaugggcgacucuauuaucucuaacauuuaucaaaacaacuuuuucacuccacuacgcauggaaaacuauggcgaugguacuuaguaucgugaguuuguuuccauuauguuugucaaccacaucucagaaaacuacauggcugccgguauugcuagggucgcuugguugcaaaccauugacgauguuucuaauagcagaaaauaaaaucugggggagaagaaguuggccauuaaaugaggggauaauggcugucggcauagucagcauucuuuuaagcucgcuauuaaagaaugauguuccacuagcaggcccgcuaauagcaggaggaauguuaauagcgugcuauguuauuagugguaguucagcagaccugagcuuggaaaaagccgccgaggugucuugggaagaagaagcagaacauucaggcgcaagucauaauauuuugguagaaguacaagaugaugggacuaugaagaucaaggaugaagaacgugaugacacacuuacaauucuauuaaaagcuacauuguuagcaguuagcgguguuuauccguuaaguauaccagcaacacuguuuguaugguauuuuuggcagaagaagaaacaaagaucugggguacuaugggauacgccaucacccccagaaguagagagagccguucuagacgacgggaucuauagaauuaugcaaagaggacuccuugggagaagccaagucggagucggaguuuuccaagaaaauguuuuucauacaauguggcaugucacuagaggagcaguucuuauguaucaagggaaacgccuugaaccaucaugggcuucagucaagaaagauuugaucuccuacggugguggguggagauuacaaggaucuuggaacacgggugaagaggugcaagucauugcuguugaaccugguaaaaauccgaaaaauguacaaaccgccccagguacauucaaaacuccugaaggagaggucggugcaauugcacuugauuuuaaaccuggaaccagugggagcccgauagucaaucgagaaggaaaaauaguuggacuguauggaaaugggguugucaccaccucagguacguauguuucagcaaucgcacaagcaaaagcgagucaagaagguccgcucccagagauagaggacgaaguuuuucguaaaagaaacuuaaccauaauggaccuacacccaggcucggguaaaacuaggagauaucuaccagcaauuguuagagaagcgauuaaacgcaaauuacgaacuuuaauacuagcacccacucgagucguggcaagugaaauggccgaggcacuaaaaggcaugccaauaagauaccagacuacggcagucaaauccgagcacacagggaaagaaauaguagauuugaugugccaugcuaccuucacgaugcggcuccuuucaccgguaagaguaccaaauuacaauaugauaaucauggaugaagcacauuucaccgaucccaguucaaucgcagcccgaggguacauuaguacgcguguuggaaugggcgaggcugcugcaauuuuuaugacugcgacaccuccagggaguguagaagcguucccgcaaucgaacgccguuauucaagaugaggagcgagauauuccagaaaggucuuggaacucuggauaugaauggauaacugacuucccaggcaaaacagugugguucgugccuucaauuaaaucggguaacgacauagcaaauugucuaaggaaaaauggcaagagagugauacaacuaucaagaaagacguuugauacagaauaccagaaaaccaagaauaaugacugggauuaugugguuacaaccgacaucucagagaugggcgcaaauuuuagagcagauagaguaauugauccuaggcgcugucuuaaaccgguuauauuaaaggacggaccagaacgcgucauccuugcgggcccaaugccgguuacgguugcaucugcagcacagcgccgaggacgaauuggcagaaaucacaauaaagaaggugaucaguauaucuacauggggcaaccacuuaauaaugaugaggaucaugcgcauuggaccgaagcuaagauguugcucgacaacauuaauaccccugaaggaauaauaccugcauuauuugaaccagaaagagaaaagucggcugcaauagauggggaauaucgauuacgaggggaagcgagaaaaaccuuugucgagcuaaugaggagaggagauuuaccuguauggcuaucauauaaaguggcuagcgagggcuuccaauacucagauagacguugguguuucgacggcgaacgaaauaaccaaguauuagaagaaaauauggauguagaaauuuggaccaaagaaggugaacguaagaaacuaaggccaagauggcuagaugcgcgaacauauuccgauccauuggcuuuaagagaauuuaaagaguucgcugccggccggaggucagugaguggggaucuaauacuagaaaucgguaaauugccacaacaucuaacgcaaagggcucagaaugcauuagauaauuuaguuaugcuacauaacuccgaacagggaggcagggcuuauagacaugcaauggaagaacuuccugauacuaucgaaacacuuauguuacucgcccuuaucgcuguacugacuggcgggguuacguuauuuuucuugagcggaagggggcuuggaaaaacuucuaucggucuuuuaugcguaauggcauccucaguucuacuauggauggcauccguugaaccacacuggauagccgcaucuauaauuuuagaguucuuucugaugguacuacucauaccugaacccgauagacaaagaacaccacaagacaaccaauuggcauacguaguuaucggauuguuauucaugauucugacuguugcggcaaaugaaaugggacuauuagagacuacgaagaaagaucuaggaauuggacaugucgcugucgaaaaccaccaccaugcugcaauguuggacguggaucugcauccagcuucugcuuggaccuuauacgcaguggcgacuacuauaauaacuccgaugaugagacacacaauagaaaauacgacagcaaacauaucccuaacagcaaucgccaaucaggcagccauccuuaugggauuagauaaaggauggccaauuucaaaaauggacaucgguguaccacucuuagcuuugggauguuauucacaggugaacccacuaacauugacggccgccguacuuaugcuuguugcacacuacgcgauuauagggccggguuuacaagcuaaagcaacccgugaagcacaaaaacgaacagcagcaggaauuaugaaaaauccaacuguagacgggauagucgcaauagauuuggauccaguaguguacgaugcaaaguuugagaaacaacucggucaaaucauguuacuaauacuauguacaucucaaauacuacuuaugagaacgacuugggccuuaugugaaagcauaacucucgcaacaggaccccuaacuacccuaugggagggaaguccaggcaaguuuuggaauacuacaauagcaguaucuauggcaaacauauucagagggaguuacuuagccggagcuggauuggcguuuucacuaaugaagaguuugggagguggccgacgugguaccggagcacaaggagaaacuuuaggagaaaaguggaaacggcaacuaaaccagcuuagcaaaucugaguuuaauaccuacaagcgcucugguauaauggaaguggaucguucggaggccaaagaaggauugaaaagaggugaaaccacaaaacaugcggucucuaggggaacggcaaaauugagaugguucguagaaaggaaucugguuaaacccgaaggaaaaguaauagaucuaggaugcggaagaggaggcuggaguuauuacugcgcaggccugaagaaagugacagaagugaagggguacacuaaaggugguccuggccacgaggaaccuauaccgauggcuacauauggauggaacuuaguaaaacuacacaguggaaaagauguuuucuuuauaccuccagagaagugugacaccuuauuaugugacaucggugaaagcucaccaaauccuacuauagaagaaggacguacacuuagaguguugaaaaugguagagccauggcuaagagguaaucaauucugcauaaaaauauuaaauccuuacaugccuaguguugucgagacucuagaacaaaugcaaaggaaacauggcgggaugcugguaagaaacccauugucaagaaauucaacucacgagauguacuggguaaguugugggaccgguaauauagugucagccguuaauaugacaagcagaauguuguuaaaucgguuuacaauggcacauagaaaaccuacauaugaacgugauguugauuugggcgccggaacgagacacguugcaguagaacccgagguugcgaaccuugauaucauaggucagaggauagaaaauauaaaacaugaacauaaaucgaccuggcauuaugacgaagauaacccuuauaaaacaugggcauaccauggcagcuaugagguuaagccuuccgguuccgcuucgagcaugguaaauggcguuguaaaacuacugacaaaaccuugggacguaauacccaugguaacccagauagcaaugacagacaccacacccuuuggucagcaaagggucuucaaagaaaagguagacacccgaacuccaaaagccaaaagggguacagcacagaucauggaaguaacggcgaagugguuauggggguuccuuucaaggaauaaaaagccacgcauuuguaccagagaagaguuuacacgaaaagucagaaguaaugcagcgaucggagcaguauuuguggacgaaaaccaguggaacucugcuaaagaagcaguagaagaugaacgauuuugggaccuuguacaucgcgaacgagaauuacauaaacaagguaaaugcgcgacaugcguauauaauaugauggguaagagagagaagaaacugggggaguucggcaaggcaaaagguagccgagccaucugguacaugugguuaggagcuagauuccuugaauuugaggcacuaggauucaugaaugaggaucacugguuuagcagagaaaauuccuuauccgguguagaaggcgaaggacuacauaagcucggauacauauuaagggacauuagcaagaucccuggugguaacauguaugcugaugauacagcugguugggauacccggauaacagaagacgauuugcaaaacgaagcucggauaacagauaucauggaaccagaacaugcacuauuggcaaaaaguauauucaaguugacuuaucagaacaaaguaguucggguacagcggcccgccaagaaugguacgguaauggacgugauuucacggcgagaccagagaggaagcggucaaguuggcacuuacgguuugaauacguuuacuaacauggaggcacagcugauacgacaaauggagagcgagggcauauuuucaccguccgaauuagaaacaccgaauuuagcaaaaagaguauuggauugguuggaaaaguauggaguugaaagauuaaaaagaauggcgauaucgggagaugauugugugguuaagccaauagacgauagguucgcuacagcgcucacggcgcuaaaugauaugggaaaagugagaaaagauauaccccaaugggaaccuaguaaaggcuggaacgauuggcaacaaguuccuuuuugcucacaucauuuucaucaacucaucaugaaagauggaagagagauuguagugccauguagaaaccaagacgaauuaguaggacgggcacggguuagucaaggagcagguuggagccugcgggaaacagcuuguuuaggaaaaucauaugcgcaaauguggcaacuaauguauuuucauagaagagaccugcgacuagcagcgaacgcgauuugcucggcugugcccguagacuggaucccaacaagcagaacuacauggucaauacaugcacaccaucaauggaugacuaccgaagauaugcugucggucuggaauagaguauggauagaagaaaacccauggauggaagacaaaacucacauuaguucguggggcgacguaccuuauuuaggaaaaagagaagaucaauggugcgggucuuuaauagguuuaacagccagggcuacaugggcaacaaauauacaggucgcuauuaaccaagugcgaaggcuuauaggcaaugaaaacuaucuagacuacaugacaucuaugaaaagauucaaaaaugaaucugacccggaaggcgcauuaugguaa

SEQ ID NO: 21465 - RNA, 9879 nt, Artificial Sequence
  derived and/or modified CDS sequence (opt6) from DENV-1__EU677158__SS-prME
ucaguaacuauguuauuaaugcuaaugccaacagcacuggcauuucaucuuacuacacgaggcggagaaccucacaugauaguuucuaaacaagaaagagggaaaucauuguuauucaaaacuucagcaggaguuaauaugugcacguugauugcaauggaucuaggcgaauuaugugaagacacaaugacauacaaauguccccgaaucaccgaaacagaaccugacgauguagauugcuggugcaaugcaacugacacguggguuacauauggaacauguucccaaacaggcgaacacagaagagacaaacggagcguagcacuugcaccccauguaggauuaggauuggaaacuaggacagaaacauggauguccucagaaggugcauggaaacaaauucaaagaguagaaacaugggcauuaagacauccaggguucacggugauugcuuuauuccuagcucacgcaauagguacaucuaucacucaaaaagguaucaucuuuauccuucuuauguuagucacgccgucaauggcaaugagaugcguuggcauugguucaagggauuucguugaagguuuauccggagcuacguggguugaugucguauuagaacaugguucgugcgucacaacuauggcaaaagacaaaccgacacuagauauagaacuauuaaaaacugaaguuaccaauccagcaguauugcgaaaacuaugcauugaggcaaaaauaucaaauacgacgacugacaguagaugcccaacucaaggggaagcaacccuuguggaagaacaagaugcaaauuucguuugucggagaacuuucguugacagagguuggggaaauggguguggacuuuuuggaaaaggaucauuaauaacgugugcuaaauuuaaaugugucacaaaacuagaagguaaaaucguacaauaugagaaccuaaaauacagcguaauaguaacuguccacacuggugaucaacaccaggucggaaacgaaagcacggaacacggaacuacagcaaccaucacuccacaggcaccuaccacugaaauacaacugacagacuacggagcacucacacuagauuguagcccaagaacgggacuugacuucaaugaaaugguuuuacuuacgaugaaagagaaaucauggcugguacauaaacaaugguuccucgaucuuccucuaccuuggacgucaggugcguccacaucucaggagacuuggaaccggcaagaucuauuaguuacuuuuaaaacagcacaugccaagaaacaggaaguaguaguacucggcucacaagaaggagcaaugcacacagcgcuaacaggagcgaccgaaauacagacgaguggcacaacaacuauuuuugcaggacaccugaaauguagauugaaaauggauaaauuaacuuugaaagggaugucauauguaaugugcacuggaucauuuaaacuagaaaaagaaguggcagaaacccaacacggaacgguuuuaguccaaauuaaauacgaaggaaccgacgcacccuguaaaauaccuuuccuuacucaagacgagaaagggguaacacagaaugggagguugaucacggcgaauccgauaguaacugacaaagaaaaaccgguuaauauagaagcugagcccccauuuggugaaucuuauaucauaauaggcgcaggggagaaagcucuaaaacuauccugguucaagaaaggaucuucuauaggcaaaauguucgaagcaaccgcacgaggugcgagaaggauggcuauucuaggagacaccgcaugggacuuuggauccauaggcgguguauuuacuuccguugggaaauuaguucaccaaaucuucgggacagcauaugggguucuauuuuccggaguaaguuggacaaugaaaaucgggauuggaguauuguuaacauggcuuggauugaauagucguagcacaucucuuuccaugacaugcauugcggucggauuaguaaccuuauaccuuggagucaugguacaggcagacucagguugugugauuaauuggaaaggaagagaacuuaaaugcggaagcggaauauuugugacaaacgaaguucauacguggacagaacaauauaaauuccaggcagacucaccuaaacggcugagugcagcuauuggaaaggcuugggaagaaggagugugcggaaucagaucugccacacgucuagagaauauuauguggaaacaaauuaguaaugaauuaaaccauauacuuuuagagaaugauaugaaauucaccgugguaguaggugauguagcagggauccuagcucaagggaagaaaaugaucagaccacaaccgauggaauauaaauacaguuggaaaucgugggguaaagcgaaaauaauaggugcagacgugcaaaauacaacauucauuauagacgguccuaauacuccagagugcccugaugaccaacgcgcauggaauauaugggaaguagaggauuaugguuuuggaauauuuacgacuaauauuugguugaaauuaagggauucguauacacaggucugugaccacagacugaugucggcggcaauuaaagacucuaaagcagugcacgcagacaugggauauuggauagaaagugagaaaaaugaaacuuggaaacuggcccgcgcaucuuucaucgaaguaaaaacaugcaucuggccaaagucgcacacucuaugguccaaugguguauuagaaucugaaaugauaaucccaaaaauuuacgggggaccuauaucucaacauaauuaucgaccgggauauuucacucagacagcugguccuuggcauuuagguaaauuggaauuagauuuugacuuaugcgaaggcacaacggugguaguugacgaacacuguggaaacagaggaccaucacuuaggaccacaacggucacaggcaagauaauccaugaauggugcugccguagcuguacacucccaccucuacgguuucggggcgaagacgguugcugguaugguauggaaauaagaccuguaaaggaaaaagaagaaaaucucguaaagucaaugguaagugcuggaucuggagaagucgacagcuucucucuaggucuucucuguauaucuaucauaauugaagaaguaaugcgaucaagguggagcagaaagauguugaugacuggaacccuugccguauuuguccugcugauaaugggacagcuaacauggaacgaccuaauacgcuuaugcauaauggugggugcgaacgcaagugaucgcaugggaauggguacaacguauuuggcccuaauggcuacguuuaaaaugcgaccaauguuugcaguaggucuauuauucaggcgauuaacauccagggaggucuuacuguugacuauuggguuaucgcuggucgcaucgguagaauuaccgaauagucuugaagaauuaggcgauggacuagcuaugggcauaaugauauugaaguugcuaacagacuuccaaucucaccagcuuugggcuacacuucucucuuuaaccuucauuaaaacaacuuucucacugcauuacgcuuggaagacgauggccaugguauugagcauaguuucauuguucccguuauguuugaguacgaccucccaaaagacuaccugguuaccgguguuauuagguucucuuggauguaaaccacugacgauguuccuuauagcagaaaacaaaauauggggaagaagaaguuggcccuuaaaugaaggcauaauggcugugggaaucguuagcaucuuauuguccagccuacuaaagaaugaugugccccuggccggaccacuaaucgcuggcgguauguugaucgcuuguuauguaauaucaggcaguucugcggacuuaagucucgagaaggccgcagaggucucuugggaagaagaagccgagcauaguggagcaagucauaauauacucguagaaguucaagaugacgguacaaugaaaauaaaagaugaggaaagagacgauacgcugacaauccuacuuaaagcuacacuacuugccgugucaggaguauacccucuaucuauuccggcuacuuuauuuguuugguauuucuggcagaaaaagaaacaacgcaguggagucuugugggauaccccgucuccaccagaaguagaacgagcuguucuggacgacgguauuuauagaaucaugcaaagaggccuucucgggcguucacaaguggggguuggcguuuuccaagagaacgucuuucacacuauguggcacguaacaagaggcgcagucuuaauguaucaggggaaacgccuagaaccuuccugggcaagcguuaagaaagacuuaaucucauacgggggcgguuggagacuucagggcucuuggaauacuggugaagaaguacaagugaucgccguagaaccagguaagaauccgaagaaugugcagacagcuccaggaacuuuuaaaacaccagaaggagaggucggcgcuauagcauuagacuuuaaaccagguacaagugggaguccuauaguuaaucgugaggguaaaaucguuggacuauauggaaacggagucguaacgacaaguggaacuuacguaagugccauagcacaagccaaggccucgcaagagggcccucucccagaaauagaagacgaaguauuucgaaaacgaaauuugacaauaauggacuugcacccaggcagcgggaaaacaagacgguaccucccggcuauaguuagggaggccauaaaacgaaaacugagaacucugauuuuagcgccgacaagaguaguggcauccgaaauggccgaggcgcucaaaggaaugcccauaagguaccagacaacugcuguaaagagugaacacacaggcaaagaaauuguugaucuaaugugucacgcaaccuuuacaaugcgucuccuaucaccaguaagaguccccaauuauaauaugauaauaauggaugaggcccauuuuacagauccuucaaguauagccgcuagggguuauaucaguacaagagugggaaugggugaagcagcggccauuuucaugacggccacgccuccaggcucgguagaagccuuuccacagucaaaugccguaauacaagaugaggaaagggauauuccggagagaucguggaacucgggauaugaauggauaaccgauuucccgggcaagacugugugguuuguacccagcauaaaaucagguaaugauaucgcgaacuguuuaaggaaaaaugguaaaaggguuauccaauuaucacggaaaacuuuugauacagaauaucaaaagacuaaaaauaacgauugggacuauguuguuaccacugauauauccgaaaugggggcaaacuuuagagcagauagaguuauagauccaaggagguguuuaaaaccagugauccuuaaagauggaccggaaagaguuauccucgcaggaccgaugccaguaacaguagcguccgcagcgcagagaagagguagaaucgggagaaaucauaauaaagaaggagaccaauacauuuacaugggccaaccuuuaaauaaugaugaggaccaugcucauuggacagaggccaaaaugcuuuuagauaauauuaacacuccagaagguauaauuccagcccuauuugaacccgaaagagaaaaaucagcugcaauagauggagaauaucggcuuagaggagaggcaagaaaaacauuugucgaguugaugcguagaggugacuugcccguaugguugucauacaaaguugccucagaagguuuucaauacagugaccggcggugguguuuugauggugaaagaaauaaccaagucuuagaagagaacauggauguagaaauuuggacaaaagaaggcgaacgaaagaaauuacgaccacggugguuagacgcucgcaccuacagcgaucccuuagcauugagagaauuuaaagaguuugcagcaggaagaaggucuguuucgggugaccuuaucuuggaaaucggaaaauugccacaacauuuaacacaaagggcacaaaacgcguuagauaauuuaguaaugcuacacaacucggaacaaggggguagggcguauagacaugcaauggaggaauuaccagacaccauagagacuuuaaugcuucucgcacuaauugcagucuuaacaggaggagucacuuuauuuuucuuaagcgguagggggcucggcaaaacgucuaucggguuacuguguguaauggcgucaucagucuuacuguggauggcaaguguggaaccucacuggauagcagcuagcauuauccuggaauuuuuccuaaugguacuauuaauaccggaaccagacaggcagcgcacuccacaggauaaucaacuagcauauguaguaauaggacuccuuuuuaugauccucacaguagcugcaaacgaaaugggacuucuagaaaccaccaagaaagauuuaggcaucggucauguagccguagagaaccaccaucaugccgcaaugcuagacgucgacuuacaccccgcgucugcauggacacuuuaugcaguagcuacaacgauuauaacucccaugaugagacacacaauugaaaauacaaccgccaacauuagccuaacagccauugcaaaccaagccgccauuuuaaugggauuagauaaaggguggccuauaucaaaaauggauauugggguuccauugcuugcauuaggaugcuacagccagguuaacccacuaacucugacagcagcugugcuuauguuaguugcacacuaugcaauaauagguccaggauuacaagcuaaagcgacuagagaagcgcagaaaagaaccgcugcagguauuaugaaaaauccgacaguugacggaaucguugcuaucgacuuagacccgguggucuaugacgcaaaauuugaaaaacaacucggucaaauaauguuacucauccuauguacaucucaaauauugcucaugcguaccacaugggcgcucugugaaucuauaacucucgcaaccggcccacugacgacccuaugggagggaucaccagguaaguuuuggaacacuacaaucgccguguccauggcuaauauauuucgugguucuuacuuggccggggcaggucuagcauucucacucaugaaaagccuaggggguggaagaagagguaccggagcccagggagaaacgcuuggagaaaaguggaaacgucaauuaaaucagcuuucaaaaucagaauuuaacacuuauaaacgaucugggauaauggaaguugauagaucagaagccaaagaaggauuaaaaaggggagagacaaccaaacacgcaguaucacgcgggacugcaaaguugagaugguucguagaacgaaaccuaguaaagccagaaggaaagguaauugaucuugguugugggagaggcgguuggucauauuauugugccgggcucaagaaaguaacggaagucaaaggauacacuaaagguggaccuggucaugaagaaccgaucccaauggcaacauacgguuggaauuuggugaaacuccacagcggaaaagacguauucuuuauaccgcccgagaaaugugauacacuauuaugcgauauaggggaauccucaccaaacccaaccauugaagaaggacguacccuaaggguacuaaaaaugguugagccauggcuucgaggcaaccaauuuuguauaaaaauauuaaauccauauaugccuagcguugucgaaacucuagaacagaugcagcguaaacauggugggaugcuugucaggaauccacuaucacgcaacuccacucacgaaauguacuggguaucaugcggcacaggcaauauaguaucggcggucaacaugacgucaaggaugcuauugaauagauuuaccauggcccauaggaaaccaacauaugaaagagauguugaccuaggagcagguacacgacacguagcaguagaaccggagguugcaaaccucgacauaauaggccaaaggauagaaaauauaaagcacgagcacaaaaguacguggcacuaugacgaagauaacccauacaaaaccugggccuaccacggaagcuaugaagugaaaccuaguggaucagcuucaucuaugguuaacggaguaguuaaacuauuaaccaaaccgugggacgucauaccuaugguuacacaaauugccaugacugacacgaccccuuuugggcaacagcgggucuuuaaagaaaaaguggauacuaggacuccgaaagccaaaagaggaacugcacaaauuauggaagucacagccaaguggcucuggggauuuuuaaguagaaacaagaaacccaggauaugcaccagagaagaguucacaaggaaaguuagaaguaacgcagcaauuggagccguauucguggacgaaaaucaauggaacagugcaaaagaagcuguagaggaugaaagauuuugggauuuaguucaccgagagcgagaguugcacaagcaagguaagugcgcgacgugcguauauaauaugaugggcaagagagagaagaaacugggugaauuuggaaaagccaaggguucgagagcaauuugguauaugugguuaggcgcccgauuccuugaguucgaagcauuaggauuuaugaacgaagaucauugguuuucgcgagaaaauucgcugagugggguagaaggagaagguuuacauaaauuaggauacaucuuaagagacauaaguaaaauaccgggcggaaacauguacgcugaugauacagcaggaugggauacgagaauaacagaagaugacuugcagaaugaggccagaauuacggauauaauggaaccagagcaugcacugcuagccaagagcaucuucaaguuaaccuaucaaaauaaaguugugagagugcaacgacccgccaaaaauggcacuguuauggauguaauaaguaggcgagaucaaagaggcucgggacaaguaggaaccuacggucuaaacacauucacuaauauggaggcacaguuaaucagacaaauggagucggaaggaauauucuccccaagcgaacuagagacuccaaaccuugcugaaaggguccuagacuggcuugaaaaauauggaguugaacgccugaaacgaauggcuauaagcggagacgauuguguagucaagccaauagacgauagguuugcuacagcacuaaccgcgcuuaacgacauggggaaagugagaaaggauaucccacaaugggaaccuaguaaagguuggaacgauuggcaacaaguaccauucugcucacaccauuuucaccaacucauaaugaaagauggacgcgagauaguagucccguguaggaaucaagaugaauuaguggggagagcuagaguaucacaaggagcaggcuggucccuuagagaaacagccuguuuagguaagucguaugcgcagauguggcaauuaauguauuuccauagaagagauuuaagauuggcugcaaacgcaauauguucugcagucccaguugacuggauucccacaucaagaacuacguggucaauucacgcccaccaccaauggaugacaacagaagacauguugucaguguggaauagagucuggauagaagagaacccuuggauggaggauaagacccauauaucuucauggggugacguaccuuacuuaggaaaaagagaggaucaaugguguggaucccuaaucgggcugacagcgcgagcaaccugggcaacgaauauccaaguagcaauuaaucaagugagacgucucauaggaaacgagaacuauuuagacuacaugacauccaugaagcgauuuaaaaaugaaggcgacccugaaggcgcacuaugguga

SEQ ID NO: 21466 - RNA, 9879 nt, Artificial Sequence
  derived and/or modified CDS sequence (opt6) from DENV-1__EU677159__SS-prME
aguguuacuaugcuacuaaugcugaugccgaccgcacuagcauuucaccuuacaacucguggaggggaaccacacaugauaguauccaaacaagaaagagguaaaucguuauuauucaaaacuucagcuggcguaaacaugugcacgcucauugcuauggaucucggggaacuaugcgaagacacaaugacauacaaauguccgaggauaaccgaagcagaaccagaugauguggauugcugguguaaugcaacagauacauggguaacguacggaacuuguagucaaacgggugaacauagaagggauaaacguucuguagcuuuggcaccccauguaggauuagggcuagaaacgcgaacugaaacguggaugucaucggaaggagcguggaaacaaauccaacgaguagaaaccugggcucuuaggcauccaggauucacaguaauagcacuguucuuagcacacgcaauagguacaaguauaacccaaaaagguauaauauuuauccuacuaauguuaguuaccccgucuauggcaaugaggugcguaggaauagguaguagagauuucguagaaggauuaagcggggcaaccuggguagauguaguccuagaacacggaucguguguaacaacgauggcaaaagacaaacccacucuagauauugaacugcuaaaaacagaggucacaaauccagccguauuaagaaaauuguguauugaagcaaaaauaagcaacacuacaacugauucccgcugcccaacucaaggggaagccacacucgucgaagaacaagaugcaaauuucguguguagaagaacauucguagauagggguuggggaaauggaugcggucuauucgggaaaggaaguuugauuacgugugcgaaauuuaaaugcguaacaaaauuagaaggaaaaaucguucaauaugaaaauuuaaaauacaguguuauagugacuguucacacuggugaucaacaccaaguugguaacgaaaguacggaacacggcacaaccgccacgauaacaccucaagccccuacaacggaaauucaacuaacugauuauggagcguuaacauuggacuguuccccaagaacaggacuagauuuuaaugagauggucuuacucacaaugaaagaaaaaucauggcuuguacauaaacaaugguuccuugaccuuccacugccuuggacaaguggugcaagcacaucccaagagacauggaacagacaagaucuguuaguaacauucaaaaccgcacaugccaagaaacaagaaguggucguccuugguucgcaagaaggcgcgaugcacacggccuugacaggugcaaccgaaauucaaacuucaggaacuacaacaaucuucgcuggucauuuaaaauguagacuuaaaauggauaaauuaacacuaaaaggaauguccuacgugauguguacagguagcuuuaaauuggaaaaagagguggccgaaacacaacaugguacaguacuugugcaaauuaaauaugaaggaacagaugcuccaugcaaaauaccauucucaacacaagaugaaaaggguguuacccaaaauggaagauuaauaacagcaaauccuauugugacugauaaagagaagccagugaacauugaagcugagccacccuuuggugaaucguacauagugaucggugcaggcgaaaaggcuuuaaaacugucaugguuuaagaaaggaucaaguauaggaaaaauguuugaagcaacagcucggggagcaaggcgcauggcgauauuaggcgauacagcaugggacuucggcucuauagguggaguauucacgagcgugggcaaguuaguucaucaaauuuucgguacggcauauggcguauuguucuccgguguaaguuggacuaugaaaauuggaauuggcguccuccuaaccuggcuuggacuuaauaguagaaguacaagucugagcaugacuugcaucgcgguuggccuagugacguuauacuuaggcguuaugguucaagcugauaguggguguguaauaaacuggaagggcagagaacucaaaugugggucggggaucuuugucacuaacgaaguacacacguggacagaacaauauaaauuucaagccgacuccccuaagaggcuaucggccgcaauagggaaggcuugggaagaaggaguuugugguauaagauccgcaaccagauuagaaaacauuauguggaaacagaucagcaaugagcucaaccacauacuacuagagaaugauaugaaguuaacgguaguaguaggcgaugucgcugguauccuaggucaaggcaagaaaaugauuagaccucaaccaauggaauauaaauacaguuggaaaucauggggaaaagcuaagaucauuggagcagaugcacaaaacacuacauuuaucauugacggaccgaacacacccgaauguccagacgaucagagagcauggaauauaugggagguagaagauuauggauucggaaucuuuacgacaaacaucugguugaaauuaagagauuccuacacucaaguuugugaccacagauuaaugagugccgcaauaaaagacaguaaagcuguucacgcugacaugggguacuggauagaaucagagaaaaaugaaacuuggaaauuagcaagagcaaguuuuauugagguaaaaaccugcauuuggcccaaaucucauacguuauggucgaacggcguguuagaaucagaaaugaucauaccaaaaauauaugguggaccaauaagucaacauaacuacagaccggguuacuucacgcaaacugcgggaccauggcaccucggaaaguuagaacuggacuuugaucuaugugaagguacaacgguagucgucgaugaacauugcgguaauagaggacccagucuucgaacgacgacgguuacuggcaagauaauucacgaauggugcugcaggaguugcacauuaccaccacugagauuccguggagaagauggaugcugguacgggauggaaauccgacccguaaaagaaaaagaagaaaaucuuguaaagucuaugguaagcgccggaagcggugaagucgauagcuuuagucuuggucuucucuguauuucaauaaugauagaggagguuaugaggucacguuggucuaggaaaaugcugaugacugguacucuagcaguauucuuuuuauuaauaaugggacaauuaacauggaaugaccucauucgucucuguauaauggucggagcgaaugcaucagaccguauggguaugggaaccacauauuuagcacucauggcaacauuuaaaaugaggcccauguucgccguaggacuacuauuucguagguuaacgaguagggaaguacuuuuacuaacaauuggguuguccuuaguugcuuccguagagcuaccaaacaguuuagaggaacugggagacggcuuagcuauggguauaaugauucuuaaauugcuuacagauuuucaaucacaccaacugugggcuacucuacuaucgcucacuuuuaucaaaacuaccuuuagccuucacuacgccuggaagacuauggccaugguuuuauccaucguuucgcuuuucccucuuugccucaguaccacaucucaaaagacgacauggcuucccgucuugcuaggaucgcuaggguguaaaccucuuaccauguuucugauagcugaaaauaaaauuuggggacgaaaaagcuggccuuugaaugagggaauuauggcaguaggcauaguguccauuuugcuuucaagucucuugaaaaaugacgucccacucgcggggccguuaauugccggcggcauguuaauagcauguuaugucauaucugguuccucggcagaccuuucacuagagaaggcagccgagguaaguugggaagaagaggcggaacacucuggugcuagccauaauauacuugucgaaguacaggaugauggaacgaugaaaauaaaggacgaagaacgagaugauaccuuaacaauacuauuaaaggccacauuacuggcaguaucaggaguguaccccauaucaauaccugcaacucuuuuugucugguauuuuuggcagaagaagaaacagagaagcggaguauuaugggacacgcccaguccuccugagguugaacgagccguguuagacgacgguauauauaggauaaugcaaaggggacuacuaggucgcagucaagucggcguaggaguauuccaagagaauguauuccauacaauguggcauguaacccgaggggcuguguuaauguaucaagguaaaagacuugaacccucaugggcuuccguaaagaaagaccucauaagcuacgggggaggguggaggcuacgagguucauggaacacaggagaagagguacaaguaauagcuguagaaccagggaaaaacccgaagaacguccagacagcaccaggaaccuuuaaaacuccagaaggcgagguaggggcuaucgcauuagauuucaaaccaggaacaagugguucuccaauugucaauagggaagguaagauaguaggcuuauacgguaacggcgugguuacaacuucuggaacuuauguguccgcuaucgcacaagcaaaggccagucaggaaggaccacuuccagagauagaagaugaaguuuuucgaaaacguaaccuuacgauuauggaccuacauccgggaucuggcaaaacgagacgauacuugccugcgauagugcgagaagcgauuaaacgaaaacuaagaacacuuauucuagcccccacucgcgugguggcaucugagauggcggaggcauuaaaaggaaugccaauccgauaccaaacuacagcaguaaaaucugaacauacuggaaaagaaauuguggaucuuaugugucaugcaacauuuacaaugcguuuguugagcccagucagaguacccaauuacaacaugauaauaauggaugaagcucacuucacggauccaucgagcauagcggcuagaggcuacauuaguaccagaguggggaugggugaagccgcagcuauuuuuaugacagccacgccuccagguucuguagaagccuucccucaaaguaaugcaguaauucaagacgaggaacgagauauuccugaaagaagcuggaacuccggauacgaguggauaacagauuucccaggcaagaccgugugguuugucccuagcauaaaaaguggcaaugauauugcaaauugcuuaaggaagaauggcaaacgcguaauacagcugucaaggaaaacguuugacaccgaauaccagaaaacgaaaaacaaugauugggauuauguuguaaccacugauauuucugagaugggagcuaauuuuagagcugacaggguuaucgauccucguagaugcuugaagccugucauacucaaggacggcccagaaaggguuauucuagccggcccaaugccgguuacuguagcuucugcagcucaacggcgugggcgcaucggaaggaaucacaauaaagaaggggaucaauacauauacaugggacaaccguugaauaaugaugaagaucaugcucauuggaccgaagccaaaauguuauuggauaacauuaauacacccgaaggaauaauuccagcacuuuucgaaccugaaagagagaaaagcgcugcugucgauggugaauaucguuuaagaggugaagcacgcaaaacauucgucgaguuaaugcgaagaggggauuugccaguuuggcuuuccuauaaaguagcuucagaagguuuucaauauagcgaucgaagauggugcuuugacggggagcguaacaaucaaguuuuagaagaaaauauggacguugaaaucuggacaaaggaaggagaacgaaagaaauuaaggccaagaugguuagacgcaaggacauacagugauccccuggcgcuucgugaguucaaagaguucgcagcagguaggcgaucgguaucgggcgaucuaauauuagaaauaggaaaauuaccucaacacuuaacucaaagagcacagaaugcacuagauaaucuaguaaugcuacauaauagugaacaagguggacgugcuuaucggcaugcuauggaagaacuacccgauaccaucgagacacuuauguuguuggcucuaaucgcggucuuaacaggaggcgugacuuuauucuuuuugagugggagaggguuaggaaaaacaaguauuggauuacuuugcgucauggcgucaaguguauuacucuggauggcgagcguagagccucauuggauagcagcauccauaauacuugaguucuuucugaugguguuacuaauccccgaaccugaccgucaaagaacgccucaagacaaucaauuagcauauguaguuauuggucugcuuuucaugauccuuacaguugcagcaaacgaaaugggacuguuagaaacuaccaagaaagauuuaggaauaggacauguagccguggaaaaccaccaccacgcugccaugcuggauguugacuuacacccagccuccgcauggacacuuuaugcaguugcaacaacuauaauuacgccaaugaugcgacauacaaucgaaaacacaacagcuaacaucagcuuaacagcuauagcaaaucaagcagcaauacuuaugggucuagacaaagguuggccuauuaguaaaauggauauuggaguaccacuacuugcguugggcuguuauagucaggucaacccucucacacuaacagcugcaguacuaaugcucguggcacacuaugcgauuauagggccaggauuacaagcuaaagccaccagagaggcacagaaacguaccgccgcagggauuaugaaaaaccccacuguggauggaauaguugcuauagacuuagaccccgucguuuaugaugcaaaguuugaaaagcaauuaggacaaaucauguugcuaauauugugcaccucacaaauacuauuaaugagaaccacuugggcacuaugugagucgaucaccuuagccacagggccauugacuacauuaugggaagguaguccgggcaaauuuuggaauacaacgauugccgucagcauggcaaauauuuuuagggguaguuaucuugccggugcaggauuagcauuuagccuuaugaaaagucucggugguggucgcagaggaaccggugcacaaggugaaacguugggagaaaaauggaagaggcaauuaaaccaacucagcaaguccgaauuuaacacuuacaaacgaucagggauuauggaaguugaccguagugaagcaaaagaaggacuaaaacgaggagaaaccacgaaacacgcugucucacgaggcacggcaaaguuaagaugguuugucgaacgaaaccuaguaaagccagaggggaaggucauagauuuagguugcggaagagggggauggucuuacuauugugccggucuaaagaaaguaacggaaguaaaggguuauacuaaaggaggucccggucaugaagaaccaauuccaauggcgaccuacggcuggaaucuagugaaauuacauucugggaaggacguauucuuuauuccuccggaaaagugcgauaccuugcuuugugauauaggagaaagcaguccuaauccaacaauagaagaaggacgaacccugcgaguccucaagaugguugaaccaugguuacgcggcaaucaauuuuguauaaaaauucuuaacccuuacaugccuucggucgucgaggcccuagagcagaugcaacggaagcauggaggaaugcugguacguaacccauuaucacguaacagcacucaugagauguauuggguuuccugcggaacugggaauauaguuucugccguaaauaugaccagcagaaugcuauuaaaucguuucacaauggcccaucgcaaacccacauaugagcgcgacguagacuuaggaacagguaccagacacguggcuguagaacccgagguagcaaauuuagauauuaucggucagaggauugaaaauaucaaacaugagcauaaaucaacauggcacuacgacgaagauaacccuuacaaaacuugggccuaucauggauccuacgaaguaaagccaagcggcagugcauccucgaugguuaaugguguaguaaaacuccuaacaaaaccgugggauguuauacccaugguaacacaaauugcgaugacagacacuacaccguucgggcaacaaagaguuuuuaaggagaagguggauacgcgcacgccaaaagcgaaacggggaacagcucagauaauggaaguuacggcacgcuggcuauggggguuucuaucuagaaauaagaaaccucgcauauguacgcgagaagaauuuacaagaaagguuagaucaaacgcagcaauaggugcaguguucgucgaugaaaaucaguggaacagugcuaaagaagcaguagaggaugaacgguucugggaccugguucauagagaacgugaacuacauaaacagggcaaaugcgcaacuugcgucuacaacaugauggguaaaagagagaagaaacuuggcgaauuuggaaaggccaaaggauccagagcaauuugguauauguggcucggugcacgauucuuagaguuugaggccuuggguuuuaugaaugaagaccacugguucagucgagaaaauagucugagcgguguugagggagaagggcuacauaaauuaggauauauacuacgugauauuucuaagauccccggaggcaauauguacgcggaugauaccgccgguugggauacgagaaucacugaagaugacuuacaaaacgaggcuaagauaacggauauaauggaaccagaacaugcccuacuggcaaaggcgauuuucaaacucacauaucagaacaaagucgugcgaguacaacgaccagccaaaaacggaaccguuauggacguuauaagcagacgagaccaaaggggaaguggccaagucgguacauacggccucaauacuuucacuaacauggaagcacaacucauuagacaaauggaaagcgaagggauauucucuccuucagaacuugagacaccaaaccuagcagagagagcacuagauugguuagguaaauacgguguagaaaggcucaaaagaauggccaucucuggagaugacuguguaguaaaacccauagacgacagauuugcaacugcuuuaacagcauugaaugauauggggaaaguaagaaaagauaucccccaaugggagccuaguaagggauggaaugauuggcaacaagucccuuuuuguagucaucauuuccaucagcuaauaaugaaggacggaagagagauaguugugcccuguagaaaucaggacgaacuugugggaagggcacgugugucucaaggugccggauggagucugcgggaaacugcuugccucggaaagaguuaugcucaaauguggcaauugauguauuuccaucgacgugaucuaagacuagccgcaaacgcaaucugcuccgccguaccaguagauuggguuccaacaucaagaacaacauggaguauacacgcucaucaccaauggaugacaaccgaagacauguugucaguuuggaaucgcguguggauagaagaaaauccguggauggaagauaaaacccacauaucaaguugggaggaugucccguaucuaggaaagcgagaagaccaaugguguggaucacuaauaggucuuacagcaagagcgacuugggcaacuaacauucaaguugcgauuaaccaaguccguagauuaauaggcaaugaaaacuacuuagauuauaugaucucaaugaaaagauuuaagaacgaaucugacccggaaggugcacuuugguaa

SEQ ID NO: 21467 - RNA, 9879 nt, Artificial Sequence
  derived and/or modified CDS sequence (opt6) from DENV-1__EU677160__SS-prME
ucuguaacuaugcuccuaauguuaaugccuaccgcccuagcauuccauuuaacuacccgcggaggagaaccgcauaugauuguauccaagcaagaaagaggaaaaucucucuuauuuaagacgucugccggugucaauaugugcacccuaauugcuauggaucuaggggaauuuugugaagacacaaugacguacaaauguccaagaauaaccgaggcggaaccagaugauguagauugcuggugcaacgcuacugacaccugggugaccuacggaacuuguucgcagacuggggaacauagaagggauaagcgauccguggcucucgcaccacauguagguuuagguuuagaaaccagaacugaaacguggaugagcuccgaaggugcuuggaaacaaauucaacgugucgaaacgugggcccuucggcauccuggauucacagucauagccuuauuuuuggcccaugcuauaggaacaucgauuacacaaaaaggaauaauauuuauauuguugguuuugguuacgccaaguauggcaaugagguguguagggauagggucgagagauuuuguugaaggacuaagcggagccacguggguagacguaguauuggaacauggcucaugcguuacgacaauggcuaaagauaagccaacauuggauauagaacuccuaaagacggaaguuacuaauccagcaguauuaagaaaguugugcauugaagcaaaaauauccaauacuacaacugacucaagauguccaacucaaggagaggcuaccuuaguugaggagcaagacgcuaauuuuguguguaggcggacauuuguagauagaggcuggggaaacgguugcggacuauuugguaaaggaucucugauaaccugugcuaaauuuaaaugcgucaccaaacucgagggcaagaccguucaauacgaaaauuuaaaauauagugucauagugacagugcauacgggagaccaacaucaaguaggaaacgaguccaccgaacacggaacgacugccacuauaaccccacaagcgccaaguacugagauacaauugaccgauuacggugcacuuacauuagauuguaguccuaggaccggacuugacuuuaaugaaaugguauuacucacgaugaaagagaagucguggcuuguucauaaacaaugguucuuagauuuaccauuaccauggacuucgggagcaagcacaagucaagaaacauggaauagaaaagaucuuuuggugacuuucaaaacagcucaugccaagaaacaagaagugguaguguugggaucgcaagagggugccaugcacacggccuuaacaggugcaacugagauccaaaccagcggaacaacuacaauauucgccggacauuuaaaaugcagacucaaaauggauaaauugacgcuaaaaggaaugaguuacguaaugugcaccgggaguuuuaaguuagaaaaagagguugccgaaacccaacauggaacaguccuaguccaaauaaaguaugaaggaacagaugcgccguguaagauaccauucucuacacaagaugaaaaaggaguaacacaaaauggucgacuaaucacggccaacccgauagucacggauaaagagaaaccagucaauauagaagcagaaccaccauuuggcgaaaguuacaucguuauaggagcuggggagaaagcucuaaaauuguccugguucaagaagggaaguucaauugguaagauguuugaagcgacagcucguggggcacggagaauggcuauucuaggugauaccgcaugggacuuuggaagcauaggugguguauucacuucagucggaaaacuuguucaucaaaucuuuggcacagcauacgguguauuguuuucgggagugucauggacaaugaagauaggaauagggguuuugcuuacauggcuagggcucaauucgagaaguaccucucuaaguaugacauguauagcaguaggcuugguaacucucuauuuagguguaaugguucaagcggauucaggaugugucauuaauuggaaaggaagagaguugaagugcgggaguggaauauuuguuacuaacgaagugcauacauggacugaacaauauaaauuccaagcagauucaccaaaaaggcuaucagcagccauugguaaggcaugggaggaggguguuugugguauucguagugcuacacgacuagaaaauauaauguggaaacagauauccaacgaacugaaccacauucuucuagaaaacgacaugaaauucacaguaguagugggagauguugccgguauucuagcacaggguaaaaagaugauaagaccucaaccaauggaauacaaauauucguggaaaagcuggggaaaagcuaaaauuaucggagcugauguacaaaacacaacauucauuauagacggaccuaauaccccugaaugcccagaugaccaaagagcauggaacauaugggaagucgaagauuauggguuugguauauuuacgacaaauaucugguuaaaacuuagggauagcuauacacagguaugugaccacagguuaaugucagcagcaauaaaggacucaaaggcgguacacgcagauauggguuauuggauagaaagcgagaaaaaugaaacuuggaaauuggcaagggcuagcuuuauugaaguuaaaacuuguauauggccuaaaucgcauacacuauggucaaacgguguuuuggaaucagagaugauuauccccaaaauauacgggggaccuauaagucaacauaauuaccguccaggauacuuuacacagaccgcaggaccauggcauuugggaaaauuagaacuugauuucgacuugugcgaaggaaccacaguggucgucgacgaacauugcgguaauagaggcccaagccuacgcacuacaacuguuacggguaagauaauccaugaauggugcugccguucaugcacccuaccaccauuacgauucaaaggagaggaugguuguugguaugggauggaaauaaggccuguaaaggaaaaagaagagaaccuaguaaaaagucuagugucagccgguucuggagaaguagacucguuuagccuaggcuuguuaugcaucagcauaaugauagaagaaguaaugcggagccgauggaguagaaagaugcuuaugacuggcacucuagcgguguucuuccuuuuaauaaugggacaacuuacuuggaacgaccuaauucggcuauguauaauggucggugccaaugcuagcgacagaaugggcaugggaacaacuuaccuagcuuugauggcgacauucaaaaugcgaccaauguucgcgguuggacuguuguuucgacgacuuacguccagagagguguuacucuugacuauaggacuuucuuuaguggcuucgguugaguuaccaaauaguuuagaagaauuaggagacggucuggcuaugggaauuaugaucuugaagcuccuaacggacuuccaaucccaucaacuaugggcaacauuguuaucgcuaacauucaucaaaaccaccuucagucuacauuacgcuuggaagacgauggcaaugguuuugucaauuguuucuuuauuucccuuauguuuaucaacaacaucgcagaaaacuacguggcuaccgguauuacucgggucguuggguuguaaaccacuaacaauguuucugauugccgaaaacaaaaucugggggcgaaaaucuuggccucuaaaugaggguauuauggcgguugguaucgugucgauacuauuaaguagcuuacugaaaaacgaugugccucuugcuggaccacuuauagcgggugguaugcugauagcauguuauguuauuaguggcucaagugcagaucuaucauuggaaaaggcagcagaaguaucaugggaggaagaagccgaacauaguggugcuucgcacaauauauuaguggaaguacaagacgacgggacaaugaagauuaaagacgaggaaagggacgauacucuuacuauauuacucaaggcaacccuacuagcuguaaguggcgucuauccauuaagcauaccugcaacacuuuuuguuugguacuuuuggcagaaaaagaaacaacguuccgggguauuaugggauacuccuucaccgccagaaguugaaagagcaguuuuagaugacggaauuuacagaauuaugcaaaggggacugcuuggaaggucacaaguaggagugggaguguuucaggaaaauguuuuccauacaauguggcacguuacucguggugccguuuugauguaucaagguaaacgauuagagccgucuugggcaagcgugaagaaagauuuaauuagcuacggcggaggauggagacuacagggaucuuggaauaccggugaagaaguacaaguuauagcgguagaaccagguaaaaaucccaaaaauguucagacugcaccaggaacuuuuaaaacaagugaaggagaggucggagccauagcauuagacuuuaaacccggaacuagcggcucucccaucgugaauagggaagggaaaauaguuggccuuuacgguaacgguguaguaacgacgucugguaccuacgucuccgcuaucgcgcaagcgaaagccagucaagaaggcccgcuaccagaaauugaagacgagguguuccgaaaacgaaaucuuacuauuauggauuuacaccccggauccgguaaaaccagacgcuauuuaccggcuauuguaagagaggcgauuaaaagaaaauuaagaacucucauuuuagcgccaacgagaguugucgcaucggagauggcagaggcccuuaaaggaaugccaauccgauaccaaacuacagcugugaaguccgagcauacuggcaaagaaauagucgaccuuaugugucacgccacguuuacuaugagauuguuaucuccaguccgaguuccaaauuauaauaugauuauuauggaugaagcccauuuuaccgauccaaguucaauagcggcgcgaggauauauaucaacaagaguaggaaugggugaagcugcugcuaucuuuaugacagcuacgccaccgggaucuguagaggcuuuuccccagaguaacgcuguaauccaagacgaagaacgagacauaccugaaaggucuuggaacagcggauaugaguggauuacugauuuucccgggaagaccgugugguucguaccauccauuaaaagugguaaugauauagcuaacugucuuagaaagaacgggaagagaguaauccaauuaagucgaaaaacauucgauacagaauaucagaagacgaagaauaacgauugggacuaugucgucacgaccgacauaucggaaaugggugcaaauuuccgagcagacagaguuauagacccaagaagaugucugaagccaguaauccugaaagaugguccugaacgugucauacuggccgguccuaugccagucacaguugccucggcagcgcaacgaagaggacgaaucgguagaaaucauaauaaggaaggugaucaauauauauauaugggacaaccucuaaauaacgacgaagaccaugcacauuggacagaagcgaaaauguuauuggacaacauuaacacuccagaagguauaauaccugcgcuguucgaaccagaaagagaaaaaucugcggccauugauggcgaauaccgacugcguggugaggcucgaaaaacguuuguugaauugaugcguagaggagacuuaccaguguggcuaucguauaaaguggcgucagaaggguuucaauauagugacagaagaugguguuuugauggagaaagaaauaaccaaguauuagaagaaaauauggaugucgagauauggacaaaagagggagaaaggaagaaguuacgaccccgauggcuagaugcucgaacauacucugacccguuagcucuacgugaauuuaaggaauuugcugcaggucggaggucagugucaggggaccuaauacuagagaucggaaaauuaccucaacauuuaacucaaagagcacaaaacgcuuuggacaaccuaguuauguuacauaacagugagcagggugggagagcauaccgacacgcuauggaagaacuuccugacacaauagagacgcuuauguugcuggcgcuuauagccguacucacugguggaguaacacuguucuuucuuucagggcgagggcuagggaaaacaaguauagguuuauuauguguaauggcaucuucaguuuugcuuuggauggcaagcguggaaccacacuggauagccgccucgauaauccucgaguucuuucuaaugguucuccugauccccgaaccagacaggcaaagaacuccacaagauaaucaacucgcauacguagugauuggauuacuuuuuaugauacuaacagucgccgccaaugaaaugggacuccuggaaaccacgaagaaagauuuagggauaggucauguggcaguugagaaucaucaucaugcagcgaugcucgacgucgaucugcauccagcaucggcguggacacuguaugccgucgcaacaacaauuauuacacccaugaugagacacacaauagaaaauacuacagcuaauaucagcuuaaccgcaaucgcuaaucaagcugcgauacucaugggauuagacaaaggguggccuauuucuaaaauggauauaggcgugccuuuauuggcauuaggcugcuacucacaaguaaauccuuugacuuuaacagcugcuguuuuaauguuaguggcgcacuaugcgauaauaggucccggacuacaagccaaagccacaagagaggcgcagaaaaggacggcagcuggcauaaugaaaaauccuacaguagaugguauaguagcuauugacuuggauccuguugucuacgacgccaaauuugagaaacaacuaggacaaauuaugcuacugauacuauguacaucccaaauccuacucaugcguacaacgugggcacuaugugaaucuauuacauuagcuaccgguccacuaacaacccuaugggaggguaguccaggaaaauucuggaauacaacgauugcaguuaguauggcaaacauauuucgcggaaguuaccuugcaggagcagguuuagccuuuucauuaaugaaaucgcuaggagggggaagacgugggaccggugcgcaaggggaaacacuuggagaaaaguggaaaaggcaauuaaaccaauugucgaaaagugaguucaauacauacaaaaggagcgguauaauggaagucgaucgauccgaagcaaaggaaggacuaaaacguggagaaacaacaaagcaugcuguauccagagguacggccaaauuaagaugguuugucgaaagaaauuuaguaaagccugaggguaaaguaaucgaucuuggaugcgggagagggggauggucauauuacugugcaggucuuaaaaagguaacugagguaaaggguuacacaaaaggcggaccaggccaugaagaaccaauuccaauggcaacuuauggauggaacuugguaaaauugcacaguggaaaggacguauucuuuauucccccagaaaaaugugauacgcuuuugugugauauuggugagaguagcccuaacccuacaauugaggagggacgcaccuuacgaguccugaaaaugguagaaccuugguugcgagguaaucaauucuguauaaaaauacuaaauccguauaugccaagcguuguugaaacucuagaacaaaugcagaggaaacauggugguaugcuaguaagaaaccccuuaagucgcaauaguacucaugaaauguauuggguaucuugcgguacaggaaacauuguuagugccgucaauaugacaucacgaaugcuacuaaaucgauuuacuauggcacaucgcaaaccuaccuaugagagagacgucgauuuaggcgcaggaacaagacaugucgcggucgaaccugaggucgcaaauuuagauauaauuggacaaagaauagaaaacauaaagcaugaacacaaaagcacauggcauuacgacgaggauaauccauacaaaaccugggcguaucacggaagcuacgaaguaaagccaaguggaucggccucaaguaugguaaaugguguagugaaauuacuuaccaaaccgugggauguaauuccaauggugacgcaaauagcaaugacggauacaacgccuuuuggacaacagcgcguauucaaggaaaaaguagauacuagaacaccuaaagcuaaacggggaacugcucagauaauggaaguaacagcuaagugguuauggggcuuucuuucuagaaacaagaagccacggauaugcacgagggaagaguucacgcguaaagucagguccaacgcugcaauaggagcuguauucgucgaugaaaaucaguggaacucugcaaaagaagcuguagaagacgaaagauucugggauuuggugcacagagaacgggaacuacauaaacaggguaaaugcgcaaccugcguauacaacaugaugggaaagcgagagaaaaaguuaggggaauuuggaaaagcaaaaggaucucgagccauuugguacauguggcuaggugccagauucuuagaauuugaagcgcugggauuuaugaaugaagaucacugguuuaguagagagaacucauuaagugguguugaaggagaaggacuucacaaacucggcuauauccuucgagacauaucuaaaauccccggcgggaacauguacgcugacgauacagcaggaugggacacgagaauuacagaagaugauuuacaaaacgaagccaaaauaacagacaucauggagccagaacaugcgcuauuagccaaaaguauuuuuaaauuaacguaccaaaacaaggugguaagaguacaaaggcccgcuaagaacgguaccguuauggauguuauaagccgacgcgaccaaaggggaaguggccagguagguacauacggacuuaauaccuuuacaaauauggaagcucaauuaauaagacaaauggagucggaaggaauauuuucgccgagugagcuggaaacaccaaaucucgcaagaagaguauuagauuggcuagagaaacacggagucgaacgauuaaagcgaauggcgauuuccggugacgauugugucguaaaacccauugaugauagauucgcaacagcacuuacggcacuuaaugacaugggaaaaguaagaaaagauauaccccaaugggaacccucaaaaggauggaaugacuggcagcaaguuccuuuuugcucucaccauuuccaucaauuaauaaugaaggacggacgagaaauaguuguaccaugucgcaaucaggacgaacucguaggccgcgcuagggucagucagggggcuggaugguccuuaagagagacggccugcuuagguaagucguaugcacagauguggcaauugauguauuuccauagaagagaucuuaggcucgccgcgaacgccauauguagcgcuguuccgguggauugggugcccacuucaaggacuacauggucaauacacgcgcaucaucaauggaugaccacagaagauaugcuuagcgucuggaaucgcgucuggauagaggaaaaucccuggauggaagacaaaacucacauuucuucuuggggcgauguaccauauuugggaaaacgagaagaucaaugguguggauccuugaucggacuaacagcucgggcuacuugggcgacaaacauacaagucgccauuaaccaggugaggagauugauaggaaaugagaauuaucuggauuauaugacaucgaugaaacguuuuaaaaaugagucagauccugaaggagcacuuugguag

SEQ ID NO: 21468 - RNA, 9879 nt, Artificial Sequence
  derived and/or modified CDS sequence (opt6) from DENV-1__EU677162__SS-prME
aguguaacaauguuauuaauguuaaugccaacagcauuggcguuccaucuuaccacuagagguggagaaccgcauaugauuguuucaaaacaagaacgaggaaaaagccuuuuguuuaaaacaucggcuggagucaacauguguacucuaauagccauggaucuaggagaauuuugcgaagauacuaugacauauaaauguccgagaauaacagaagcggagccagaugauguggauuguuggugcaaugccacugacacuuggguaacauaugguacguguagucaaacuggcgaacauaggcgugauaaaagaaguguagcccuagcgccacacguuggacuggguuuggaaacuagaacagagacauggaugagcucugaaggagccuggaaacaaauacaaagaguugagacuugggcacuccgacauccaggguucacaguaauagcgcuauuucuugcucaugcgaucggaacaucuaucacucaaaaaggcauuauuuucauuuuacuuauguuagugacgccuucgauggcaaugcgaugcguugguauagguucccgggauuuuguagaaggacuuuccggggcaacauggguagacguaguccuagagcacgguucuuguguuacaacaauggcaaaagauaaaccaacuuuagauauagaacuauuaaaaacagaagucacuaauccagcuguacuaagaaaauuauguauagaagcuaaaauaagcaauacuacgacggauucuagaugccccacacaaggugaagcaacccuggucgaagaacaagacgccaauuucgucugucgacgaaccuuuguugauagaggaugggggaacgguugugguuuguuuggaaaaggaucauuaauaacaugugcaaaauucaaauguguuaccaaguuggagggaaagauuguucaauacgagaaucuaaaguauucaguaauaguuacaguucauacaggcgaccaacaucaagucggaaaugaaucuacagaacaugguacaacugcuacaauaacuccccaagcgccuaguacagaaauccaguuaacggacuauggagcacugacguuagacuguucaccucgaacgggguuggauuucaaugaaaugguacucuuaaccaugaaagagaagucgugguuggugcacaagcaaugguuuuuagaccuuccuuuaccuuggacuucgggggcaucgacuagccaagagacauggaauagaaaagaucuauuaguaaccuucaagacggcucacgcgaaaaagcaagaggucguuguauuagggagucaagaaggugcaaugcacacagccuugacgggagccacggaaauacaaacaucugguacaaccacuaucuucgcgggucaccuaaaguguagauugaaaauggauaaauuaacacugaagggaaugucguauguaauguguacgggaucguucaaacuugaaaaagaaguagcggagacccaacacggcacgguauuaguucaaauaaaauaugaaggaacagaugcaccguguaagauacccuuuucaacucaagacgagaaaggagugacucaaaacggacgccuaauaaccgcuaauccuauaguuacagauaaagagaaaccagugaacauugaagcagagccucccuucggagagucguauauaguaauaggcgcaggcgaaaaagccuuaaagcugucgugguuuaagaaaggcucaucaauaggacguauguucgaagccacggcgagaggagcaagacggauggcaauauugggagauacagcaugggacuuugguuccauuggcgguguauuuacguccgugggcaaauuaguacaucagauauuugggacugcauaugguguauuauuuaguggcguuaguuggacuaugaaaauagguauagguguuuuacuuaccugguuagggcuaaauucacgaucuaccucauuaucaaugacaugcaucgcuguaggcuugguuacuuuauauuuaggggugaugguucaagcugacucgggcuguguuauaaacuggaaaggcagagagcuaaaaugcgggagcggaaucuucguuacgaacgaaguacacacuuggacagagcaauauaaguuucaagccgauucgccuaaacgacuuucagcagcaauagguaaggccugggaagaaggaguuugcgggauucgcagugccacucgauuagagaacaucauguggaaacaaauaagcaacgagcucaaucauauacuccuugaaaaugauaugaaauucacugucguagugggggauguugcgggaauauuggcacaaggcaagaaaaugauaagaccgcagccuauggaauauaaauauaguuggaaaucguggggcaaggcaaaaauuauaggagccgacguucaaaauacaacuuucauaauagacggaccaaacacaccagaaugcccagacgaucaacgggcauggaauauaugggaaguggaagauuacgguuuuggaauuuuuacaacaaacaucuggcuuaaacuccgcgauaguuauacucaaguuugcgaucacagauuaaugucagcggcgauuaaagacagcaaagccguacacgcagacaugggguauuggauugaaagugagaaaaaugaaacuuggaaauuagcccgcgcauccuucauugaaguuaaaacaugcauauggccaaagucgcauacauuauggucaaacggaguauuagagucugaaaugauaauacccaaaauauacggagggccgauaucacaacacaacuauaggccaggguacuuuacucagacugccggaccuuggcaccuaggaaaauuagaauuagauuuugaccucugcgaaggaacgacgguaguuguagaugagcauugcggcaaucggggaccgucgcuuagaaccacaacagugaccgggaaaauaauucacgaauggugcugucgcagcuguacacuuccuccacuaagauucaaaggagaagauggauguugguacggcauggaaauaagaccuguaaaagaaaaggaagaaaaccuuguaaaaagcaugguaucugcggggucaggagaagucgacucauuuaguuuaggccuguuguguauaagcauuaugauagaggagguaaugcgcaguagauggucaagaaagauguuaaugacugggacacuagcaguauucuuucuuuuaauaaugggacaguuaacauggaacgaccuaauucgucucugcauuaugguaggagcaaaugcuucugauaggauggguauggggacaacauaucuugcuuuaauggcaacuuucaagaugaggccaauguucgcagucggucuacucuuuagacgguuaacaucucgagaaguucuucuucucaccauaggacucagcuuagucgcuucaguugagcuaccaaauucgcucgaagaauuaggagauggguuagcgauggguauaaugauauuaaaauuauugacggauuuccaaucacaucaauuaugggcuacucuccuuucacuuacauuuauaaagaccaccuucagccugcauuaugcauggaaaaccauggcaaugguucuaucgauaguaagucuauuuccauuaugucugagcacuaccagccagaaaacgacguggcugccaguucuauuggguuccuuaggauguaaacccuuaacgauguuucuaauagcagagaacaagauauggggcagaaagagcuggccguugaacgaaggcaucauggcaguuggcaucguaaguauacuguugaguucacuacugaaaaaugauguuccauuagcuggaccauugauagcaggagggaugcugauagcgugcuacgugaucagugggucaucugcggacuuaucauuagaaaaagcagcugaaguaucaugggaagaagaggcggaacauuccggggcaucacauaauauuuuagucgaaguacaagaugaugguacaaugaaaauaaaagaugaggaacgagacgauacauuaacgauuuuguuaaaagcaacucuucuugcaguuucaggaguguauccccucucaaucccagcaacguuauucguuugguauuucuggcagaaaaagaaacaaagaagcggaguauugugggauacgcccagcccaccagaaguugaaagagcagugcuugacgaugguauauauagaaucaugcaacgaggacuguuaggucgaagccagguagguguaggaguguuucaagaaaacgucuuucauacuauguggcauguaacuagaggugcaguguuaauguaccaaggaaaaagacuugaaccuagcugggcuagcgucaagaaagaucuuaucagcuacggaggaggauggcgucuacagggaucauggaauacaggcgaagaaguucaagugauagcaguugaaccugguaaaaaccccaaaaacguacaaaccgcgcccggcacguucaaaaccucugagggugaaguuggggcaauugcuuuagacuuuaaaccuggcacuucuggaaguccaaucguuaaucgggaggggaaaauaguaggccuauacgguaauggagucgugacuacuucuggaacauacguaagugcuauugcacaggcgaaagcgagucaagagggcccgcuuccggagauugaagaugaaguuuuccguaagagaaaucuaaccauaauggaccuucauccaggaucaggcaaaaccagacguuacuuaccggcuauaguaagagaagccaucaagagaaaauuacggacucuuauauuagcgccuacaagaguuguugcuuccgagauggcggaagcauuaaaagguaugccaauaagauaccaaacuacugccgucaaaucggaacauacagggaaagaaauaguagaccuaaugugccaugcaacauuuacuaugcggcuauuaucucccguacgcguaccaaacuauaauaugauuauaauggaugaagcacacuuuacagacccuucuaguauugcagcacgaggauacauaagcacccguguagggaugggcgaggcggcggcgauauuuaugaccgcaaccccgccaggaucggucgaggcauuuccccaaaguaaugcaguuauccaagacgaagaaagagauauuccagaacguagcuggaacucgggauaugaauggauaacggauuuucccgguaaaacagugugguuuguaccuucuauaaaauccggaaacgacaucgcaaauuguuugaggaaaaauggaaaacguguaauacagcuuuccagaaaaacauuugacacagaauaucagaaaaccaaaaauaacgauugggauuauguuguuacaacugacauaagugagaugggagcgaauuucagggcagaccgcgucaucgauccacgcagaugucuaaaaccuguaauacugaaagauggaccugaaagggucauacuagcagggccaaugcccguaacagucgccagcgcagcacaacgaaggggaagaaucgguagaaaucauaauaaagaaggggaucaauauauauauaugggacaaccguugaauaacgacgaggaucacgcgcauuggacugaagcgaagauguuacuggacaauauuaauacaccugaaggaauaauaccagcacucuuugaaccagaacgagaaaaauccgccgcuauagauggagaauaucggcuaaggggagaagcacguaagacauuuguggaauuaaugagacguggugauuuaccuguaugguuaucauacaagguagcuucugagggcuuucaguauucagacagaagaugguguuuugauggagaaaggaauaaucaggucuuagaagagaauauggaugucgaaauauggacaaaggagggcgaaaggaagaaacuucguccuagguggcucgaugccagaacuuacagcgauccuuuggcguuacgagaauuuaaagaauuugcagcuggaagaagaaguguaagcggagaucucauauuggagauagggaaauuaccucaacauuuaacucaaagagcucaaaacgcguuggauaauuuagucauguuacacaauucugaacagggcggccgugcauaucgucaugcuauggaggaacuuccagauacgauugaaacguugaugcuucuugcacucaucgcgguacuaacggguggcgucaccuuauuuuuccugucaggacgcgggcuugggaaaacaaguauaggcuuacuuuguguaauggcauccaguguacuuuuauggauggccucuguugaaccacauuggauugcagcaagcauaauucucgaguucuuuuuaaugguacuucugauaccagaaccagaucgacagaggaccccacaagacaaucaacuggcauaugucgucaucggacuacuuuuuaugauucuuacuguugcggcaaaugaaaugggacuuuuggaaaccaccaagaaagacuuagggaucggacauguagcaguugaaaaccaccaucaugcagcaaugcuagauguugaucuucacccugcgucagcauggacgcuguaugcgguagcaacuacuauuauuaccccaaugaugaggcauacaauagagaauacuacggcaaauauaucauuaacugcaauugcaaaucaagcagcaauauugaugggccuagauaagggauggccaauuucuaagauggacauuggagucccauuauuagcgcuuggauguuauucgcagguaaauccucuaacucuaacugcugcaguccuaauguuaguggcacacuacgcgauuaucgguccugggcuacaagcaaaagcuacgagagaggcacagaaaagaaccgcggcagggaucaugaaaaaucccacaguagaugguauuguagcuauugaccuagauccgguaguauacgaugccaaauucgagaagcaacuuggacaaauaauguuacuaaucuugugcacgagucaaauauuauuaaugagaacuacgugggcacuuugugagucaauaacucuagccacaggaccucuuacaacacuuugggaaggaaguccgggcaaauuuuggaauacaacaauagcuguuaguauggcgaacaucuucagaggcagcuacuuagcgggagccggacuugccuuuucacuuaugaaaagccucgggggcggccgcaggggaacuggagcgcaaggagaaacccuaggugaaaaauggaagcgucaauugaaucaacuuaguaaaucugaguuuaacacauauaaaagaaguggaauuauggaggucgacagauccgaggcuaaagaggggcucaaaagaggagaaacaacgaaacaugcaguuagcagaggcacagcaaaauuacgaugguucgucgaacgaaaccuuguuaaaccugaaggaaaagucauagaucuugguugugguagagguggguggucuuauuacugcgccggauuaaagaagguuacugaaguuaaaggauacacaaaggguggaccuggacaugaggaaccuauaccuauggcuacguacggauggaauuugguuaaguugcauucgggaaaagaugucuucuuuauaccacccgaaaaaugugauacccuucuaugugacauaggagaaagcagcccaaauccaaccauagaggaagggagaacgcuaagaguccugaaaaugguggaaccauggcuucgaggaaaucaauuuuguauuaaaauacugaacccauacaugccuagcguaguugaaacacuagaacaaaugcaacgaaaacacggcggaauguuagucagaaauccauugaguagaaauucaacacaugaaauguauuggguaucauguggcaccgguaacaucgucagcgccguuaauaugacaagccgcaugcuguuaaauagauuuacuauggcucauagaaagccaacguaugaaagagauguagauuugggggcagguacaagacacguugcuguggagccagaaguagcgaacuuggauauuauugggcaacggaucgaaaauauaaaacaugaacacaaaucaacguggcacuaugacgaagacaauccauauaagaccugggcauaccaugggaguuaugaaguaaaaccaucaggaucagccucgaguaugguaaauggaguugucaaguuauuaacaaaaccuugggauguaauucccauggugacccagauagcuaugacagauacuacccccuucggacaacaaagaguauucaaagaaaagguagauacccgaacaccgaaggcuaaaagaggcacagcacaaaucauggaaguaacagcaaaaugguugugggguuucuuaucaagaaacaagaagccgcgaauuuguacaagggaagaguuuacgagaaaaguucgaaguaaugcagcaaucggagcagucuuuguagacgaaaaucaauggaacucagccaaggaagccgucgaagacgaacguuuuugggacuugguucauagagagagagaguuacacaaacaagggaaaugcgcaacgugcguauauaauaugauggguaaaagagagaagaaacuuggugaauuugggaaagcaaaaggcucgcgugcaauaugguauauguggcuuggagcgcgcuucuuagaauuugaggcuuuggguuuuaugaacgaagaccauugguuuaguagagaaaacuccuugucuggaguugaaggagaaggauuacauaaacuaggauauauacugagagacaucuccaagauacccgggggaaacauguaugcagaugacacugccgguugggauacacguauuacagaagaugauuugcaaaacgaggcaaagauuacagauauaauggagccagaacaugcccuccucgcgaaaucgaucuuuaaauuaaccuaucaaaauaaagugguccgaguacaacgaccagcuaaaaaugggacugugauggauguaauauccagaagagaccaacguggaucaggacagguggggaccuacggucuaaauacuuuuacgaauauggaggcccaauuaauaagacagauggagagugaaggaauauucucuccuuccgaauuagaaacgccuaaccuagcugguagaguuuuggauuggcuagagaaacauggggucgaaaggcugaaaagaauggcaaucagcggagacgauugcgucguuaaaccgauagaugaucgguuugcuacugcacugacagcacugaacgauauggggaaaguaaggaaagacaucccgcaaugggaacccagcaaaggguggaaugauuggcaacaagucccguuuugcucacaucauuuccaucagcuaauaaugaaagauggccgcgaaaucguuguacccugcaggaaucaagaugaacuuguuggcagagcacgggucagccagggagcugguuggucucuacgagaaacagcuugccuaggaaaaucuuaugcucaaauguggcaauugauguacuuucaucgucgagaucuacggcucgcggcaaaugccaucuguucugcgguuccaguugauuggguuccaaccucaagaacgacguggaguauucaugcccaucaccaguggaugacgacagaagauaugcuaaguguauggaacaggguauggauugaagaaaacccuuggauggaggacaagacccauauaucaucguggggugacgucccuuaccuggggaaacgagaagaucaaugguguggaucccuaauaggucuuacagcucgugcuacgugggcuacaaacauccaaguugccauuaaucaagugcguagauuaaucgggaacgagaacuacuuagacuauaugacuucaaugaagagauuuaaaaaugaauccgauccagagggcgcacuuugguaa

SEQ ID NO: 21469 - RNA, 9879 nt, Artificial Sequence
  derived and/or modified CDS sequence (opt6) from DENV-1__EU677164__SS-prME
aguguuacgaugcuauuaauguuaaugccaacagcuuuagcauuucaccucacaaccagaggaggagaaccacauaugaucgugagcaaacaagagcgcggaaaaagccuuuuauuuaaaacgucagcaggagugaauaugugcacucucauugcaauggacuuaggagaauuuugugaagacacgaugacauacaaauguccaagaauaacagaagcagagccagacgacguugacuguuggugcaaugcaacagacacauggguaacuuacgggacauguucacagacgggagaacaucgccgugacaaacgaaguguagcuuuagcaccacacgugggacuuggucucgaaacacguacggagaccuggaugagcucggaaggugcuuggaaacaaauacaacggguagaaaccugggcguuaagacauccuggauuuacuguaauagcucuauuucuggcucacgccauuggaacuucuauuacacaaaaaggaaucauuuucauacuguugaugcuggugacuccaucaauggcaaugagauguguuggaauaggaucucgagacuucguagaaggacuuuccggagcgacaugggucgacguuguacucgagcauggaucuuguguuacgacgauggcaaaagacaaaccuacucuugauauagaacuuuugaaaacugaagucacuaauccggcuguacuacguaaauuaugcauagaggccaaaauauccaauacuacuaccgauaguagaugucccacacagggugaagcaacguuaguggaagaacaggacgcaaauuuuguuugucgaagaaccuucguugauagagguugggggaauggauguggccuauuuggcaaaggaucucuaauaacuugugcaaaauucaaauguguaacaaaauuagaagguaaaacuguacaauaugaaaaucugaaauacaguguaauaguaacaguucauacaggcgaucagcaccaagugggaaacgaguccacagaacauggaacaacagcaacaauaacuccgcaagcaccaucgacggaaauacaacuaacagacuauggcgcuuugacuuuagacugcucgccaagaacaggacucgauuucaaugaaaugguuuugcuaaccaugaaggaaaagagcuggcucgugcauaagcaaugguuccuagacuuaccuuuaccauggacauccggcgccucgacuagccaagagacuuggaauagaaaagaucuccuaguaacuuucaaaacggcacacgcuaagaaacaggaaguagugguccuaggcagucaagaaggagcaaugcacacagcauuaacuggagccacggaaauucaaacuuccgguacaacuacuauauuugcuggccaccuuaaauguaggcuaaagauggacaaacuaacuuuaaaaggcaugaguuacguaauguguacugguaguuuuaaauuggagaaggaaguagccgagacucagcaugguaccgucuugguacaaaucaaauacgaaggcaccgaugccccuugcaagaucccauuuucaacacaagaugaaaaaggaguuacucagaauggacgucuaauuacugccaaccccaucgucaccgauaaggaaaaaccaguaaauauagaagcugagccuccauuuggagaaaguuauaucguaauaggagcgggggaaaaggcacuaaagcuguccugguuuaagaaagguaguagcauugguaagauguucgaagcuacagcaagaggggcccgacguauagcaauauuaggagauacagcuugggacuucggaagcauaggaggaguuuuuaccucuguuggaaaacuugugcaucagaucuucggaaccgccuacgguguacuauuuucgggagugucauggacaaugaaaauuggcauuggcguacuacuuacauggcuaggcuuaaacucaagaaguacuagcuuaucaaugacguguauagccguaggcuuggugacccuauaucucgggguuaugguacaagcugauuccggauguguuaucaacuggaaaggaagggaauugaaguguggaucagguauauuugugacaaaugagguacauaccuggaccgaacaguauaaguuucaagccgacagucccaaaagauuaucagcggcuauagguaaggcuugggaagaaggaguauguggaauacguuccgcgacaagauuagaaaauaucauguggaaacaaaucaguaaugaauuaaaccacaucuuauuggaaaaugauaugaaauuuacaguuguuguaggugauguagcuggaauuuuagcgcaaggaaagaaaaugauaaggccccaaccaauggaauauaaauauaguuggaagucgugggggaaagcuaaaaucauaggagcagacguacagaauaccaccuucaucauagauggccccaauacuccagaauguccagaugaucagagggcuuggaauaucugggaaguugaggacuauggguucggaauuuuuacuacaaacaucugguuaaaacuaagggacaguuauacgcaaguuugugaucauagacuaaugucggcagcuauaaaagacucuaaggcaguacaugcugauaugggauacuggauugagagugagaaaaaugaaacguggaaguuagcccgagcaucuuucauagaaguuaaaacuuguauauggccaaaaucccauacacuuuggucaaacgguguccucgaaagcgaaaugauaauacccaaaaauuauggagggccuauaucucaacacaauuauagaccaggauauuucacccagacagcuggacccuggcauuuaggaaaauuagaacuagacuucgauuugugcgaagguacaaccguaguuguugaugaacauuguggaaaucgaggacccagccugagaacuacgacaguaacaggaaagauuauucaugagugguguuguagauccuguacauuaccaccucuaagauucaaaggagaggauggguguugguacggaauggaaauaagaccaguuaaggaaaaggaagaaaauuuagucaaaucgaugguuucugcugguaguggagaaguugauagcuuuagucugggucuccuuuguauaucaauaaugaucgaggaagugaugaggucaagguggucuagaaagaugcucaugacaggcacacuggcgguauuauuucuacuaaucaugggucaacuaacauggaaugauuuaauccgacuuuguauaaugguaggcgcuaacgcuucugaccgcaugggaauggggacgaccuacuuagcucuaauggcaaccuuuaaaaugagaccuauguucgcuguaggucuccuauuuagaagacuuacuuccagagaaguacucuuguugacaauaggucugucucuaguagcaucagucgaauugcccaauucgcucgaagaacuaggugauggauuggcuaugggcaucaugauuuuaaaacuauuaaccgacuuucaaagccaucaacuaugggcaacuuuacucucacugacguucauaaaaaccacauucagucuucacuaugcauggaagacaauggcgaugguacugagcaucguaagucuauuuccguuaugucuauccacaacgucucagaagacaacaugguuaccaguccuccuagggagucuagguuguaaaccauuaaccauguucuuaaucgcggaaaauaaaauauggggacggaaaaguuggccucuaaaugaagggaucauggcagucgggauugucaguauuuuacuaucuagucugcugaagaaugaugugccucuagcaggcccacuaauugcuggagguaugcuuauagcaugcuacguaauauccggcucgucagcagaucugucccuagaaaaagcugcagagguaucuugggaggaagaagcugaacacaguggagcaucucauaauauacuuguugagguacaagaugacggcacaaugaaaaucaaagaugaagaacgagaugacacacuaacuaccuuacuaaaagcgacgcuuuuagcggugagcggaguauacccacuuucaauaccugccacacuuuucguaugguacuucuggcagaagaagaaacaaagaucuggaguucuaugggauacacccuccccucccgaaguagagagagcaguguuagacgauggcauuuaucgaauaaugcagcggggacucuuaggaaggucgcaaguagguguuggaguguuucaagagaacguauuucauacaauguggcacguuacaaggggugcaguucuaauguaucaaggaaaaagacuagaacccucaugggcuaguguuaaaaaggauuugauuaguuacgggggaggauggagauugcaagggucuuggaacacuggugaagaaguacaaguuaucgcagucgagccaggcaaaaauccaaagaauguccagacagcgccaggaaccuucaaaacgagugaaggagaaguuggugcuaucgccuuggauuuuaaaccggguacaaguggaucaccgauuguuaaucgagagggcaaaauuguuggauuauacggcaauggggucguuacaacuagcgguacuuacguaagugcaauagcacaagcaaaagcgucacaggaaggaccuuuaccagaaauagaagaugaagucuuuaggaaacgaaaccuaacaauaauggauuuacaccccgguaguggaaaaacacgaagguaccuuccagcaauuguacgugaagcgauaaaaagaaaauugcggacacuaauacuagcccccacucgagugguagcgucagaaauggcagaagcguugaaagguaugccuauuagauaucaaacuacugcagugaaaagugagcacacuggaaaagaaauagucgaucucaugugucaugcuacauuuacgaugaggcuccuaucaccugucagaguaccaaacuacaauaugauaauuauggacgaagcucauuucaccgacccuucuaguauugcagcccgugguuauauauccacgcguguaggaaugggugaggcagcagcuauuuuuaugacugcuacaccgccaggaagcgucgaggcuuuuccccaaucgaaugccguuauucaagaugaagaaagagauauacccgaacgaaguuggaacagcgguuacgaguggaucacugacuuucccggcaaaacaguaugguuugugcccagcauaaagucugguaacgacauagcaaauugccugaggaaaaacggaaaaaggguaauacaauuaagucgaaaaacauucgauaccgaguaucagaaaaccaaaaauaacgauugggacuauguaguaacaaccgauauauccgaaaugggugcaaauuuccgagccgaucgagucauugauccaaggcgaugccucaaaccugucauccugaaagacgguccugaacgugucauccuagcagguccuaugccagugacuguugcaagcgcagcgcagagacguggcagaauaggccgaaaucauaacaaagaaggagaucaauacauauauaugggucaaccauuaaauaaugacgaagaccaugcucacuggacugaggcgaaaaugcugcuagauaacauaaacacgccggaagguauuaucccagcacuauuugaaccagagagggagaaaucagccgccauugacggagaguaucggcucagaggagaagcaagaaaaaccuuuguggagcuaaugcgcaggggugaccugccaguguggcuaaguuauaagguagcuucugaaggguuucaauacucugauagacgauggugcuucgauggggagcgcaacaaccaaguccuggaagagaauauggacguagaaauuuggacuaaggaaggagaacggaagaaacuacgcccaagauggcuggaugcuagaacauauagcgauccuuuggcccuuagagaauuuaaagaguucgcugcggggcgaaggucaguaucaggugauuuaauacuugaaaucggaaaacugccacaacacuuaacgcaaagagcacaaaaugcgcuggauaauuuaguuauguugcauaacuccgaacaaggagggcgagcauacagacaugcgauggaggagcugccugacacgauagaaacacucaugcuacuagcacuaaucgcuguacuuacugguggugucacacuauucuuuuuaagcggaagggguuuagguaaaaccucuaucggucuacuuugcgugauggccucauccgucuuauuauggauggcuucaguugaaccacacuggauagcugcaaguauuauucuagaauuuuuccuaaugguauuguuaauaccugagccggauagacaaagaacaccucaagacaaccaauuagccuacguuguaauagguuuacucuucaugauuuuaacagucgcugcuaaugagauggggcugcuggaaacaacgaagaaagaucuagguauaggacacguugcggucgaaaaucaccaccaugccgcaaugcuagauguugaccuacacccugcaucagcguggacuuuguaugcuguagcaacgaccaucauuacaccaaugaugcgacauacaauugaaaauaccacagcuaauauaagucucaccgcgaucgcaaaccaggcggccauuuuaaugggacuggauaaaggguggccuauuaguaaaauggacauaggcguuccgcuauuagcucucggauguuacucacaggugaauccguuaacccuuacagccgcuguguuaauguuaguagcacauuacgccaucauuggcccuggucuacaagccaaagccacuagagaagcacaaaaacguacagcagcaggcauaaugaaaaacccuacaguagacggaauuguugccaucgacuuagaucccguaguauaugacgcuaaguuugaaaaacaacucgggcaaauuaugcuacucauucuauguacuucgcaaauauuguuaaugagaacaacgugggcucuuugugaaagcauaacucucgccacaggaccacuaaccacgcuaugggaaggcucuccagggaaauucuggaauacuacuauagcuguaucaauggccaacaucuucaggggcucuuaccucgcaggagccggucuagcuuuuucgcuuaugaagagucuaggagggggccgacgggggacaggagcacaaggcgaaacacuaggggaaaaguggaaaagacaacuuaaccaguuaaguaaaucggaguucaauacuuauaaaagaagcgguaucauggaaguagauagaucugaggcuaaggagggacuaaagagaggcgaaaccacuaaacaugcaguuucccguggaacagcaaaauugagaugguucgucgaacguaauuuaguaaaaccugaaggcaaaguaauagacuuaggaugcggaagaggcggauggagcuauuacugcgccggauuaaagaaagucacagaaguaaaagguuauacaaagggaggcccaggccaugaagaaccgauacccauggcuacuuacggauggaacuuaguaaaguugcacagcggaaaggacgucuucuuuaucccaccggaaaaaugcgacacccuacuaugugacauaggagaaucaucaccuaauccgacaaucgaagaaggucgaacacuacgcguacugaaaauggucgagccauggcuacguggaaaucaauuuugcauaaaaauauugaauccuuacaugccuucgguagucgagacuuuggaacaaaugcagcgaaaacauggaggcauguugguccguaacccuuuaucuagaaacaguacgcaugagauguacuggguaaguugcgguacaggaaacauuguaucagcaguaaauaugaccucgcgaauguuguuaaaucgauuuaccauggcucaucgcaaaccuacguacgagcgcgauguugacuuaggugcuggcacucgucaugucgcuguugaaccagaaguugcaaacuuagacauaauugggcaacgaauugagaacauuaaacaugaacacaagucgacguggcacuaugaugaggacaauccguauaaaacuugggccuaucacggaucauacgaaguuaaaccgucaggaucagcuucgagcaugguuaauggcguaguaaaguuacuaacaaaacccugggaugucauaccuaugguaacccaaauagcaaugacagauaccacacccuucgggcagcaaagaguauucaaagaaaaagucgauacacgaacuccuaaagcaaaacgugguacugcgcaaauuauggaaguaaccgccaaauggcuguggggauuuuuaucacguaauaagaaaccgcgaauauguaccagagaagaauuuacgcguaagguacguagcaacgccgcaauuggagcaguauucguagacgaaaaucaguggaacucugcuaaggaagcgguagaagaugaacgguuuugggaucucgugcaccgugagagagaacugcacaaacaggguaaaugcgcgacaugugucuacaauaugauggggaaaagggagaagaaacuaggagaauuuggcaaagccaaaggaagucgugcaauuugguauaugugguuaggugcacgauuccuagaauuugaagcccuaggauucaugaaugaagaucacugguucucaagagaaaauucgcuuagcgguguggaaggugaagguuuacauaaacucggcuacauacugagagauauaagcaaaauucccgguggcaauauguaugccgaugauacagcagguugggauacccgaaucaccgaagaugauuuacaaaaugaagccaagauuacagauauaauggaaccugaacacgcacuacucgcaaaauccauuuuuaaacuaaccuaucagaauaaaguugucagaguucaaagaccagcaaagaauggaacaguaauggauguaauauccaggagagaucaaagaggaucgggccaaguaggcaccuacggacuuaauacauucacuaacauggaagcacaacucauaaggcagauggaaucugagggcaucuuuaguccaagugaauuagagacucccaaccuagccggacgaguacuugauugguuagaaaaacaugggguagaacgauuaaaaagaauggcaauuucgggagaugacugcgucgucaagccaauugacgauagguucgcuacagcccuaacagcgcuuaaugacauggguaagguaagaaaggacauuccucagugggaaccaaguaaggguuggaaugacuggcaacaagucccguucugcucccaucacuuucaccaacugauuaugaaggauggaagagagauugucguaccuugcagaaaucaggacgaacuuguuggcagagcucgaguaagucaaggugcggguugguccuuacgugaaacagcgugcuugggaaaaucguaugcucaaauguggcaacuaauguauuuccaccggagagacuuacgauuagcagccaacgccaucuguagugcaguuccugucgauuggguacccacgucaagaaccacguggucaauacacgcacaucaucaauggaugaccacagaagacauguuaagugucuggaacagaguuuggauugaagaaaauccauggauggaagauaagacucauauaagcucauggggagauguaccuuaucucggcaagcgagaagaucaaugguguggcucgcuuaucggguuaacugcacgagcuacuugggcuacgaacauucaagucgcuauuaaccaagugagacgacuaauuggcaacgaaaauuacuuagauuauaugacaucuaugaaaagguuuaaaaacgaaagcgacccagagggagcacuaugguaa

SEQ ID NO: 21470 - RNA, 9879 nt, Artificial Sequence
  derived and/or modified CDS sequence (opt6) from DENV-1__EU677165__SS-prME
ucggucacuauguuauuaaugcucaugccuacugcacucgcauuccauuuaacaacacguggaggagaaccgcacaugauaguuagcaaacaagaacgaggcaagucauuacuauucaagacaucagcggguguaaauauguguacuuuaauugcaauggaucuaggcgagcuaugcgaagacacgaucacauauaaguguccgcguauaacagagacugaaccagaugauguagacuguugguguaaugcaaccgauacgugggucacuuacggaacaugcucccaaacaggagaacacaggagagacaagagaagcguagcacuugcaccacauguaggauugggucuagaaacacgcaccgagaccuggaugucuagugaaggagcauggaaacaaauacagcgugucgagacaugggcacugaggcacccaggguuuacaguuauagcccuauuccuagcucaugccauagggacaaguauuacucaaaaaggaauuaucuuuauucuuuuaaugcuagccacaccuucuauggcaaugaggugugucggaaucggcaguagagacuucguagaggguuuaaguggcgcuacguggguugauguaguuuuagaacauggcagcugugucacaaccauggcgaaagauaagccgacacuagauauagaguuacugaagacagaaguuacgaaccccgcaguucuucgaaaacuauguauagaagccaaaaucucaaacacuaccacagauaguagguguccgacucagggagaggcaacgcuuguagaagaacaagacgcgaauuuuguaugcagacgaaccuuugucgacagagguuggggaaacggaugcggccuuuuuggaaaaggaagucuaauaacaugugcaaaauuuaaaugcgugacuaagcuagagggaaagauaguacaauaugaaaaccuaaaauauucagugaucgugaccguacacacaggcgaucagcaccagguugguaaugaaucuaccgaacaugguacaacagcaacgauuacaccucaagcaccuacuacugaaauacaauuaacagacuauggagcguugacgcucgauuguaguccccggacaggucuggauuucaaugaaaugguacuauugacaaugaaagagaagucguggcucguucauaaacagugguuucuggauuugccgcuuccauggacgucaggggcgaguacaagccaagaaacuuggaaucggcaagauuuacuuguaacuuuuaaaaccgcgcaugcgaagaaacaggaaguaguagugcuaggcucucaagagggugcaaugcauacagcuuuaaccggagcgacagaaauacaaacaucagguacuacuacuaucuuugcaggucauuugaagugccgguuaaagauggauaaacuaacacuuagaggaaugucuuacguaauguguacaggcaguuuuaaguuagaaaaagaaguugccgaaacucaacacgguacagucuugguccagauuaaauaugaagguacagacgcuccauguaaaauaccuuucuccacgcaggaugaaaaaggaguuacccagaauggacgccucauaaccgcuaauccgauaguuacugauaaagaaaaaccuguuaacauagaggcagaaccucccuuuggagaaaguuauaucguaaucggagcuggugagaaagcacuaaaacuuagcugguucaagaaaggcucaaguauagguaagauguuugaagcaacagcgagaggggcaaggcgaauggccauucuuggagauaccgcuugggauuuuggaucuauaggcggaguuuuuacgucgguugggaaauugguccaucaaaucuucggcacagcauacggaguccuguucucugguguuucuuggacaaugaagauaggaauaggggugcuguuaacuuggcugggucuaaacagccgguccacuucucuuucaaugacuuguaucgcaguuggucuggucacccuauacuugggaguaaugguacaagcggauucaggaugcguuaucaacuggaagggaagggaauuaaaauguggaucggguauauucguaacaaaugaaguacauacuuggacagaacaauauaaauuucaagcggauucaccaaagagguuaagcgcagcuauagguaaggcaugggaagagggaguaugcgguaucagaucggcaacucgacuagaaaacauuauguggaagcaaauaucaaacgagcuuaaucacauuuugcuagaaaacgauaugaaguucaccgucgucguuggggacguagcugguauacucgcacaagggaagaaaaugauaaggccacaaccaauggaacacaaguacaguuggaaaagcuggggcaaggcaaaaauaauaggagcagauguccaaaacaccacuuuuauuauagacggaccaaacaccccagaguguccggaugaucaaagagccuggaacauuugggaggucgaagauuacggauuugggauuuuuacaaccaauauuugguugaaauuacgagacucguauacacaaguuugcgaccacagauuaaugucugcugcgaucaaagacucaaaggccguccacgcagauaugggcuauuggaucgaaucagaaaagaaugagaccuggaagcuagccagagcuucuuuuauugagguuaaaacuugcauauggccaaaaucgcauacucuuuggagcaaugguguauuggaaucagagaugauaauaccaaaaauauacggcggucccauaucacaacacaacuaccgcccaggcuacuucacucaaacugcgggcccuuggcaucucggaaaacuugaacuggacuucgauuuaugcgaagguacaacuguuguuguagacgagcauugcgggaauagaggcccaucauugaggacaacaacaguaacgggaaaaaucauacaugagugguguugcagaucaugcacacuuccgccgcuaagguuuaggggugaggacggauguugguacgggauggaaauucgaccggucaaggaaaaagaggaaaaucucguuaaaucaaugguuagcgcaggcagcggcgagguagacaguuuuagccucgggcuucucuguauuaguauaaugauagaggaaguuaugcgaucacguuggucaagaaaaauguuaaugacaggaacguuagcuguauucuuuuuacuaauaaugggacaauuaacuuggaaugauuuaauaagauuauguauuaugguaggcgcuaacgcaagugauagaauggguauggggaccacguaccuggcccuuauggcaacguuuaaaaugagaccaauguuugcaguaggacuauuauuccguagauuaacuucacgcgaaguucucuugcugacaaucgguuuaucacucguagccucuguugagcuuccaaauaguuuagaagaauugggugacggucuugcgauggggauaaugauauugaaacucuuaacagauuuucagucccaucaauuaugggcaacgcuacuuagucucacauucaucaaaacaacauuuagucuccauuaugccuggaagacgauggcgauggugcuuagcauugugagucuguuuccacuauguuuaucgaccacaucccagaaaacgacgugguuaccaguauugcuagguagccuagguuguaaaccguugacuauguuccucauagccgagaauaaaaucuggggcagacgaucuuggccuuuaaaugaaggcaucauggcgguggggauuguaucaauccuguuguccucccuauugaaaaacgaugucccucuagcuggaccauuaauagccggcggaaugcuuaucgcguguuacgugauuagugguaguucugcggaccuaucacucgagaaggccgcagaaguaagcugggaagaggaagcggaacauuccggagccucccacaauauucuaguagagguccaggaugacgggacuaugaagaucaaagaugaagaacgggacgauacacucacaauucuucucaaagcuacauuacuugcuguaucagggguuuauccucuguccauaccggcgacuuuauuuguaugguauuuuuggcagaagaagaaacagcgaucgggaguuuuaugggauacaccaucacccccagaaguggaaagagcaguucuugaugacgggauauacagaauuaugcaacguggauuauuaggcagaucccaaguaggcguaggagucuuucaagaaaacguauuucauacgauguggcauguuacaagaggugcaguauuaauguaucaaggaaaacggcuggaaccguccugggcaucggucaagaaagaccuuauaucguauggggguggauggcguuuacaaggaucguggaacacgggugaggaaguacaaguuauagcggucgaaccuggcaaaaaucccaaaaauguacagacugcaccuggcacauucaaaacuccggaaggagaaguaggugcuauagcauuagacuuuaaaccgggcacauccgguaguccuauaguaaaucgugaaggaaaaauaguaggauuauacggcaacggaguagucacuacuucaggcacauacguaucagcgaucgcccaagcuaaagcaucacaggaagguccucugccggaaauagaagaugagguguuucggaaacgaaacuugacaauaauggacuuacauccagggucugggaaaacgcguagguacuugccagcuauagucagagaagccaucaaaagaaaguugcggacauugauacuugcaccgacacgaguaguugcgucggaaauggcugaagcacucaaaggcaugccuauccguuaucaaacuacggcaguaaaaucagaacauacaggcaaagaaaucgucgauuuaaugugucaugcuacauuuacaaugcguuugcuaucaccaguucggguuccaaauuauaauaugauaauaauggaugaggcucacuucacggacccgucuucaaucgcugcaagaggcuauauaaguacaaggguuggaaugggagaagcugcugcuauuuuuaugaccgcuacacccccaggaaguguggaagcauucccacaaucgaacgccgugauacaagaugaagaacgugauauaccugaaagaaguuggaauagugguuacgaguggaucacagacuuuccugguaagacuguaugguuuguuccaucuauaaaaaguggaaaugauauugcuaauugccuucgcaaaaauggaaaacguguaauccagcucucgagaaagacguuugacacggaguaucagaaaacgaaaaacaacgauugggauuacguugucacuacagacauaucagaaaugggugccaacuuuagagcggauagaguaaucgauccaagacguugccucaaaccuguuauuuugaaggaugggccugaaaggguaauucuggcuggcccuaugccggugacgguagcaagugcggcccagaggagaggacgaauuggucgcaaucacaauaaagaaggugaucaauauauauauaugggacaaccucucaacaacgaugaagaccacgcucauuggacagaagcuaaaauguuacuugacaacaucaacacuccugaaggaauaauaccugcccuauuugaaccggaaagggaaaagagugcagcuauagauggugaguauagacuacgaggagaagcaagaaagacauuuguggaauuaaugagaaggggcgacuuaccgguuuggcuuucuuacaaaguagcaucugaggguuuccaauacucagaucgcagauggugcuuugauggcgaaagaaacaaucaaguucuagaagaaaacauggaugucgagauuuggacaaaagaaggugaaagaaagaaauuaagaccucgaugguuagaugcgcggacauacucagauccacuugcccuccgagaauuuaaagaauuugcugccggaagacgcucuguuagcggagaucuuauccuugagauugguaaacuuccucaacaccugacccaacgagcccaaaacgcccuagauaacuugguuaugcuccauaauucugaacaagguggcagagcuuauaggcaugcgauggaagaauugccugauacaaucgaaacgcuaaugcuuuuagcauuaauagccguuuugacagggggcguaacauuauucuuucucagcggcaggggacuggguaaaacaaguaucggguuacucuguguaauggcgucgucaguucuucuauggauggcaagcguggagccccacuggauugccgcaaguauaauccuagaauuuuucuugaugguacuuuugauacccgaaccagauagacaaaggacuccucaagauaaucaacuugcauauguuguuauuggacuuuuguucaugauccuuaccguugcugccaaugaaaugggacuacuagagacgaccaagaaagaccugggcauuggacauguggcaguggagaaucaucaccaugcugcaauguuagacguagauuuacaccccgcuagugcauggacccuauaugcaguugccacuacaaucaucacuccaaugaugagacacacuauagaaaauacuacagcaaacauaucauuaacugcaaucgccaaucaggcugcgauauuaaugggcuuagauaaaggauggccaaucaguaaaauggauauagguguaccauugcuagcacuagguugcuauucgcaagugaacccauuaaccuugaccgccgccguucuaaugcuuguagcacauuacgcuauaauagggccaggacuccaagcaaaagcaacaagagaggcacagaaaagaaccgccgcggguauuaugaaaaaccccaccguugaugguaucgucgcaauagaccucgaucccgucguguaugaugcuaaauuugaaaagcaacuagggcaaauuaugcuauuaaucuuguguacaagccaaauucugcuuaugaggacaacuugggcccuuugugagucaauaacuuuagcaaccggcccgcuaacuacuuuaugggaagggucgccugggaaauuuuggaacacaacaauugcuguuaguauggcaaauauuuuccguggaagcuauuuagcaggagcaggcuuagcauucucccuaaugaaauccuuagguggagggagacgcggaacgggagcccaaggagagacuuugggagaaaaauggaaaagacaauuaaaccaauuaaguaagucggaauuuaauaccuauaaacguucggguauuauggaaguugauagguccgaggcaaaagaaggcuugaaaagaggggagacaacaaaacaugcaguaagccgggggacagcaaaacugaggugguuuguagaaagaaauuuagucaaaccagagggaaaggucauagaccuuggaugcggccgugggggauggucauauuauugcgcuggccuaaagaaaguuacagaaguaaaagguuauacuaaaggcggcccaggucacgaagaaccaauuccgauggcaaccuauggguggaaucuaguuaaauugcauucaggaaaagauguguucuuuauaccaccagaaaaaugcgacacccuauuaugcgacauaggagagaguucaccaaacccaacaauagaagaaggccguacauugcgaguuuugaaaaugguagagcccugguuaagaggaaaucaauuuuguauuaaaauacuuaauccauacaugccaucuguaguagagacgcuugaacaaaugcaaagaaaacacgggggaauguugguaagaaacccucuuagcagaaacaguacucaugaaauguauuggguuagcuguggcacugguaauauaguuagugcaguaaauaugaccagucgcaugcuacuuaacagauucacaauggcccauagaaagccaacguacgagagagaugucgaucucggugcggggacucgucauguagccguugaaccugaaguugccaaucuagauauaaucggucaacgaauagaaaauaucaaacacgaacauaaaaguacauggcauuacgaugaagauaaccccuacaaaacaugggcauaucauggaucuuacgagguaaagcccagugggagugccagcucuaugguaaacggagugguuaaacuguuaacuaaacccugggauguaauaccaauggucacucaaauugcuaugaccgacacuacuccauucggacagcaaagaguuuucaaagaaaaaguagacacacguaccccuaaagcaaaaagggguacagcucaaauuauggaaguaacagccaaaugguuguggggcuuccuagcaagaaauaagaaaccaaggauauguacacgagaggaauuuaccagaaaagucagauccaacgcugcaauaggcgcagucuuugucgaugaaaaucaauggaacuccgcaaaggaagccguagaagacgaaagauuuugggaucuaguacauagagaaagggaauuacauaagcaagguaaaugugcaaccugcguauacaauaugauggguaaacgggagaagaaacuaggagaguuugguaaagcaaaaggcucucgggcaauaugguacauguggcucggagcaagauuucuugaauuugaagcacuagguuuuaugaacgaagaucauugguuuucucgagaaaauucacucuccgguguugaaggugaagggcuacacaaacuuggauacaucuugcgugacauaaguaaaauccccggcggaaacauguaugcggaugauacagcaggcugggauaccaggauaacagaagaugaucuacagaaugaagcacgcauaacagacauuauggaaccugagcaugcacuauuagccaaaaguaucuuuaaacuuacauaucaaaacaaaguugugcggguacaaagaccugccaaaaaugguacagugauggacgucauaagcagaagagaucaacgaggaucgggccagguagguacguacggauuaaauacguucacaaauauggaagcccaacuaauccgacaaauggagucugaaggcauuuucucaccaagcgaauuagagaccccuaaccuugcagaacguguauuagauuggcuggaaaaauacggcguugagcguuuaaaaagaauggcaauaaguggagaugacugcguaguaaagccuauagacgaucgguuugcuacggcacuuaccgcgcuaaaugauaugggaaagguacgcaaggauauaccccaaugggaaccaucaaaaggcuggaaugacuggcaacaaguaccauuuuguucgcaucauuuucaccaauuaauuaugaaggaugggagagaaauagucguaccuugucguaaucaggaugagcuagucgggagagcaagaguuucacagggcgcagguuggagccuaagagaaacagcaugucuuggaaaaaguuaugcacaaauguggcaauuaauguacuuucaccgcagagaucucagacucgccgcaaaugcgauuuguagugcuguuccagucgauuggauaccuacgucgagaacgacauggaguauucacgcucaucaccaauggaugacaacugaggauaugcuaucaguauggaaucgcgucuggauagaggaaaauccuuggauggaagacaaaacgcacaucagcucuuggggcgaugugccauauuuaggaaaacgcgaagaccaguggugugguucuuuaauuggacuuaccgcaagggccacaugggcaacuaacauucaaguggccauaaaucaaguaagacgucucauaggaaaugaaaacuaucuugauuauaugacaucaaugaaacgcuuuaaaaacgaaucagauccugaaggugcacuaugguaa

SEQ ID NO: 21471 - RNA, 9879 nt, Artificial Sequence
  derived and/or modified CDS sequence (opt6) from DENV-1__EU677140__SS-prME
ucgguaacuaugcuucuuauguuaaugccuacugcuuuggcauuccauuugaccacgagagguggagaaccgcauaugauaguuucuaaacaagaaaggggaaaaagccuacucuuuaaaacuucugcagggguaaauaugugcacacuaauagcaauggacuugggugaacuuugugaagauacuaugaccuauaaaugcccaagaauaacagaaaccgaacccgacgauguugacugcugguguaaugcaacagacaccuggguuacauauggcacuuguucacaaaccggugaacaucgaagagacaaaaggagcguugcacuagccccgcauguaggauuaggucuugaaacuagaacggaaacauggaugucaagugaaggagcauggaaacaaauucaaaggguagaaacgugggcauuaagacacccaggcuuuacagugauagcucuauuuuuggcccacgcaauagguacuuccauaacucaaaaaggcauuauauuuauauuauuaaugcuugugaccccaucaauggcuaugagaugcguaggaauaggaagcagagauuuuguagaaggacucucuggggcaacuuggguggacguuguuuuagagcaugguaguugcguaaccacuauggcaaaagauaaaccuaccuuagacauagagcuauuaaaaaccgaaguuaccaacccugcaguacuucgcaaacuuugcauugaggcgaaaaucucuaauacaacuacugauucaagauguccaacacaaggagaagcaaccuuaguggaggaacaagaugcaaacuuuguuugucgacggacuuucguagacagggguugggggaauggauguggccuauuuggaaaagguucauuaauaacgugcgcgaaauuuaaaugcgucacaaaacucgaggggaaaauuguucaauaugaaaauuuaaaauacucagugauaguuacgguacauacuggagaccaacaucaaguugguaaugaaucaacagagcaugggaccacugcgacuauaacuccccaagcucccacaacugagauacagcuaacagauuacggggcuuugacauuagauugcucuccaagaaccggucuggauuucaacgagaugguccuacuaacuaugaaagagaaaagcugguuagugcauaaacaaugguuuuuagacuugccacuccccuggacaaguggcgcaaguaccucacaggaaacuuggaaccgacaagaucuucuaguaacauuuaaaacagcgcaugcgaagaaacaagaagucgugguacuaggcucccaagagggagcaaugcacacugcacucacuggagcgacugaaauacaaaccucuggcaccacaacaauauuugcuggucauuugaaaugcaggcuaaaaauggacaaguuaacacuaaaagguaugucguacgugaugugcacugguucuuuuaaacucgagaaggaaguugcggaaacucagcauggaaccguccuuguacaaauaaaauaugaggggacugacgcaccauguaaaaucccauucaguacucaagaugaaaaagggguaacacaaaacggaagacugauaacugcaaaucccauaguaacagauaaagaaaaaccagugaacauugaagcagaaccaccauuuggggagaguuauauuauuauaggggcgggcgagaaagcucuaaaacuuaguugguucaagaaagguaguucaauagggaaaauguucgaagccacugcgagaggugcacgucgaauggcaauccuuggugacacagccugggauuuuggaagcauugggggaguguucaccucaguuggcaaacuuguucaccagauauucgggaccgccuacgguguauuauucaguggaguaaguuggacaaugaaaauaggcaucggaguauuguuaacauggcuaggccuaaauaguaggaguaccagcuuaucuaugaccuguauugcagugggucucguuacauuauauuuaggaguaaugguacaggcugauuccggcuguguuauaaauuggaagggacgugaacuuaaauguggcucagguauauuuguuacuaacgagguacacacauggacggaacaguacaaauuucaagcagacaguccuaaaagauuaucugcggcuauaggcaaagcaugggaagaggguguuuguggaauuaggucagcgacgagacucgagaauauaauguggaaacaaaucucuaacgaguugaaucacauacugcuagaaaacgauaugaaauuuacagugguagugggugacguugcugguauauuggcacaggguaagaaaaugaucagaccucagccuauggaauauaaauacagcuggaaaagcuggggcaaagcaaagauuauuggcgcugacguacaaaauacuaccuuuauaauugacgguccaaacacacccgaaugcccugaugaucagagagcguggaauauuugggaagucgaagacuacggguuuggcaucuuuacaacgaacauuuggcuuaagcuaagagacucgcauacucaaguaugugaucaccgguuaaugucugccgcgauaaaagauucaaaagcuguucacgcagauauggguuauuggauagaaucggaaaagaacgaaacauggaaauuagcucgagccaguuuuauagaaguaaagacuuguauuuggcccaaaucacauacucuauggagcaaugguguauuagaauccgaaaugaucauuccaaaaauuuacggggguccuauaucacagcacaauuacaggccgggguacuucacgcaaacagcugggccauggcacuuaggcaaguuggaacucgacuuugauuuaugugaagguaccacaguagucguagacgaacauugcggaaauagagggccuucauuaaggacgacuaccguaacugggaagauaauucaugagugguguugccgaagcugcacacuuccgccauugcguuucaggggagaggauggcuguugguacggaauggaaauuaggcccgugaaggagaaagaggaaaaucugguaaaaucuaugguguccgcggggaguggcgaaguagauaguuuuucucucggauuacuguguauaaguauaaugaucgaggaaguaaugcgaucgcguuggagccgaaaaaugcugaugacuggaacucuugcaguauucuuccuuuuaauuaugggucaauuaacguggaaugaccuuauucgauuaugcauaaugguaggggcaaaugcauccgauaggaugggaaugggaacaacauaccuugcccugauggcaacauucaaaaugagaccgauguucgcuguagguuuacuauucagaagauuaacaagucgugaagucuuacugcuaacaaucggauuaucacucguagcaucgguagaauugccaaauucacucgaggagcucggcgacggacuagcaaugggcauaaugauauuaaaacugcucacagauuuucaaagucaccaauuaugggcaacauuguuaucgcugaccuucauaaagacgacauuuucauuacacuaugcuuggaaaacuauggcaaugguccuaagcaucguuuccuuguucccucuauguuuaagcaccacuucacaaaagacaacuugguugccaguauuauuaggaagucucggguguaaaccuuuaacuauguucuuaauugcagaaaauaagauauggggccggagaucguggccucuuaaugaaggcaucauggcaguggggauugucuccauacuucucagcagucugcuuaaaaacgauguuccgcuugcaggaccccuaauagccggaggaaugcuaaucgcaugcuauguaauuucgggaucaagugcugauuuaucacuagaaaaagccgcagaaguaaguugggaagaggaggcagagcauagcggugcgagccacaacauacugguggaaguacaagacgacggcaccaugaaaauuaaagaugaagaaagagacgauacguuaacgauauuguuaaaagcgacccuucuagcuguuuccggcguguacccacuaaguauaccagcaacacuguuuguuugguauuuuuggcaaaagaagaaacagagaaguggcgucuugugggacacaccaagcccucccgaaguagaacgagcaguucuagacgauggaauuuauagaauaaugcagcggggauugcuuggaagaucucaaguaggaguaggaguguuucaagagaaugucuuucacaccauguggcaugucacgagaggugcagugcuaauguaucagggaaaacgacuagaaccaagcugggcaagcguuaaaaaggauuuaauaaguuauggagguggauggagacuacaaggaucauggaauaccggcgaagaaguccaggugaucgcugucgaaccuggcaaaaacccuaagaacguacaaacggcuccuggaacauuuaaaacgccagaaggagaagugggagcaaucgcauuagacuuuaaaccagguacaagcggaagcccaaucguuaaucgcgaagguaaaauagucggauuauaugggaacggggucguaacaacaucugggacuuauguuucugcgauugcucaagcaaaagccucacaagaaggcccguuaccugagaucgaagaugagguauuucgcaaaagaaaccuuacaaucauggauuugcauccaggcucaggaaaaacuagacguuaucuuccugcaauugucagagaagcuauuaaaaggaaacuuagaacucuaauacucgcaccuacacgagugguugcaagugaaauggcagaagcgcuuaaaggaaugcccauaagauaccagacaacagcuguaaaaucugaacauacggguaaagaaauuguugaucuaaugugucaugccacuuucacaaugcguuuacuuucuccggucagaguuccaaacuacaauaugauaauuauggacgaagcccauuuuacggaucccagcucaauugcggcaagaggguauauaucuacgcggguggguaugggggaagcagcagcaauuuuuaugacugcaacaccaccgggcagcguugaagcauuuccacaauccaaugcuguuauacaagaugaagaaagggacauaccagagcgcagcuggaauaguggguaugaauggaucacagauuucccaggaaagacagucugguucgucccaaguauaaaaucaggaaaugauauugcgaauugucucaggaaaaacggcaaaagaguaauucaauugaguagaaagacauuugauaccgaauaucagaaaacaaagaauaaugauugggauuacguaguuacgacagacauaucugaaaugggagcaaacuuuagggcugauagaguaauugacccucgccgaugucuaaaaccaguuauuuuaaaagacggcccagaacguguaauucuagcgggaccgaugccaguuaccgucgccucagcagcacaaagaaggggucguaucgguagaaaucauaacaaggaaggggaccaauauauauauaugggacaaccucugaauaaugaugaagaucaugcccauuggacggaagcuaaaauguuacuagacaauauaaauacaccagaaggaauaauaccagcucucuuugaacccgaaagggaaaaaucagcugcaauugauggcgaauaucgguuacgaggcgaggcuagaaaaacguucguagaauuaaugaggagaggagauuugccaguaugguuaagcuacaaaguugcuagcgaaggguuccaauacucugauaggagauggugcuuugacggcgagagaaacaaccaaguacuagaagaaaacauggacguagagauuuggacgaaagagggugaaagaaagaaguugagaccucgcuggcuagacgcacguacuuauucagacccucuugcgcuuagggaauuuaaggaguucgcagcuggcagacgcaguguaucgggggaucugaucuuagaaauagggaaguugccucaacacuugacucaaagagcgcaaaacgcacucgauaaccuuguuauguuacauaauagugagcaaggcggacgagcauauagacacgcaauggaagaguugccggacacaauugaaacauuaauguuguuagcucuuauugcgguauuaacuggugguguaacguuauucuuuuuauccggaagaggacuugggaaaacgaguauaggacuauuaugcguuauggcgucgaguguguuguuguggauggcaaguguagaaccacauuggauugcugcuucuauuaucuuagaguucuuuuuaaugguauugcuaauacccgaacccgauaggcaacgcacaccacaggauaaccaguuagcauacguuguaauaggguuacuguucaugauauuaacaguugcagcuaaugaaaugggacuauuagaaaccacuaagaaagaccuggggauuggucauguggcuguagagaaucaucaccacgcagccauguuagauguugauuugcaccccgcuucagcauggacccuauacgcuguagcuacuacgauaaucacuccaaugaugaggcauacaauagaaaacacaacugccaauaucucacuaacggcuauagcaaaccaagcagcaauauuaauggguuuggacaagggauggccaauuucgaagauggacauagggguaccauuguuagcccuaggguguuauucgcaaguuaauccauuaacacugacugcugcaguuuuaaugcuagucgcacauuacgcaauaauaggaccgggcuugcaagccaaagcaacgagggaggcucagaaaaggaccgccgcuggcaucaugaaaaaucccacaguugaugguauaguugcaauugaucuagacccggucguuuaugaugcuaaauucgaaaaacaacuggggcaaauuauguuauugauacuuuguaccucucagauauuauuaaugaggacgacaugggcccuuugcgaaucaauaacucuugcgacuggcccgcuaacgacgcuaugggaagggaguccaggaaaauuuuggaauacgacaauugcuguaucaauggccaacauauucagagguaguuaucuagcgggggcaggacuugccuucucacucaugaaaucacuagggggagguaggagagguacuggggcgcaaggagaaacguuaggggaaaaauggaaacgacaacuaaaccaacuaagcaaaucagaguucaacacauauaaaagaucggguauaauggaaguggaucgcucagaagcaaaagaaggccuaaaaaggggagaaacuacgaaacaugcagucagccgagggacagcaaaacuuagaugguucguagaaagaaaucuugucaaacccgaagguaaggucauugauuuaggaugugggcgcggaggguggucauacuauugcgccggauugaagaaaguuacggaggucaaagguuauacuaaagguggcccagggcacgaagaaccaauacccauggcuacauaugguuggaacuugguaaaacugcauucgggcaaggacguguuuuucauuccaccugaaaaaugugauacucuacucugugauauuggggagaguaguccuaauccaacaauagaggaagguagaaccuuaagaguacucaaaaugguagaaccuugguugcgaggaaaucaauucuguaucaaaauccuaaaucccuacaugccuagcguuguagaaacucuagaacaaaugcaaaggaagcacgggggaauguuaguuaggaacccuuugagucguaacaguacucaugagauguauugggugucauguggaaccggaaauauugucucugccgugaacaugacaagcagaaugcuauuaaauagauucacaauggcacaccguaaaccaacauacgaacgagacguggacuugggugcgggcacucgacaugucgcaguggaaccagaaguagccaaccuagacauaauuggacaaagaaucgaaaacauaaaacaugaacacaagucuacguggcacuacgaugaagauaauccauauaagacuugggcauaucauggaucauaugagguaaaaccuucugguucggcuaguuccaugguuaauggcguagucaaacuuuuaacaaagccaugggacguaauaccaauggucacacaaauugcuaugacugacacaacaccuuuuggccagcaacguguauucaaggagaaaguagauacaaggacaccaaaggcaaaacgagggacagcucaaauuauggaggucacagcuaaauggcuauggggauuucuuucgcggaacaagaaaccacguauuuguacacgagaagaguucacgagaaagguaaggaguaaugcugcaauuggugcgguguucguggaugaaaaucaauggaacucugcaaaagaagcaguagaagaugaaagauucugggauuugguucauagagaacgugaacuucacaagcaaggaaagugcgccacuuguguauauaauaugaugggaaaacgcgagaagaaacugggugaguucgguaaagcuaaagggagccgagcaaucugguacauguggcuuggggcccgcuuucuugaguuugaggcauuaggauucaugaaugaagaucauugguuuucgagagaaaacucuuuaucagggguugaaggagaagguuuacacaaacuaggauacauacucagggauauaucuaaaauucccgggggaaacauguaugcugaugauaccgcagggugggauacccgaauuacggaagacgauuuacagaaugaggcuagaauaacagacaucauggaaccagagcaugcuuuacuggcgaaaucaauauucaaacucacuuaucaaaauaaaguaguaagaguccagcgucccgccaaaaacggcaccgugauggacgucaucaguaggagggaucaacguggcaguggccagguaggaacuuaugguuugaauaccuuuacuaauauggaagcucaauuaaucagacaaauggaaucagaggggauauuuaguccaucugagcuagaaacaccaaacuuagccgaacgaguccucgauugguuaaagaaguacggaguggaacgccuaaaacguauggccauaucuggggaugacugcgugguaaagcccaucgaugacagauuugcaacagcucuaacggcacuaaacgauauggggaagguaaggaaggauauaccucaaugggagccaagcaagggcuggaaugacuggcaacaaguuccauucugcagucaucacuuucaccaacugauuaugaaagauggaagagaaauagugguacccugccgaaaccaagaugagcuaguaggucgagcgcgcguuucucaaggggcaggauggucacugagagagaccgcuugccucgguaaaaguuaugcgcagauguggcaacuaauguacuuucauagacgugauuugagauuggcugccaacgccauauguagugccguuccaguggacuggauaccaacgucacgaacuacuuggucgauucacgcucaccaucaguggaugacuacagaagauaugcugucaguauggaauagaguuuggauagaagaaaauccuuggauggaagacaaaacucauauuaguaguuggggugacgucccauaccuaggaaagcgagaagaucaguggugugguucgcuaauaggacucacugcaagagcgacaugggccacaaacauccaaguagcaauaaaucaaguaagaagguuaauaggaaaugaaaauuaucuugauuacaugacaucuaugaaaagauuuaagaaugaaggcgacccugagggggcauuaugguaa

SEQ ID NO: 21472 - RNA, 9879 nt, Artificial Sequence
  derived and/or modified CDS sequence (opt6) from DENV-1__EU677166__SS-prME
agcgugacuaugcuacuaauguuaaugccgacugcacuugcauuucaccuuaccacucgagguggagaaccacauaugauuguuagcaaacaagaaagaggaaaaucacuuuuauuuaagacaucugcuggaguaaacauguguacccuuauugccauggaccuuggggaacuaugugaagacacaaugaccuauaaauguccucggauuacggaaaccgaaccggacgauguugauugcugguguaaugcaacggacacuugggugaccuauggaacauguagucaaacuggagaacaccggagggacaaacguucgguagcgcuagcuccccacguuggacugggacuugaaacuagaacagaaacguggaugucauccgaaggagcuuggaaacaaauccaacggguugaaacuugggcgcuccgacauccaggauuuacaguaaucgcacucuuucuagcacaugccauuggcacaaguaucacucaaaaagguauaaucuuuauauuacucaugcugguuacaccgucaauggcaaugagaugcgugggcaucgguucaagagauuuuguagaagguuuauccggagcaacguggguggaugugguacuugaacacgguuccugcgucacaacaauggcaaaagauaaaccgacucuggauauugaauuguuaaagacagaaguaacaaauccggcuguauuaagaaaacuaugcauagaagcgaaaauaaguaacacuacaacugacuccagaugcccaacccaaggcgaagccacucuaguugaagaacaagacgcuaacuuuguuugcagaagaacuuuuguagaccguggaugggguaauggcugugggcuauuugguaaagguucuuuaauaaccugugcgaaauucaaaugcgucacaaaacuugaaggaaagauagugcaauaugaaaaccugaaauauagugucaucguaacaguccacacgggcgaucaacaucaaguaggaaaugagucaacagagcaugggaccacagcaacuaucacaccucaagcaccaacuacagaaauacaauuaaccgauuacggagccuugacuuuagacuguagcccacggacggggcuagauuucaaugaaaugguucuuuuaacuaugaaagaaaagucaugguuaguucauaaacaaugguuuuuagaccugccauugccuuggaccaguggggcuaguacaucacaagaaacauggaauaggcaagauuuauugguaaccuucaaaacggcacaugcgaagaaacaagaaguuguuguguuaggaucgcaagagggugcgaugcacacagcacuaacuggggcaacugaaauacaaacuucgggcacuacaacaaucuuugcaggacacuuaaaauguagacugaaaauggauaaauuaaccuugaaaggaaugucauauguaauguguacaggaaguuuuaaacuagagaaagaagucgcagaaacucaacacggcaccguguugguacaaaucaaauacgaaggcacagaugcacccuguaagauaccuuuuucgacacaggaugaaaaaggcgucacacaaaaugguagauugauaacagcuaauccgauuguuaccgacaaagagaagccuguuaacaucgaggcugaacccccauucggagaaaguuacauugucauaggggcuggagaaaaagcauugaaacucaguugguucaagaaagggucaucgauagggaaaauguuugaggcgaccgcuaggggagcacggcggauggcuauauuaggcgacacggcuugggauuucgguucaauugggggaguauuuacaucagucggaaaguuaguccaucaaauauuugguacagcauacggaguacuuuuuaguggggugucguggacuaugaaaauaggaauuggcguacuucucacaugguuaggacuuaauucgcggucaacgagccuaucaaugacaugcauagcuguuggauuaguaacacucuaucuuggcguaaugguucaggcagacagcggcugcgucauaaacuggaaaggccgagaacugaagugcggcagugguauauuuguaacaaaugaaguucauacuuggacagaacaauauaaauuucaagcugacaguccgaagagacuuagugcugcaaucggaaaagccugggaggaaggugucuguggcauucggagugcaacacgacuagagaauauaauguggaaacagauaucaaacgaacugaaucacauauuauuagagaaugacaugaaauuuacaguaguaguuggugacguugcggguauacuugcacaaggcaagaaaaugauucguccacaaccaauggaguacaaguauuccuggaaaucuuggggcaaagccaaaauuaucggggcagacguacaaaacacuaccuuuauuauagaugguccuaacacgccugaaugcccagaugaucaacgcgcauggaauauuugggaaguagaagacuacggguucggaauauuuacuacaaacaucuggcuaaaacuccgggauaguuacacacaaguaugcgaucaucgguuaaugucggcugcaauuaaagauucaaaagccguacacgcggauaugggcuauuggauagagagcgagaaaaaugaaacauggaaauuggcgagggcuuccuuuaucgaaguaaaaacauguaucuggccaaaaagucacacauuaugguccaauggaguucuagaguccgaaaugauaauaccaaaaauauauggugggccaauaagucaacauaauuauagaccaggauauuuuacacaaacagcgggaccauggcaccuagggaaauuagaguuagacuuugaccugugugaagguaccacgguuguaguagaugagcauugugguaaucgaggucccaguuuaagaacgacgacagucaccggcaaaauaauacacgaauggugcugccgcucauguacacugccuccccuuagauuccgaggugaagauggguguugguaugggauggaaauacgcccagugaaggaaaaagaagaaaauuuggucaaaagcaugguaagugccgguucgggagagguagacucauucucauuaggacuguugugcauuucuauuaugaucgaagaggucaugcggucacgauggagccgcaagauguuaaugacaggaaccuuggcaguguucuucuuauugauaaugggccaacuaaccuggaacgaucuuauuagauuauguauaauggugggugccaaugcaucugaccguaugggcauggggacgacguacuuagccuuaauggccacuuuuaaaaugcgaccuauguuugcuguaggacuguuauuccgaagguuaaccucucgugaaguacuauugcucacgauugguuuaucccugguugcaucuguagaacuuccaaauucccuugaagaacuuggagauggacucgcuauggggauaaugauuuuaaaauuacugaccgauuuccagucgcaucaacuuugggcaacucucuuaucuuuaaccuuuauuaaaacgacauuuucauugcacuaugccuggaaaacgauggcaaugguucucucuaucgucucgcuuuucccacuguguuugucgacaacaucccaaaagacuacauggcuuccaguucuauugggaagucugggauguaaaccauuaacgauguuucuaaucgcugaaaauaagauauggggaagaaggagcuggccgcuaaacgaagggauuauggccguagguauaguuucaauacuucuaaguagucuuuugaaaaacgacguaccacuagccggcccacugauugcaggaggaaugcuaauagcauguuaugucauaucugguucaucggcagaccuaucauuggagaaggcagcggaaguaaguugggaagaagaagcagaacauaguggugcaucacacaacauuuugguagaagugcaagaugacggaacgaugaaaauaaaggacgaagaaagagacgauacauuaacaauucuacuuaaagcaacauuauuagccguaagugggguauacccccuauccauacccgcaacauuauuugugugguauuuuuggcagaaaaagaaacaaagaaguggggugcuaugggacacccccaguccaccugaaguagaacgggcaguuuuagacgaugguauuuaucgcauaaugcaaaggggacuacucggaagaucucaaguggggguugguguauuucaagaaaacguuuuucauacuauguggcacguuacacgaggugcaguuuuaauguaucagggaaagagauuagagccgucgugggcaagugugaagaaggaucuaauaucuuauggcggcggauggcgacugcaagggaguuggaacacgggagaagaaguucaaguaauagcaguagaaccugggaagaacccaaagaacguucaaacagcgccuggaacauuuaaaacaccugaaggagaaguaggagcaaucgcgcuugauuuuaagccuggaacuuccgggucacccauugucaauagagaaggaaagauugugggccuuuacggaaauggcguaguuacaacaaguggaacauaugucucggcaaucgcucaagcaaaagcaucucaagagggaccacuuccugagauagaagaugagguguuucguaaaaggaaucugaccauuauggacuuacauccagguagcggcaagacucgaagauaucuaccagcaaucguuagggaagcaauuaagagaaaacuacguacauuaauacuugcaccaacccggguaguagcaucugaaauggcggaggccuuaaaggggaugccaauaagguaucagacaacagcugugaaaucggaacauaccggaaaagaaauagucgauuuaaugugucaugcaacuuucacaaugcgacuacuaucgccaguucguguuccuaauuauaauaugauaauaauggaugaagcgcauuuuacagauccgagcagcauagcagcacgaggauauauuaguacgagggucggaaugggcgaagcagcagcaauauucaugacugcaacuccaccgggaaguguugaagcauuuccacaauccaacgcaguuauucaggaugaagaacgcgacauaccagaacgaucguggaacucaggauaugaauggaucacagauuucccugguaaaacaguuugguucguacccuccauaaaaucagguaaugacauagcaaauugucuaaggaaaaacggaaaaagagucauucaacugaguagaaagacauucgauaccgaauaccagaaaacgaaaaacaaugacugggauuaugugguaaccacugacauaucggaaaugggagcaaauuucagagcagaucgagugauugauccgagaagaugcuuaaagccgguaauuuuaaaagauggcccagagcgagugaucuuagcggguccuaugccaguuacgguggcuagugcugcgcaacggcguggacguauaggacguaaucacaauaaggaaggagaucaauauauuuauaugggacagccauuaaauaacgacgaggaucaugcucauuggacugaagcuaaaauguugcucgauaauauaaauacuccagagggaauuauuccugcacuauuugaaccagaaagagagaaaagcgcagcgauagacggggaauaucgcuugagaggugaagcacgaaaaacuuuuguugaacugaugaggcguggcgaccuuccagucuggcuaaguuacaaaguugcaagugaaggcuuccaauauagugacagacguuggugcuuugacggggaacguaauaaucaggugcuugaagaaaauauggacguggaaauuuggaccaaggaaggagaacgaaagaaauugagaccuaggugguuagaugcccguaccuauucagacccauuggcucuacgagaguucaaagaguuugcagcggguagacgcagcgugucuggagaccugauccuugagaucgggaaacuuccccaacauuuaacgcagcgugcgcaaaaugcuuuagacaaccuaguaauguugcacaauagcgagcaaggagggcgugcguacagacaugcaauggaagaacuaccagacacaaucgagacacuaauguuacuggcguuaaucgcugugcuaacaggggguguaacccuauucuucuuaucaggcagagguuuggggaaaacaaguauaggacugcuaugugucauggcuagcagcguacugcuguggauggcuaguguagaaccacauuggauugccgcaucaauuauacuggaguucuuuuuaauggucuugcucauaccagagccagaucgccaaagaacaccucaagauaaccaacucgcauauguuguaauuggacuauuguuuaugauacuaaccguugccgcuaaugaaaugggacuauuagagacaacuaaaaaggaucucgguauuggccacguagccguugaaaaccaucaucacgcagcaauguuagacguugacuuacauccugcaucagcguggacacuuuaugcggucgcaaccaccauaauaacacccaugaugagacauacaauagaaaauacaacagccaauaucucacuuacagcaauagcuaaccaagcugcaauucuuaugggauuggauaagggguggccaaucagcaaaauggacaucggaguucccuuacuggcguuaggcugcuacagucaagucaacccauuaacacuuacagccgcaguacuaaugcuaguagcacauuaugcuauuauaggaccaggguuacaggccaaagccacgcgugaagcgcagaagagaacagcugcaggaaucaugaaaaacccuaccguugaugggauugucgccauagacuuagacccaguaguguacgacgcgaaauucgaaaaacagcuaggacaaauaaugcuucuuauauuauguacuucucaaauacuucuaaugaggacaacaugggcccucugugaauccauuacucuugcaaccgggccgcuuacaacauuaugggaaggaucucccgggaaauucuggaauacgacaauugcaguaaguauggcgaauauuuucagagguaguuaucuugcuggugcaggauuagcuuucagucuaaugaaaucauuaggaggaggacgucgaggaacuggagcacagggagaaacguuaggcgagaaauggaaaaggcagcuaaaucaacuaagcaaaagcgaauuuaauacauauaaacgcucagguauaauggaaguggaucgaagcgaagcuaaagaaggcuuaaaaagaggcgaaacaaccaagcacgcaguaagccguggaacagccaaacuucgaugguuugucgaaagaaauuuaguuaagcccgaaggaaagguuaucgacuuaggauguggacggggcgguuggaguuauuauugugcuggucuuaagaaaguuaccgaagucaaaggauacacgaaaggcggaccgggacaugaagaaccaauuccaauggccacguauggauggaaccucguuaagcuacauuccggaaaagaugucuucuuuauaccuccugaaaaaugugacacauugcuuugcgauauuggcgaaaguucccccaacccuacuauugaggaaggacgaacucuacgaguuuuaaaaaugguugaaccguggcuaagaggaaaccaauuuuguauuaagauccuaaaccccuacaugccaucugucguugagaccuuggagcaaaugcaacguaaacacggagguauguuaguacguaauccacuaucuagaaauucaacacaugaaauguauuggguuaguugcggcacaggaaauaucgugucggcaguuaauaugacauccaggauguuacuaaauagguuuaccauggcucauaggaaaccuacguaugaaagagauguagauuuaggggcaggcacaagacauguagcaguagaaccagaaguggcuaauuuagauaucauuggccaaaggauugaaaauauaaagcaugaacauaaaaguacuuggcauuacgacgaagauaaccccuauaaaacaugggccuaucaugguucauaugaagugaagccguccgguagcgcgaguuccaugguaaacggaguagugaaacuuuuaacaaagccaugggaugugauuccuaugguaacgcaaauugccaugacagacacuacaccauuuggacaacaacgaguuuucaaagaaaaaguagauaccagaacaccaaaagcaaagcgcggaacagcccaaauuauggaagucaccgcaaagugguuguggggauuuuuaucaaggaacaaaaagcccaggaucugcacucgagaagaguucacacggaagguuaggaguaacgcagcgauaggagcaguauuuguggacgaaaaucaauggaacucagcaaaagaggccguagaagaugagagguucugggacuuaguacaucgugaacgagaauuacacaaacaaggaaagugugcaacuuguguguacaauaugaugggcaaaagggagaagaaauuaggagaauuugggaaagccaaagguucucgagcaaucugguacaugugguuaggggcacguuuucuagaguuugaggcucugggguucaugaacgaggaccacugguuuagucgugaaaacagccuuucaggaguagaaggugaaggauuacacaaauuaggauacauacuacgagacauuagcaaaauaccagguggaaauauguaugcugaugacacugcagggugggacaccagaauuacugaagacgacuuacaaaaugaagcgcgaaucacugauauaauggaaccagaacaugcacuauuagcaagaucuaucuuuaaguugacuuaucaaaauaaaguagugagaguccagcggccggccaaaaauggaacaguuauggacguuaucagcagaagagaucaacgagguaguggacaagucggaacguaugguuuaaacaccuucacgaacauggaagcacaauuaauucgucaaauggaaagugaaggcauuuucucaccuagugagcuagaaaccccaaaccuagcggaacguguacuugacuggcucgaaaaguauggcgucgaaagauuaaagaggauggcaauaaguggagaugauugugucguuaaaccaaucgaugacagauuugcaacagcucuuacagcgcuuaaugauauggguaaaguucguaaagauauaccacaaugggagccaaguaaaggauggaaugauuggcaacaaguuccuuuuuguagucaccacuuucaccagcuaauaaugaaagacggccgugaaauaguaguaccgugucggaaccaagaugagcuagucggacgggcaaggguuucacagggugcuggauggucucuaagagaaacugcuugucuugguaaaucauacgcacaaauguggcagcuuauguacuuucaccgccgcgauuuaagauuagcagcuaaugcuauaugcagugcgguuccaguaaauuggauaccgacauccagaacaacguggucuauccaugcucaucaucaauggaugacgacagaagacaugcuaagcguauggaauagaguauggauagaagagaaucccuggauggaggauaaaacccauauaucguccuggggugacgugccauauuuaggaaaaagagaagaccaauggugugguucauuaauuggccucacagcuagagcaacgugggccacgaauauucaaguugcuauaaaccaaguccgaagacuuauagguaacgagaacuaucuagacuauaugacuucaaugaaacgauuuaaaaacgaaucagaucccgaaggcgcucugugguga

SEQ ID NO: 21473 - RNA, 9879 nt, Artificial Sequence
  derived and/or modified CDS sequence (opt6) from DENV-1__EU677170__SS-prME
agcgugacaauguuauuaaugcuaaugccaacugcucucgcauuccaccuuaccacacgagguggggaaccgcauaugaucguaucaaaacaggaacgaggaaaaucucuucucuuuaaaacaucugcuggagucaauauguguacucucauugcuauggaucugggggaguuaugcgaggacacaaugacauauaaaugccccaggauuacagagacagaacccgacgauguagacuguugguguaaugccacggauaccugggucacauauggaacauguagccagacaggcgaacauagacgagauaaacgaucgguagcauuagcuccucauguaggucucggucuugaaacccgaacggaaacuuggaugaguagugaaggggccuggaaacaaauacaacguguugaaacaugggcccugcggcauccgggcuuuacuguaauagccuuguuucuagcucaugcuaucggaacuuccauaacucaaaaagggaucauauuuauuuuacuaaugcugguaaccccgaguauggcuaugagauguguaggcauagguucgagagacuuuguugaagggcuauccggcgcaaccuggguagaugucgugcuagagcaugguucauguguaacaacaauggccaaagacaaacccacgcuugacauagaacugcuaaaaacugaaguaacuaauccugcuguguuaagaaaauuauguauugaagcaaaaauuagcaacacgacaacagacagucggugcccaacucaaggugaggcgacauuaguagaagaacaggaugccaauuuugucuguagaagaacguuuguagaccgaggcuggggcaacggauguggauuguucggaaagggaagcuugaucacuugugcgaaauuuaaguguguuaccaaacuagaagguaaaauaguacaauaugaaaacuuaaaguacuccgugauaguaacuguacauacuggagaucaacaucaaguagggaaugaaagcacagaacauggcaccacggcuacgauaacgccacaggccccuacuaccgagauucaauuaaccgacuauggugcauuaacucuggacuguaguccccggacggggcuagauuucaaugaaaugguccuacuaacaaugaaggaaaaguccugguuaguccauaaacaaugguuuuuagauuuaccacuuccauggacaaguggugcgucaacuucgcaagagacauggaaucgacaagacuuacuaguaacguucaagacagcucaugcgaaaaaacaagaaguuguaguuuuagggagucaggaaggcgccaugcacacagcacugacgggcgccacagagauacaaacgucagggacaacuacuauuuuugcuggacaccucaaaugcagacuaaaaauggauaagcugacguuaaaagggaugucauauguuauguguacuggaagcuucaagcucgaaaaagagguagccgaaacucaacaugguacuguucugguccaaauaaaauaugagggaaccgaugcgcccugcaaaauacccuucagcacacaagaugaaaaagguguaacucagaaugggcgucuaauuacugccaacccaaucguuacagauaaagagaaaccggucaacauagaagcagaaccaccuuucggugagaguuauauugugauuggugcaggggaaaaagcuuuaaaacuaucuugguuuaaaaaagguucaagcauaggcaaaauguuugaagccacagcuaggggugcaagaagaauggcuauacuuggugauacagcgugggacuuuggaucgauaggcggaguuuucacaucagugggaaaacuagugcaccaaauauuuggaacggccuauggaguguuauucucuggaguaaguuggacuaugaaaauagguauugguguauuacuuacauggcugggccugaauucaagaaguaccucuuuaaguaugaccuguauugcugugggccuagucacgcuuuaccuggggguaaugguacaagcagacucuggguguguaauaaacuggaaaggacgagaacuuaaaugcggcaguggaauuuuuguaacgaacgagguccauacauggacugagcaauacaaauuucaagcggauucaccuaaaagacuaucggcugccauuggaaaagcaugggaagaagggguuuguggaauuaggucugcaacuaggcuugagaauauaauguggaagcaaaucuccaaugaacuaaaccauauacuauuggaaaaugacaugaaauucacugugguagugggggacgucgcuggcauauuagcccagggaaaaaaaaugauaagaccacaacccauggaauauaaauauucuuggaaaucauggggaaaggcuaaaauaauaggagcagauguacaaaauacaaccuuuauaaucgacggaccuaacacacccgaaugcccggacgaccagcgcgccuggaacauaugggagguagaagacuacggauuuggaauauuuaccacuaauauauggaugaagcuuagggauucauacacucaaguaugugaccauagauugaugucagcagcaauuaaagacucuaaagcuguacacgcagacauggguuauuggauugaaucagaaaaaaacgagacguggaagcuagcgcgagccaguuuuauagaaguaaagacgugcauauggcccaaaucucacacuuuauggagcaauggugucuuagagucugaaaugauuauaccaaaaauuuauggagguccgauuucucagcacaauuauagacccggauauuuuacucagacugccggucccuggcaucuaggaaaauuagaauuagauuucgacuuaugcgaaggcaccacaguaguuguagacgaacauugugggaaucgaggaccuagucugagaacaacaacagucacuggcaaaauaauccaugaaugguguuguaggucguguacauuacccccuuuaagauucaggggcgaagaugguuguugguaugggauggaaauacggccaguuaaggagaaagaagaaaaucuggugaaaaguaugguaucggcggguaguggggagguggacucauuuaguuuagguuugcuuugcauaucuauaaugauagaagaggucaugcgaaguagauggagucgaaaaaugcuuaugacuggaacgcuagcgguguucuuucuacuaauuaugggucaauuaacauggaaugauuuaauaagauuaugcauuaugguaggagcaaacgcaagcgauagaauggguauggguacgaccuaccuugccuuaauggccacguuuaaaaugagaccaauguucgcgguggguuugcuauuucggagauugaccaguagagaaguuuuguugcugacgauaggauuaagccuaguugcuucuguggaacuaccaaauaguuuagaagagcuaggcgauggucuagcgaugggaauaaugauauuaaagcucuuaaccgauuuucaaagucaucaauuaugggcaacauugcugagucuuacauuuauuaaaaccacuuucucauuacauuaugcauggaaaacuauggcaaugguuuuaagcauuguaagcuuauuccccuugugcuuaucuacaacuagccagaagacuacguggcuucccguauuacuagguucauuaggaugcaagccauuaacgauguuccuuaucgcggaaaauaaaauuugggggcgaaggagcuggccucuaaacgaaggaauaauggccguaggaauaguuucaauccuacuaucaagucuuuuaaaaaaugaugucccauuagcggguccacuaauagcuggugggauguuaauagcuuguuauguaauauccggaucuucugcggaucucagcuuagaaaaagcggcugagguaaguugggaagaagaagcugaacauucuggugcaucccacaauauccuugucgagguccaagacgauggaacaaugaaaauuaaagaugaagaacgugaugacacacuuacaauacuuuuaaaagcaacauuauuagcggucucgggaguuuaucccuugucuauuccugcuacauuauucgugugguauuucuggcagaaaaagaagcagcguagugggguguuaugggacacgccaucuccaccugaaguagaaagagcaguucucgacgacggcauauacagaaucaugcaacguggcuuacuugggcgaucacaggucggaguugguguauuccaggagaauguguuucauacgauguggcacguaacgagaggcgcaguccugauguaucaaggaaaacgguuagaacccuccugggccucagugaaaaaggaucugauuucauacggcggagguuggcgccuucagggaagcuggaacacaggugaggaaguccaagucauagcugucgaaccggggaagaacccaaagaauguucaaacugcgcccggaacauuuaagacuccggaaggagaagucggagccauugcguuagauuuuaaaccaggaaccucaggaagcccaauuguaaauagagaagguaaaauuguuggauuauacgggaaugggguuguuacaacgucgggaacauacguauccgcaaucgcucaagcaaaggccucacaagaaggcccucugccagaaauagaagaugaagucuuuagaaaacgaaacuuaacuauuauggauuuacacccugguuccggaaaaacgcgcagguauuuaccggcuaucguacgagaagccauaaaaaggaaauuacggacuuuaauucuggcacccacaaggguaguagcauccgaaauggcagaagccuugaaggggaugccaauacgauaucaaacuaccgcugucaaaucggaacauaccggaaaggagauuguagaucuuaugugucaugcuacuuuuacaaugcgacuucucagucccguaaggguuccaaauuauaauaugauaauuauggaugaagcgcauuucaccgauccuagcagcauagcagcgagaggauacauaucuacuagaguugguaugggggaagcagcagcaauuuucaugacggcgacuccuccugggucuguagaagcguuuccucaauccaacgcugugauucaggacgaagagagagauaucccugaaagaucguggaacuccggauaugaauggauaacggauuucccugggaaaacuguaugguuugugccaaguauaaaauccgggaaugauauugcuaacugcuuaagaaaaaacggaaaacgaguaauacagcuaucacgaaagacguuugauacggaauaucaaaagacuaaaaauaaugacugggauuacguuguuacaacugauauaucagaaaugggagcaaacuuuagggccgaucgggugauagaccccagaagaugucuaaaaccgguuauauugaaagacggaccagaaagagugauauuagcaggaccaaugccugucacugucgcaucagcagcacaaaggagaggucgcaucggacguaaucacaacaaagagggugaccaguauaucuauaugggacaaccguuaaauaaugaugaggaucaugcucacuggacagaagcaaagauguuacuugauaauauaaacaccccagaagggauaauaccggcacuuuucgaaccggagcgugaaaaaagcgcggcgauugauggcgaauauagauuacguggagaggcuaggaaaacuuuuguggaacuuaugagaagaggcgaccuaccagugugguuaaguuacaaggucgcgagugaaggcuuccaauacucggaccggcgaugguguuuugauggggaacgaaauaaccagguacuugaagaaaacauggacguggagauauggacaaaggaaggagagagaaaaaaacuccguccucggugguuagacgcacguacauauagugacccucuagcccuaagagaauuuaaagaauucgcagcaggaagacguucuguuaguggggaccuuauuuuggagauaggcaaauugccucaacaucugacacaaagagcccaaaaugcguuggacaaucuugucaugcuacauaauucagaacagggagguagagcuuaucgucaugcuauggaagaguuaccagauaccaucgagacccuaaugcuauuagcuuuaauugcuguacuuacagguggaguuaccuuauuuuuuuugucgggaagaggcuugggaaagacgaguauaggcuuacuguguguuauggcgucgagcguccuuuuauggauggcuaguguggagccacacuggauagcugcuaguauuauucuagaauucuucuugaugguuuuauuaauuccggaaccugaucgacaacguacaccccaagauaaccagcuugcguauguaguaauagggcuauuguuuaugauccuuacgguugcagcuaacgaaaugggguuauuggaaacuacuaaaaaagaucuugggauagggcaugucgcaguagagaaucaccaucaugccgcaaugcuagauguugauuuacacccugcuucugcguggacacuuuaugcuguggccacaacaauuauaacgcccaugaugagacauacgauagaaaauaccacugccaacaucagucuaacugccauugcaaaucaagcagccauauugaugggacuagauaaaggcuggccuaucucaaagauggacauaggaguaccacuccucgcacuaggaugcuauagccagguaaauccgcuaacacuuaccgcagcaguacugaugcuaguugcucacuaugcaaucauagguccaggauuacaagcgaaagcuacacgagaagcccagaaaagaacagcggcuggaauuaugaagaacccuacuguugauggaaucguggcaauagauuuagacccaguuguauaugaugcaaaauucgaaaaacaacugggacaaauuaugcuacuuauauuauguacgucgcaaauucuauuaaugagaacaacaugggccuugugugaauccauuacacuagcuacaggcccauuaaccacuuugugggaagguaguccagguaaauuuuggaacaccacaauugcaguuucgauggcgaacaucuucagggguuccuauuuagcaggagcaggacuagcauuuagcuugaugaaaaguuuaggaggagggcguagggggacgggagcacaaggggaaacauugggagaaaaauggaaacgucaacuaaaucagcucagcaaaucugaguuuaauacuuacaaacgcagugguauaauggaaguagaccgcucagaagccaaggaagguuuaaaacguggagaaacuacaaaacacgcugugagucgcgguacagccaaacugagaugguuuguagaaaggaaucuuguaaaaccagaagguaaagucauagaccuggguuguggucgaggggguuggaguuauuauugugcaggguugaaaaagguaacagaagucaagggcuauacuaagggaggaccaggucaugaagagcccaucccaauggcaacuuauggauggaaucuggugaaacuacauucaggaaaagacgucuucuucaucccacccgaaaaaugcgauacgcugcucugugauaucggagaaucaaguccaaauccgacgauugaagaagggagaacacugcgcguucucaagaugguugagccuuggcuacgagggaaccaauuuugcaucaaaauucuaaacccuuauaugccguccguaguggaaacgcuugagcaaaugcaaaggaaacauggaggaaugcugguuaggaauccgcugucucgaaauaguacgcaugaaauguauuggguuucaugcggaacaggaaacauaguaucugcagugaacaugacuucaaggaugcuguuaaauagauuuacaauggcacauaggaaacccacauaugagcgugauguagauuugggagcugguaccaggcauguagcaguugaacccgaagucgcaaaucuggauaucauuggacaaagaauagaaaacauaaagcacgaacauaaauccacauggcacuaugaugaagacaacccguauaaaacaugggccuaccacggaucuuaugaaguaaaaccauccgggucagcaucuucgaugguaaaugggguugucaaauuauuaacaaagccaugggauguuauaccuaugguuacacaaauugcaaugacugauacaacuccauucggacaacaacguguuuuuaaagagaaaguagauacaagaacucccaaggccaaacgcggcacagcgcaaaucauggaaguaacggcuaaauggcuauggggauuucuuagucguaacaaaaaaccaagaauaugcacacgagaagaauuuacgcggaaaguucggaguaacgcugcaauuggagcgguuuuuguggacgaaaaucaauggaacagugcaaaggaagcuguggaagaugaacgcuucugggaccuaguucaccgggagagagagcugcacaagcaagguaaaugcgcaacuuguguauacaauaugaugggcaaaagagagaagaaguuaggggaauucggaaaggcuaaggggucacgggcuauaugguauaugugguuaggcgcacgcuuucuggaguucgaagcacuagguuuuaugaaugaagaucauugguucagucgagaaaauagucuaucaggcgucgaaggagaaggauugcauaaacuuggauauauacugcgugacauuuccaaaauuccaggugguaauauguacgcggaugauacggcugggugggauacccgaauuacagaagaugauuuacaaaacgaagcccguauuacugauaucauggaaccagagcaugcccugcucgcgagaucaauuuuuaaacuaaccuaucaaaauaaaguaguucggguucaaagaccagcuaagaacggcacuguuauggauguaauaagccgccgagaucaacgaggcaguggucagguaggcaccuauggucuaaacacuuuuacgaauauggaggcucaguuaauacgacaaauggagucagaaggcauuuuuucgcccagugaauuagaaacaccaauacuugcugaacgcgucuuagauugguuagagaaguacgguguugaaagguugaagaggauggcaauuucaggcgaugacugcguaguuaagccaaucgaugaccguuuugcaacagcauuaacagcucuuaaugacaugggaaaaguaagaaaagauauuccacaaugggaaccuucaaaaggcuggaaugacuggcaacaaguuccauuuuguagucaucauuuucaucaauuaaucaugaaagacggccgagaaauagucgucccaugccggaaucaggaugaacuaguuggacgcgccagaguuucacaaggggccggauggucgcuccgagaaacagcauguuuggguaaaucguacgcacaaauguggcaguugauguauuuucauagaagagauuugagguuagcagccaacgccaucugcagcgcuguaccuguagauuggaucccaacgucacguacaacuuggagcauucaugcucaucaucaauggaugacgacagaggacaugcuuagcguauggaacagaguuuggauagaggaaaaucccuggauggaagauaaaacucacauuucgaguuggggugacguaccauacuuaggaaagagagaagaucaguggugcgguucccuaauagguuuaaccgcaagggcuaccugggcaacaaacauucaaguugcgauaaaucagguuagaaggcuaauugguaacgaaaacuaucuagacuauaugacguccaugaaaagguucaaaaacgagucugauccagaaggggcauuaugguaa

SEQ ID NO: 21474 - RNA, 9879 nt, Artificial Sequence
  derived and/or modified CDS sequence (opt6) from DENV-1__EU677171__SS-prME
ucagugacuaugcuguuaaugcucaugccgaccgcucuagcauuucaucucacuacccgugggggugaaccacauaugauuguaucaaaacaggaaagagguaaauccuuacuauuuaaaacaagugcgggaguaaacauguguacacuaauagcaauggauuuaggagaacugugugaggauacuaugacguauaaaugucccagaauaacggaaaccgagccagaugacguugauugcugguguaacgcaacagauaccuggguuacuuacgguacauguucccaaacuggagaacaucggcgagacaaacgaucaguagcacucgcaccacauguaggacuaggauuggaaacccgcacggagaccuggauguccucagaaggagcuuggaaacaaauacagcgaguagagacgugggcacucagacauccaggauuuacaguuauagcacuguuucuagcacacgccauaggaacaucgauuacacaaaaaggcauuauauuuauacuauuaaugcuugugacaccgaguauggcgaugagaugugugggaauaggaucacgagauuuuguugaaggccugucuggugcuacauggguagacguaguauuagaacacgggucaugcgucacaacaauggccaaagauaaaccgacgcuggacauagaauuacuuaagacggaaguaacaaaucccgcaguauuaagaaaacucuguaucgaagcaaaaaucagcaauaccacaacagauucaagauguccgacucagggagaggcuacacugguagaagaacaagaugcgaauuuuguuuguaggaggacauucguagauagagguugggguaauggauguggacuauucgggaaagggagucuaauaaccugcgcgaaguuuaaaugcguuacgaaacuagaaggcaaaaucguacaauacgagaacuuaaaguacucuguaauaguuacaguucacacaggggaucagcaucaaguggggaaugaaucuacugaacauggaaccacagcuaccauaacgccacaagcuccuacaacggaaauacaauuaaccgauuacggcgcucugacuuuagauuguagcccacggacuggucucgacuucaaugaaaugguacuccuaacuaugaaagagaaaucauggcuaguucacaaacagugguuucucgauuuaccacuucccuggacaaguggagcgucaacaagucaagaaacguggaacagacaagaucuuuuagucacuuucaagacagcacacgccaagaaacaagaagucguaguccuggggucccaagaaggcgcgaugcauaccgccuuaacuggagcaacugagauacaaacaagugguaccacaacgauauuugcuggacacuugaaaugucgccugaaaauggauaaauugacauuaaaaggcaugucauacguuauguguacggggucauucaaauuagaaaaggaagucgcagagacccaacauggcacaguauugguacaaauuaaauaugaggguacagacgcaccaugcaaaaucccauucagcacacaggacgaaaaaggaguaacucagaacggucgacugauaacugcuaacccuaucguuacggauaaagaaaaaccuguuaauauagaagcugagccuccauucggagagucauauauuguuauuggagccggcgaaaaggcauugaaacuuaguugguuuaaaaaggggaguucaauagguaaaauguucgaagcaaccgcuagaggugcacgacggauggcaauacucggugauacagcuugggacuuugguucgauuggaggcguauuuacuagcguagggaaauuagugcaucaaaucuucgguacagcuuauggaguuuuauucaguggaguuucguggacgaugaagauugggauugguguauuauuaacuuggcuaggauuaaacagucgaucaacgucgcucucgaugacaugcauugcuguuggauuaguaacucuauaucuggguguuauggugcaggccgacaguggcuguguuauaaauuggaagggacgcgaacuaaaaugcgguucagguauuuuugucacuaacgaaguccacacguggacugaacaguacaaguuccaagcagauucaccuaaacgucugucagcugcgaucggcaaagcaugggaagaaggaguauguggcauaaggucagcuaccagguuagaaaauaucauguggaagcagauaaguaaugaauugaaucauauacugcuagagaaugacaugaaauuuacagucguggucggugauguagcaggaauacuagcacaaggaaagaaaaugauaagaccacagccgauggaguauaaauauucuuggaaaucauggggaaaagcaaaaauuauaggcgcagauguccaaaauacaacauuuauuauugauggaccuaauacgccagaaugcccagacgaucaaagagcuuggaauauuugggaaguugaagacuauggauucggcauuuuuacaacgaacauaugguuaaaauugcgcgauucuuacacgcaaguuugcgaucaccguuuaauguccgcggcaauaaaagacucgaaggccguacaugcagauauggguuauuggauagaaucagagaaaaaugaaacuuggaaacuugcuagagcuucauucauagagguuaagacuugcauauggccaaaaagccauacauuauggucgaaugguguuuuagagagcgaaaugaucauaccaaaaauauacggaggaccgauaagucaacauaauuauagaccuggguauuucacacaaacagcaggaccauggcaccuuggaaaauuggaacucgauuuugauuuaugugaaggaacuacgguaguugucgacgaacacugugguaacaggggaccgagcuuaagaacuaccacugucacagggaaaauaauucaugagugguguugucgaucuugcacauuaccuccguugagauucaggggcgaggauggcuguugguauggaauggaaauacggccugugaaagagaaagaagagaaucuagugaaaucaauggucucugcgggaucgggcgaggucgacagcuuuucccuaggauugcucuguauaagcauaaugauagaagaggucaugagaucacgaugguccagaaaaauguuaaugacuggaacccuagcuguauucuuucucuuaauaaugggacaacuaacguggaaugauuuaauacgacuaugcaucaugguaggugccaacgcaucagauagaauggguaugggaaccacguaccuugcccuuauggcaacauuuaagaugaggccgauguuugcuguaggguuacuauuucgaagacugacaaguagggaagucuuauuauuaacgaucggcuuaucccuggucgccagcguagaacugccaaauagucuugaagaacucggcgauggucuugcgauggguauuaugauucucaaacuccuuacggauuuccaaagccaucaacuaugggcaacacucuuaucauuaaccuuuauuaagacaaccuuuucccuacacuaugcauggaaaacaauggcuaugguacuaucaauugucaguuuauucccuuuauguuuguccacgacuagccaaaagacaacaugguuaccuguacuccugggaucguuaggauguaaaccuuuaacaauguuuuugauagccgaaaauaaaauauggggccggcggucguggccgcuuaaugaagguauuauggcgguagggaucguguccauccuauuaaguucauuauugaaaaaugacguaccgcuagcaggcccacuaauugcaggcggaaugcuuaucgcauguuaugugauaucaggcaguucagcagaccuguccuuagaaaaagccgcagaagucucuugggaagaagaggcggagcauucuggugcaagccacaacauccuagucgaaguucaagaugaugguaccaugaagauuaaagaugaagaacgcgaugauacacuaaccauacuauuaaaggcuacucuccucgccgucucaggaguauacccauuguccauaccggcaaccuuauucgucugguauuuuuggcaaaagaagaaacaacgaucaggugucuugugggauacaccaagcccaccagaaguagaacgugcaguauuggacgauggaauauaccgcauaaugcaaagaggacuguuagggcggucucaaguuggugucgggguauuucaggagaacguauuucauacuauguggcacguaacaagaggcgcugucuuaauguaccaagggaagagguuagagccgucuugggcauccguuaagaaagaccuaauaaguuacggugguggcuggagguuacaagguuccuggaacaccggcgaggaaguccaaguuauugcuguggaaccagguaaaaaccccaaaaauguacagacugccccuggcacuuucaaaacaccagaaggagagguaggagcuauagcacuggacuuuaaacccgggacaagcggaagucccaucguaaaucgcgaagguaaaauaguuggauuauauggaaacggcguugucacuacaucugguacuuauguaucugcaauugcccaagcaaaggcaagccaagaaggaccauuaccggaaaucgaggaugaaguauuuagaaagcgaaaucuaaccauuauggaccuccacccuggaucagguaaaacacguagguaucuaccugcaauuguaagggaggcuauaaaacgaaagcucaggacccuaauccuugcaccgacacgcguaguagcuucagaaauggcugaagcacuuaaaggcaugccaauaagguaucaaacaacagcagugaaaagugagcacaccgguaaggagauuguggauuuaaugugccacgccaccuucacuaugagauuacugagccccgucagagugccuaauuacaauaugaucauaauggacgaagcacauuucaccgaucccucuuccaucgcagcucguggauauauuucuacaagagucgguaugggcgaagcagcugcaauauucaugaccgcuacacccccgggcucaguugaagcguuuccacaauccaacgcaguuauacaagacgaagaaagagauauucccgaaaggagcuggaacucgggauacgaauggaucacugauuuucccgguaaaaccguaugguucguuccauccauaaagagcggaaaugauauagcuaacugucugagaaagaauggaaaaagagucauacaacuuagccggaaaacuuuugacacugaauaccaaaagacuaaaaauaaugauugggauuacguaguuacuacagacaucucagaaaugggggcaaacuucagagccgauagggugaucgacccaaggagaugucucaaaccuguaauacuaaaagaugguccggaaagaguaauucuagcagggccaaugccuguaacgguggcaagugcagcacaacgacgcgguaggauuggacguaaucacaacaaagagggcgaccaguacauauacaugggacaaccgcucaauaacgaugaagaccaugcccacuggacagaagcuaagaugcuacuggacaacauaaauacgccugagggaauaaucccggccuuguucgaaccugagagagaaaaaucagcagcuauugacggagaguacagacuucgaggugaagccaggaaaacguucguagaauugaugcgacgaggagaucuuccugucugguugucauacaaaguagccucugaaggauuccaauauuccgaccguagaugguguuuugauggugagaggaauaaucagguuuuagaggaaaauauggaugucgaaauauggacaaaggaaggcgagaggaagaaauugagaccaagauggcuagaugcacgcacauacucagauccacuagcacugagagaauuuaaagaauuugcagcggguagaagauccgugucaggggaucuaauucuagaaauaggaaaauuaccgcaacaccuaacgcagcgagcgcaaaaugcucuagauaaucuaguaauguuacauaacagugaacagggaggcagagcguaucgacaugcaauggaagaauuaccggacacaauagagacauuaaugcuguuggcacugauugcgguucuuacagggggagucacacuauucuuuuuaagcggacgugggcuugguaaaacgaguauagggcuacuuuguguuauggcuaguagcgucuuacuauggauggccagcgucgaaccacauuggauugcagcgucgauuauacuagaguucuuuuuaaugguacuacucaucccagaacccgauagacaaagaacaccccaagauaaucaauuggcauaugucguaauaggucuuuuauucaugauucugacuguggcggcaaaugaaauggggcuacuagaaacuacgaagaaagauuuagguauaggucauguugcagucgagaaccaucaucacgcggcaauguuagacguagaucuccacccagccucagccuggacuuuauacgcuguagcaacuacuauuauaacuccaaugaugagacauacuaucgagaauacaacggcgaacauuagccugaccgcaauagcuaaucaagcggcgauucugauggggcuagacaaaggguggccaauuagcaaaauggacauuggaguaccuuuauuggcacuaggguguuauucgcaaguuaauccucuaacuuuaacagccgcuguacuuauguuaguggcacauuaugcaaucauagggccaggacuacaagcaaaagcuacacgugaggcgcaaaaacgaaccgcggcaggaauaaugaagaauccaaccguagacggaauaguggcuauagaccuagauccuguuguauacgacgcaaaauuugaaaaacaacugggucaaauaauguuacucauuuuauguacaucgcagauauuacuaaugagaaccacgugggcuuugugugagagcauuacuuuagcaacugguccacuaacaacccucugggaagguagcccagguaaauuuuggaacacuacuauugcuguaaguauggcaaauauauucagaggauccuauuuagcaggggcaggguuggcauuuucuuuaaugaagucacuaggugguggucggagagguacaggagcccaaggagagacucuuggggagaaguggaagaggcaacugaaucaacuuaguaaguccgaauuuaacacuuauaagcgauccggcauaauggagguagaccguagcgaagccaaagagggucucaaacgaggagaaacaacgaaacacgcaguaucccgugguacugcaaaacuccgaugguuuguugaaagaaaucuagugaaaccggagggaaaaguaauugaucucgguugugguagaggaggguggucauauuauugugcugggcuuaagaaaguaacagagguaaaggguuauacaaaaggaggaccaggucaugaagaacccauuccaauggcuaccuauggguggaaucuuguaaagcuacauaguggaaaggaugucuucuucauacccccagagaaaugugauacuuuacuaugugauauuggugaaaguucuccuaacccaaccauugaggaaggacgaacacuacguguauugaagaugguagaaccuugguuaagagggaaucaauuuuguauuaagauauugaauccauauaugcccucaguagucgagacauuagaacagaugcaaagaaaacaugguggaauguuaguuagaaacccccuaucuagaaauuccacucaugaaauguacugggucucaugugguacugguaauauugugucagcggugaacaugacuucucgaaugcuccuaaaccgcuuuaccauggcgcauagaaaacccacauaugaacgugacguugaucuaggggcuggaacccgucacguagcagucgagccagaaguagccaaccucgauauuauuggucaaagaaucgaaaauauuaaacaugagcacaaaagcacauggcauuaugacgaagauaacccauauaagaccugggcguaccauggaagcuaugaggucaaaccuaguggguccgccucaaguaugguaaauggcguuguuaaacugcucacgaaaccgugggauguuauaccgauggucacucaaaucgcgaugaccgacacuacaccauucggucaacagcgugucuuuaaggaaaaaguggauacccggacaccuaaagccaaaagaggaacagcccaaauaauggaaguuacugcaaagugguuguggggauuuuugucucgcaauaaaaagccaagaaucugcacucgugaagaauuuacacgcaaaguuagaaguaaugcagcaauaggggcaguauuuguugacgaaaaucaauggaacucagcuaaagaagccguagaagacgaacgauuuugggauuuaguacauagagagagagagcuacauaagcaagggaaaugugcaacgugcguauauaacaugaugggaaaacgagagaaaaaguuaggugaguucgguaaggccaaagguaguagggcaauuugguacaugugguuaggagcuagguuccuugaauuugaggcuuuaggauuuaugaaugaagaccacugguucucgagagagaacagucuuucuggagucgagggugaaggccuacacaaauuagguuauauauuaagggauaucaguaaaauuccgggaggaaauauguacgcggaugacacggcuggaugggauacaagaauuacggaagaugaccuacaaaaugaagcuagaauuacugauauaauggaaccagaacacgcgcuacucgcccgaucuauauucaaauuaacuuaucaaaacaaagugguacgaguacagagaccagccaaaaauggcacaguaauggacguaauaagucgcagagaccagagagguucuggacaaguugguacauacggccugaauacuuuuacgaauauggaagcacaacuuauacgacaaauggagagugaagggauauuuucgccauccgaauuggagacacccaaccuggcugagaggguucuggacugguuagagaaauaugguguagagcgauuaaagcgaauggcaaucucgggugaugauugugugguaaagccaauagaugaucgauuugcaacugcucucaccgcauugaacgacauggguaaaguacguaaggacauuccgcaaugggagccuucaaaaggcuggaacgauuggcaacaagugccauuuugcucacaccauuuucaucaauugaucaugaaagacggucgagaaaucgucguaccaugcaggaaccaagaugaguugguaggacgagcaagggugucccaaggagcuggguggaguuuacgagaaaccgcuuguuuaggaaaaaguuaugcccagauguggcaauuaauguauuuucauagacgcgauuuaagacucgccgcuaacgcgauauguagcgcuguaccagucgacuggauaccaacgucccgaaccacauggaguauacaugcgcaucaucaauggaugacuacagaagauauguugucgguuuggaaccgaguauggauagaagaaaaucccuggauggaggauaaaacgcauaucaguucguggggagacgugccuuauuuaggcaaaagagaagaucaauggugugguucgcuaauuggacugaccgccagagcaacuugggcaacaaacauucagguagcuauaaaucaaguacgucgguugauuggcaaugagaacuaccuagauuacaugacaaguaugaagagauuuaagaacgaaucugauccagaaggggcuuuaugguga

SEQ ID NO: 21475 - RNA, 9879 nt, Artificial Sequence
  derived and/or modified CDS sequence (opt6) from DENV-1__EU677172__SS-prME
agugugacaaugcuauuaaugcuaaugccuacagcgcuagcauuucaccuuacaacaagagguggugaaccgcacaugaucguaaguaaacaagaaagggguaagagcuuacuuuuuaaaacuucagcagggguuaauauguguacccuaaucgcgauggaccuaggggaacuaugcgaagacaccaugacguacaaaugcccucgaaucacugaaacugagccagaugacguugacugcugguguaaugcaaccgauacauggguaacauaugguaccuguucacaaacaggagaacacagaagagauaaaagaucgguggcuuuagcaccccauguuggauuaggccuagaaacacgaacugagaccuggaugagcucagaaggugccuggaaacaaauacaaagaguagagacuugggccuugcgacauccgggauuuacugugauagcuuuauuuuuagcacaugcaauaggaacauccaucacacaaaaagggauaaucuuuauacuccuuauguuaguaacaccuucuauggcuaugaggugcguagguauaggaucgcgugauuuuguugaaggacugaguggcgcaacuuggguagacguuguccuagaacauggcucaugcguuacgacuauggcaaaagauaaaccaacacuagacauagagcuacuuaaaacugaaguaacgaacccagcuguacugagaaaauuaugcauagaagcgaaaauaucaaacacaacgaccgauucuagauguccgacccagggagaagcaacacugguggaagaacaggacgcgaacuuugucugccguagaaccuuuguggacagaggauggggcaauggauguggucuguucggaaaaggcagcuugauuaccugugcaaaauucaaauguguaacaaaacuagaaggaaaaauaguacaauacgaaaaucuaaaauacagcguaaucgugacgguacauacuggagaccagcaccaggucggcaaugaaucgacagagcacgguacaacagcuacaauaacaccacaggccccuacgacggaaauccaauugacggacuacggagcauuaacacuugacuguuccccacgcacgggacuggauuuuaacgagaugguccuguuaaccaugaaagagaaaucauggcuaguucauaaacagugguuuuuggacuugccccuacccuggacuucaggggcaaguacaagccaagaaacauggaacagacaggaucuacucguaaccuuuaaaacugcacacgccaagaaacaggaaguagugguguuaggaucacaagaaggugcgaugcacacagcacuaacaggagcgacagaaauacaaaccucagguacuaccacuauauuugcgggacaucucaaaugccgacuuaaaauggacaaauuaacacuaaaagggaugucguauguuauguguacggguucauucaaacuagaaaaagaacuggccgagacucaacacggcacuguucugguacagaucaaauacgagggaaccgacgcacccugcaaaauaccguuuucuacucaagaugaaaagggugucacacaaaacggaagacugaucacugcuaacccgaucgugacagacaaagaaaaacccguuaacauugaagcagaaccaccguuuggcgaaaguuacaucguaauaggagcgggugagaaggcuuugaaauugucaugguuuaagaaaggauccucgauagguaagauguuugaagcuacagcaagaggagcgagacggauggcuauucuuggagacaccgcaugggacuucggcaguauagguggcguauuuacuuccguuggaaaacucguacaucaaaucuuugggacugcauacgguguauuguucucggguguaucauggacgaugaaaauaggcauuggaguacuacuaaccuggcucgggcuaaauucgagaaguaccucccuaucaaugacauguauagcagucgggcuagucacuuuauacuuagggguaaugguccaagccgauuccggauguguuauuaacuggaagggacgggaauuaaaaugugggucaggaauuuucguaacaaacgagguucacacauggacagagcaauacaaauuucaagcugauucaccuaaacgucuuucggcagcaauugggaaggcuugggaagagggagucuguggcauacguuccgcuacaaggcuggaaaauauuauguggaaacagauuagcaaugaauuaaaucauauacuuuuagaaaaugacaugaaguuuacgguagucgucggcgacguagcagguauacuugcucaaggaaagaaaaugauaaggccacaaccgauggaguauaaauacucauggaagaguugggggaaagcaaaaauaauuggggcugaugcacagaauacaaccuucauuauagauggacccaacacaccagaaugcccugaugaccaacgagcauggaacauaugggaaguagaagacuauggguucgggauauuuacgacuaauauauggcugaaacuccgagacaguuauacucaaguaugcgaucaucgcuugaugucggcagcaauaaaagauaguaaggcagugcaugcugacaugggauacuggauagaaagugagaaaaaugaaacauggaaauuagcacgugcaucguuuauagaaguaaagacauguauauggccaaaaucgcacacccuaugguccaauggagugcuagaaagcgaaaugaucauuccgaaaauuuacggugggccuauuucgcaacacaauuaucguccuggauacuuuacccaaacugcagguccauggcacuuaggaaaacucgaauuagacuucgaucuaugcgaggggaccacagugguuguagacgaacauuguggaaauagaggaccaucacugagaacaaccacaguuaccgguaaaaucauacaugagugguguugcagaaguugcacauuacccccauugagauuucguggugaagacggcugcugguacggaauggagauacguccaguuaaagaaaaggaagaaaaucuugugaaaaguaugguguccgcagguucuggcgagguugauagcuuuucauuggggcuguuauguaucucgauaaugauagaggaagucaugagaucacgauggagccgaaaaauguuaaugacggggacucuugccgucuucuuucuacuaacaaugggacagcuuaccuggaaugauuugauaagauuaugcauaaugguaggugcuaaugccagugauagaaugggaauggggaccacauaccuagcucuaauggcaaccuuuaaaaugaggccaauguuugcagugggauuacuguucagacggcuuaccagcagagagguguuacuauuaacaauuggacuaagucucguggcaagcguggaacuuccaaacagucuagaagaauuaggggaugggcuagcuaugggcauaaugauauuaaaauugcuuacagauuuccaaucgcaucagcuuugggcuacacuguuaaguuugacguucauaaaaacuacauuuuccuuacauuaugcauggaaaaccauggccaugguucuaaguauagucagucuuuucccgcuuuguuuaagcacaacgucacagaaaacaacguggcugccuguuuugcuaggcagucuaggauguaaacccuugacuauguucuuaaucgcggagaacaaaauuuggggucgaagaucauggccccuuaacgaaggcauaauggccgucgguauaguaagcauacuguuaucaagccuacuuaaaaaugauguuccuuuagcugggccauuaauagcugguggaauguuaaucgcuugcuacguuauuagcggaucaucagcagaccuaucuuuggaaaaagcagcugaaguuaguugggaggaagaggcagaacacucuggagcaagucacaauauuuuaguagagguccaagacgacggcacgaugaagauuaaagacgaagaaagggacgauacacucaccaucuuauuaaaagccacauuauuagcaguaaguggaguauacccacuaucgauucccgcuacucucuucguaugguacuuuuggcagaaaaagaaacaaagaucaggcguauuaugggacacaccuaguccuccagaaguagaaagggcagucuuggacgacgguauuuauaggauuaugcaaaggggacuucuuggaagaagccaggucggagucggcguuuuucaagagaacgucuuucacacgauguggcauguuacaagaggugcuguucucauguaucaaggcaagagacuagaaccaucaugggcuucaguuaagaaggaccuaauaagcuacggagggggcuggcgucugcaaggaagcuggaauacaggagaagaaguccagguaauagcaguugaaccuggcaaaaaucccaaaaacguucaaacagcuccaggaaccuuuaaaacaccugaaggcgaagucggcgccaucgcucuggauuuuaaaccaggcacauccgggucuccuauugucaauagagaagggaaaauaguaggacuguaugguaauggaguaguaacgacaucagguacauaugugucugcaaucgcucaggcaaaggcuucucaagaaggaccuuuaccagaaauagaagacgaaguauucagaaagagaaaccugacgaucauggaccugcacccaggaagcggaaaaacuagaagauauuuaccagcaaucguacgagaagcaaucaagagaaaacuucggacgcuaauauuagccccgacuaggguaguugcaagugaaauggccgaggcuuugaaaggcaugccaauuagauaucaaacaaccgcaguuaaaagcgaacauaccgguaaagaaauuguugauuuaaugugucacgcaacguucaccaugaggcuccucucuccagugcgaguaccaaauuauaauaugauaauuauggaugaagcgcauuucacggacccuucgucgauugcggcacguggcuauauaucuacacgcguuggcaugggagaagcggcagcaauauucaugacagcuacacccccagguaguguugaagcauuuccucagucaaaugcuguaauccaagacgaagaacgagacauaccagagcgaagcuggaacucagguuaugaauggauaaccgauuucccaggaaaaacuguuugguuuguuccuucgauaaaaucuggaaaugacauagcuaauugucuaaggaagaacggcaagagaguaauccagcuaagucgaaaaacauuugauacugaauaucagaaaaccaaaaauaaugauugggacuauguagucacuacggauaucagugagaugggagcaaacuuuagggcugaucgaguaauugauccuagaagauguuugaaaccuguaauucucaaagaugguccggaaagagucauuuuagcaggcccgaugccuguuaccguagccucggcugcucaaagaagaggcagaauagguagaaaccauaacaaagagggagaucaauauauauacauggggcaaccccuaaacaaugaugaagaucaugcgcauuggacggaagccaaaaugcuauuagacaacauuaacacaccugaaggaaucauaccggcauuauucgaaccagaaagggagaaaagcgccgcgauagacggcgaauacaggcuucgaggugaagcaaggaaaacguucgucgaacugaugagaagaggggacuuaccugucuggcuaagcuacaaagucgcgagugaggguuuucaguauuccgaccgacguugguguuuugauggggaaagaaauaaccaaguuuuagaagaaaacauggauguagaaauuuggacuaaagaaggcgaaaggaagaaauuacgaccaagauggcuugacgcaagaacauacuccgauccgcuagcacuacgggaauuuaaagaauuugcagcggguagacggucugucagcggugauuuaauuuuggagaucgguaaacugccacaacaucuuacacaaagggcccaaaacgcuuuggacaacuuaguaauguuacauaacucggagcaaggcgggagagcauacagacaugccauggaggaguuaccagacacuaucgaaacauugaugcuccucgcauuaaucgcuguauugacaggagggguuacgcuguucuuuuuaaguggaagaggucucggaaaaacauccauuggauuacuaugcguaauggcaucaucaguauuguuauggauggcaucuguugaaccucacuggauagccgcaucuauuauauuagaguucuuucuuaugguucuauugauuccugaaccagauagacaaagaacuccacaagauaaucaacuagcuuaugucguuaucgggcuauuauuuaugauacucacuguugcugcuaaugaaaugggcuuauuggaaaccacgaagaaagauuugggaauagggcacguagcaguagaaaaccaccaucacgcggcgauguuagauguugauuuacauccugcaucugcguggacuuuauaugcugucgcuaccacaauuauuacuccaaugaugagacacaccauugagaacacaacagcuaacauaucauuaacugcgauagcgaaucaagcugcaauucuaauggguuuagacaaaggauggccaauuagcaagauggauauuggcgugccucuacuagcucuaggaugcuauagucagguuaacccgcuaacacuuacagccgccgucuugauguugguagcucauuaugcaauaauugguccaggacuccaggcuaaagcaacaagagaggcucagaaaaggacagcagcagguaucaugaaaaauccaaccguggaugguauaguagcuauagacuuagauccugucguguaugaugccaaauuugaaaagcaacuagggcaaauaauguuauuaauauuaugcacuucacaaauacuucuuaugaggaccacuugggcgcuuugugaauccauaacacuugccacugguccacugacaacacugugggaagggaguccugguaaauuuuggaauaccaccauagcagugaguauggcuaauauauuuagaggaucguaucuggccggagccggccuugccuuuagcuuaaugaaaaguuuaggaggugggaggcgaggcacgggagcgcaaggugaaacucuuggagaaaaauggaaacgacaacuuaaucaauuaucaaaaucagaauuuaauaccuacaaacgaagcggcauaauggaaguugauaggucagaagccaaagagggucuuaaaaggggagaaacaacgaaacaugcaguguccagaggaacugcuaaauuaagaugguucguagaaaggaauuugguaaaaccugaggggaaggugauugauuugggauguggacgaggcggaugguccuauuacugugcuggacugaagaaaguaacagagguuaaaggauauacgaaaggugggccuggacaugaagaaccaauaccuauggcuacauaugguuggaacuuagucaagcugcauucugguaaagauguauucuuuauaccgccugaaaaaugugacacauuauuaugcgauaucggcgaaagcaguccgaaccccaccauagaagagggccgaacgcugagaguucucaagaugguugagccauggcuaagaggcaaucaguucuguauaaagauuuugaaucccuacaugccuagcgucguagaaaccuuagaacaaaugcagcgcaagcacggaggaauguuaguacgcaacccucugucaagaaacaguacacaugaaauguauuggguaucaugugguacagggaauauaguaagcgccgucaauaugacaucaagaaugcuguuaaaccgguucacaauggcacacaggaaaccaacauacgaacgcgauguggaccuuggagcgggaacucggcacguagcaguggaaccggaagucgcaaacuuggauauaauuggccaaagaauugaaaauauaaaacacgagcacaaaagcacuuggcacuaugacgaggacaauccauacaaaacuugggccuaccacgggucauaugaaguuaagccuuccggaagugcuucuucaaugguuaauggcguagugaaacuauuaacaaaaccuugggacguuauaccuaugguuacccaaaucgcaaugacagacacaacucccuuugggcaacaaagaguuuuuaaagagaagguugauacgaggacaccaaaagcuaaaagaggaacugcgcagaucauggaagugacagcaaaauggcuuuggggauucuugucucgcaacaagaaaccacguaucugcacaagagaagaauuuacaagaaaaguuagaucaaacgcggcaauuggggccguauuuguagacgaaaaucaauggaacucagccaaagaggcaguagaagaugaaagauucugggaucuaguacauagggaacgugaacuacauaaacaagguaaaugugccacguguguuuauaacaugaugggcaagagagagaagaaauuaggagaauuuggaaaggcuaaaggaucacgugcuauuugguauauguggcuaggagcaagguuuuuagaauuugaggcuuuaggauuuaugaaugaagaccauugguucucucgugaaaauuccuugucagggguugaaggagaaggcuugcacaaacuaggguacauauugagggauauuagcaaaauuccaggagggaacauguaugcagacgacacagcuggaugggauacccggauuacagaagacgacuugcagaaugaggcaagaauuacugacauaauggagccagaacaugccuuguuagcgaaaaguauauucaaacuuacauaucaaaacaaggucguaaggguccaaaggcccgccaaaaaugggacagugauggacguuauuaguagaagggaccagcgcggaucuggacaaguugguacguauggcuuaaauacauuuacaaauauggaggcgcaauuaaucagacaaauggaaagcgaagguauauucuccccaucggaacuagagacccccaaucuagcggaacguguauuggauuggcucgaaaaauacggcguggagcguuuaaaacgcauggccaucucuggugaugauuguguuguaaaaccaauugaugacagauucgcaacagcacuaacugcacuaaaugauaugggaaaagugagaaaagacaucccucagugggaaccaucuaaaggguggaaugacuggcaacaggucccauuuugcucucaccacuuccaucaguuaauaaugaaagacggucgggagauaguuguaccaugcaggaaucaggacgaacuuguaggaagggcccgaguaucgcagggagcaggauggagucuaagagagacggcgugucucgguaaaucauaugcucaaauguggcaauuaauguauuuccacagacgugauuuacguuuagcagcaaaugcuauaugcuccgcggucccaguagauuggauacccacaagccgaacaaccuggucaauccaugcgcaucaccaauggaugaccacagaagacauguuauccguauggaacagaguauggauagaagaaaaucccuggauggaagacaaaacgcauauaucuucauggggagacguuccuuacuuaggcaaacgggaagaccaauggugugguucccucauuggacuaacagcacgcgcaaccugggcaacaaauauccagguagcuauaaaucaaguaagacggcugaucggaaacgaaaauuaccuagacuacaugaccagcaugaaacgcuuuaaaaaugaaagcgaccccgaaggggcgcucugguag

SEQ ID NO: 21476 - RNA, 9879 nt, Artificial Sequence
  derived and/or modified CDS sequence (opt6) from DENV-1__EU677173__SS-prME
agcgucacaauguuguugaugcuaaugcccacagcauuggcguuucacuuaacuacuagaggaggggaaccacacaugauagucacgaaacaggaacguggaaaaucuuuauuauuuaaaaccagugcuggaguuaacaugugcacccugauugcaauggauuuaggcgaacuuugcgaagauacaaugacuuauaaaugcccgagaauaacggaagcagaacccgacgauguagauugcugguguaacgcgacagauacguggguaacuuacggaacguguucccaaaccggagaacacagaagggauaaaagaucaguggcauuggcuccacauguggggcucggucuggaaacaagaacagaaacguggaugucuucugaaggagcauggaaacagauucaacgcguugaaacuugggcgcuaaggcauccaggauuuacaguuaucgcauuauuucuagcucaugcaauuggaacaagcauaacucaaaaagguauaauauuuauucugcugaugcugguuacaccaaguauggcaaugcgaugugugggcauuggaucaagagauuuugucgaaggccuaaguggggcgacauggguagacguagucuuagaacaugggaguuguguuacaacuauggcaaaagacaaaccuaccuuagauauagaauuacuaaaaacagaagugacuaauccggccguuuuacgaaaacuauguauugaagccaaaauaucgaauacaacgacugauucucguugcccgacccagggcgaagcgacucucauggaagaacaagacgcgaacuuugugugcaggcgaacauuuguggaucgggguuggggaaaugguugcgguuuauuugguaaaggaucgcuaauuacaugugcgaaauuuaaauguguaacuaaacuagaagguaaaauuguccaauaugagaaucugaaauauaguguaauaguaaccguucacacaggugaucagcaccaagugggaaacgaguccacggagcauggaaccaccgcaacaauaacaccgcaggcaccaacgagcgaaauacaacuaaccgacuauggagcgcugacucuagacuguagcccccgcacagguuuggauuuuaacgaaaugguacuauuaacuaugaaagagaaaucgugguugguccacaaacagugguuucuagaccuacccuugcccuggacaucaggugcaacaacgagucaagaaacauggaaccgucaagaucucuuaguaacauuuaaaacagcccacgcgaagaaacaagaaguugucgugcuugguucccaagaaggagcgaugcacacagcuuuaacaggcgccacggaaauccagacuagcggaaccaccacuauauuugcgggccacuuaaaaugcagauuaaaaauggacaaacuaacccugaaagguaugucauaugugaugugcacuggaucuuuuaaacuugaaaaagaaguggcugaaacccaacacgguacaguccuggugcaaauaaaauacgagggcacagacgcaccauguaaaauaccguucuccacacaggacgaaaaagguguaacacaaaacgggagacuaauuacugcuaacccuauugucacugacaaagagaaaccagucaacaucgaggcugaaccaccauuuggugaaaguuauaucguaauuggggcuggggaaaaggcacugaaauuaagcugguuuaagaaaggaucaucuaucgguaaaauguuugaagcgaccgcuagaggagcaaggcgaauggcaauacuaggugauacagcuugggauuucggcuccauagguggaguuuucacaucaguaggaaagcuagugcaccaaauuuuuggaaccgcauauggcgucuuauuuuccgggguuagcuggacaaugaagauaggaauugguguuuuacuuacauggcuagggcuaaauucuagaucgaccagcuuaaguaugacguguauugcaguaggccuaguuacauuauacuuaggagucaugguacaagcagauucuggcuguguaauuaauuggaaagguagggaauugaaaugcgggagugggaucuucguuacaaacgaaguacauacauggaccgaacaauauaaauuccaggcagacagcccgaaaagacucucugcugccauagguaaggcaugggaagagggaguuuguggcauuagaagcgcaacaagauuggaaaauauuauguggaaacagaucaguaaugaauuaaaucauauucuguuggaaaaugauaugaaauuuacagugguugucggcgauguuguagguauacuugcccagggaaagaaaaugauaagaccacaaccuauggaacacaaauauucuuggaaauccugggguaaagcuaaaaucauaggggcugaugugcaaaacacgacguucaucauagauggaccuaacacuccagaaugcccugaugaucaacgugcuuggaauauuugggaaguagaggauuauggauuugggauauuuacuacaaauauauggcucaaguuaagagacucauauacccaaaugugugaucauagguuaaugagcgcagccaucaaagauagcaaagccguacaugcagauauggguuauuggauagaaucagagaaaaacgagaccuggaaauuagcuagagcgagcuuuauugaagucaaaacaugcauauggccuaaaagccauacacucuggucuaauggugucuuggaaagcgaaaugauaauacccaagauauacggugguccgauuucacagcauaauuauagaccaggauauuuuacgcaaacggcaggccccuggcaucuagggaagcucgagcuugauuucgaucugugcgagggcacaaccgucguuguagaugaacacugugggaacagagguccaaguuugcgcacaacaacuguaaccggcaaaauaauacaugaauggugcugucguucuuguacauugccuccuuuaagauuuaaaggagaagacgguuguugguauggaauggaaauuagaccgguuaaagaaaaagaagaaaauuuaguaaaaucuaugguaagugcagguucaggagagguggauagcuucaguuuagggcuacuaugcauauccauuaugauugaggagguaaugaggaguagauggagcagaaaaauguuaaugacaggcacccuagcgguguuucuuuuacuaauaauggggcaacuuacuuggaacgaucuaaucagauuauguaucaugguuggagcuaacgccagugaccguaugggaaugggaacuacauaucuagcauuaauggcuacuuuuaagaugagacccauguuugccguaggccuucucuuccgaagguuaaccaguagagagguguuacuauuaaccauaggucuuucguuaguagcaucugucgaauugccaaauagccuagaagaguuaggugacggucuagcaaugggaauuaugauccuaaaacuacuuacggauuuucaaucucaccaacuuugggcaacucuuuuaucacugacauucauuaagacgacacuuucacuacacuaugcguggaaaacuauggcgaugguauuaaguaucguuucgcuauucccacuauguuugaguacgacaucacaaaagacgacuugguuaccaguacuguuaggaagucuugguuguaagccucuuacuauguuuuugauuaccgaaaauaagaucuggggacggaaaagcuggccucucaacgagggcauaauggcgguaggaguaguaucaauuuuacuaaguagucuucuaaagaacgaugucccauuagccgguccacuaauugcaggagguauguugauagcaugcuacguuauuagcgguuccucagcagaucuaucauuggagaaagcugcagaaguuaguugggaggaggaggcagagcauucaggcgcgagucauaauauccuuguagaaguccaagacgaugggaccaugaaaauaaaggaugaagaacgugaugauacucuaacaauauuauuaaaagcuacccuacuggcaguuagcgggguuuauccauuauccauucccgcgacauuauuuguuugguauuucuggcagaagaagaaacagagaucaggaguacucugggauacaccuagucccccagaaguagaaagagcaguucuagacgauggaauauaucgcauuaugcaaagagguuuauuagggcgaucgcaagugggaguugguguuuuucaggagaacguguuucauacaauguggcauguaacacggggugccguucugauguaucaaggaaaaaggcuagaaccaagcugggccucaguuaagaaagauuugaucaguuauggugguggcuggcggcuucaaggaucauggaaugcuggagaagaagugcaaguuauagcgguagagccgggcaaaaaccccaaaaauguccagacagcuccuggaacuuucaaaacacccgaaggagaaguaggggcuaucgccuuggauuucaaaccaggaacuucaggcuccccaauaguuaacagagagggcaaaauaguaggauuauauggcaacggaguaguuaccacaucugguacuuauguuuccgcgauagcccaagccaaagcaagccaagaaggaccacuacccgaaaucgaagaugaaguuuucagaaaaagaaauuuaacgauaauggacuuacaucccggaaguggcaaaacucgaagauacuugccagcuauaguucgggaggcaauaaaacggaaacuaagaacacuaauucuugcaccgacacguguaguggcaucagagauggcggaagcauuaaaaggaaugccuauuagguaucaaaccacagccguuaaaucugaacauacaggaaaagaaauuguagaucuuaugugucaugcaaccuuuacaaugagauugcuuagcccuguuagagucccgaacuauaauaugauaauuauggaugaggcucauuuuacagacccuaguucaaucgcggcgcguggauacauuucaacgagaguaggcaugggcgaagcugcagcaauuuucaugacugcuacaccuccaggaucaguggaagcauuuccucaaucuaacgcagucauccaagaugaagaacgagauauaccugaacguagcuggaauagcggauaugaguggauuacagacuucccagguaaaacagucugguuuguuccuuccauaaaaucaggaaaugauauugccaauuguuuaaggaaaaacggaaaacgaguaauacaacuuucccgaaagaccuucgauacagaauaucaaaagaccaaaaacaaugauugggacuauguagucacaacugauauuagcgaaaugggcgcaaacuuucgcgcugacagagucauugacccaagaagaugucugaaaccuguaauacugaaggaugguccagagagaguaauauuagccggcccaaugccaguuacaguggccucugcagcacaaagacguggaaggauaggccggaaucauaacaaagaaggugaccaauauauuuauaugggacaaccauuaaauaaugaugaagaucacgcucauuggacugaagcaaaaauguugcuugauaauauaaacacucccgaaggaauaauaccugcccucuuugaaccagaaagagagaaaagcgcagcuauugauggagaauauaggcucagaggcgaagcaaggaagacguucguugaacuuaugagaaggggagaccuucccguuugguugagcuauaagguagcaucagaaggauuucaguauucagauagaaggugguguuucgauggggaacgaaacaaccaggucuuagaagaaaauauggauguugaaauauggacaaaagagggcgaacgcaaaaaguugcgccccagauggcuagaugcuaggacuuauagugacccauuagcgcugcgggaauuuaaagaguucgcggcagguagacggucaguaaguggggauuugauacuagaaauuggaaaauuaccucaacaucugacucaaagagcacaaaaugcccuggacaaucugguaaugcuccacaacucugagcaagguggccgggccuacaggcaugcuauggaagaacuaccugacacaauagaaaccuuaauguuacuagcacuaauagcgguacuaacuggcggagucacguuauucuucuugucagggcggggauuaggaaaaacgaguauuggccuacugugcguaauggcaucaagcgucuuauuauggauggcaagcguugaaccucauuggaucgcagcaucaauuauccucgaguucuuuuuaauggucuugcuaaucccagaaccugaucggcaacgcacaccccaggauaaucaguuagcauacguuguaauuggacugcuauuuaugaucuuaacagucgcggcaaaugaaaugggauuacuugaaaccaccaagaaggaucuaggcauaggacacguggccguggagaaccaucaucaugcgacuaugcuggacguagaucuacacccagcaagcgcuuggaccuuauacgcaguagcuacgacaaucauaacuccaaugaugagacauacaauugagaauaccacugcaaacauuagccucacagcuauagcgaaccaagccgcaauccugaugggauuagacaaagguuggccaauuucaaaaauggacauuggagucccuuuacuagcacucggguguuauagccaaguaaacccccugacucuaacggcggccguuuuaaugcugguagcccauuacgcuauaauagggcccggccuccaagccaaggccacuagagaagcgcagaaaagaacugcggccgguauaaugaaaaauccuaccguugauggcauaguugcaaucgaucuugauccuguuguguaugacgcuaaguuugaaaaacaauuaggccaaauaaugcuacuuauacuuuguacaucgcaaauuuuauugaugagaaccacaugggcacuuugugaaaguauaacacuggcaacuggcccacucacuacgcugugggaggguucaccagguaaauuuuggaacacaacuauagcaguuagcauggcgaauauuuuuaggggaaguuaucuggcgggagcaggacuggcauuuagcuugaugaaaucgcuaggggguggacgcagagguacgggagcacaaggagaaacguuaggugaaaaauggaaacgccaacuuaaucaauuaaguaaaucagaauuuaacaucuacaaacgaagcggaauuauggaaguagaucggucugaggcgaaagaaggauugaagaggggcgagaccacgcgccaugccgugucaagaggaacagcuaaacuccguugguuuguagagagaaaucuugucaagccugaaggaaaaguuaucgauuugggauguggccgagguggguggucuuauuacugcgccggacuaaagaaaguaacggagguuaaaggguauacgaagggaggacccggacaugaagaaccgauacccauggcaacauacgguuggaauuuaguaaaacuacauucugggaaagacguauucuuuacaccuccugaaaagugugacacacuccugugcgacauaggagaaaguucuccuaauccgaccauugaggaaggccggaccuugcgaguacucaagaugguagaaccaugguuaagaggcaaccaauuuuguauaaagaucuuaaacccauauaugccaagcgucguugaaacuuuggaacaaaugcaaagaaaauauggcggaauguuaguccguaacccguuaagucguaauagcacacacgaaauguauuggguuucgugcggaacuggcaacauagugagugcaguaaauaugaccagcaggaugcuucuuaauagauucacuauggcacacaggaaaccaacauacgaaagagaugucgacuuaggggcaggaacucggcaugucgcaguagaaccagaaguagcuaauuuagauauuaucgggcaaagaauagaaaacauaaaacacgaacauaaaucuacuuggcacuacgaugaagacaauccguacaaaacgugggcuuaucacgggucguaugaagucaaaccaagugguagugcaucuucaauggugaauggggucguuaaacuauuaacgaaaccaugggacgugauuccaaugguaacacaaauugcaaugacugacacgaccccauuuggacagcaaagaguauuuaaggagaaaguagauacuagaacuccgaaagcaaaaagggggaccgcacaaauuauggaaguuacagcaagauggcuguggggcuuccuaucgcgcaacaaaaagccacgaauuugcacucgagaagaguucacacggaaaguacggucaaaugccgcgauaggugcaguguuugucgaugaaaaccaauggaauagcgcaaaagaagcaguagaagacgagagauuuugggacuuaguucaaaaagaacgugaacuucauaaacaagggaaaugcgcuacaugcguuuacaacaugauggggaaaagggagaagaaacuaggugaauuuggaaaagcuaagggaagccgugccaucugguauauguggcuaggggcaagauuuuuggaguucgaggcccucggguucaugaacgaagaucauugguuuucccgcgaaaacucccuauccggaguugaaggagaaggacuacauaaacucggcuauaucuuacgugacauuucaaagauccccgggggaaauauguaugcugaugacacagcaggaugggacacccgaaucacagaagaugaucuucaaaaugaagcgaaaauaacugauauaauggagccggaacacgcgcuguuagcaacaucaauauuuaaauuaacuuaccaaaauaaaguuguaaggguacaacgaccagccaaaaacggaacaguuauggacguaauaucaaggcgugaucagcguggcuccggacagguagguacuuacggucuaaauaccuucacaaauauggaggcccaguuaauacgacaaauggaaucggaagggaucuuccuuccauccgaauuagagacgccuaauuuagcagaacguguguuagacuggcuagaaaaguacgguguugagagguugaagcgcauggccauaaguggugaugacuguguagucaaaccaaucgaugauagauucgcaacagcacucacugcuuuaaaugauaugggaaagguuagaaaagauauuccacaaugggaacccagcaaaggauggaaugauuggcaacagguuccauucugcagccaccauuuucaucagcuaauuaugaaagauggcagagaaaucgucguuccaugucgcaaucaagaugaacuuguaggaagggccagggucagucaaggagcgggauggucucugcgugaaacagcaugcuuaggaaaaucuuacgcacaaauguggcaauuaauguauuuucauagacgugaucuucggcuagcugcgaacgccauaugcucagcaguuccuguugauuggguucccacuucuagaacuaccugguccauccacgcacaccaucaauggaugaccacagaagacaugcuuucuguauggaaucggguauggauagaagagaaccccuggauggaggacaaaacacauguaucaagcuggggagauguacccuaucuugggaaaagagaagaccaguggugugggagcuugaucggccuaacagcacgagcgacaugggccucuaacauccaaguggcaaucaaccagguacguagacucauaggaaaugaaaacuaucuugacuauaugacaucaaugaagagguuuaaaaaugaaggcgauccugaaggagcccucugguag

SEQ ID NO: 21477 - RNA, 9879 nt, Artificial Sequence
  derived and/or modified CDS sequence (opt6) from DENV-1__EU726779__SS-prME
uccguaacuaugcuacuaauguuaaugccuacagcacucgcauuucaucuaacaacucgaggaggagaaccucacaugauaguuucaaaacaagaaagagguaaaagccuccuguuuaaaacaucugccggcguaaauauguguacuuuaauagcaauggaucuuggagaacugugcgaagauacaaugacauacaaauguccacgaauuacggagacugaaccggaugacguagauugcuggugcaaugcaacggauacuuggguuacauauggcacauguucccaaacaggagaacauagacgggacaaaagaucagucgccuuagcuccacauguaggauuaggacuugagacacguacggagacauggaugucauccgaaggagcuuggaaacaaauacaacggguggaaacgugggcucugagacacccgggguuuacuguaaucgcccuauuucuagcgcaugccauuggcacuucaaucacucaaaaaggaauaauuuuuauacuccucauguuaguaacuccuuccauggccaugagaugcguagguauaggaucacgggauuuuguagaggggcucaguggagcuacuuggguugacguuguacuggagcaugguucauguguaacaacgauggcgaaagauaaaccaacauuggauauagagcuccuaaaaacagaaguuacuaauccagccguucuacgaaaauugugcauugaggcaaaaaucucaaauacgacaacagacagcagauguccaacacagggugaagcaacguugguugaggagcaagacgcgaauuucguauguagaaggacauuuguagauagaggcuggggcaauggcugcggauuauuuggcaaaggaucacugauaaccugcgcaaaauucaaaugcgugacaaaauuagaaggcaaaaucgugcaauacgaaaaucuuaaauauucuguaaucguaacaguacauacaggugaccaacaucaaguuggcaacgaauccaccgaacacggaacgacagcgacaauuaccccucaagcgccaacaacugaaauacaacuaacagacuacggagcucugacauuagauuguucuccucgaacaggacuagauuucaaugagaugguuuuauuaacuaugaaagagaaaucaugguugguccacaagcaaugguuucuggauuuaccccuuccauggacgucuggugcaagcacaucacaagaaacauggaauagacaggacuuauuagugacauucaagacggcccaugccaagaaacaggaaguuguugugcuaggaagucaagagggagcaaugcacaccgcacuaaccggugcgaccgaaauacagacgucgggaacuacgacaauauuugccggccaucuuaaaugccgguuaaaaauggauaaacuuacacuuaaagguaugaguuauguuaugugcacuggcucguuuaaacuugaaaaagaaguagcagagacccaacacggaaccguacuuguacaaauaaaauaugagggaacugaugcgccguguaaaauaccauuuucuacacaagaugaaaaaggugugacucaaaauggacgucuaauaacggcuaauccaauugugacagauaaggagaaacccgucaacauugaagcagagccacccuuuggggaaucauacauuguaauaggggcgggugaaaaggcauugaaacuaucaugguucaagaaaggaucaucgauaggcaaaauguuugaagcuacugcacgaggagcgagaagaauggcgauucuuggggacacggcuugggauuuuggaucaauaggagguguuuucaccucgguagguaagcuaguacaccagaucuuuggaacggcuuaugggguacuguuuagcggagucaguuggacuaugaaaaucgguaucggaguacuauuaacuuggcucgguuuaaacucgcgcuccacaucauuuucaaugacauguauugcggucggacuuguaaccuuauaucuugggguuauggugcaagcagauucgggauguguuauaaauuggaagggcagagaauugaagugcgggucaggaauauuuguuaccaaugaaguucauacauggacugaacaauacaaauuccaagcagacuccccaaaacgucucucugcggcaauagggaaggcuugggaggaggguguuuguggcauucgaucggcgacacggcuugagaauauaauguggaaacaaauuagcaacgaacuuaaccauauuuuauuagaaaaugauaugaaauuuacaguaguagugggugacguagcugguauucuagcacagggcaagaaaaugauuagaccccagccaauggaauauaaauauucauggaaaucaugggguaaagcaaaaauaauaggugcagacgugcagaacacaacauuuauuauagacggaccaaacacccccgaauguccugacgaccaacgggccuggaacauaugggaaguggaagauuauggauuuggaauauuuacaacuaauaucugguuaaaauugagggauagcuacacccaaguaugugaucauagauuaaugagugcugcuauaaaggauucaaaagcuguacacgcugauaugggauauuggauugaaagugagaaaaaugaaacauggaaauuagcgagagcuagcuucauagaaguaaaaaccuguauauggccgaaaucacacaccuuauggagcaauggaguuuuagaaagcgaaaugauuaucccuaagaucuacggagggccaaucucucaacacaauuaccguccaggguauuucacccaaacagcaggaccauggcauuuaggcaaauuagaauuggauuuugaccuuugugaaggaacaacagugguagucgaugaacacugcggcaaucgaggaccuagucucagaacaacuaccguaaccggcaaaaucauucacgaaugguguugcaggaguugcacucuaccaccuuuaagauuuagaggagaagauggauguugguacggaauggaaauacgacccguaaaagaaaaagaagaaaaucuaguuaaaucaaugguuucagcagguaguggugaaguugauucauuuaguuugggacuacuuugcauaagcaucaugauagaagagguaaugagaucacguuggucacguaaaaugcucaugacaggaacacuagccguauuuuuccuacuuaucauggggcaacuuacuuggaaugacuuaaucagacugugcauaauggucggugcaaaugccucagauagaaugggcaugggaacaacauaucuugccuuaauggcaacauucaaaaugagaccuauguuugcaguaggacuacuauuucgaagauuaacuagcagagaaguucuacuauuaacaaucggcuuaagucuuguugcgucgguagaacuuccaaacucucuggaggaguugggagauggcuuggcaauggggauaaugauacucaaauuauugaccgauuuucagagucaucaauuaugggcuacuuuacugucauuaaccuuuauuaaaaccacuuuuagucuucacuaugcauggaaaacuauggcaaugguauuauccauagugagucuauuuccccucugccugucaacuacaucccagaaaacaacuugguuaccagucuuacuagggucccuaggauguaaaccauuaacuauguuucuaauugccgaaaauaagauuuggggcagaagauccuggccauuaaaugaagguaucauggcuguggguauuguaucuauacuccuaaguucccuucugaaaaaugauguuccauuagcaggaccguuaauagcgggaggaaugcuaauagcgugcuacguaauaucuggaucaucagcagaccucagcuuagaaaaagcggcagaaguuaguugggaggaagaagcugagcacuccggcgcuucacacaacauuuugguggaaguccaagaugauggcacaaugaagauuaaggaugaggagagagaugauacacugacuauacuacucaaggcuacuuuacuagcugugaguggcguauacccacugucaauuccugcaaccuuauuugucugguauuuuuggcagaagaagaaacagagaucgggaguauugugggacaccccaagucccccagaaguuggccgggccguuuuggaugauggaauauaccgcaucaugcaaagaggucuguugggaagaagucaagucgggguaggaguauuucaagagaauguauuucauacaauguggcacguaacuaggggcgccguacugauguaucaaggcaaaaggcuugaacccucgugggcuucugucaagaaagacuuaaucagcuauggaggaggauggagauugcaaggauccuggaauacuggcgaggaagugcaaguaauagcgguagaaccggguaaaaaucccaaaaauguccaaacugcgccugggacuuuuaaaacaccagaaggggagguaggggcaauugcacuagauuuuaaaccuggaaccuccggaucgccaauaguuaaccgggaagguaaaauagugggacuauauggcaacgguguaguaacaacaucagggacguauguguccgcaauagcccaagcaaaagccagccaggaagggccuuuaccagaaauagaagaugagguauuccgaaagagaaaucugaccauaauggaucuucacccuggaagcggaaagacuagacgauacuugcccgcgauaguaagggaagcaauuaaaagaaaauuaaggacacuaauauuagcacccacgaggguagucgcgucagaaauggccgaagcauuaaaggggaugccuauaagauaucaaacaacagccguaaaaucugagcacaccggcaaagagauaguagauuuaaugugccaugcaacuuuuacuaugcgauuauuaucuccggucagaguucccaacuacaauaugauaauuauggaugaagcacauuuuacggacccaucaucaauugcagcaagaggguauauaaguacacgcguaggaaugggugaagcagcugcaauauucaugacugccacaccgccaggcucaguagaggcuuuuccgcagucaaacgcuguaauacaagaugaagaaagagauaucccugaacguuccuggaacucggguuaugaauggauaacugauuuucccgggaaaacagugugguuuguuccuagcauaaaaucgggaaaugacauugcaaauuguuugaggaaaaaugguaagagaguuauacaacuuaguagaaaaacauuugauaccgaauaucaaaagaccaaaaauaacgauugggauuauguuguuacgaccgauauaagugaaaugggcgccaacuuuagggccgaccggguuaucgauccaagaaggugcuugaagcccguuauauugaaagaugggccugaaagggugauccuagcggggccuaugccaguuacaguugcaagugcggcucaacgaagggguagaauuggacgaaaucacaacaaagaaggagaucaauauauuuauauggggcaaccuuuaaacaaugacgaagaucacgcacauuggaccgaagcaaaaauguuacuugacaacaucaauacaccggaaggaauaauucccgcucuguucgagcccgagagggagaaaagugccgcaauagauggggaguacagguuaagaggagaggcacguaaaacauuuguugaguugaugcggaggggugacuugccaguuugguuaucuuauaaaguagcauccgaaggguuccaauacucggaccgaagaugguguuuugacggcgaaaggaacaaccaagugcuugaagaaaacauggauguagaaauuuggacgaaggaaggggagaggaagaaguuacgaccgcgaugguuagaugcaaggacuuauagugauccacuugcccucagggaauuuaaagaguucgccgcuggcaggcgaucggucaguggagaucuaauuuuagaaauuggcaaacuaccccagcaucugacccaaagggcacagaacgcauuagacaaccuaguaaugcuccauaauagcgaacagggaggccgugcauaucgccaugcaauggaggaacuuccagauaccauugaaacucuaaugcuauuagcacuuauagcaguccuuacaggcggaguuaccuuauucuuucuuucaggacgcggguuaggaaaaacaucuauaggauuacuuugugugauggcaaguagugugcuacuauggauggcgagcgucgaaccacauuggauagcggcuaguauaaucuuagaguucuuucuaaugguucuacuaauuccagaaccugaucggcagagaacaccgcaagacaaccaacuggcauauguugugauuggauuacucuuuaugauccuaacaguagcggcuaacgaaaugggcuuguuagagaccaccaagaaagaucuuggaauuggccacguagcaguggaaaaucaucaucaugcugcaaugcuggauguagauuugcauccugccagcgccuggacccuauaugcaguagcaacuaccauaauuacuccaaugaugagacacacaauagaaaacacuaccgcgaauauuagucugaccgcgauugcuaaucaagcugcgauauugaugggacucgauaaaggcuggccgauaaguaaaauggauauuggcguuccacugcuggcacucggcuguuauucucagguaaacccccugaccuugacagccgcaguacugaugcuaguagcgcacuacgcaauaauagguccgggccuccaagcgaaagcuacacgagaggcccaaaaacguaccgcagcaggaauuaugaaaaaucccacuguugauggaauaguugcuaucgaucuagacccagugguguaugaugccaaauuugaaaagcaguuggggcaaauaauguuacucauacuuugcacaagccaaauucuauugaugaggacaaccugggcguugugcgaguccauuacauuagccacgggaccccuaaccacacucugggagggcucgccggguaaguucuggaauacaaccauugcggugaguauggcuaauauauuucgggguagcuaucuugcgggagcaggcuuggcauuuucucuaaugaagucuuuaggaggaggaagaagggguacaggugcccagggcgaaacauugggugaaaaguggaaacgucaauugaaccaauugucaaaaagcgaauuuaacacuuauaaaagaagcggcauuauggaaguugauagauccgaagcgaaggaaggauuaaagagaggagagacaacuaagcaugcaguaagucgagguacggccaaacuaagaugguuuguggagaggaaucuaguaaaaccagaggggaaggugauugaucucgguuguggaagggguggauggagcuauuauugcgcugggcucaagaaaguuacugaagugaagggauacacuaaggguggcccaggucaugaagaaccuaucccuauggcgacauauggauggaaucucguaaaacuacauucaggaaaagacguguucuuuauaccaccugaaaaaugugauacuuuacugugugauauuggcgaauccucgccaaauccuacuaucgaagagggaaggacccuuaggguucuuaaaaugguugaacccuggcuaagaggaaaucaauuuuguauaaaaauacuuaauccauauaugccaagcguuguagaaacgcucgaacaaaugcaaaggaaacauggaggaauguuggugaggaacccgcuuucccgaaauagcacucaugaaauguacugggucuccugcggcacggggaauaucgucucugcgguaaacaugacgucgcguauguugcuuaauagguuuacgauggcacauagaaaaccaacauaugaacgagauguugaccuaggagcaggcacaagacacguagcagucgaaccagagguggcaaacuuggauauaauagggcaaagaauagaaaacauaaaacaugaacauaaaucgaccuggcauuaugaugaagacaauccauauaagacaugggcuuaccacgguagcuaugaaguaaaaccaucggguucagcaagcagcaugguaaacggcguaguaaaauuauuaacaaaaccuugggacguaaucccgauggucacucagauagcuaugacagauacaacucccuucgggcaacaacgaguuuuuaaagaaaaagucgauacacguaccccuaaagccaaaaggggaacagcacaaauuauggaagucacggcgaaaugguuguggggcuuucuaagucggaauaagaaaccacgaauauguacgcgagaagaguuuacuagaaagguaaggagcaacgcagccauaggcgcaguauuuguggaugaaaaccaauggaacagugcuaaagaggcgguagaagaugaacguuuuugggaccuuguacacagagaacgugaauuacauaaacaaggaaagugugcaacuuguguauauaauaugaugggaaagcgagaaaagaaacugggugaauuuggaaaagcgaaaggaagccgagcaauuugguauauguggcugggugcacgauuucuagaguuugaggcucucggauucaugaaugaagaccauugguuuagucgagaaaauaguuuaagcggcguagagggcgaaggguugcauaaacucggauauauauuacgugauaucucaaauauaccaggagguaacauguaugccgacgacacagcagggugggauacucgaaucaccgaggaugaccuacagaacgaagcacgaauaacagacaucauggaacccgaacacgcguuauuggcgaaguccauuuuuaaauuaaccuaucaaaacaaggucguuaggguucaacgaccagcgaaaaauggaaccgucauggaugugauaucuagacgugaccaacgaggaucugggcaaguuggaacuuaugguuugaauacauuuacgaauauggaggcccaacuuauacgacagauggagagugaaggaauauuuucucccucagaguuagaaacacccaacuuagccgaaaggguuuuggacuggcuagaaaaauaugggguagaacgauuaaaaagaauggccauuaguggcgacgacuguguaguaaaacccauugacgacagguuugcuacugcacuaacagccuuaaacgauaugggaaaaguacgaaaagacauaccucaaugggagccgaguaagggguggaaugauuggcaacagguaccauuuuguucacaucauuuucaccaacucauuaugaaagaugggcgggaaauuguuguucccuguagaaaccaagaugaacuuguagguagagcgagaguaucucaaggggcgggauggucacuuagggaaaccgcauguuugggcaaaucauacgcgcaaauguggcaacuuauguacuuucauagacgagaucuccgcuuagcggcaaaugcaauauguagcgccgucccuguugauuggaucccuacaaguagaacuaccuggaguauccaugcacaccaccaauggaugaccaccgaagacauguugucaguauggaauagaguauggauagaagaaaacccuuggauggaggauaagacacacauaucaagcuggggcgacgucccguaucucggaaaacgagaagaccaauggugcggcucacuaauuggauuaacggcucgugcuaccugggcaacuaauauccaaguagcaaucaaucaaguaagaaggcuaauuggcaaugaaaacuaccuagauuauaugacauccaugaagcgauuuaagaacgaaagcgacccagagggugcauuaugguaa

SEQ ID NO: 21478 - RNA, 9879 nt, Artificial Sequence
  derived and/or modified CDS sequence (opt6) from DENV-1__EU677176__SS-prME
agcgugacuauguuacugauguuaaugcccacagcucuugcguuucaucuuacgacgagaggaggagagccacauaugauaguaaguaaacaagaaagagggaaaagccuccuguucaaaacuagcgcugggguaaauaugugcacacucauagcuauggaucuuggagaauuaugugaagacacuaugacauacaaaugcccaagaauaacagaagucgagccugaugacguagauuguuggugcaauacuacagacacauggguuacauacggaacauguagccaaaccggagaacaccgacgagacaaaagaucgguggcacuugccccucauguaggauuaggauuagaaacucgugcugagaccuggaugucuucugaaggagcguggaaacaaauacaaaaagucgaaaccugggcucugcgucauccuggcuuuacaguuauugcuuuauuuuuagcacaugcuauagguacaagcauaacacaaaaagggauaauauuuauacuuuuaaugcucgucacgccaaguauggcaaugcgguguguaggaauaggaagcagggauuucguagaagggcucucaggugcaacauggguagacgucgugcucgaacacggaaguugcgugaccacaauggcaaaagauaaaccaacguuggauauugaguuauuaaaaacagaaguaaccaaucccgcaguuuuaagaaaacuaugcauagaagcaaaaauaucuaacacuacaaccgacucaagauguccaacacaaggcgaagcaaccuuaguugaggaacaagaugcgaacuuuguauguagaagaacauuuguugaccgaggcugggggaacggaugcggucuguuugggaagggcagcuugauaacaugugcuaaauucaagugcguaacuaaacuagagggaaaaauaguacaauacgaaaaccuuaaauacucuguaaucgugacuguucauacgggagaucaacaccaaguagguaaugaaucgacagagcauggaacuaccgccaccauuaccccucaagcaccuacauccgagauucagcucacagacuauggcgcucuaacuuuagauuguagcccaagaacagggcuggauuucaacgaaauggucuuauugacaaugaaagaaaaauccuggcuaguccacaaacagugguuucuugaccuaccccucccguggacaaguggugccuccaccagucaagaaacuuggaacagacaagaucuacuuguaacguuuaagacagcgcaugcuaagaagcaggaagugguaguucuagguucacaggaaggggcaaugcacacggcccuaacaggugcaacggaaauacaaacaagugggacaacaaccauauuugcgggacaucugaaauguagauuaaaaauggauaaguuaacccuaaaaggcaugaguuacguuauguguacugguuuauuuaaauuggaaaaagagguagcugagacucaacauggaacaguacugguacagauuaaauacgaggggacagaugcaccuugcaaaauaccauuuaguacacaagacgaaaagggaguuacacaaaacggaagacuuauuacugcuaauccuaucguaacugauaaagaaaagccggucaauaucgaagccgagccacccuucggagaauccuacauuguaauuggcgcuggugagaaagcauuaaaauuaucaugguucaaaaagggcaguuccauuggcaaaauguucgaagcgacugcacgcggagccaggagaauggcuauccuuggagauaccgcgugggacuuugggagcauagguggaguguuuacuucaguuggaaaauuaguacaccaaaucuucggaacugcauauggaguacuauuuucuggugucagcuggacgaugaaaauagguauuggugucuugcugacguggcuaggcuuaaauagucguucuacaagucucucuaugacuugcauugccguaggacucgugacguuguacuuaggggucauggugcaagcagacagcggcugcgugaucaauuggaaagggagggaacugaaaugcggaucuggcauuuucgucacaaaugaaguacauaccuggaccgaacaauauaaguuucaagcggacaguccaaaacgccuuucagcugcaaucgguaaggcuugggaagaaggagugugcggcauaaggagugcaacccgucucgaaaacauaauguggaggcaaauaaguaaugaauuaaaccauauacuucuagaaaacgacaugaaguuuacgguuguaguaggagauguaguugggauuuuagcucaaggaaagaaaaugauacgaccgcaaccuauggagcauaaauauucauggaaaucaugggguaaagcuaaaauuaucggggcagauguccaaaauacuacauucaucauagaugguccaaauaccccugagugccccgaugaucagagggcuuggaauaucugggaaguugaggacuaugguuucgguauauuuaccacaaauauuuggcuaaagcugcgugauucauacacucaaguuugcgaucauagauuaaugucagcagcaauuaaggauucgaaggccguacaugcugacauggguuauuggauagaaagugagaaaaaugagacuuggaaauuagcacgagcuucauuuauugaaguuaaaacauguauuuggccaaaaagccauacauuauggaguaauggagucuuagagagugaaaugauuauaccaaaaauauacggugguccgaucucacaacauaacuaccguccuggauauuucacccaaacagcgggcccguggcacuuggguaaguuagaguuagacuuugacuuaugugaggggacaacaguggucguagaugaacauugugguaaucgggguccgucuuugagaacaacaaccguuaccggcaaaauaauacaugagugguguugcagaucauguacucuaccuccucuacgauuuaaaggagaagacggauguugguacgggauggaaauaagaccuguuaaggaaaaagaagaaaaucuugucaaaaguaugguauccgcaggaucuggugaaguagauucuuucucucugggccuuuuauguauuaguauaaugauagaagagguaaugcgaucgcgauggucccguaagaugcuuaugacagggaccuuagcaguauucuuucuacucaucauggggcaauugacguggaaugacuugaucagauccuguaucaugguuggcgcuaaugcaagugaccggaugggcaugggcaccaccuauuuagcuuugauggccacauucaaaaugagaccaauguuugcgguuggacuacucuuccgaaggcuaacuucgcgugaaguauuauuauuaaccauaggauugagucuuguagcuaguguggagcuaccuaauucucuagaggaguugggugacgggcuugcgauggggauuaugauauuaaaauuauuaacggauuuccaaaguuaucaacuaugggcaacguugcuuuccuugacauuuauaaaaacuacuuuuucuuugcacuaugcuuggaaaacuauggcaaugguacuuagcaucgucaguuuauuaccguuguguuuaucaaccacuucccagaagacaaccuggcuuccaguuuuauuaggcagcuuaggguguaaaccgcuaacaauguuucugaucgcugaaaauaaaauauggggaaggaagucuuggccuuuaaaugagggaauuauggccgucggaauagucagcaucuuguuaucaagucuacucaaaaacgacguaccacuagcaggaccgcuaauagcaggaggcauguuaauagcaugcuacgugauuuccgguaguagugcggauuugucacucgagaaagcagccgaaguuuccugggaagaagaagccgaacauucuggugcaucacacaacauacucguugaaguacaagacgacgguacaaugaaaaucaaagaugaggagagagaugacacauuaacaauauuacuuaaagccacucuuuuggcgguuucuggaguauacccacuuucaauacccgcgacacuauucguaugguauuuuuggcagaagaagaaacaaaggagugguguucuuugggauacaccaaguccacccgagguagaacgagcuguuuuagacgacggcauauaccgaauuaugcaacgagguuuauuagguagaucacaaguaggaguugguguuuuucaagaaaauguauuucauacaauguggcauguuacccggggcgcaguucuaauguaucaagguaaaagguuagaaccaagcugggcgucuguaaagaaagacuugauaagcuacggcgguggauggcgucuucagggaucauggaauacgggcgaagagguucaaguaauugcaguagaaccagguaaaaaccccaaaaacgugcaaacagcgcccgguacuuuuaaaacuccagaaggcgaaguuggcgcaauugcauuagauuuuaaaccugggacaagugguucacccauuguaaauagagaggggaaaauuguagggcuuuaugguaaugguguugucacaaccucuggcacauacguauccgcaaucgcgcaagcgaaagccagucaagaagggccuuuaccggagaucgaagacgaaguauuuagaaaacgaaacuugacuauaauggaucuacauccugguagcggaaaaacgaaacguuauuugccugcuauuguucgugaggcaaucaaacggaaauugaggacucuuauacuggcaccuacgcguguaguagccagcgaaauggcggaggcauugaaaggaaugccaauuagguaccaaaccacugcaguaaagucugagcacacggggagggaaauuguagaucugaugugucacgccacauucacuaugaggcuucucagcccgguucgagucccaaacuauaauaugaucauaauggaugaagcgcauuuuacagacccuuccaguauagcggcuagaggguauaucaguacgagaguaggcaugggagaagcagccgcuauauucaugacagcaacaccgccgggaaguguagaagcauuuccacaaucaaaugcaguaauccaggacgaagaacgagauauuccggagaggucauggaacuccggauacgaauggauaacugauuucccuggaaaaacaguaugguucguaccaucaaucaaaucaggcaacgacauagcuaauugucuaagaaagaaugggaaacgagucauacaacucagcagaaaaacauucgauacugaauaucaaaagaccaaaaacaaugauugggacuauguaguaacaacugacauauccgaaaugggggcaaacuucagggcugaucguguaauagacccuagaagaugcuuaaaaccaguaauacucaaagacggacccgaaaggguuauauuagcagguccuaugccuguaacuguugcaucagcggcucaacgucgaggaagaauugggaggaaccauaauaaagaaggugaccaauauauauacaugggacaaccucuaaauaaugaugaagaucaugcucauuggacggaagcuaaaaugcuuuuagauaauauaaauacgccggaagguauaauaccugcacuguucgaaccugaaagagagaaaagcgcagcaauagauggugaguauagauuaagaggagaggcgcgcaaaacauucgucgagcucaugagaagaggggaucuucccgucugguuguccuauaaagucgcuuccgaaggauuccaauacucagaucgacgaugguguuuugauggcgaaagaaacaaucaaguacuagaggagaacauggacguggaaauauggacaaaagaaggcgaaaggaagaaacuccgaccacgcuggcuggaugcucgaacauauuccgacccuuuagcccuuagagaauuuaaagaauuugcagccgguagaaggagugugucaggcgaucuaauucucgaaauuggaaaguugccacaacaccuuacccaacgcgcccaaaacgcauuagacaacuuagucaugcuccauaauagcgaacaagguggcagagcauauagacaugcuauggaagaauugcccgacacaauagagacccuaauguugcuagcgcuaauugcaguacucaccggaggaguuacacuguucuuucuauccggacggggucucggcaagacaagcaucggguuacucugugucauggcgagcagugcauuauuguggauggccucuguagaaccccauuggaucgccgcaaguauaauccuggaauuuuuccuaaugguucuauuaauaccagaaccagauaggcaaagaacgccgcaggauaaucaacuagcuuaugucguaauaggucugcuuuuuaugauauuaacgguagcagccaaugagaugggguuacucgagacaacgaaaaaggaucucggcaucgggcaugucgcgguagaaaaucaucaucacgcuacaauguuagacguugaucugcacccugcaucagcauggacccuauaugccguagcuacuacaauaauaacucccaugaugagacacacgauugagaacacgaccgcgaacaucagcuuaacugccaucgcaaaucaagcagcuauauuaaugggccuagauaaaggauggccaauuucaaaaauggauauuggugucccucuauuagcacucggauguuacucucaaguuaauccacuuacauuaacugcggcuguacucauguuagucgcacauuacgcaauuauugguccuggucuucaagcuaaagcaacgcgagaggcacagaaaagaacagcagccgguauuaugaaaaauccuacggucgacggaauuguagcuaucgauuuagacccuguaguuuaugacgcuaaauuugaaaaacagcuaggccagauaauguugcugauccuauguacaucucagauacuacuaaugagaacuacgugggcucuaugcgaaucaauaaccuuggcgacaggcccuuugacuacucuuugggaagggaguccuggaaaauuuuggaauacgaccauagcgguuucuauggcaaauauuuuuagaggcucuuauuuagcgggagccgggcuugcauuuagucuaaugaagagucuagggggugguagaaggggcacgggagcacaaggcgaaacguugggagagaaguggaaacgucagcuuaaucaauuaucaaaaagugaauuuaauacauauaaaagaucggguauaauggaaguagacagaagugaggcuaaagaaggacuaaggcgcggagaaacuacaaagcaugcggucagcagagguacggccaaacuuaggugguucguagaaagaaaccuaguuaaaccagaagguaaaguaauugaccuugguugugggcgaggagguugguccuauuauugugcaggacuaaagaaagugacugaagucaaaggauauacaaaaggaggaccugggcacgaagaaccaauuccaauggcgacguacggauggaaccucguaaaauuacauagcggaaaagacguguuuuucauaccaccagaaaaaugcgauacuuuauuaugugauauuggcgaguccucgccuaauccuacaauagaggaggggagaacacuacguguauuaaaaauggucgaaccuuggcuaagagggaaucaguucugcauuaaaauacuuaauccauauaugccaucaguaguggaaacauuagaacaaaugcagcgaaaacauggaggcaugcucgugaggaauccgcuaucaagaaauagcacacacgaaauguauuggguaagcugugggacggguaauauagugagcgcugucaacaugacaagcaggaugcugcugaaucgguucacgauggcucacaggaaaccuacguacgaacgugaugucgaccuaggugcaggaacacgacauguugccguagagccugaaguagcaaacuuagacauaauaggucaaagaauugaaaauauaaaacaugaacauaaauccacauggcauuaugacgaggauaauccuuauaaaacgugggccuaucaugguaguuaugaaguaaagccgucaggaagcgcuucaaguaugguaaacggaguaguaaaacuacucacaaagccaugggacguuauaccgauggucacucaaauagcuaugacagacacaacuccauucggacaacaaagaguuuucaaagagaaaguugauacucgcaccccuaaggcuaaacgcgguacagcccaaauaauggaagucacagcuagauggcuauggggcuuucucucucguaauaagaaaccgcgaauaugcacacgggaagaguuuacaagaaaaguacguaguaaugcagccauaggagccguuuuuguugaugaaaaccaauggaacucagcuaaagaagcgguagaagacgaaagguuuugggaucucguacauagagaacgggaacuacacaaacagggaaaaugugcgacguguguguauaacaugauggguaagcgagagaagaaacuuggugaguuuggaaaagcuaaggggucaagagcaauuugguauauguggcugggugcgagauucuuagaguucgaggcguuggguuucaugaacgaagaccacugguuuucacgagagaacagccucucaggaguggagggagaaggccuucacaaguuaggauauauauuaagagauaucuccaaaauucccggaggcaacauguaugcagaugacacagcaggcugggauacacguauuaccgaggaugaucuccaaaacgaagcuaaaaucacagacaucauggaaccagagcacgcacucuuggcgacaaguaucuucaaacuaaccuaccaaaacaaaguaguuagaguucaacgacccgcucguaauggaacugugauggacguaauaagucgaagagaucaaagaggcagcggucaaguuggcacuuacggacuuaauacauuuacaaauauggaggcacaguugauacgucaaauggaaagugagcguauuuucucgccuuccgaauuagaaacgcccaacuuagcagaaagagucuuagacuggcuagagaaacacggaguugagcgucugaaaagaauggcaaucagcggagaugacuguguuguuaaaccgauagaugaucgguuugcuacagcacuuagugcacuaaacgauauggguaaaguaagaaaagauauuccacagugggaaccuucaaaagguuggaaugauuggcaacaaguaccauuuuguucucaucauuuucaccaacugauaaugaaagacggcagggagauaguuguuccgugucgcaaucaagacgaauugguagggagagcucgagugucacaaggagcaggauggagcuugagggagacagcuugcuuaggaaaaucauacgcccaaauguggcaauuaauguacuuccacaggagggaucuuagauuggcagcuaaugcaauauguucugcagucccaguagacuggguucccaccuccagaacaacauggucaauucaugcucaucaucaauggaugacaacugaagauaugcucucuguuuggaacagaguuuggauugaggaaaauccuuggauggaagacaagacucacauuuccucuuggggagaugucccauaccuaggcaaacgugaagaucaaugguguggcucucuaauuggucugacagcucgagcuaccugggcaacuaauauccagguugcaaucaaccaaguacgcagacuaaucggcaacgagaauuaucuugauuauaugaccucaaugaagagauuuaagaaugacagcgauccugaaggagcucuuugguaa

SEQ ID NO: 21479 - RNA, 9879 nt, Artificial Sequence
  derived and/or modified CDS sequence (opt6) from DENV-1__EU726780__SS-prME
agcguaacaauguuauuaaugcugaugccaaccgcucuugcuuuucaucuuacgacuagaggaggagaaccacacaugauaguuucgaaacaagaacgcgggaaaucauuacuauucaaaacgucagcuggaguaaauauguguacauuaauugcgauggaccucggagaauuaugugaagauacaaugaccuacaaaugcccacgaauuacugaaacugaaccugaugacguugacuguugguguaacgcaacagauacuuggguaacauacggaacaugcucucaaacaggugaacaucgaagagacaaaagaaguguagcgcuggcgccgcaugugggacucgggcuugaaaccaggaccgaaacauggaugaguucagaaggugcguggaaacaaauacaaagagucgaaacaugggcauuaagacauccaggauucaccguaauugcacuuuuucuggcucaugcuauaggaaccucuauaacacaaaaaggaauaauauucauacuguuaauguuaguuacacccuccauggcaaugcgauguguugguauaggaucaagagauuucguagaaggucuaucuggggccaccuggguagacguaguacuagaacacggcucaugcgugacgacaauggcaaaagacaaaccuacccuagacauagaauuauuaaaaacugaaguuacuaauccagcuguacuacgaaaacuaugcauugaagcaaaaauaaguaauacaaccacggacucacggugcccaacgcaaggcgaagcuacccuaguagaagaacaagaugcaaauuucguuuguaggagaacauuuguagaccguggguggggcaauggauguggucuauucggaaaaggcaguuugaucacgugcgcuaaauucaaaugcgugaccaaacuugaaggaaaaaucguacaauaugaaaaucuaaaauauucuguaaucgugacaguacacaccggagaccaacaccaagugggaaaugaaaguacagaacacggaaccacggcuacuauaacaccacaagcgccuacuaccgagauccaauuaacagauuauggugcacucacucuggauuguaguccuaggacgggccuagauuucaaugaaauggucuuauuaacaaugaaagagaaauccugguuaguucauaaacaaugguuuuuggaucuaccauugccuuggacaagcggggcaucaacaucucaagaaacuuggaauaggcaagauuugcucguuacauuuaaaacagcgcacgcuaagaaacaagagguuguaguauuaggcagucaagaaggugccaugcacacggcacugacgggagcaacagaaauacaaacaucgggaaccacaacaaucuuugcuggucaucugaaauguagauugaaaauggauaaauuaacguuaaaaggaauguccuaugugauguguacugguaguuuuaaauuagagaaagagguugcugaaacccaacacggcacaguacuuguacaaaucaaauacgaaggaacugaugccccgugcaaaauaccauucucaacacaagaugaaaaaggaguuacucaaaaugguagauuaauaaccgcgaaccccauaguaacagauaaagaaaagcccguuaacauugaagcagaaccaccauuuggagaaucuuauaucguaauaggggcgggcgagaaaacguuaaaacuaaguugguucaagaaaggaagcaguauagguaagauguucgaagcgaccgcucguggugccagaagaauggcaauauuaggagauacugcuugggauuuuggcagcauaggaggagucuuuacauccguuggcaagcuaguccaucaaaucuucgggacagcuuauggaguuuuguucagcgguguaucguggacaaugaagauugguauaggaguucuguuaacauggcugggauuaaauagcagaaguacaucauuaucaaugacuuguauugcaguaggacuuguaacacuauaccuggggguaaugguacaagccgauaguggcugugugauaaacuggaaaggacgugaacuaaaaugugguucggggaucuuuguuacgaaugagguacauacauggacagaacaauauaaauuucaagcugauaguccaaaacgacuaucagcugcuauagggaaagcaugggaggaaggcguaugugguauccgaucagcaacacgauuagaaaauauaauguggaaacagauaucaaaugaacuuaaucacaucuugcuagaaaaugauaugaaguucacagucguagugggagacguagcgggcaucuuagcucaaggcaagaaaaugauacgaccacagccuauggaauauaaauacagcuggaagaguuggggaaaggcaaaaauaauuggagcagauguacaaaacacuaccuuuauaaucgauggucccaacacuccugaaugcccagaugaucaaagggcauggaauauaugggaaguggaggauuaugguuuugguaucuuuacaacuaacaucuggcucaagcuacgagauagcuacacacaaguuugcgaccauagacuaaugagcgcagcaauaaaggauuccaaagcuguccaugccgauaugggauauuggauugagucagagaaaaaugaaacguggaaauuggccagagcuucauucaucgaagucaagacauguauauggccgaagucacacacuuuauggagcaaugguguucucgaauccgagaugaucauuccgaaaauuuaugggggacccaucucucagcauaacuaccgacccggguacuuuacacaaacagcuggaccauggcauuuagguaagcuagaacuagauuuugaucuuugugaagggacaaccgugguaguugacgagcauuguggcaaccggggaccuaguuugagaacaacuacaguuaccggaaaaaucauccaugagugguguugucgaucauguacuuuacccccauuacgguuuagaggagaagaugguuguugguaugggauggagauucgaccuguaaaagaaaaagaagaaaauuuaguaaaaagcauggugagcgcgggcagcggugagguagauucauuuaguuuaggguuacuuuguauaucuauaaugaucgaagaggucaugcgaucccgauggucacguaaaauguuaaugacugggacacuggcaguguucuuucuauugauaauggggcaguugaccuggaaugaccucauacggcugugcaucauggucggggcaaaugccagugacagaaugggaauggguacaacuuauuuagcacuuauggcuacauucaagaugagaccuauguucgcaguaggauuauuauuuaggagacugacaucuagggaaguauuacuacucacaauaggguugaguuuagucgccuccguggagcugccuaacucacuugaggaguuaggggacggacucgccauggguauaaugauccugaaacucuugacugacuuccagagccaucagcuguggguaacccuauugucacuaacguucauaaaaacuaccuucucgcuccauuacgcuuggaaaacuauggcaaugguacucucuauaguuagccuguucccguugugccuguccacuacaagucagaaaacaaccuggcuuccaguauugcuuggaaguuuaggguguaagccuuugacuauguuucuaauugcggagaacaaaaucugggggcgaagaucguggcccuuaaacgaagguaucauggcaguuggcaucgucagcauccuucuuagcaguuuauugaaaaaugaugugccauuagcuggaccauuaauagcaggcggaauguuaaucgcauguuaugugauaagcggaucgagugcagacuuaagccuagagaaagcggcugaaguuaguugggaggaagaagcagaacauucaggugcgagccacaacauacuuguggaaguccaagaugacgggacuaugaaaaucaaagaugaagaaagagacgauacauuaaccauucuccugaaagcaacacuccucgcgguaucggggguuuacccuuuaaguauaccagccacauuauuuguaugguauuuuuggcaaaagaaaaagcagagaucagggguguuaugggauacaccgagcccaccagaaguggaaagagccguccuggaugaugggauuuaucgaauaaugcaacgagggcuucuagguagaucccaaguuggaguuggaguauuucaagagaauguguuucauacaauguggcauguaaccagaggugccgucuugauguaucaaggaaaacgacuugagccuucaugggcuucgguaaagaaagaucugauaucauacgggggugguuggagacuacaagguaguuggaauacaggugaagaagugcaaguaauagcaguggaaccaggcaaaaaccccaaaaacguacaaacugcaccaggaaccuucaagacacccgagggggaaguuggagccauugcuuuagauuuuaagccagguaccucugguucucccauagucaauagggaggguaaaauagucggccuuuauggcaacgggguaguuaccacaucugguacguaugucucagcgauugcucaggcuaaggcuucccaagaagguccuuuaccagaaaucgaagaugagguguuucguaaacgaaacuugacaaucauggaucuucacccuggaucaggaaaaaccagacgauaccuaccagcaauaguacgggaggcaauaaaacgaaaauugcgaacccuuauuuuggcaccuacaagggucgucgcuucggagauggccgaggcccuaaaggggaugccgauacgauaucaaacgacagcgguuaaaucagaacacacagguaaagagauugucgaccuaaugugucaugcuacuuucacaaugcgacuuuuaucgccgguaagaguuccaaauuacaauaugauaauuauggaugaggcgcauuuuaccgauccaucaaguauugcggcaagaggauacauaucaacaagagucggcaugggagaggcugcggccauauuuaugacagcuacaccuccagguucaguugaggcauuuccucagucgaacgcaguaauacaagaugaggaaagagauauuccagagcguaguuggaacucgggcuacgaauggauaacagacuuuccggggaaaacagucugguucguuccaaguauaaaaagcggcaacgacauugcuaauugucugaggaaaaacggaaaaagaguaauacaacuaucacgaaagacauuugauacagaauaucagaaaacuaagaacaaugauugggacuacgucguaacuacagacaucagcgaaaugggcgcaaacuuuagagcagaccgagucauugauccacguagaugucuaaaaccuguaauacugaaagacgguccggaacgcguaauacucgccgguccuaugccggugaccguggcuucugcugcacaacgacgugguagaauagggcgaaaucacaauaaagaaggugaccaguacauauauaugggacaaccacucaauaacgacgaggaucaugcacauuggacagaagcuaaaauguuacuagauaauauaaacaccccagaaggcauuauucccgcccuauucgagccagaaagggagaaaagugccgcuauagauggcgaauauagauuaaggggagaggcaagaaaaacauuuguggaauuaaugcgcaggggagaccuaccuguaugguuaucauauaaggucgcaagugaaggcuuucaguauucagacagacgcugguguuuugauggagagcgaaauaaucaagugcuagaggaaaauauggacguagaaauauggacuaaagaaggagaacggaagaaacuaagaccucgauggcuagaugcacgaacguacagcgacccauuagcacugcgugaauuuaaggaauuugcugcuggucgaagauccguuucuggggacuugauaucagaaauaggaaaauuaccucagcaucuuacgcagagagcacaaaacgcucuagacaaucuagugaugcuucauaauagcgaacaaggcgggcgagcauaucggcacgcaauggaagaacuuccagacacaauugaaacgcuaaugcuccuagcacuuauagcgguacuaacaggaggugugacucuauucuuuuuaaguggccgcggauuaggaaaaaccaguauagggcuccugugcguaauggcaaguucgguuuuauuguggauggccucaguagaaccacauuggaucgcugcgucaauuauauuggaguucuuucuuaugguucuauugauacccgaaccagacagacaaagaacaccacaagauaaucagcuagcauacgugguaaucggucuccuuuuuaugauuuugacaguagcagcgaaugaaaugggacuauuagaaacaacuaagaaagaucuggggauagggcaugucgccguagaaaaccaucaccacgcagcuaugcuagacguugaucuacacccugcgucagcuuggacucucuaugcagucgcaaccaccauaauuacacccaugaugagacauacgauugaaaacacgacggcuaacaucagcuuaaccgcaaucgcgaaucaagcagcaaucuuaaugggucuagauaaaggauggcccauuaguaaaauggauauaggugucccucucuuggcccuggguuguuauucucaaguuaauccguuaacguuaacggcggccguccucauguuaguggcacacuaugcgauuauaggaccagguuugcaagcuaaggccacaagagaagcacaaaagaggacggcugcuggcauuaugaaaaauccuaccgucgacgggauugucgcaauagauuuggauccaguaguauaugaugcaaaguuugaaaaacaacuuggacaaauaaugcuccugauucuauguacuucccaaauacuucuaaugcgcacaacaugggcucuaugugaaaguauuacgcuagcuacaggaccacuuacaacgcucugggaaggaucaccgggaaaguuuuggaauacuacuaucgcuguaaguauggcuaauauauuccgugguaguuaucuagcgggagcaggacuagcauucuccuugaugaaaucguuaggaggaggcaggcguggaaccggggcccaaggugagacacuuggagaaaaguggaaacgccagcuaaaucaguugucuaaaagugaauuuaacaccuacaaaagaucgggaaucauggaggucgacagaagcgaagcaaaagaaggucuaaaaagaggagagaccacuaaacacgcugucaguagagggacagcaaaacucagaugguuuguagaaaggaauuuggucaagcccgaagguaaaguaauagauuuaggcuguggaagaggcgguuggucguauuauugugcaggacucaagaaaguaacagagguaaaaggauacacaaaaggaggaccaggacaugaagaaccaauucccauggcaaccuacggauggaaccuggucaaacugcacucaggaaaagauguuuucuucauacccccugaaaagugcgauacccuauugugcgauauuggagaaucaucaccgaauccuacaaucgaagaaggcagaacgcuacguguacuuaaaaugguagaaccaugguuaagggguaaucaauuuugcauaaaaauauuaaauccuuauaugccuaguguuguggaaacacuagaacagaugcaaagaaaacaugggggcaugcugguaagaaauccauuauccagaaauaguacccaugaaauguacuggguuagcugcgguacagguaauauuguuucugcgguuaacaugaccucaagaaugcuuuuaaaucgauucacaauggcccaucgaaaaccuacuuaugaacgggauguugacuuaggagccggaacucgucaugucgcggucgaaccggaaguagcgaauuuggacauaauuggacaaagaaucgaaaauaucaagcaugaacauaaaucuacguggcauuaugaugaagacaauccauauaagaccugggcuuaccacgggucauaugagguuaagccaucaggcuccgcuucuaguaugguaaacgggguaguaaaacuauugacaaaaccaugggaugucauuccgaugguaacucaaauagcaaugacugacaccacgccauucggacagcaacgaguuuuuaaggaaaaaguagacacaaggacccccaaagcaaaaagagguacagcccagauaauggaagugacagcaaaauggcuauggggauuccucucuagaaacaaaaagccaagaauuugcacacgcgaagaauuuacgaggaaagugcgcucgaacgcagcaauaggcgccguguuuguggaugaaaaccaauggaacucagcaaaggaagcgguugaagaugagagauuuugggaucuaguacacagagaaagagaacuccacaaacaaggaaaaugcgcgaccugcguuuauaauaugauggguaaaagagagaaaaaguugggagaguucggaaaagcgaagggaaguagagcgauuugguauauguggcuaggagcacgcuuucuagaauuugaagcgcuuggcuucaugaaugaagaucauugguucucacgagaaaacucauuaaguggcguugaaggagagggucugcacaaguuagguuauaucuuacgagacauaagcaaaauuccggguggaaauauguaugcagaugauacagcgggaugggacacuagaauaacugaagacgaucuacaaaacgaggcacggauaacggauaucauggaaccugaacacgcacuacuugcuaaaaguauauuuaaauuaaccuaucaaaauaaaguaguaaggguacagaggccggccaaaaacggaacagucauggacguaauuucuagacgagaucagcgggggagugggcaaguuggaacauauggcuuaaauacuuuuaccaauauggaagcucaauuaauuaggcagauggagagcgaggguauauucagccccagugaauuagaaacacccaauuuggcagaacguguacuugauuggcucgagaaauaugggaucgagagacuaaaacgaauggccaucuccggagacgacugcgucguuaaaccgauugaugaucgauucgcgacugcccuaacagcccuuaacgauaugggaaaaguuaggaaggauauuccacaaugggaacccagcaagggauggaaugacuggcaacaagugccauuuugcagucaucauuuucaccaacucaucaugaaagaugguagagaaaucgucguaccgugcagaaaucaagaugagcuaguuggccgagccaggguuucucagggagcagguuggaguuuaagagaaaccgccugucucgggaaaucuuaugcucagauguggcaauugauguacuuucacagaagagauuuaaggcucgcagcaaacgcuauaugcucagccguaccagucgauuggauuccaacgaguaggaccacauggucaauacaugcccaccaucaguggaugacuaccgaggauauguuauccguguggaauaggguauggaucgaggaaaauccguggauggaggauaagacacacauuaguaguuggggagaugucccuuaucucggaaaaagagaggaucagugguguggcucacucauagguuugacagcaagggcaacaugggcaaccaauauucaaguugcaauuaaucaaguacggcgauugauagggaacgaaaauuauuuagauuauaugacaucaaugaaaagguucaaaaaugaaucugacccagagggcgcucuuugguaa

SEQ ID NO: 21480 - RNA, 9879 nt, Artificial Sequence
  derived and/or modified CDS sequence (opt6) from DENV-1__EU726781__SS-prME
aguguaacuaugcucuuaaugcuaaugccaacugcgcuugcauuccaccuaacgaccaggggcggugaaccacauaugauuguuucuaaacaggagagagggaagaguuuauuauuuaaaacauccgcgggaguaaauauguguacuuuaauugcaauggaucucggagaauuuugugaagacacgaugaccuacaaauguccgagaaucaccgaggcugaaccagacgacguugacuguuggugcaacgcaacugauacuugggucacauacgggacguguucgcaaacaggagaacauaggagggauaaaagaagcguugcuuuggcuccacauguaggcuugggauuagagacacgcaccgagaccuggaugucaucugagggagcauggaaacaaauucaaaggguggaaacuugggcccuuaggcauccaggguucacaguaauagcuuuguuccuggcacacgcaauaggcacaucaaucacacaaaagggcauuauauuuauuuuacuuaugcuaguaacgcccucaauggcuaugagaugcguaggcauaggaucacgagauuucguagaaggauuaagcggcgcuacauggguagauguaguauuagaacacgggucuugcgugacaacuauggcgaaggauaaaccuacacuugauauugaacuguuaaaaacagaggucacgaacccggcagugcuacgaaaguugugcauagaagcaaagauaucaaauacaacgacagauucgcguugucccacucaaggugaagcaacauuaguagaggaacaagaugcuaacuuuguuugccgacguaccuucgucgaucguggauggggcaauggauguggauuauucgggaagggcagucuaauaacaugcgccaaauuuaaaugugugaccaaauuagagggaaaaacgguacaauaugaaaaucuaaaauacagcguaauuguaacaguacacacgggggaucagcaccaggucggcaaugagagcacagaacacgguacaaccgccacaauaacaccccaagcuccauccaccgaaauacaguuaaccgacuauggcgcgcugacacuagacuguucaccuagaacuggguuggacuuuaaugaaauggucuuacucacaaugaaagagaaaucgugguugguacauaaacaaugguucuuagaucuaccacuaccuuggacauccggagcaaguaccucacaggagacauggaaccgcaaagauuuacucguuacuuucaagaccgcucaugcaaaaaagcaagaaguagugguucuuggcucucaagaaggagcaaugcauacagcuuuaacaggugcuaccgaaauacaaacgucgggaacaacaacgaucuucgcuggacaccucaaauguagauugaaaauggacaagcuaacuuuaaaaggaaugucauauguuaugugcacaggaaguuucaagcuggaaaaagaaguagcagagacucagcaugguacuguguuaguacaaauaaaauaugaaggaacugaugcacccugcaaaauaccguuuucaacacaagacgagaaaggugucacacaaaauggcagauuaauaacagcuaauccaaucgucacggacaaagaaaaaccuguuaauauagaggcagaaccuccauucggcgaaaguuauauaguaauuggagcaggagagaaggcccuaaaacucuccugguuuaaaaaaggcucgucaaucggaaagauguucgaagccacagcccggggcgcacgacgaauggcgauauuaggugauaccgcaugggacuuuggaagcauuggagguguauuuacaucaguaggaaagcuuguacaucaaauuuuugggacugcauauggaguauuauucucugguguaucuuggaccaugaagaucggcauaggagugcuacucacauggcucggccucaauaguagaagcaccucacuuuccaugacuuguauagucguggguuuagucacgcuuuauuuagguguaaugguccaggcagacucagguugugucauuaauuggaaaggucgugagcuaaaauguggaagcgggauuuucguuaccaacgagguacauacguggacagagcaauauaaauuucaagccgacagcccgaaacgacuuucagcagcuauagggaaagcaugggaagaaggcgugugcgguauccgcucggcaacaagauuagaaaauauuauguggaaacaaauaaguaaugaauugaaucauauacuacuagagaaugauaugaaguucacaguuguuguaggagacguggcuggcauccuggcucaagguaaaaagaugauucgaccacaaccgauggaauacaaauauucuuggaaaucaugggguaaagcuaaaauaaucggggcagauguacaaaacacgacauuuauaauugacggaccaaacacaccggaaugcccugaugaccaaagagcauggaauauuugggaaguugaggauuauggauucggaauuuucacuacaaauauauggcuaaagcugagggauuccuauacacagguaugugaccaucgauuaaugucggcggcgauuaaagacagcaaagcaguacacgccgauauggguuauuggauugaauccgaaaagaacgaaaccuggaaauuggcaagagcuuccuuuauagaagucaaaacauguaucuggccgaagucccacacacucuggucgaaugguguauuggaaucagaaaugauuauaccuaaaaauuacggagggccuauuucccaacacaacuaucggccagguuauuuuacccaaacugcagguccguggcaccuugguaaguuagaacuagauuucgacuugugugaaggaacuacaguagucgucgacgaacauugcggaaacagagggccaucacuaagaacaacaaccgucacagggaaaaucauacacgaauggugcuguagauccuguacguuaccaccacuucguuuuaaaggagaagauggaugcugguauggaauggaaauuaggccgguuaaagaaaaggaagaaaaucuggucaaaaguaugguuuccgcugguagcggugaaguggacaguuuuaguuugggucucuuauguauuaguauaaugaucgaggaagugaugagaagucgaugguccagaaaaaugcuuaugacagguacauuggcaguauuauuuuugcuaauuaugggacaguuaacauggaaugaccugauuagauuaugcauaaugguaggcgcuaacgccucggauagaaugggcaugggcacaacguaucucgcucuaauggcuacguuuaaaaugcgacccauguuugcgguaggauuacucuuuagaagacuuacaucaagagaaguccuucuacuaacaauaggacuaaguuuaguggccaguguugaauuaccaaauagucuggaagaauugggcgauggacuagcaauggggauuaugauucuaaaguuacuaaccgauuuucaaagucaccaacucugggcaacacuucuaucuuugacauuuauaaaaacgaccuuuucucuacacuaugcauggaaaacuauggcuauggugcugucaauaguaucccuuuucccauuaugucucucgaccacuucacaaaagacaacaugguuaccggucuuauuaggaaguuugggaugcaaaccuuugacaauguuccucauagccgaaaacaagauuuggggacggaaaucauggccacuaaaugaagguauuauggcaguagggaucguguccaucuuacuaaguucguugcugaaaaaugaugugccacucgcgggaccccuaauugcuggcggaaugcucauagccuguuauguuauuagcggaaguuccgcggaccuaagccuggaaaaagcagcagaaguuagcugggaagaggaagcagagcauaguggggcgagucauaauauauuaguugaaguacaagaugacggaacuaugaaaaucaaggaugaagaaagagaugacacccuaacaauccuucugaaagcaacauuauuagcaguaucugggguauauccccugucaauaccggcuacauuguucguuugguauuucuggcaaaaaaaaaaacaaagaucaggaguguugugggauacuccuaguccuccugaaguugaaagagcgguacuagacgauggaaucuaucgcaucaugcagcgcggucuacuaggcaggagccaagugggaguaggaguguuucaggaaaauguauuccauacuauguggcacgugacucgcggagcuguucuaauguaucaaggaaagcgguuagagcccucaugggcaagcgugaaaaaggaucuaauaaguuauggaggugguuggaggcuacagggaucuuggaauaccggagaagaaguacaaguaauagcaguagaaccgggcaagaacccaaagaauguacaaaccgcaccagguaccuuuaaaacgagugaaggcgagguaggagccaucgcgcuagacuuuaaaccuggaacgagcgguucaccaauagucaauagagagggcaaaaucguaggauuauacggcaacgggguagucacaacuucgggaaccuacguuagugcaauugcucaagcaaaagcaagucaagagggaccauugccagaaauugaagaugaagucuuuagaaaacguaaucuaaccauaauggacuuacauccagguaguggaaaaacaagacguuauuugccggccauuguccgggaagcuaucaaaaggaaauugcgaacgcuaauucuugcucccacaaggguaguggcaucagagauggcagaggcuuugaaagggaugccuauaagauaucaaacaacagccguaaaaucagaacauacugguaaagagauuguagaucuaaugugccacgcuacuuucacuaugcgauuacucucacccguuagagucccaaauuacaauaugauaauaauggaugaggcucauuucacagacccaucaucuaucgcugcucgaggguauauuaguacgcgcguaggaaugggagaagcagccgcaauuuuuaugacagccaccccaccaggauccguggaagcguucccgcaaagcaacgcuguuauccaagaugaagaaagggacauuccagaacguucauggaacucagguuaugaauggauaacggauuuuccgggaaagacaguuugguucgucccaagcauaaaaaguggaaaugauauugccaauugucuacgaaaaaaugguaaacgagucauacaacuuaguagaaaaacuuucgacacagaauaccaaaaaacaaagaauaacgauugggacuacguagugacaacagauauuagcgaaaugggcgcuaauuuuagggccgauagagucaucgauccaagaaggugucuuaaaccuguaauacuaaaagacggaccugaaagagugauucuagcuggcccaaugccuguuaccguugcauccgcugcacagcgaagggggagaauaggucguaaucacaauaaagaaggugaucaauauauuuauaugggacagccauuaaauaacgaugaggaucaugcucacuggacagaggcaaaaauguuacuggauaauauuaacacaccagaagguauuauuccggcucuauuugaaccagaaagggaaaaaagcgcagcuauugacggggaguauagacugagaggugaagcccggaagacuuucguugaacuaaugcggagaggagauuuaccggucuggcucucguauaaaguagcaucugagggauuucaauacucggaucgccgaugguguuucgacggcgaaagaaacaaucaaguauuagaagaaaauauggaugucgagauuuggacuaaggaaggggagcguaagaaacugcggccgagaugguuagaugccagaaccuauagugacccauuagcauuacgugaauuuaaggaguucgcagcagguaggagaagugucagcggugaccuaaucuuggaaauuggcaaacuaccacaacaccugacucaaagagcacaaaaugcguuagacaauuuggucaugcugcacaacagcgaacaaggaggaagagcauacaggcacgcgauggaagaacugccugauacaauagaaacacuaauguuacucgcacuaauugcuguuuuaaccggaggaguaacacuauucuucuuaucuggaagaggcuuaggaaagacgucuauuggauugcuuugcguuauggccucgucaguauuauuauggauggccagcguggaaccgcauuggaucgcagcaaguauuauccuugaauucuuucugaugguacucuuaauuccugaacccgauagacaacgaacuccucaagacaaccaacucgcauaugugguaauugggcuguuauucaugauuuuaacaguagcagcgaacgaaaugggcuuacucgaaacgacuaaaaaagauuugggaauaggucaugucgcaguagagaaucaucaucaugccgccaugcuggauguagacuuacacccagcaucagccuggacauuauacgcuguagcgacgacaaucauaacuccgaugaugcgacauacuaucgaaaauaccacagcuaauauaucucuaaccgcaauugcaaaucaagcagcuauacuuaugggacucgacaaaggguggccaauaaguaagauggauaucggagucccucuucucgcacuaggauguuacagucaaguaaacccauugacucuuacggcagcgguacuuauguugguugcgcacuacgcgauuauuggucccggucuacaagcuaaagccacacgagaagcucagaagcguacagccgcaggaauaaugaaaaacccaaccguggaugggauaguugcuauagauuuggacccagugguuuacgaugcuaaauuugaaaaacagcuaggacaaauuaugcuacuuauauuguguaccagucaaauacuauuaaugagaacuacaugggcucuaugugaaucaauuacucuagcgacgggaccacuaacaacccuuugggaggggucgccagggaaguuuuggaauacaacuauagcgguaucgauggcuaauauauuuagaggaucuuauuuagcgggcgccggauuggcuuuuucauuaaugaaaagucugggcggagggcguagagggacgggagcucagggcgaaacauugggugaaaaguggaaaagacagcugaaccagcuaaguaagagcgaguucaauacuuacaaacgcaguggaauaauggagguagaccgaucagaagcuaaagaaggauugaagcggggagaaaccacuaagcacgcagucagcaggggcacagcuaaacugagaugguucgucgaacguaaccuggucaagcccgaaggaaaggucauagaucuagguuguggcagaggagguuggaguuauuacugcgcaggcuuaaaaaaagucacagagguaaaaggauacacuaaaggcgggccaggacacgaagaaccuauuccaauggcuacguacgguuggaaucucgugaaacuacacucugguaaagacgucuuuuuuauaccucccgaaaaaugcgacacauugcuaugcgacauuggugaaucauccccuaauccuacaauugaagagggaaggaccuugcguguacuuaaaaugguagagccguggcuuagaggaaaucaguuuuguauaaaaauacuuaauccuuauaugccgucgguggucgaaacauuggaacaaaugcagagaaaacauggggggauguuagugcguaauccacucaguagaaacucaacgcaugaaauguauuggguuagcugcgggacuggaaauauagugagcgcuguaaacaugacaucuagaauguuauugaaccguuuuacuauggcccacagaaaaccuaccuacgagagagauguagaucucggugcugggaccaggcaugucgcagucgaaccagaaguagccaaucuugacauuauaggacaaagaauagaaaauaucaaacacgaacauaagagcacuuggcacuaugacgaggacaacccauacaaaaccugggcuuaucauggaucauacgaagucaagccaagcgguucggcgagcaguaugguuaaugggguugucaaguuacuaacuaaaccaugggaugucauaccuauggucacgcagauugccaugacugacaccacuccuuuuggacaacaaagaguauuuaaagaaaagguugauacuaggacaccaaaagcuaaacgcgguacugcccaaauaauggaaguaaccgcaaaauggcucuggggcuuucuuaguagaaauaaaaaaccucgaauuuguaccagagaagaauuuacaagaaaaguucgcuccaacgcugcuaucggggcuguuuucguagacgaaaaccaauggaauucagcgaaggaggcaguggaagaugaaagguuuugggauuuaguacaucgagagcgagaauuacacaagcaaggaaagugcgcuacgugcguauacaauaugaugggaaaaagagaaaaaaagcuaggagaauucggaaaagcuaagggaagccgugcaauuugguauaugugguugggugcccgauucuuagaauucgaagccuugggcuuuaugaaugaagaucauugguuuagccgagagaauucacuuucggguguugagggggagggcuuacauaaauuaggauauauauugcgugacauaaguaaaauaccuggagguaauauguaugccgaugacaccgcaggaugggacacacgaaucacagaagaugauuuacaaaacgaggcaaaaaucacggacauaauggagccugaacaugcuuuguuagccaaaaguauauuuaaacuaacauaccaaaacaagguugucaggguucaacgcccagccaaaaacggaacaguaauggacgucauaucucgucgcgaucaacgggguuccggucaagugggcacauauggguuaaacacguuuacgaacauggaagcgcaacucauucgacaaauggaaagcgaaggcauauuuucaccuucagaauuagaaacaccgaaccuggcaggaaggguuuuggauuggcuagaaaagcauggaguugaacgguuaaaaaggauggcaauaaguggcgacgacugugugguaaagccaauugacgaucgauuugcaacggcacuaacugcccugaaugacauggguaaagugagaaaggauaucccucaaugggaaccaaguaaaggauggaaugauuggcaacaagugcccuuuugcagccaccacuuucaucaacuuauaaugaaagauggacgggagauaguuguacccuguagaaaccaggacgaguugguuggaagagcucgcgucagccaaggcgcaggcuggucgcucagagaaacagcaugcuuggggaagagcuacgcacaaauguggcaacuuauguauuuucacaggcgagaucuacgacuagcugccaaugcaauuuguagugcuguaccuguugacuggguaccgacuucccgcacaacauggucaauccaugcacaucaucaauggaugaccacagaagauauguuaagugucuggaaucgaguauggauugaggagaacccuuggauggaagacaaaacacauaucuccucuuggggagacguuccuuaucuaggaaaacgagaagaucaauggugugggucccugaucggauugacagcaagagcgacaugggcaacgaauauucaagucgcuauaaaccaaguaagaagguuaauuggcaaugaaaauuaucucgauuauaugacgucaaugaagagauuuaaaaacgagagcgauccagaaggagcauuaugguaa

SEQ ID NO: 21481 - RNA, 9879 nt, Artificial Sequence
  derived and/or modified CDS sequence (opt6) from DENV-1__EU726782__SS-prME
ucuguuacuaugcuauuaauguuaaugccuacugcacuagcuuuucaccuaacgacucgugguggcgaaccccauaugauuguuuccaaacaagaaaggggaaaaaguuuauuauuuaaaacuucugcagggguaaauauguguacgcuaauagcaauggauuugggagaacuaugugaagacacaaugacauauaaaugccccagaauaacugaaacggaacccgacgauguagacugcugguguaaugccacagauacaugggugacuuacgguacguguagucaaacgggagaacacaggagagauaaaaggucaguugcauuggcaccccauguaggcuuaggguuagaaacacguaccgaaacuuggaugucaucggaaggagcauggaaacagauucaaagaguagaaacaugggcucuacgacaucccggauuuacugugaucgcacuguucuuagcacacgcuauagguacaaguaucacgcaaaaagguauaauauucauccuccuaauguuaguaacacccucaauggcuaugcgcuguguggguauagguucucgagauuucguagagggauugagcggagcaacauggguagauguaguguuagaacacgguucauguguaaccacuauggcgaaagauaaacccacgcuugauauagaacuacugaaaacugaagucacuaacccagcuguauuacggaaacuuuguauugaagcuaaaauuaguaauacuaccaccgauucuagaugcccaacacaaggagaagcgacucuaguugaggaacaagacgcuaacuucguauguagaagaacauuuguagauaggggcugggguaauggaugcggguuauuuggcaaaggcuccuugaucacaugugcaaaauucaaauguguaaccaaguuagaagggaaaaucguccaauacgaaaaccucaaauacucagugauuguuacagugcauacgggcgaccaacaucaaguuggcaacgaaucaacagaacauggaacuacagccacgauaaccccacaagcuccgacaaccgaaauacaauuaaccgauuauggagcccuaacccuagauuguucaccaaggacaggacuugacuuuaacgaaaugguacuccucacuaugaaagagaagucauggcucguucacaaacaaugguucuuggauuugccccuaccguggaccucuggagccaguacuucgcaagaaaccuggaauaggcaagaccuucucgucacuuucaaaacagcccaugcuaagaaacaagaaguagucguacuaggaucgcaagagggugcaaugcauaccgcccucaccggggccaccgaaauucaaacaucaggaacaacgacaauauuugccggucaucuaaaauguagacuaaaaauggauaagcuaacacuuaaagggaugucauacguaaugugcacuggcucauuuaaacuugagaaagagguagcggaaacacagcaugggacugucuugguacaaauaaaauaugagggaaccgaugcaccaugcaaaauccccuuuuugacccaggaugaaaagggaguaacgcaaaaugguagauuaaucacagcuaaucccauuguaacagauaaggaaaaaccagucaauauugaagcagagccacccuucggagaaagcuauaucauaaucggagcuggcgagaaagcucuaaaacuuagcugguuuaagaaagguucaucaauaggcaaaauguucgaagccacugcucggggcgcgcggcgaauggcgaucuuaggggauacagcgugggacuucggcaguauuggcggaguauucacaaguguugguaaauuaguucaucaaaucuuuggaacagcuuaugggguucuauuuucagggguaucguggacgaugaaaauugguauagggguccuccugacuuggcuagguuuaaauucgcgaaguacuucuuuaucaaugaccugcauagcaguugguuugguuacguuguaccuaggaguaauggugcaagcggauucuggauguguuauuaauuggaaaggcagggagcuaaaauguggcagugguauuuuuguaacgaaugaggugcauacauggaccgaacaauacaaguuucaagccgacuccccuaaacgacugucagcggccauagggaaagcaugggaagaaggagugugcggaauaagaagugcuacuaggcuagaaaauauuauguggaagcagaucucaaacgaacuaaaucauauacuguuagagaacgauaugaaguuuacaguuguugucggagaugucgcugguauacuggcacaaggaaagaagaugauuaggccucaaccuauggaauauaaguauuccuggaaaucuugggguaaagcaaagauaaucggagcggauguucaaaacacuacuuuuauaaucgauggcccaaauacacccgaauguccugacgaccaacgagcguggaauauaugggaaguagaagauuauggguucggcauuuuuacaacaaacauauggcuuaaacucagagacagcuauacacaaguuugugaccacagacugaugagugcagcuauuaaggauuccaaggcaguucacgccgacauggguuauuggauagaaagcgagaaaaaugaaacuuggaaacuugcgagagccagcuuuaucgaggucaaaacguguauuuggccaaaaagucacacacuuuggucuaacggcguucuugaaucagagaugauuauaccuaaaauauacggugguccaaucucucaacauaauuaucguccuggguauuuuacgcaaacggccggaccuuggcaucuggggaaauuagaacuugauuucgauuuaugugaggggacuacagugguaguagacgaacauuguggcaaucgcgggccuagucuaagaacuacuaccguaacagguaagauuauacaugaauggugcugccgaucguguacucuaccaccauugcgguucagaggagaagauggguguugguauggaauggaaauacggccggucaaggaaaaggaagaaaaucugguaaaaucaaugguaucagcgggaagcggagaaguggauucauucucccucgguuuauuguguauuucuauaauuauagaagaagucaugagaucgcgguggagcagaaaaauguuaaugacaggaacuuuggccgucuucuuucuucuaaucaugggacagcugacauggaaugaccuaauacgauuaugcauuauggugggcgcaaaugcaucugacagaauggggaugggcacuacauauuuagcacuaauggcaacuuuuaagaugcgaccaauguuugcuguaggcuuauuauucaggagacuaacaagucgggaaguuuugcugcuuacaauuggacuuucuuuaguagcuagcguagaauuacccaacuccuuagaggaacuaggugauggcuuggcaaugggcauaaugauccuaaaauuacuaacggauuuucaaagccaucaacuaugggcaacccuuuuaucauuaacauucauuaaaacgacauucagcuuacauuaugcauggaagacaauggcaaugguacuuaguauuguuagcuuguucccgcucugccuaaguacaaccagucaaaagacaacguggcugccagugcuucuuggaucucuaggcuguaagccuuugaccauguuuuugaucgcugaaaacaaaaucuggggaagacgcucauggccuuuaaacgaagguauaauggcgguuggaauagucagcauacuguuaaguucccugcucaaaaaugaugucccccuugcuggucccuuaaucgcgggaggaauguugauugcauguuaugucauaaguggaagcucugcagauuuaucgcuugaaaaagcugcugaaguaaguugggaagaagaggcggaacauucgggagcaagccauaacauccuggucgaaguacaagaugauggcacaaugaagauaaaagaugaagaaagagaugauacauugacgauacuacugaaagcgacauuacuggcuguaagcggggucuaccccuuaucuauuccugcgaccuuauuuguuugguauuucuggcagaaaaagaaacaaagaagcggcguuuuaugggauacaccuucuccaccagaaguagaaagggcaguucuggaugaugggauauauagaauaaugcaacgcggucuucucgguagaucacagguggggguaggaguauuucaagaaaauguuuuucacacaauguggcacguaacgcguggcgcugucuuaauguaccaagguaaacgacuagaaccuucaugggcguccguuaagaaagaucuaauuucuuaugguggcggauggagacugcaagguucuuggaacaccggagaagaaguucaaguuauagccguugaaccgggaaagaauccaaagaacguucagacugcuccaggaacauuuaaaacgccugagggagaaguaggagcgauagcgcuugauuucaagcccgguacaucggggucaccaauaguuaauagagaagguaaaauaguugggcuauacgguaauggcgugguaacgacuucagggacguacguaagugcaauugcacaggcaaaggcuucacaggaagguccguugccggagauagaagaugagguauucaggaaaagaaaccuuacaauuauggacuuacaccccggaucaggcaagaccagaagauauuugccagccauaguacgggaagcaauuaaacgaaaacuacgaaccuuaauucuggcacccacaagaguaguagcuucagagauggcggaagcucuuaaagggaugccuauccgauaccagacaacagcagugaagagugagcauacgggcaaagagauuguagaccuaaugugccaugccacuuuuacuaugcgccuucucucaccuguacgagugccuaauuacaauaugauuauaauggaugaggcacacuucacggauccaucauccauagccgcacgaggcuauauaucaaccagaguggggaugggggaggccgccgcaauauuuaugaccgcuacgccacccgggagcgucgaggcuuuuccgcaaucuaaugcugugauacaagacgaagaaagagauauaccagaaagaaguuggaacucgggcuacgaauggaucacugacuuccccggaaagacggugugguucgucccaagcauaaaaaguggaaaugauauagcaaauuguuuacgcaaaaauggaaaaagaguaauacaacuauccagaaaaacuuuugauacagaauaucagaaaacuaagaauaaugauugggauuaugucguuacuacagacauuucugagaugggugcgaauuuuagagcugacagagugauagauccgcgaagaugucuaaaaccuguuauauuaaaagauggaccagagcguguuauacuugcaggaccaaugccagugacaguggcuucagcagcacaacgacgcggaaggauaggaaggaaucacaauaaagaaggagaccaauacauuuacaugggacaaccccuaaauaaugacgaagaucacgcacauuggacagaagcaaaaaugcuauuagauaacauuaauacaccagaagguaucauaccugcauuauucgaaccggaaagagagaaaucagcagcaauagauggggaauaucgcuugaggggugaagcaagaaaaacguuugucgaacuaaugagaagaggugaucucccgguuugguuaucuuacaaagucgcuuccgaaggauuccaauauucagacagaagauggugcuuugacggagaaagaaacaaccaaguucuagaagaaaacauggacguugaaauuuggacaaaagaaggugagcgaaagaaacuaaggccucggugguuagaugcucguacauauucagauccacuagccuugagggaguucaaggaauuugcagcuggacgcagaagcguaaguggagacuugauccuugaaaucggcaaacucccucagcaccuaacgcaaagggcgcagaaugcauuggacaaucuggucauguugcauaacagugaacagggaggacgggcauauagacacgcaauggaagaguugccugauacaaucgaaacucuaaugcuacuggcgcuaauagcaguauuaacaggaggcguuacucuauucuuucuaagugguagaggacuuggaaaaaccucgaucggacuucuuugcgugauggcuucaaguguacuacuauggauggcuucagucgaaccgcauuggauugcagcaagcauuauauuagaguucuuuuugaugguauuguugauaccagaaccggaucggcagaggacaccucaagauaaccaauuagcauauguuguaauaggucucuuauuuaugauauuaacagucgcugccaacgaaaugggcuuguuagaaacaacgaagaaagaccugggaauugggcauguggcuguugaaaaucaucaccaugcugcuaugcuagauguagaucuucauccggcaucugcauggacucuauacgcaguagcaaccacuauaaucacuccgaugaugcgacauaccauagagaauaccacggcgaauauaaguuuaacugcaaucgccaaccaggcagcaauucucaugggacuugacaaaggcuggccaauauccaagauggauauaggaguaccauuguuagcucuaggaugcuauagucagguaaacccucuaacacuaacagccgcgguacucaugcuuguagcacacuacgccauaauuggaccaggacuucaagcaaaggcaacaagagaagcacaaaagagaacagcugcagggaucaugaaaaacccaacaguagacgguauaguagccauagaucuggacccgguuguuuaugacgcgaaauucgaaaagcaauuaggucaaauaaugcugcuuauuuuauguacaagucagauucuucuuaugaggacaacgugggcuuuaugugagucaauuacccuagccacaggaccacuaaccacgcuaugggaagguucaccagguaaauuuuggaacacaaccauagcuguaucgauggcaaacaucuuccgagggaguuaucuagcaggggcgggcuuagcuuuuucucuuaugaaaucucugggaggaggacgucgagggacaggcgcacaaggagaaaccuuaggugaaaaguggaaacgacaacuaaaucaacuaagcaaaagcgaguuuaacacauacaaaagaagugguauaauggaagucgacagaucagaagcuaaggaggguuuaaaacguggagaaacuacaaaacaugcagucucucgggguacagcuaaacuucggugguuuguagaacgaaauuuggucaaaccagaaggcaaggucauugaucuaggcugcgggaggggaggauggucauauuauugcgcaggccuaaagaaagucaccgaagugaaaggcuauacuaaaggaggaccuggccacgaagaaccaauacccauggcuacauaugguuggaauuuaguaaagcugcacuccggaaaagaugucuuuuucauaccacccgaaaaaugugauacauuacuuugcgauauaggggaaucuaguccaaacccaaccaucgaggaagguagaacacuuagaguacuaaaaaugguugagccgugguuaagaggaaaucaauucugcauaaaaauacucaauccauacaugccuagugugguagaaacauuggagcaaaugcagagaaaacauggaggcaugcucgugcguaacccucuaucuagaaacucuacucacgaaauguacuggguuucguguggaacggggaacauaguaagcgcaguaaauaugaccucuagaaugcuucuuaauagauuuaccauggcacaucgaaaaccuacauacgagagggacguagaucucggugcuggcacaaggcacgucgcaguagaacccgagguagcaaauuuagacauaauagggcagcgcauugaaaauauuaaacaugaacauaaaaguacuuggcacuaugacgaagauaacccauauaaaaccugggcauaccauggauccuaugaagucaaaccgucuggaagcgcuuccagcaugguaaauggaguaguuaaauuguuaacgaaacccugggacgucaucccgaugguuacacaaaucgcaaugacagacaccacgccauucgggcaacaacgcguauuuaaggagaaaguugacacaagaacaccuaaagcgaaaagaggaacggcacaaaucauggaggugacagccaaaugguuaugggguuuccucucucgaaacaagaaacccaggauaugcacacgagaggaguucacaaggaaaguccgaucaaacgccgcgaucggcgcaguauuugucgaugagaaccaauggaacucagcuaaagaagcaguagaagacgaaagauuuugggauuuaguacauagggaacgagaacugcauaaacaaggcaaaugugcuacauguguuuauaacaugauggguaaaagggagaagaaauugggugaauuugguaaagccaaagggucgagagcuauuugguacaugugguuaggggcuagauuuuuagaauuugaggcucuaggauuuaugaaugaggaccauugguuuaguagggagaacagucuaucaggcguagagggagaaggccuccauaaacuggguuacauauuacgagacauuagcaaaauaccaggaggcaacauguacgcugacgacacagcagguugggacacuaggauaacggaagacgauuuacaaaaugaagcaagaaucacagacauaauggaaccggaacaugcauuguuagcaaagagcaucuuuaaacuaaccuaucagaauaaagucguacggguacagcgaccagcgaaaaacggaacuguuauggaugucauuagcagacgcgaucagcgaggcaguggucaaguagguacguacgggcuaaacacauuuacuaauauggaggcucaauuaauuagacaaauggaaucggaaggaaucuuuucacccagugaauuggaaauucccaauuuagcagaacgcgugcuggauuggcuugaaaaauauggggucgaaagacuaaaaagaauggcuaucagcggugaugauugcguuguaaaaccuauagacgauagguuugcaacugcucuaaccgcacugaaugacauggggaagguucggaaagacauuccacagugggaaccuucuaaagguuggaacgacuggcaacaaguaccguucugcucucaucacuuccaccaguugauuaugaaagaugggagagaaauaguggucccgugccgcaaccaagaugaauuaguaggacgagccaggguaagucaaggggcaggaugguccuuaagagaaacggcauguuuagguaaaaguuacgcacaaauguggcaauugauguacuuucaccguagagacuugcgauuagccgccaaugcgauauguucagccguuccuguagauuggauuccaacgucacgcacaacuugguccauucacgcucaccaccaauggaugacuacggaagauaugcuaaguguauggaauaggguauggauagaggagaacccauggauggaagauaaaacucauauuaguucauggggagauguuccauacuuaggaaaaagggaagaccaaugguguggaagucuaauaggacuuacugcuagagcaacaugggcaacaaacauacaaguugccauuaaucaggugagaagauuaauuggaaaugagaauuauuuagauuauaugacaucaaugaaaagguuuaaaaaugaaggcgacccggaaggagcacucugguga

SEQ ID NO: 21482 - RNA, 9879 nt, Artificial Sequence
  derived and/or modified CDS sequence (opt6) from DENV-1__EU677178__SS-prME
agcguaacuaugcuauuaauguuaaugccaacggcucuagcauuucaccugaccacgcggggaggggaaccucacaugaucguaagcaaacaagaaagaggaaaaagucugcuauuuaaaacguccgcgggagugaauauguguacuuuaaucgcaauggauuugggagagcuaugugaagacacuaugacuuacaaauguccacggauuacggagacugaaccagacgauguagauugcugguguaaugcuacagauacaugggugacguacggaaccuguucccaaaccggagagcacagaagagacaaacgaagcguggcccuagcgccgcacgucggauuaggauuagaaacaagaacugagacauggaugucaucagaaggcgcguggaaacagauucagagaguagaaaccugggcccuacgacacccggguuucacgguaauagcguuguuucuagcccaugcuauugggaccucaauaacacagaaagguauaaucuucauacuacuaaugcuaguaacaccuucgauggcaaugcgcuguguagggaucggaagucgcgauuuuguagagggacuaucgggcgccacauggguugacguaguacuggaacauggauccuguguaacaacuauggcuaaagauaaaccaacauuggauaucgaguuguuaaaaacugaggucacuaaucccgcuguauuacgcaaacucugcauugaggcaaaaauauccaauacgacgacugauaguaggugcccaacucaaggagaggcaaccuuaguggaggaacaagaugcgaauuucguauguaggagaacauuugucgauagaggcuggggaaaugguuguggauuguucggcaaagggagccuaauaacuugugccaaauuuaaauguguuacuaaauuagagggaaaaaucguucaguaugaaaauuugaaauauagcguuaucguaaccguacacacaggcgaccaacaucaagugggcaacgagucgacggaacauggaacgacagcaacaauaacgccgcaagcgccaacgaccgaaauacaauugacagauuauggugcauuaacgcuagauugcagcccuaggacagguuuagacuuuaaugaaauggucuuguugaccaugaaagaaaaaucaugguugguacacaaacaaugguuccuagaccugccacuaccauggacgagcggagcaucuaccucacaagaaacauggaacagacaagauuugcuaguaacguuuaaaacugcacaugccaagaaacaagaaguuguaguucucggaucgcaagaaggugccaugcacacggcguuaacuggagccacugaaauacagacgucagggaccacuacuauuuuugcgggccaucucaaaugcagauugaaaauggacaaacuaacauugaaagggaugucuuaugucaugugcacaggaaguuuuaaauuagaaaaagaagucgcagaaacucagcauggaacaguuuugguacaaauaaaauacgaaggaacagacgcaccaugcaaaauaccguuuuuaacgcaagaugagaaagggguuacccaaaacggacgauuaauaaccgcaaauccaauuguaacugauaaagaaaaaccaguaaacaucgaagcagaaccaccauucggugaaaguuacauuaucauuggcgcgggcgaaaaagcucuaaaacuuuccugguucaagaaagguagcaguauaggcaaaauguucgaagcaacugcucguggagcucgucgaauggcgauacuuggagauacagcuugggacuuuggcucuauaggaggaguauucacaucagucgguaaacucguucaccaaauauuugggaccgcauacgguguauuguuuagugggguaaguuggacuaugaagauagguauuggcgucuuacuuacauggcuuggguuaaacucacguucgacgucauuaagcaugacuugcauagccguaggcuuaguaacacuauaucuaggaguaaugguacaagcggauucgggcugugugauaaauuggaaaggccgagaacugaaauguggaaguggcauauucguaaccaaugagguacauacauggacugagcaauauaaauuccaagcagacucaccaaagcgccuuagcgcagccauaggaaaggcuugggaggagggagugugugggauaaggucugcgacacgacucgaaaauauaauguggaaacagauuaguaaugaauuaaaccauauucuacuugagaacgauaugaaauucaccgugguagugggcgacguagcagguauccuagcacaaggcaagaaaaugauaaggccucagcccauggaauacaaauauaguuggaagucauggggcaaggcgaaaaucauaggggccgauguacaaaacacgacauuuaucauugacgggccaaauacaccugaguguccugaugaucagagagcauggaacauuugggaaguagaagauuauggguucggaauauucacgacaaacauauggcucaaacuacgggauagucacacucaaguaugugaucauagauuaaugucagcagccauaaaagauucgaaggcaguacacgcugacaugggcuacuggauagaaagugagaaaaaugaaacauggaaauuggcucgagcgucauuuaucgaaguaaaaacuugcauauggccaaaaagucauacacucuggaguaauggggucuuagaaucugaaaugauaauccccaaaauauauggcgggcccauuagccaacauaauuaucgaccuggauauuucacucagacugccggaccguggcaucuggguaaauuagaauuagauuuugacuuaugcgaaggaaccacuguagugguagacgaacacugcgggaaucguggcccaucccuaagaacgacaacagucaccggaaagaucauacaugaguggugcugcagauccugcacguuacccccacuucguuucagaggugaggauggaugcugguaugguauggaaaucaggccaguuaaagaaaaggaagaaaauuuaguaaagucgaugguuucugcggguucaggagaaguagacagcuucucauuaggguuauuguguauauccauaaugauugaagaaguaaugagaucaagauggucgaggaaaauguuaaugacagggacuuuagcuguguuuuucuuauugauaaugggacaauugacauggaacgacuuaauaagacuguguauuaugguuggagcaaacacgucagauagaauggguaugggaacuacauauuuagcacuuauggcuacguuuaaaaugcggccgauguucgcggucggauuauuauucagacgacuaacaaguagagaaguuuugcuucuuacgauaggacucagucuagucgccagcguagagcugccaaacucucuugaggaacuaggugaugguuuggcaaugggaauaaugauccuuaaguugcuuacugauuuccagagucaucaauuaugggcaacauuauuaucucuaaccuuuauaaaaacaacauucagccuccauuaugcuuggaagacgauggcaaugguuuuaaguauaguaagccuauuuccacucugccuaagcaccacuucgcagaaaacaacauggcuuccuguuuuauuggggagccuugguugcaaaccccugacaauguuucuaauagcugaaaauaaaaucugggggagaaggagcuggccucuaaaugagggaauaauggcaguaggaauaguaaguauccugcuaucaagucuguugaaaaacgaugugccauuagcggguccucuaauugcaggaggcauguugauagcaugcuauguuauaucaggaaguagugcggaucuaagccuagagaaagcagcggagguuaguugggaagaagaagccgagcauucaggagccagccauaauauuuuaguugagguacaagaugauggcacaaugaagauaaaagacgaagaacgugaugacacgcugacaaucuuauuaaaggcuacucuacucgcaguuagugggguauacccacuaaguaucccugccaccuuauuuguaugguauuucuggcaaaagaaaaagcaaaggaguggugugcugugggauacuccuucaccuccggaaguggagagggcgguguuggaugaugguauauaucgcauuaugcaaagagguuuauuaggucguucacaggugggggucggaguguuucaggaaaauguauuccacacaauguggcacguaaccagaggcgcuguucuaauguaucaagguaaacgauuagaaccgagcugggcgaguguuaagaaagauuugauuucuuacgggggagguuggcggcuucaaggaaguuggaauaccggcgaagaaguucagguaauagcgguggaacccggcaaaaauccgaaaaauguucaaacagcaccgggcacuuucaaaacccccgagggggaaguaggagccaucgcacuagacuuuaaacccggaacaucgggcucuccuauugugaaucgagagggcaaaauaguaggauuauacggaaacggugucguaaccacgaguggaacguacgugucugcuauagcacaagccaaggcgucgcaagaaggaccguuaccugaaauagaagaugaagucuuucguaaaaggaauuuaacuauaauggaucuacacccagggagugguaagacaagacgauaccuucccgcaaucguuagagaggccauuaaacguaaguuaagaacauuaaucuuagccccaacgcgcguaguugcuucggaaauggcggaagcauugaaaggaaugcccauacgauaccaaacuacugcagugaaaagugaacauacugguaaggaaauuguggaucuuaugugucacgcgacauucacgaugcguuuacucucaccaguucgagugccaaauuauaauaugauuauuauggacgaggcacauuuuacggacccaucuucuauagcugcaagagguuauaucuccacccggguuggaaugggagaggcagcagcgauauuuaugaccgcuacgccgccuggaaguguggaagcauucccacagaguaacgcugucauucaagacgaagaacgcgauauaccugagagaaguuggaacuccggguaugaauggauuaccgacuucccuggaaagacggucugguucgugccuucaauaaaaaguggaaaugauauagcaaauugccuacggaaaaauggaaagaggguaauccaacuauccaggaaaacuuucgacacugaauaccagaaaacgaaaaauaaugauugggauuacgugguaaccaccgacaucucagagaugggggccaauuuucgugcagauaggguuauagauccaagacgcuguuuaaaaccaguaauacucaaagacgguccagaacgcguaauuuuagcugguccaaugccuguaaccguagcuagugcagcacaaagacguggaagaauaggcagaaaucauaauaaagaaggggaucaauacauauauaugggucaaccacucaacaaugaugaagaccacgcacauuggacagaagcgaaaaugcucuuagauaauauaaauaccccggagggcauuaucccugcauuauuugagccagagagggaaaaauccgcggcgauugacggagaguauagauuacgaggggaagcuagaaagacuuucguggaguugaugcggcguggagacuugccuguuuggcuuagcuacaagguagcaagcgaaggguuccaauauucagauagaagauggugcuucgauggagaaagaaacaaucaaguucucgaagaaaauauggacguugaaauauggacaaaagaaggggaaaggaagaaauuaagacccagguggcuagacgcacgaacauauucggauccauuagccuuacgcgaauuuaaagaauuugcagcgggcagaagaucgguaucaggcgaucuaaucuuagaaauagggaaacugccacaacaucuaacucaaagagcacaaaacgcacuugacaaccugguaaugcugcauaauuccgaacaagggggacgcgcauaucgacacgccauggaggaacucccggauacgauagaaaccuuaaugcuuuuggcguuaauagcggugcuuacggguggaguaaccuuauuuuuccuaagcgguagaggacuaggaaagacaucaaucgguuuacuuugcguaauggcuaguagcguacuauuauggauggccucaguggaaccacacuggauagcagcuagcauaauucucgaguucuuucuaaugguguuauuaauccccgaaccagauaggcaaagaacaccucaagauaaucagcucgcguaugucgucauaggauuauuauuuaugauccugacaguagccgcaaaugaaaugggauuacucgagacuacgaagaaagaccugggaaucgggcacgucgcgguagaaaaccaucaucacgcugcaauguuggauguugauuuacacccggccucagcauggacgcucuaugcuguagcaacgacuauaauaacccccaugaugaggcauacuauagaaaauacuacggcaaauauuagucugacugcaaucgcaaaccaagccgcaauucuuaugggccuagacaaaggguggccaauaucaaagauggacauuggagugccauuacucgcucuggguuguuacagucaaguaaacccauugacucuaacugcugcaguauugaugcuuguggcucauuacgcuauaaucgguccuggauuacaagcaaaagccacaagagaagcacaaaagaggacugcagcggggauuaugaagaacccaacgguagacgguauuguugcaauagauuuggauccugugguuuaugaugcgaaauuugaaaagcaacuagggcaaauaaugcuacucauacuuuguacgagucaaauuuuacuaaugagaacaacaugggcgcuaugcgagagcaucacuuuggcaacagggccauuaacaacccuaugggaaggcucaccgggaaaauuuuggaauacaacaauagcaguuucgauggccaauauauucaggggcaguuaucuggcaggggcuggauuagcuuucucguuaaugaagagucuaggaggcggaagacgaggcaccggagcucaaggugaaacauuaggagaaaaauggaaacgacaauuaaaucaacuaucaaaaagugaauuuaacacauauaagcgauccggaauaauggaaguugauagaagugaagcaaaagagggacuuaaacgaggggaaacaacaaagcaugcaguaaguaggggaacugcaaaacuacggugguucguggagcggaacuuaguaaagccagaagguaaaguuauagaccugggauguggaagaggggguuggucauauuauugcgcaggauuaaagaaagugaccgagguuaagggauauacgaaaggaggaccaggacaugaagaaccuauucccauggcaacauaugguuggaaccuaguuaaguuacacucagguaaagauguauuuuucauucccccagaaaagugugacacauuauuaugugauaucggagaaaguagcccuaacccaacaauugaagagggucggacauugagaguccuaaaaaugguugaaccguggcuucgaggaaaccaauuuuguauaaaaauucuaaacccauauaugcccucagugguugagacgcuugaacaaaugcaacggaaacacgguggaaugcuaguccguaauccgcugucaagaaauuccacacaugaaauguauugggugucgugugggacuggaaacauagugagugcuguuaacaugaccuccaggauguugcuuaaucgguuuaccauggcacauagaaaaccgacauaugagagggacgucgaucuaggcgcagggaccagacacguagcagucgaaccagaaauagcaaaucuagauauaauagggcaacgaauagaaaauauuaaacaugagcauaagucgacuuggcauuacgaugaagauaauccuuauaagaccugggcuuaucacggaagcuaugaagucaaaccguccggaagugcgucuucaaugguaaacggaguaguuaaacuucuaacaaagccuugggauguaaucccgaugguuacacaaaucgcaaugacagacacaacuccauuuggacaacagaggguauucaaggaaaaaguugacacucgaacaccuaaagcaaaacgggggaccgcgcaaauuauggaagugacugcaaaauggcuauggggauuuuuaucaagaaauaagaaaccucgaauuugcacccgagaagaguuuacaaggaaaguuagaagcaaugcagcaauuggugccguauuugucgacgagaaccaauggaauagugcuaaggaggcagucgaagacgagcgauucugggauuuaguacaccgggaaagagaguuacauaaacaaggaaaaugugcaaccuguguguauaauaugaugggcaagcgcgagaagaaacuuggggaauuuggaaaagccaaggguaguagggcuauaugguacaugugguugggagcaagauuccuagaguucgaagcgcucggauucaugaaugaagaucauugguucucacgagaaaauucacuaucagggguagaaggagagggcuuacauaaauuaggauauauacuaagagauauaaguaaaauuccuggcggaaacauguacgcugacgauacugcuggcugggauaccaggauuacagaagaugaucuacagaaugaggcaaggauaacugauaucauggagccggaacacgcguugcuugcuaaaucaauauuuaaguuaacguaucaaaacaagguggugaggguacaaagaccagcuaagaacgggacaguaauggaugucaucagucgaagggaucaacguggaagcggucaagucgggacauacggauuaaacacuuucaccaauauggaagcucaacugauacgacaaauggaaucagaggguauauuuagcccuucagaguuggaaacaccaaaucuagcagaaagaguucuugacugguuagagaaauauggcguggagagauuaaaacgcauggcuauuucuggcgacgauugugucguaaaaccaauagaugacagauucgcaacggcauugacggccuugaacgacaugggcaagguuaggaaagauauaccgcaaugggaacccucuaagggauggaaugauuggcaacaagucccuuucuguucccaccauuuccaucaacuaaucaugaaagaugggcgagaaauuguaguaccuugcagaaaccaagacgagcuagugggacgagcgagagugagccaaggagccggcuggucucuuagggagacugcgugucucggaaaaucauacgcucaaauguggcaauuaauguauuuucaccggagagaucuacguuuggcggccaacgcuauaugcucugcaguuccgguggauuggauuccgaccaguagaacaacuuggucaauacaugcucaucaucaguggaugacaacugaagacaugcuaagcguauggaaccggguuuggauagaagaaaacccuuggauggaagauaagacacauauauccaguuggggagacguuccuuacuuagggaaacgggaggaucaaugguguggaucgcuuauaggcuugacggcuagagcuaccugggcaacuaauauucaaguggccauaaaucaaguucggaggcucauaggaaaugaaaauuauuuagauuacaugacaucaaugaaacgauuuaaaaacgaaggcgauccggagggggccuuaugguag

SEQ ID NO: 21483 - RNA, 9879 nt, Artificial Sequence
  derived and/or modified CDS sequence (opt6) from DENV-1__EU687251__SS-prME
ucaguuaccaugcuacuuauguuaaugcccacagcauuagcauuccauuuaacaacaagaggaggugaaccucauaugaucguuuccaaacaagaaagaggaaaaucauugcuauucaaaacaucggccgguguuaauauguguacacuaaucgcuauggaucuaggggaacuaugcgaagauaccaugacauauaaaugcccaagaauaaccgaaacagaaccugacgauguugacugcugguguaaugcuaccgacacauggguuacguauggaacgugcucacaaacgggagaacaucgaagagacaaacgaaguguggcauuggcuccucacguggguuuaggguuagaaaccagaaccgaaacauggaugucuucugaaggagcauggaaacaaauucaaagaguugaaacaugggcauuacgucauccggguuuuacaguaaucgcauuauuucuugcucaugcuauagguacauccauaacucaaaaagggauaauauuuauauugcuaauguuagugacaccuucuauggcuaugcgauguguaggaauagguagcagggauuucguugaaggauuauccggggcaacuugggucgauguuguacuagaacaugggagcugcguaacaacgauggcaaaagacaaaccuacuuuagauauugaacuacuaaaaacugaagugacgaauccggcaguguuacgaaaacuuuguaucgaagcgaaaauaucaaauacuaccaccgauucaagaugcccaacucaaggagaagcgacucuuguugaagaacaagaugcaaauuuuguauguagacgcaccuucguggauagaggauggggaaacgguugcggacuauuugguaaaggaaguuugauaacaugcgcuaaauuuaaauguguuacaaaauuggaagggaaaauagugcaauacgaaaaccucaaauacucugucauuguuacuguacauacgggugaucagcaucaaguugguaacgagaguacagaacauggaacaacggcaaccaucaccccgcaggcaccgaccacagaaauucagcugacagacuauggugcucuuaccuuagauuguagccccagaacgggauuagauuuuaaugaaaugguacugcuaacuaugaaggagaaaaguuggcuaguacacaaacagugguuucuagaucuaccucuaccauggaccucuggagcaagcacgucccaagaaaccuggaaucggcaagauuuauuaguuacuuucaaaacggcacaugccaagaaacaagaagucguaguuuuagggucacaggaaggugcaaugcauacugcacuuaccggagcaacagagauucaaaccucgggaacuacaaccauauucgcuggacaccucaaaugcagguuaaaaauggacaaguugacucucaaagguaugagcuacgugauguguacgggaucauuuaaauuagagaaagaaguagcagagacgcaacacgggacgguucucguacaaauuaaauacgaagguacugacgcaccauguaagauacccuuuagcacacaggacgaaaaagggguuacgcagaacggacgauugauaacugcuaacccaauuguaacagacaaagaaaaaccagucaacauagaagccgaaccaccauuuggagaaagcuauauaaucauaggagcaggagagaaagccuuaaaacuaucuugguuuaagaaagggaguaguauaggaaaaauguuugaggccacugcuagaggugcgcggagaauggcuauuuuaggggauacagcaugggauuucgguucuauuggugguguauuuacuuccguaggaaagcuaguacaucaaaucuuuggaaccgcauacggcguucuuuucaguggaguaucuuggacaaugaaaauugggauuggaguacuauuaacaugguugggacucaacucaaggaguacgagucuuaguaugacauguauagcuguagggcugguaacuuuguauuuagguguuaugguacaggcagauucgggauguguaauuaacuggaaaggaagagaauuaaaaugcgguucaggaauauucguaacaaaugagguacacacuuggacugaacaauauaaauuucaagcagacucaccuaaacgauugucagcagcgauaggcaaggcgugggaagaaggagugugcggaauacguagcgcgacgcgacucgagaacauuauguggaaacagauaucuaaugagcugaaccauauacuacuugaaaaugauaugaaauuuacagugguugugggagauguggcagguauacucgcacagggcaagaaaaugauucggccccaaccuauggaauauaaauacucauggaaaucauggggcaaggcuaaaauaauuggcgcagauguccaaaauacgaccuucaucauugauggucccaacacccccgagugcccugacgaccaacgagcuuggaauauaugggaaguugaagacuauggauucgguauauuuacaacaaauauuugguuaaaauugcgcgacucacauacccaagugugcgaccaucgcuugaugucagccgcgauaaaagauaguaaggccgugcaugcggauaugggauacuggaucgaaucagagaaaaaugagacauggaaguuggcacgagccagcuucauugaaguaaagacauguauuuggccgaagucucacacacuauggucaaacggggucuuagaaucagagaugauuauucccaaaauauauggaggaccaauaucccaacacaacuaucgcccuggguauuuuacucaaacagcaggaccauggcaccuaggcaaauuggaacuugauuuugaucuuugcgaaggaacaacaguagucguugaugaacauuguggaaaccguggaccaagccuuagaacaacgacggucacuggaaaaaucauacaugaauggugcugccgaagcugcacccucccuccauugagauuucgaggagaagauggguguugguauggaauggaaauuagacccguaaaggaaaaagaagaaaaucuaguaaaaucaaugguuucggcuggaaguggggagguugauucuuucucccuuggccuccuaugcauaucaauaaugaucgaagaaguaaugagaucaagauggucaagaaagaugcucaugacuggaacauuggcagucuucuucuuauuaauuaugggacaauugacguggaaugaucucauacgacucuguauuauggucggagcaaacgcuucagauagaauggguaugggcacuaccuaucuugcauuaauggcuaccuuuaaaaugaggccaauguucgccguaggccuguuauuucgacgauuaacaagccgagaaguccuacuguuaacaauaggacugucauuaguagcauccguagaauuaccaaauucucucgaagaacugggugauggauuagccaugggcauaaugauccuaaaacuguugacagacuuccaaucacaucaacucugggccacauuauuauccuuaacuuuuauuaagacgaccuuuaguuuacacuaugcauggaaaacaauggcuauggugcugagcaucgugucgcuauuuccuuugugccuaaguacaacaucccaaaagacaacaugguuaccaguucuauuaggaucacuugguuguaaaccauuaaccauguucuugauugcagaaaauaaaauauggggaagacgauccuggccacuaaacgaaggaauaauggccguuggcauaguuagcauucuauuaagcucacuacuaaagaaugacguuccuuuagccgggccuuuaauugcuggaggaauguuaauugcguguuacguaauaagugguucaucagcggacuuaucauuggagaaagcagcugaagugucgugggaagaagaagccgagcauucgggggccucgcauaacaucuuggucgaaguucaagaugacggcacaaugaaaaucaaagaugaagagagggacgacaccuuaacuauccuacuaaaagcaacgcuacuagcgguuagugguguauacccuuuauccauucccgcaacccuuuuugucugguacuucuggcaaaagaaaaagcaacggucggguguucuaugggacacaccuucuccaccggaaguggaaagggcgguccuugaugacggcauauacagaauaaugcaaagaggauuacuaggacgaucucagguggggguuggaguauuccaagaaaacgucuuucauaccauguggcaugucacaagaggcgcuguucucauguaccaggguaagcgauuagaaccaucgugggcgaguguaaagaaggaucuuaucaguuacgguggagguuggcggcuacagggaagcuggaauacuggugaagagguccaaguaauugcaguugaaccagggaaaaacccgaagaauguacaaacggccccagguaccuuuaaaaccccugaaggagaaguaggcgcaaucgcguuggacuuuaaaccugguaccaguggaucuccuauaguuaauagagaagguaaaauugucggacuuuauggaaacggcgugguaaccacuucaggaacguauguaagugcaaucgcucaagcuaaggcaucacaagaggguccucugccugaaauagaagaugaaguauuuagaaaaagaaaccuuacaauaauggacuuacacccgggcucaggcaaaacaaggagauaccucccagcgaucguacgagaagcaauuaagcgaaaguuacgaacauuaauacuugccccaacucgaguagucgcuagugaaauggcagaagcgcuuaaggggaugcccauaagauaucaaacgaccgcuguaaagucagaacauacuggcaaagaaauaguagaccugaugugccacgcaacauucacaaugcgauuacuuaguccaguccgcguaccaaacuacaauaugauaauaauggacgaggcacacuucaccgauccuucaaguauagcagcaagagguuauauaucaacaagaguagggaugggugaagcagcugcgauuuucaugaccgcgacaccacccggcuccguagaggcuuucccucagaguaaugcuguuauucaagacgaagaaagagacauaccagaacgaagcuggaacucaggauaugaguggauuacugacuuucccggaaaaacuguuugguucgucccaaguauaaaaucagguaaugauauagcgaacuguuugcguaagaaugguaaacgagucauacaguugucucgcaaaaccuuugacacugaauaucagaaaacuaaaaauaacgauugggauuacguuguaacuacugacauaucugagaugggagcaaauuuuagagcggaucgaguaauagaucccagaaggugcuuaaaaccugugauauugaaggacgggccggaaagaguaauauuagccggacccaugccgguaacaguugcaucugccgcacaaagaagagguagaaucgggaggaaucacaauaaagagggugaccaauauauauauaugggccaaccccuaaauaacgaugaggaucacgcucauuggacagaggccaaaaugcuacuggauaacauaaauacaccggagggaauuauaccagcguuauuugaaccagagagggaaaaaucagcugcuauagauggggaauacagacuaagaggugaagccaggaagacauuuguagaauugaugagaagaggugaccucccaguguggcucucauauaaaguagcuucagagggguuucaauacucagacaggcgaugguguuuugauggugagaggaauaaucagguacuagaagaaaauauggauguugaaaucuggacgaaagaaggcgaaaggaagaaacugaggccgagauggcuugaugcacggacguacagugauccacuugccuugcgagaauuuaaagaguucgcggcaggaagaaggucugucucaggagacuuaauccucgaaauuggaaaacuaccccagcauuugacucagagagcucaaaaugccuuagauaauuugguaaugcuucauaauagugaacaaggagguagggcuuaccgacaugcuauggaagaacuaccagauacaauagaaaccuugauguuacuggcguugauugccguauugacaggugguguuacguuauucuuucuauccggucgaggccuaggcaaaacauccauugggcuguuaugcgugauggcuaguaguguauuacuguggauggcaucuguugaaccccauuggaucgcggcuuccauaauuuuagaguuuuucuuaaugguacuuuuaauaccagagccugacaggcaaagaacgccucaagacaaucagcuugcauaugucguuauaggauuguuauucaugauucucacugucgcagcgaaugaaaugggacuguuagagacuacuaagaaagaucuaggaauugggcaugucgccgucgaaaaccaccaccaugcagcuaugcuugauguagaccuucauccagcaucugcuuggacgcucuaugcagucgccacuacaaucaucacaccuaugaugcgacauaccauagagaauacaaccgcgaacaucucccuaacugcaauagcuaaucaagcagcaauucucaugggauuagauaaaggauggccgauuagcaaaauggauaucggcguuccgcuauuagcacuaggaugcuacucacaaguaaacccauugacacuuacugcagcuguacuaauguuagucgcucauuacgcuauuauaggaccaggacugcaagcgaaagcaacaagggaagcacaaaaacgaacagcugcuggaauuaugaaaaauccaaccguagacggaauuguagccauugauuuggacccaguaguauaugacgcuaaauuugagaaacaacucggccaaauaauguuauuaaucuuguguaccagccagauacuuuugaugcguaccacuugggcuuugugugaaaguauaacacuagcuacaggaccacuaacaacgcuaugggagggcagcccgggaaaauuuuggaauacaaccauagcugucucuauggcaaauauuuucagaggguccuauuuagccggagcuggacuugcauucucuuuaaugaaaucacuaggcgguggaagacgugggacaggagcacagggcgaaacgcuaggcgagaaauggaagcgacaauugaaucaacuuaguaagagcgaauuuaacacauauaaaaggucagggauaauggaagucgauagaucagaggccaaagagggccucaaaagaggagagaccacaaaacaugcagugucaagaggcacugcuaaauuaagaugguuuguagaaagaaacuugguaaaaccugaaggcaaaguaauagaucuggggugcggccguggaggaugguccuauuauugcgcugguuugaagaaaguaaccgaagugaaagguuauaccaagggagguccgggucaugaggagccaauaccaauggcaaccuacggguggaauuuaguaaagcuacauucuggaaaggaugucuucuuuauacccccugagaaaugugacacguuacuuugcgacauuggcgaaaguucuccuaauccgaccauagaagaaggacgaacacuaagagucuugaaaaugguagaaccguggcuaaggggaaaccaguuuugcauuaaaauucucaacccauauaugccaagugucgucgaaacccucgagcaaaugcagcggaaacacggagguauguuaguucgcaauccuuuaagucgaaauaguacucaugaaauguauuggguaucaugcggcacuggaaacauagucucagcaguaaauaugacaaguagaaugcuacugaacagguuuacuauggcucauaggaaaccaacguaugaacgugacguugauuuaggcgcaggaacacgacaugucgcuguagagccagaaguugcgaaucuagauaucaucgggcaacguauagaaaauaucaaacacgagcauaagucuacauggcauuaugaugaagauaauccuuacaagacuugggcguaucauggaagcuaugaaguuaaaccgucgggcagugcaucuucaauggucaacgguguaguaaaacuucuaacaaaaccuugggauguaaucccaauggugacccagaucgcgaugacagacaccacacccuucggacaacaaagaguuuucaaggaaaagguggauacgagaacaccuaaggcaaaacgagguacggcccagaucauggaaguaacugcaaaguggcuuugggguuucuugagucgaaacaagaaaccuagaaucuguacacgagaagaguuuacaagaaaagugcguaguaaugccgcaauuggcgcaguguuuguugacgaaaaucaauggaauagugcuaaggaagcuguugaagaugagcgguuuugggauuuggugcaccgugagagagaguuacauaagcaagggaaaugugcaacaugcguauauaauaugaugggaaagagagaaaagaagcuaggcgaauuuggaaaagcaaaagggucccgugcuaucugguacauguggcugggagcaagauuccuugaguuugaagcucuagguuucaugaaugaggaucauugguucucucgagaaaacagccuuaguggaguagaaggagaagguuuacauaaauuaggauacauucuucgagacaucaguaaaauaccgggugguaacauguaugcggaugauaccgcgggaugggacacaagaauaaccgaagacgaucuucaaaaugaagcaaggaucacggacauuauggaaccugaacaugcacuauuggcgaaaagcauauucaaacuuacuuaucaaaacaaaguugugagaguacagaggccggcaaagaauggcacuguuauggauguuauuucaaggagagaucagcguggcagcggccaagucggcacauacggcuuaaacacauuuacuaacauggaagcucaauuaauaagacaaauggagucagaaggcauauucagcccaagcgaauuggaaacuccaaaccuugcagaaagaguacuagacuggcucaagaaauauggcguggaaagauuaaaaagaauggcaauaucaggggaugauuguguuguaaagcccauagacgaccgauuugcuacagcgcucacagcacuaaaugacauggguaaaguaagaaaagacauaccccagugggagccaaguaagggguggaacgacuggcagcaaguaccguuuugcagccaucacuuccaccaacugaucaugaaagacggaagggaaauaguuguaccaugucgaaaucaagaugagcuuguaggcagggcaagagucagccagggugcuggauggaguuuacgagaaacagcuugucuuggaaaaaguuaugcacagauguggcaauuaauguauuuucauagaagggaucuaagauuagcugcgaacgcaauuuguucggcuguaccgguggauuggauacccaccagccgaacgacuugguccauucaugcacaccaccaauggaugacuacugaagauauguuauccguauggaauaggguguggauagaagaaaacccauggauggaagacaaaacucauaucaguuccuggggugauguaccguaccuaggaaagcgggaggaucaauggugcgguagucuaauuggguuaacagcacgggccacgugggcaaccaacauucagguugcaauuaaucagguccgucgacuuauugggaacgagaacuacuuggauuacaugacaucaaugaagagguuuaaaaacgagagugauccggaaggcgcacuaugguaa

SEQ ID NO: 21484 - RNA, 9879 nt, Artificial Sequence
  derived and/or modified CDS sequence (opt6) from DENV-1__FJ024427__SS-prME
uccguuaccauguuacuaauguuaaugccaaccgcucuugcauuucauuuaaccacaagaggcggcgaaccacauaugauuguuucgaaacaagaacgcggaaaaucgcuuuuguuuaaaacgagugcaggggugaacauguguacucucauagcgauggauuugggugaacuuugcgaagauacgaugacauauaaaugucccagaauuaccgaaacagaaccggaugacgucgauuguugguguaaugcaacugacacaugggucaccuacgguaccuguagucaaacuggagagcaccgcagagacaaaagauccguagcauuagcaccacauguugguuuaggacuugagacaaggaccgagaccuggaugucgucagaaggggcuuggaaacagauccagcggguugaaacgugggcauuacgacaucccggauuuacuguaauugcucuguuucuggcacaugcaaucggaaccucaauaacgcagaaaggaauaaucuuuauacuguuaaugcuaguaacacccaguauggcgaugcgaugcguaggcauuggaagucgggacuuuguugaaggucuaucgggggcgacguggguggaugugguacuagaacaugguucauguguuacaacuauggcaaaagacaaaccaacucuagauaucgagcuccugaaaacugaaguaacaaauccagcagugcuaagaaaacuuuguauagaggcaaaaauaucaaacacaacaaccgauuccagauguccgacacaaggcgaggcuacccugguugaagaacaagaugcaaauuuuguguguagaagaacauuuguugauagggguuggggcaacggauguggacuuuuugggaaaggaagucuaauuacuugugcaaaauucaaaugugucacaaaacuagaaggcaaaauaguacaauacgagaaccuaaaauacagcguaauugugacagugcacacaggagaccaacaucaagugggaaaugaaucuacugaacacgguacaacagcgacaauaacaccccaagcacccaccacagaaauccaauuaacaggguauggggcacuaacguuggauuguucuccccguaccggucuggauuucaacgagaugguauugcuaaccaugaaagaaaaauccugguuaguucacaaacaaugguuucucgauuuaccacucccauggacaaguggcgcaaguacaucacaagaaacuuggaaucgacaagaccuauuaguuaccuuuaaaacagcccacgcuaagaaacaagagguaguaguuuuagggucucaggagggagccaugcauacagcacuuacuggggccacagaaauacaaacaucagguacaacuacaauauucgcagggcaccucaaaugucgguuaaaaauggauaaauuaacucuaaaaggcaugagcuacguuauguguaccggaucauucaaauuagaaaaagaaguugcagaaacucaacacggaaccguuuuaguacaaauuaaguaugaaggagccgacgcuccauguaaaauacccuucaguacgcaagacgaaaagggaauaacacagaacggccgacuuauaacugccaaucccaucguaacagacaaagagaagccuguuaacaucgaggccgaacccccguuuggugaaaguuauauagugauaggcgcuggagaaaaagcgcuaaagcuaucaugguuuaagaagggaaguucuauaggaaaaauguuugaagcgacggcccgaggagccaggcgaauggccauccuaggagauaccgcaugggauuucgguucgauaggaggaguauucacaagcguagguaaguuagugcaucaaauauuugguacugcuuauggcguuuuauuuucaggagucucauggacaaugaaaauugguauagguguuuuguuaacaugguugggacucaauagcagaagcacaucuuuaucgaugacuugcaucgcgguuggauugguaacgcuuuaucuugguguuaugguucaagccgacaguggcugugucauuaauuggaaaggaagggaacugaaauguggaagcggaauauucguuaccaacgaaguacacacguggacagaacaauacaaauuucaagcagauucaccaaaacgacuaucagccgccauagguaaggcuugggaagaaggagucugcgguaucagaagugcaacuagacuagaaaauauaauguggaaacaaauaaguaacgaguuaaaucauauucuauuagagaacgauaugaaguucacuguggucguaggcgaugucgcuggaauauuggcccaagguaaaaagaugauacgcccacaaccaauggaauauaaguauuccuggaaaucauggggcaaagcgaaaauaauaggagcggauguucagaauaccacguucauuauugacggaccaaauaccccugaaugcccagacgaucagagagcauggaauauuugggaaguugaagauuacgguuuuggaauauuuacgacuaacauuuggcuaaaacuaagagauagcuauacacagguuugugaucaucgauuaaugagugcagcuauuaaagauucuaaagccguacaugcagauaugggcuacuggauagaaucugagaaaaacgaaacuuggaaguuggcuagggccaguuuuauagaaguuaaaacaugcauuuggccaaaaucacacacauuauggagcaacggcguuuuggagucugaaaugauaauaccaaagauauauggagguccuauuucacaacauaauuaccgacccgguuauuucacgcaaacggcaggaccguggcaucuugggaaauuggaacuugauuucgaccuaugugagggaacgacuguuguuguggaugagcauugcggaaacagaggacccucauugaggacgacuacggucacaggaaaaauaauucacgaaugguguugcagaucauguacucuaccaccacuacgauucagaggggaagaugguuguugguacggcauggaaauacgacccguuaaagaaaaggaagagaauuuaguuaagucuauggucucagcgggaaguggagaaguagacaguuucucauuaggauuacuguguauuuccauuaugauagaagaaguaaugagaucacgguggucaagaaaaauguugaugacaggaacauuagccguauucuuucuucugauaaugggacaacuaacauggaacgaucuaauccgucuauguauaaugguuggagcuaaugcgagugauagaaugggaauggguaccacguaucuagcuuuaauggcuacauuuaaaaugcgaccuauguucgcaguagggcuauuguuuagaagacucacaagccgagaaguacuacuuuugacgauagggcucucuuugguugcuagugucgaacugccaaacucauuggaagaauuaggagacgggcucgcuaugggaauaaugauucuaaaacuauuaaccgauuuucaaucgcaucaacucugggcgacucucuuaagccuaaccuuuauuaaaacaacuuuuagccuacacuacgcauggaaaacaauggcuaugguccuuaguaucguaagucuauuuccacuaugucucucuacaacaagucagaaaacuacauggcuaccugugcucuuagguagcuuagggugcaaaccacucacaauguuuuuaaucgcagagaauaaaauuuggggaagaaggaguuggccguuaaacgagggaauuauggccguuggaauuguaaguauacuucugagcucuuuacucaaaaaugaugugccuuuagcaggaccauuaauagcggguggaauguuaauagcauguuacgucaucagcggaucaucagccgaucuaagucuagaaaaggcugccgaagugaguugggaagaagaggcagaacacucgggugcuucccauaauauacucguggaaguucaagacgacggaacaaugaaaauaaaagaugaagagagagaugauacguuaacuauuuuauugaaagcuacccuguuagcaguaucagguguauauccacucucuauuccagcuacacuauucguuugguauuucuggcaaaagaagaagcaaagaaguggagugcucugggacaccccaagcccaccggaaguagagcgugcagucuuagacgauggcaucuauaggauaaugcaaaggggcuuauuaggaaggucucaggucggagucggaguauuucaagagaauguguuucauacaauguggcacguaacaaggggcgccgucuuaauguaucaaggaaagaggcuugaaccuucgugggcuucuguaaagaaggaucugauaucuuacggugguggauggagauuacagggcucuuggaacacuggcgaggaaguucaaguuauagcagucgaacccggcaaaaacccaaagaauguucagaccgcaccugguacguuuaagacgccugaaggcgaaguuggagcuauagcauuagauuuuaagccaggaacuucagggaguccaauaguaaaucgcgagggaaaaaucguaggccuauacgggaaugguguagugacuacuagcggaacguauguaagugcuauagcgcaggcuaaggcuucucaggaagguccucuuccggaaauagaggacgaaguauuuagaaagcgaaaccuaaccauaauggaccuacacccugguaguggaaaaacacgcagauaccuccccgcgaucguacgugaggcaauaaaacgaaaauuaagaacccuuauauuagcucccacuagaguaguagcuagcgaaauggcagaagcucuaaaagggaugccaauaagauaucaaacuacugcggugaaaucagaacacacagguaaggaaauaguugauuuaaugugccacgcgaccuucacgaugcgacuacuuucaccaguaagagugccaaacuauaauaugauaauuauggaugaagcucacuuuacagauccaucaucgauugcugcgcggggauauauuucaacaagaguagguaugggagaagcggcagcgaucuuuaugaccgcaacgcccccaggaaguguggaggcguucccacagucuaaugcgguuauacaagacgaagaaagagauauuccagagcguaguuggaauaguggcuaugaauggauaacugacuuuccuggcaaaacgguaugguuugucccuuccauuaaaucuggcaaugacauagcaaacugucuuaggaaaaaugggaagcgugucauucagcuaucacgcaagacuuucgacacugaguaucaaaagacuaagaauaaugauugggacuacguugucaccacggauauaucagaaaugggcgcaaacuuuagagccgauagaguaaucgauccucggagaugccuuaaaccagugauacugaaagacggucccgaaaggguuauuuuagcgggaccaaugccggugacaguagcaucugcugcacaaaggagaggacguauaggaagaaaccacaauaaagaaggcgaccaguauauuuauaugggacaaccucuaaacaacgaugaagaucaugcacauuggacagaggcuaaaaugcuauuagauaauauaaauacacccgagggaauaauaccugcuuuguucgagcccgaacgugagaaaagugccgcaauugacggugaguaucgccugcguggagaggcgaggaagacauuuguagaauugaugaggagaggggauuuaccagucuggcuaagcuacaaaguagccagugagggauuccaauauucagacaggcguugguguuuugauggagaacggaacaaucaaguacuagaagaaaauauggauguugagaucuggacaaaagaaggugaaagaaagaagcuacguccuagaugguuagaugcuagaacauacagcgauccucucgcauuacgugaauuuaaagaauuugcagcgggaagacgcagugucuccggagaucucaucuuggagaucggcaagcucccucaacacuuaacucaacgcgcacaaaaugccuuggauaacuuaguaaugcuucacaacagcgagcaaggggguagagcauauaggcaugcuauggaggaacuacccgacacaauugaaacccucauguuauuagcacuaaucgcaguauuaaccgggggaguuacguuauucuuuuugucuggacguggauugggaaagacuuccauuggacucuuguguguuauggcuagcaguguucuucuguggauggcuaguguugagccacacuggauagcugcaaguauaauauuggaguucuucuugaugguauuguuaauaccagaaccagacagacaacgaacgccccaagacaaccaauuagcguaugugguuaucggguuauuauuuaugauauugacagucgccgcgaaugaaaugggacuucuugaaacuacuaagaaagaucucgggauuggacacguugcaguagagaaccaccaccaugccgccaugcuagaugucgaucuucauccagcauccgccuggacacuuuacgcagucgcuacuacaauuauaacaccuaugaugcgacacacaauagaaaauacaacagcgaauauaucacucacagcuauagcgaaucaagccgcaauacugaugggacuagauaaagguuggccaauaucuaaaauggacaucggaguaccguuauuagcuuuaggaugcuauucccaagucaacccacuaacacugaccgccgcaguauuaaugcuaguugcucauuaugcaauuaucggccccggguugcaagcaaaggcgacgcgugaagcacagaaacgaacagcagccggaauaaugaagaauccgacaguggaugguauugucgcuauagauuuagauccuguuguauaugacgccaaauuugagaaacaguuaggucagauaaugcuauugauacuauguacgagccagauccuguuaaugcgaacaacaugggcgcuuugugaaaguauaacgcuagccacuggcccauuaacaacuuugugggaaggcagcccugggaaauucuggaacacaacgauagcaguaaguauggcgaauauauuucgaggaucguaucucgcuggugcuggucucgcauuuagcuuaaugaagucuuuaggaggaggacggcgcggaacaggagcccaaggugagacacuaggugaaaaguggaaacgacagcuuaaucaacuaagcaaguccgaauuuaacacuuacaaacgcucuggaauaauggaaguagaucggucagaggcaaaagaagguuugaagagaggggagacuacuaaacacgccguuucuaggggaacagccaagcucaggugguucgucgaaagaaaucuaguaaaaccugaaggaaagguuauugaucuaggaugugguaggggaggauggucguauuauugugcagguuuaaagaaagucaccgaagucaaagguuauacaaaagguggaccaggacaugaagaaccuauaccaauggcgaccuaugguuggaauuuagucaaacugcacuccggaaaagacguauucuuuauaccacccgaaaagugcgauacacugcugugcgauauuggagaaaguucuccuaauccuacuauagaagaaggaagaacacuaagaguacucaagaugguugaaccauggcuuagagguaaccaauuuugcauaaaaauacuuaauccuuacaugccuagcgugguugaaacauuagagcagaugcaaaggaagcauggugguaugcuuguuaggaaccccuuaucucgaaauagcacacacgagauguauuggguaagcugcgguaccgggaacauaguaagugcgguaaauaugacaucacgaauguuacuaaauagguuuacaauggcacacaggaaaccgacuuacgaaagagacguugaucuuggggcaggaacucgucaugucgcuguugaaccagagguugcaaauuuggacauuauagggcagcgaaucgaaaacaucaaacaugagcauaagucaacauggcauuacgacgaagauaacccauacaaaaccugggcuuaccauggaucguaugaaguuaaaccaucagguagugcgucaucuaugguaaaugggguuguaaaacugcucaccaaacccugggaugugauucccaugguaacgcaaauugcaaugacggacacaacgcccuuugggcagcaacgaguauuuaaagagaaggucgauacccgaacuccuaaggcaaaacgagggacagcacaaauaauggaagugacagcgaaaugguugugggguuuucugucaaggaauaagaaacccagaauaugcacaagagaggaauuuacgcggaaagugcggagcaaugccgcaaucggggccguauucguagacgaaaaucaauggaacucagcaaaagaagcggucgaggacgaaagauuuugggaucuuguacacagagaaagagaauuacacaaacaaggcaaaugugccacauguguguacaacaugauggguaaaagagagaagaaacugggugaauuugggaaagccaaggguucacgagccauuugguauauguggcuaggcgcccguuuucuagaauuugaagcguuaggauucaugaaugaagaccacugguucaacagagaaaauucucuaagcggaguagaaggggagggacuucacaaauuaggguauauuuuaagagauauuaguaaaauacccggcgguaacauguaugcugacgacaccgcggguugggacacucgaauuacagaagaugaccuucagaacgaagcuagaaucacugauauaauggagccugaacacgcauuacuugcucgaucgaucuuuaaacuaaccuaucaaaacaaaguaguaagaguucaaagacccgccaaaaauggaaccgucauggauguuauuagucgcagggaucaacggggaagcggacaagucgggacuuaugguuuaaacaccuucacuaauauggaggcucaacuaauccgacagauggagagcgaaggcauauuuucaccauccgaguuagaaacgccaaaucuagcagagagagugcuagauugguuggaaaaauauggcguugaacgacuaaaacgcauggcaaucagcggcgacgauugugugguaaaaccuauagaugacagguuugcaaccgcauugacggcacuaaaugauaugggaaagguaaggaaagauaucccacaaugggaaccaagcaaaggauggaaugauuggcaacaagucccauucuguagccaucauuuucaucagcucauaaugaaggaugguagagaaauaguaguaccaugccgaaaucaagaugaguugguaggcagagcaagaguaagucaaggggcugguuggucacuacgagagacagcaugccuuggaaagucauaugcacaaauguggcaacuaauguauuuucacaggcgggaccugcgacuagcagcaaacgccaucugcucagcaguaccugucgacuggaucccaacuagcaggacaacauggagcauacaugcccaccaucaauggaugacaacugaagauaugcucucgguauggaaucguguauggauagaggagaauccuuggauggaggauaaaacacacauaagcucuuggggagacguaccguauuuagguaaaagagaagaccaauggugugggaguuuaauuggucucacugcgagagcaacaugggcaacaaauauacaaguagcgaucaaucaagugagacgacuuaucggcaaugaaaauuacuuagacuauaugacaagcaugaaacgguuuaaaaacgaaucagacccugaaggugcguuaugguaa

SEQ ID NO: 21485 - RNA, 9879 nt, Artificial Sequence
  derived and/or modified CDS sequence (opt6) from DENV-1__FJ024428__SS-prME
aguguaacuaugcuccucauguuaaugccaacugcucuggcguuucauuuaacuacaagggguggugaaccacacaugauuguaaguaaacaagaaagggguaaaagucuauuguuuaaaacuuccgccgggguaaauauguguacucuaauagcuauggaucugggcgaauuaugcgaagauacaaugaccuauaaaugcccuagaaucacggaaacagagccagacgauguggacuguuggugcaacgcaacagauacauggguuacuuaugguacuuguucacagacaggugaacacagaagggauaaaaggaguguugcucuggcaccgcauguagguuugggacucgaaacgcgcacugagacuuggaugucauccgagggugccuggaaacagauccaaagaguagaaacaugggcauuaagacauccugguuuuacaguuacugcacucuucuuagcgcacgcgaucggaacaucaaucacacagaaaggaauuauauuuauucuauuaaugcucguaacucccaguauggccaugagaugcgucggaauaggaaguagagacuucgucgagggacuuucgggggcaaccuggguagacguaguguuagagcauggaucaugugugacaacuauggcaaaagauaaaccgacccuagauauagaguuacuuaaaacugaaguaacgaauccggcuguguuaagaaaacuauguauagaagcaaaaauaagcaacaccacuacagauagcagaugcccgacucaaggugaagcuacguuaguagaagaacaagacgcaaauuuuguaugcagacguacuuuuguagaucgaggcuggggaaauggguguggauuguucgguaaaggaucucugauaaccugugcuaaauucaaaugugugacaaaacuagaaggaaaaauuguccaauacgaaaaucugaaauauucugugauagugacuguccacacaggcgaccaacaucaaguaggcaacgaaucaacggagcauggaaccacagcaacaauaacgccacaggccccgacaacagaaauccaacuaacagacuacggagcauugacccucgacuguucuccgcgaacaggccuagacuucaaugagaugguccuauugacaaugaaagagaaaaguugguuaguacauaaacaaugguuuuuagaccugccucuuccauggaccucuggugcauccacaucccaagaaacauggaaccgccaagaccuauuaguaacuuuuaaaacagcccacgcgaagaaacaggaagucguaguucuaggaagucaagaaggagcaaugcauacagcauuaacgggagccacagaaauacagacaagcggaaccacgacaauauuugcaggacaucuaaaaugcagauuaaaaauggacaaauuaacucuaaaaggcaugucuuaugucauguguaccggcucauuuaaacuagagaaggagcuagcagagacgcagcacggaacuguuuuaguacagauaaaauacgaaggaacagaugcaccgugcaaaaucccauuuucaacgcaggaugaaaaaggugucacacaaaacgguagguuaauaacagcuaaucccauuguaacugauaaggaaaaaccuguuaauauagaagcggaaccgccauuuggugaaaguuauauagucaucggagcuggcgagaaggcgcuaaaacugagcugguuuaagaaaggcaguucaauaggcaagauguucgaagcgacagccagaggagcaagacguauggccaucuuaggagacaccgccugggacuucggaucaauagguggaguauuuaccuccguaggaaaauuaguacaucaaauuuucggcaccgcauauggaguauuguucucaggaguuucguggaccaugaaaauagggauuggugucuuacugacuuggcuugguuugaacucacguucuacuagccugucaaugaccugcauagcaguaggauugguuaccuuauaucuuggagugauggugcaagcugauagcgggugcguaauuaacuggaagggucgagaauuaaaaugcggaagcggcauauuuguaacaaaugaaguucauacauggacagaacaguauaaauuccaagcagauagucccaaaaggcuaagugcugcuaucgggaaagcgugggaagaagggguuugcgguauaagaucagcaacgcgucuagaaaauauaauguggaaacaaauaucaaaugaacuaaaccacauuuuguuggagaaugacaugaaauuuacgguaguaguuggagacguagcggggauauuagcacaggguaagaaaaugaucagaccucagccuauggaacacaaguacuccuggaaaucguggggaaaagcaaaaauuauaggagcagaugugcaaaacaccaccuucaucauagauggccccaacacgccagagugcccugaugaccagagagcauggaacauuugggaaguagaagacuaugguuuugguauuuuuacuaccaauauauggcucaagcuaagagauuccuauacacagguuugcgaucaccgucugaugucagcggcuauuaaagauaguaaagccguccaugcagauaugggauauuggaucgaaucggagaaaaaugaaacguggaagcuggcacgagcaaguuuuauagaaguaaaaacaugcauuuggccaaaaagucauacguuauggagcaauggugucuuggaaagugaaaugauaauaccuaagaucuacggaggacccauuucucaacauaacuaccgcccaggauacuuuacccagacggcgggcccuuggcaccuaggaaaacuugaacuugacuucgacuuaugcgaaggaacgacaguaguaguugaugaacacugcggaaaccgaggucccagcuuacgaacaacaacaguaacaggaaaaaucauacaugagugguguugucguagcugcacccuaccaccauuaagguucaggggugaagacgguuguugguaugguauggagauaagaccugucaaagaaaaagaagaaaauuuaguaaagagcaugguuagcgccgguagcggggaaguugauucauuuucuuuaggccugcucuguauaaguauaaugaucgaggaagugaugaggucaagauggucgcguaaaaugcuaaugacgggaacgcuagcugucuucuucuuacucaucgugggacaacuuacauggaaugaucucauacgucuaugcauaaugguaggcgccaaugcuucagaucgaaugggaaugggaacgacguauuuagcacucauggcaacguucaaaaugcgacccauguuugcggucggauuauuguuuagaagauuaacaaguagagaaguacuauuacuaacaauuggauugucauuaguagcaucgguagaauuaccgaacaguuuagaagaguuaggggacgguuuagcgaugggcaucaugauuuuaaaauuacuuacugauuuucagucucaccaguuaugggcaacauuacucagucugacuuucauuaaaaccacuuuuagccuucauuacgcuuggaaaacaauggccaugguacucaguguagucagccuauuucccuugugucucagcacaacaucccaaaagacaacuugguuaccagucuuacuagguucacugggaugcaaaccauuaacgauguuccucaucgccgaaaauaaaauuugggggaggagauccuggccccucaaugaagggauuauggcaguaggcauaguaucuauuuuacuaucaagucuacugaaaaacgaugucccacuagcaggaccucucaucgcaggcggcauguuaaucgcauguuacguaauuaguggauccagugcggacuuaaguuuagagaaggccgccgaagucagcugggaggaggaagcugagcauucaggugcuagucacaacauccuaguagaaguacaagaugaugguacuaugaagauaaaagaugaagaaagagaugauacccuaacaauacuacuuaaagccacucuucuagcagugucuggagucuacccccuuagcauaccggcgacauuauuugucugguacuuuuggcagaagaagaaacaaaggucaggaguuuuaugggauacaccuucacccccagaaguagaacgagcgguccuugaugacggcaucuaucguauaaugcaaagagggcuauuggggagaucgcaagugggcguugguguuuuccaagagaauguauuucauacaauguggcacguuacucgaggagcaguauuaauguaccaagggaagagacuugagccaagcugggcuucaguuaagaaagaucugauuucauacggaggcggauggcgauugcagggaaguuggaacacuggugaagagguucaggugauagccgucgaaccagguaagaauccgaaaaacguucagaccgccccuggaaccuucaagacuccugaaggcgaggugggagcaauagcauuagauuucaaaccugguacgaguggguccccaauagucaaucgagagggcaaaauagucggauuauauggaaauggcguagucacgacaaguggcacuuauguaagcgcuauagcacaagcaaaggcuucacaggaggguccauuaccugagauagaagacgaaguauuucgaaaaagaaaucuaaccauaauggaccuucauccaggguccggcaaaacuagaagguacuuaccugcgauuguucgagaagcaaucaagcguaaauugagaacacugauuuuagcaccaacuaggguuguagccagugaaauggcggaagcacucaaagguaugccuauacgauaccaaacuacagcgguaaagucagagcauacugguaaggaaaucguggaucucaugugucaugcaacauucacaaugagacuauuguccccaguacgaguaccaaauuauaauaugauaauuauggaugaagcccauuuuacagaucccucaaguauagcugcucgaggauacauaaguacaagagucggcaugggcgaagcagcagcuauauuuaugacggccacaccaccaggaucaguugaagccuuuccucagucuaaugcugucauccaggacgaagagagggacaucccugaaagaucauggaacucgggauaugaguggauaacagauuucccuggaaagacaguaugguucgugcccagcauaaaaagcggaaaugauauagcaaacugucuuagaaagaacgguaaaagaguuauccaauuaucucggaaaaccuucgacacagaauaucagaaaacuaaaaacaacgauugggauuauguaguaacuacagauauuucagaaaugggggcgaacuuuagagcagaucgaguaauagauccaagacgcugucuuaaaccuguaauccuaaaggauggccccgaacguguuauucuagcaggacccaugccagugacaguagccucugcugcgcaacgaagagggcgcauaggcagaaaucauaacaaggaaggggaccaguauauuuacaugggacagccacucaauaacgacgaagaucacgcucauuggaccgaagcuaaaaugcuacuagacaacauaaacaccccagaaggaauuauaccggcacuuuucgagccugaacgagaaaagucggcugcaauagacggugaauauagacuuagaggagaagcuagaaagacuuuuguugagcuaaugagaagaggugaucuaccuguaugguuaaguuacaagguggcaucagaaggguuccaguacagcgauagaagauggugcuuugauggagagagaaauaaucagguacuagaagaaaauauggauguagagauauggacgaaagaaggcgaacggaagaagcuaagaccccguugguuagaugcaaggacguacucagacccguuagcguuaagggaauuuaaagaauuugcugcugguagaagaaguguaaguggggaccuaauucuugagauugggaaacugccacaacauuuaacacaaagagcacaaaaugcauuagauaaucugguaauguugcauaauagugaacagggcgguagggcauauagacacgccauggaagaauuaccugacacaaucgaaacucuuauguuauuagcgcugaucgcaguacuuacuggagggguuacucuuuucuucuuaagugguagaggauuagguaaaacaucaauuggacucuuauguguaauggccucgaguguacuguuguggauggccaguguagagccucacuggauagcugcaucaaucaucuuggaguucuuucugaugguccuccuaauaccagaaccagauagacaaagaacuccacaggauaaccaacuagcuuaugugguaauaggccuucuauucaugauauuaacaguugcagcaaacgaaauggggcuauuagaaacgacaaagaaagaucuaggaauagggcauguugcaguggaaaaucaccaucaugcagcaaugcuagauguggauuugcauccagcuagugcuuggaccuuauaugcuguagcaacaacaauaauuacgccuaugaugcgacauacaauagaaaauacuacagccaauauaucacucacggcaauagcuaaucaagcugcaauucuuauggggcuagacaaaggauggccgauaaguaagauggauaucggcgugccucucuuagcuuuggggugcuauagucaagucaauccacucacucuuacagcagccgucuuaauguuaguagcacauuacgcaauaauugggccgggauuacaagcgaaagcuacaagagaggcacaaaagagaacagcugcgggaauuaugaaaaauccaacgguugauggcauuguagcgauugaccuagacccaguuguuuaugacgcuaaguucgaaaaacaauuaggacaaauaauguuacucauacugugcacuucacaaauacuguugaugagaaccacuugggcacuuugcgaauccauaacacuagcgacugggcccuugacaacauuaugggaagguucuccagguaaauuuuggaauacaacuauugcgguauccauggcuaauaucuuuagggggucguaucuagcaggagcuggacuugcguucucccuaaugaagucacuagguggcggcagacgcggaaccggcgcgcaaggugagacacuaggugaaaaguggaaaagacaacugaaucagcuaaguaaaucugaauuuaacacauacaagcgaaguggaauaauggaaguagacagaucugaagcaaaagaagggcuaaaaagaggugaaacaacuaaacaugcagugagcaggggaacagcgaaauugagaugguucgucgaaaggaaccuaguuaagccugaagguaaaguaauugacuuaggauguggacgaggaggauggucauauuauugcgcuggccuuaagaaagugacagaaguaaaaggcuauacaaaggguggaccaggacaugaagaaccgauaccuauggcaacauacgguuggaaccuaguaaaauugcacucuggaaaagauguauucuuuauaccgcccgaaaaaugugacacuuuacuaugugauauuggugaauccaguccgaauccaacaauugaagagggccguacacuuagaguccuuaagauggucgaaccgugguugcgaggcaaucaauucugcauaaaaauacuuaauccauauaugccuucugucguggaaacuuuagagcaaaugcaaagaaaacauggagguauguuaguaaggaacccucuuuccagaaauuccacccacgaaauguacugggugucaugcggaacaggaaacaucguuucagcuguuaacaugaccagucguaugcuuuuaaacagauucacuauggcacaccgaaaaccgaccuaugaaagggacguagauuugggugccggaacucgucacguggcaguugaaccagagguggcgaaucuugauauaauaggacagagaauugagaauaucaagcacgaacacaaaagcacauggcacuaugaugaagacaauccauauaaaacgugggccuaucauggaucauacgaaguaaaaccuucaggcagcgcuuccagcauggucaacgggguaguaaagcuauuaaccaaaccaugggauguaauaccgaugguaacucaaauugcuaugacagauacaaccccguucgggcaacaaagaguauuuaaagaaaaaguugauacucgcacccccaaagccaaacgagguaccgcucaaauaauggaagucacagcgaagugguuauggggguuccuaagucgaaauaaaaagccgagaauauguacaagggaagaguuuacacggaaagucagaucaaaugccgccaucggagcaguauucguagacgagaaucaauggaauagcgcaaaggaagccguagaggacgaaagauucugggaucucguacauagagaaagagaguuacacaaacagggaaagugcgcaacauguguauacaauaugaugggcaaacgcgaaaagaaacuuggagaguucggcaaggcaaaaggaucccgugcuauaugguauaugugguugggagcacgcuuccucgaauuugaagcucuugguuucaugaaugaagaucauugguucuccagagaaaauucacuuuccggaguagaaggagaaggacuacauaaacuuggauacauccuaagggauaucaguaagauacccggaggaaauauguacgcggacgauacagccggaugggacacacgaauaacagaggaugaccuucaaaacgaagcuaggauuacugauauuauggagccagaacaugcauuacuggcuaaaucaauuuucaaacugaccuaucaaaauaaaguuguaagagugcagcgcccagcaaagaauggaacuguaauggaugucaucucacgaagagaucaaagagguucagggcaaguaggcacguacggucuaaacaccuuuaccaacauggaggcccaauugauccgacaaauggaauccgaaggcauuuucucgcccagugaguuggaaacgccaaaucuagcggaacgaguacuugauuggcucgagaaauauggugucgaaagauuaaaaaggauggcaauuaguggcgaugauugugucgugaaaccaauugaugauagguuugcgacagcuuuaacagcguugaacgacaugggaaaagucagaaaggauaucccgcaaugggaaccuucuaaaggauggaaugauuggcagcaagugccauuuugcucgcaccacuuucaucaauuaauuaugaaggacgguagagagaucguaguuccgugucgaaaucaagaugaacuugugggucgggcaagaguaucacaaggcgcaggcuggagccuucgagaaacagcaugucugggcaaaucauacgcccagauguggcaacuaauguacuuucaccgcagagaucuacgauuagcagcaaaugcgauaugcagugccgugccuguagacuggauaccaacuucaaggacuacauggaguauacaugcucaccaccaguggaugacuacugaagauauguuaucuguuuggaacagaguauggaucgaagagaauccuuggauggaagauaaaacgcauauaaguucauggggagauguaccauauuuaggaaaaagggaagaucaauggugugguaguuuaaucggacucaccgcuagagcaacgugggcaaccaauauccaagucgcuauuaaucaagugagacguuuaauuggaaaugaaaacuauuuagacuacaugacaucaaugaaaagguucaagaaugagucagauccggaaggagcacuaugguag

SEQ ID NO: 21486 - RNA, 9879 nt, Artificial Sequence
  derived and/or modified CDS sequence (opt6) from DENV-1__FJ024429__SS-prME
ucagucaccauguugcuuauguuaaugccaaccgcgcuagccuuucaucuaaccacacgcgggggagaaccacauaugauugucuccaaacaggaaagagguaaaucgcuauuauuuaaaacaagugccgguguuaauaugugcacucuuaucgcaauggaucuaggugagcuuugugaagacaccaugacguacaaaugcccacguauuacugaaaccgaaccugaugacguggauugcugguguaacgcgacagauacguggguaacauauggaacaugcagccaaacgggagagcauagaagagauaaacggucagucgcacuugcgccacaugucggccuggguuuagaaacacgaaccgaaacuuggaugucgucagagggcgcauggaaacaaauacaaaggguagagacaugggcauuaagacaccccggcuuuacagucaucgccuuauucuuagcacaugcaauagguacaucaauaacccaaaaagguauaaucuucauucuauuaauguuaguaacuccuucaauggcaaugagauguguggguaucggcaguagggauuuuguagaaggucuaucaggagccacguggguugauguagugcuagagcaugggaguuguguuacaacaauggcaaaagauaaaccaacccuagacauagaauugcuaaagacagaagugacgaauccugcaguguuacguaaacuauguauagaagcaaaaauaaguaauacgacuacagacagccgauguccaacccaaggagaagcaacccucgucgaagaacaggaugcuaacuuuguuuguagaaggacauuuguggaccggggauggggaaauggaugcggacuauucggaaaaggaagucuaauuacuugugcaaaauucaagugugucaccaagcuggaaggcaaaauaguucaauaugagaaccucaaauauucugucauaguuacuguacacaccggugaccaacaccagguaggaaaugaaucuacagaacauggaacuacggcaacgauuacuccucaagccccgacaacagaaauacaauugacagauuacggugcacuuacacuagacuguucucccagaacaggcuuggauuuuaaugagauggucuuguuaaccaugaaagaaaaauccugguuaguucauaagcaaugguucuuagacuugccuuuaccguggacaucaggggcuucaacuucucaagaaacauggaaucgucaagaucuccuaguaacauucaaaacagcccacgcgaagaaacaagagguggugguauuaggaagucaagagggggcaaugcauacggcgcuaacgggggcuacugaaauacaaacauccgguacaacuaccaucuuugcaggccaccuuaaauguagguugaagauggauaaacuuacucuaaaaggaaugagcuauguuaugugcacaggcucauucaaacucgagaaagaguuagcugaaacucaacaugggacaguauugguucagaucaaauacgagggaacugaugccccuuguaagaucccuuuuaguacccaagacgagaaagguguaacucaaaaugguagacuaauuacugcaaacccuauaguuacagacaaggaaaaaccaguaaauauugaagcagaaccaccauuuggcgaauccuauauaguaaucggcgcuggagaaaaagcauuaaaacuaaguugguucaaaaagggauccaguauaggaaaaauguuugaagcaacugcacgaggugcgcgaaggauggcaauuuuaggagacacagcuugggauuuuggaucuauaggagguguauucacuucaguuggaaaauuaguccaccaaauauuugguacggccuauggaguauuauuuucaggggucucuuggacuaugaagauugguauaggggugcucaugaccuggcucggguuaaacagccgaucaacgucacuuucuaugacgugcauagcagucggccuuguaacuuuauauuuaggcgucaugguucaagcggacuccgggugugucauaaacuggaaaggcagggaauugaaguguggaaguggaauuuuuguaacuaaugaagugcacaccuggacugaacaauauaaguuccaagcagauucccccaaaagauuauccgcagcaauaggcaaagccugggaggaggguguauguggaauacgaagcgcaacuagacuagagaacauaauguggaaacaaauaagcaacgaacucaaucauauacuccuagagaaugauaugaaauuuacaguugucgugggagacguagccggaaucuuagcgcaaggcaagaaaaugauaagaccacagccuauggaacauaaauauaguuggaaaaguuggggaaaagcgaaaaucauuggugcugauguccagaacaccacauuuaucauugacggaccuaauacacccgaaugcccagaugaucaacgggccuggaauauaugggaaguagaagauuauggauuugggauauucacaacgaauaucugguugaaguugcgugauucauauacacaaguaugcgaucaucgacuaaugagugcugcaaucaaagauucaaaagcagugcaugcugauaugggguauuggaucgagagcgagaaaaacgaaacauggaaguuggcgcgagcuuccuuuauagaaguuaaaacaugcauauggccaaaaucacacacuuuauggaguaaugggguauuagagagcgaaaugauaauaccaaagauauauggagguccgauaucgcaacacaacuacagacccggguauuuuacccaaauagcagguccuuggcaucucggaaagcucgaacuagacuuugauuuaugugaaggaacaacagucgucguggaugaacauuguggaaaucgaggaccauccuuacggacgacgacagugacugggaaaauaauacaugaaugguguuguagaaguuguacgcuuccuccauuaagauuccguggagaagauggauguugguauggaauggaaauuagaccagugaaggagaaggaggaaaauuuggugaaaagcaugguuagcgccggcucaggugaaguagauuccuuuucacuagguuugcucuguauuucuaucaugauagaggaaguaaugaggucgagauggaguagaaaaauguuaaugacagguacgcuugcuguauuuuuccuauuaaucguagggcagcuaacauggaacgaucucauuagacuuugcauuaugguuggugcaaacgcaagugaucggauggguaugggaaccacauaucuugcacuaauggcuacguucaagaugagaccuauguuugcaguuggucuacuauuucgucgauuaacaucucgcgaaguacuacuauuaacaauaggacuaagucuuguugccaguguagaacuuccaaacagucuugaggaacugggugaugggcuggcuaugggaaucaugauuuuaaaacuacuuacugauuuucaaucucaucaauuaugggcgaccuuacuuaguuugaccuuuauuaagacaacuuuuucauuacauuacgcuuggaaaacaauggcaaugguuuuaucuguuguaaguuuauuuccacuauguuuaagcaccacgucacagaaaaccaccuggcuuccaguccuguuaggaucucuuggguguaagccgcuuacuauguucuuaauagcugaaaauaaaauauggggcagacguaguuggccauugaacgaagguauuauggccgucggaauagucagcaucuuauuaagcaguuugcuuaaaaaugauguaccacucgcaggcccuuugaucgcuggugguaugcuaaucgcguguuauguaauaagcggaucaucugcugacuuaagucuugagaaagcggcagaaguuagcugggaggaagaagcugaacauucaggugcuagucacaacauucuaguagagguacaagaugacggaacaaugaaaauaaaagacgaagaacgagacgauacucuaaccaucuuacuaaaagcgacgcuacucgcaguauccggugucuacccuuuaaguauaccugcaacucuuuuuguuugguauuucuggcaaaagaagaaacaaagaucaggaguauuaugggacacuccaaguccgccugagguugaaagagcaguacuugacgaugguauuuaccgaauaaugcaaagggguuugcugggaagaucgcagguagguguggguguguuccaggaaaauguuuuucauacuauguggcauguaacucgaggagcgguacugauguaccagggaaaacgacuagaacccucaugggcaagugucaagaaagaccuaauuaguuacggagguggguggcgguugcaaggcagcuggaauacaggagaagaaguccaaguuauugcaguugagccuggcaaaaauccaaagaaugugcaaacagcucccgguacauuuaaaacgccagagggugaaguuggugcaauagcuuuagacuucaaaccggggacaucugggucucccauugucaacagagagaggaaaauaguagguuuauaugggaacggcguuguaacaaccagcgguaccuacgugucugcaauugcacaggcaaaagcaucgcaagaaggcccguugcccgaaauagaggacgaaguauucagaaaaagaaaucugacgaucauggacuuacauccaggaucagguaaaacucguagguauuuacccgccauugugcgugaggcgauuaaacguaaguuaagaacucuaauacuagccccaacucggguaguugcgagugagauggcugaagcacugaaaggaaugccuauucguuaccagaccacugcugugaaguccgagcacacuggcaaggagauuguagaccucaugugccacgcaacguucacaaugcgucuacuaagucccguacgagugccgaacuacaacaugauaauuauggacgaggcccauuuuacugauccuaguucaauugcagcgcgcgguuacauaucaacuagagugggaaugggagaagcagcugcgauauuuaugacagcuacaccuccuggcucaguugaagccuucccccaaucuaacgcuguaauacaagaugaagaacgggacaucccagaacgaagcuggaacaguggauaugaguggauuacugacuuucccgggaaaacuguuugguuuguuccaucuauaaaauccgguaacgauauugcuaacuguuugaggaaaaacggcaaacgagucauacaacuaucaagaaagaccuuugacacugaauaucaaaagacaaagaauaaugauugggauuauguuguaaccaccgauauaucugaaaugggagccaauuuccgugccgauagagucauagauccgagaaggugcuugaaaccagugauuuugaaagaugggccagaaaggguuauucuagcaggcccgaugccgguuaccgucgcuagugcagcacagaggagaggcaggauagggcguaaccauaauaaagagggggaccaauauauuuauaugggccagccucugaacaaugacgaggaucaugcucacuggacagaagcaaaaaugcuacuagauaauaucaauacaccggagggaaucauaccagcauuauucgaaccagaaagagaaaagucugcggcaauagacggagaauacagacuaagaggagaggcuagaaaaacauucguagaauuaaugcguagaggugaucuaccaguauggcuuaguuauaaaguagcgagugaaggguuccaauacagugauaggagguggugcuuugauggcgaacguaacaaccagguauuagaagaaaacauggauguagagauuuggaccaaggagggagaacguaagaaacuuagaccaagaugguuagaugcaaggacauauagcgauccucuugccuugagagaguucaaagaauuugcugccggccgacgcaguguuucaggugacuuaauucuggaaauuggaaaauuaccacaacacuugacacaaagagcacaaaacgcauuagauaacuuagugauguugcauaacucagaacaaggcggcagagcauauagacaugcaauggaagaacugccagauaccauagaaacgcugaugcuucuggcacuaauagcaguacuaaccggcgggguaacuuuauucuuucuuucuggaagaggccucgggaaaacuucaauaggacuuuuaugcgucauggcaaguaguguauuauuguggauggcuucaguugaaccacacuggauagcagcuucaauaauauuagaguucuuucuuaugguauugcucauaccagaaccugaccgucaacgaacaccucaagacaaucaguuagccuacgucgugauaggacuccuauuuaugauacuaacuguugcagcaaaugaaauggggcuacuagaaacaacuaagaaagaccuaggcaucggccauguagcaguagaaaaccaucaccacgcugccauguuagauguugauuuacauccagcaucugcauggacauuguaugcuguagcgacuaccaucauaacacccaugaugagacacacuaucgaaaauacaaccgcuaauaucucacuaacggccauagccaaccaagcagcuaucuuaaugggauuagauaaaggauggccuauuucuaaaauggauauagguguaccgcuuuuagcucucggcuguuacucccaaguaaacccacugacuuuaacggcggcaguacuaauguuaguagcacacuacgccaucauagggccuggccuacaagccaaggcaacucgcgaggcucagaaaaggacagcugcgggcauuaugaaaaauccaaccguagauggaauuguagcuauagaccuggacccugucgucuaugaugcgaaauuugaaaagcaauugggacaaauaaugcugcuaauauuauguacaucacaaauacuucuuaugcgaacaaccugggcauuaugugagucaauuacacuagcuacgggaccucuaacaacucucugggaagggucaccgggaaaauucuggaauaccacaaucgcagucucuauggcgaauauuuucagaggaucuuauuuagccggugcaggacucgcuuuuagccuuaugaaaucauuaggaggcggccgaagagguacaggagcucagggagaaacucucggagaaaaauggaaaagacaacuuaaucaauuaaguaagagcgaguuuaauacuuauaagagaucaggaauaauggaaguggaucgcagugaagcaaaagaagggcuaaagcggggcgaaacgacaaaacaugcggucagccguggaacugcaaaauugagaugguuuguagaacggaacuuaguuaaaccagaaggaaaagugaucgaccuaggauguggaagagguggauggucuuacuauugcgcaggucugaagaaggugacagaagugaaaggauauacuaaaggagguccagggcacgaagaaccuauaccgauggccacuuauggauggaaucuuguaaaguugcauagcggaaaggacguauuuuucauaccuccagaaaaaugcgauacccucuuaugcgauauaggagaaaguucuccaaauccaacaauagaggaaggacgcacgcuaagggugcucaaaaugguagaacccuggcuaagagggaaccaauucuguauuaaaauucugaauccauacaugccuucuguuguagagacacuugaacaaaugcaaagaaagcauggcggaaugcuaguuagaaauccucuguccagaaauagcacccacgaaauguacuggguaucgugcgguacaggaaauaucguaucugcaguaaauaugacgucccguauguuacuuaauagauuuacuauggcacauagaaaacccacauaugagagagacguagauuugggagcaggcacgcgccacguggcaguagaaccagaaguugcaaaucuggauauaaucggccagaggauagagaacauuaaacaugaacauaaaagcacguggcauuacgaugaagauaauccauauaagacuugggcguaccaugggucauacgaggucaagccaagcggaagcgccagcaguaugguaaacgggguuguaaaauuguugaccaaaccaugggaugugaucccaaugguaacacaaauugcuaugacugacaccacucccuucggccaacagagaguuuuuaaggagaaggucgauacacguacccccaaggcaaaaagggguacagcacaaauuauggagguaacagcuaaauggcucuggggauuuuuaucaagaaauaagaaaccgcguauauguacaagagaggaguuuacgagaaaaguucggaguaaugcugcuauuggugcuguguucguagacgagaaucaauggaacucugcuaaagaggcgguugaagacgaaagguuuugggacuuaguccaccgagagagagaguuacauaaacaagguaaaugugcgacaugcgucuacaacaugauggguaaaagggaaaagaagcucggugaguuugguaaagcuaaaggcagcagagccauaugguauaugugguuaggagcucgcuuucuagaguucgaggcgcuagguuucaugaaugaggaucauugguucagccgugaaaauucauuaagugguguugaaggcgaaggccugcacaaacuagguuauauucuacgugauauuucuaaaauuccugguggaaacauguaugcagacgauacagcaggaugggauacaaggauaaccgaagacgaccuccaaaacgaagcaaggauuacagauauuauggagccugagcaugcacugcuugcaaaaaguauuuucaaacuuacauaccagaacaaaguagucagaguacaaaggccugcgaaaaaugguacggucauggaugugauuucaagaagggaccaaagaggaaguggacagguuggaacguauggacuuaauacauuuacuaacauggaagcccagcucaucagacagauggaaagugaagguauauuuucaccaucugagcuugaaacaccuaauuuggcagaacgcguccucgacuggcucgaaaaguauggcguagagcgucugaaacggauggcuaucucuggagacgacugcguaguaaaaccaauagaugauagauuugcaacugcacuuacagcucuuaaugauaugggaaaaguacguaaagauauaccccaaugggaaccgucgaaaggauggaaugauuggcaacaagucccauucuguucacaccauuuccaucaauuaauuaugaaagaugggagagaaauaguaguuccuugccggaaucaagaugaauugguaggcagagcuaggguuucgcaaggggcuggcuggucucuaagagaaacggcuugccuaggcaagagcuacgcucagauguggcaacuaauguauuuucauagacgagaccuuagauuagcugccaaugcuauauguagcgcaguacccguugauuggauaccgacaucccguacaaccuggucuauacaugcgcaucaucaauggaugacaacggaagauaugcuaagcgucuggaacagaguauggauagaggagaacccauggauggaagacaaaacacacaucagcucauggggagauguuccauaucuugggaaaagagaagaccaauggugugguaguuuaauuggccuaacugccagagccacgugggcgacuaauauucagguugcgauuaaccaagugcgacgacuaauaggcaaugagaauuaccuugauuacaugacuucuaugaaaagauuuaagaacgaaucugauccagaaggugcauuaugguga

SEQ ID NO: 21487 - RNA, 9879 nt, Artificial Sequence
  derived and/or modified CDS sequence (opt6) from DENV-1__FJ024430__SS-prME
ucuguuacuaugcuucugaugcuaaugccgaccgcccuugcauuucacuugaccacuagagguggggaaccacauaugauuguaucuaaacaagaaagagguaaaaguuuauuauucaaaacaucagcugguguuaacauguguacacuaauugcgauggauuugggugaauugugcgaagacacuaugacauauaaaugcccuaggaucaccgaaacagaaccagacgaugucgauuguugguguaaugccaccgacacguggguaacuuacggaacaugcucacaaaccggcgaacauagacgagacaaacguucaguugcacuggcaccgcacguaggucuagggcuugaaacuagaacagaaacauggaugucauccgaaggggcuuggaaacaaauucagagggucgaaacuugggcccuaaggcacccaggauucacuguaauugcucuuuuucuggcgcaugcuauagguacaucgauuacgcaaaaaggcauuauauuuauacuauugauguuaguaacgccaagcauggccaugagauguguuggaauagguagcagagauuuugucgaaggacuguccggggcuacguggguagacgugguacuagaacacgguucuugcgucacaacuauggcgaaagacaaaccaacucuagauauugaguuauugaaaaccgaggugacuaauccagcugugcucaggaaacuguguaucgaggcaaaaaucaguaacacaacaaccgacucaagaugcccgacucagggugaggcgacuuuaguugaagaacaagacgcgaacuucguauguaggagaacauuuguagauagggguugggguaaugguugcggacuuuuugguaaaggcuccuuaauaacuugcgcaaaauuuaaauguguaacaaaacuggagggcaaaauaguccaauacgaaaaccucaaauauuccgugauaguaacaguucauacaggcgaccagcaucagguaggaaaugaguccacagaacaugggaccacugcaacgauuacuccccaagcuccaacuacagagauucaacucacagauuacggagcacuuacacucgacuguaguccaaggacagggcuggauuuuaaugaaaugguacuccugaccaugaaagaaaaaucauggcuuguccacaaacaaugguucuuagauuuaccauugccauggacgagcggugcaucuacaagucaggagacauggaauagacaggaccucuugguaacguucaaaacagcucacgcuaagaaacaggaaguagucguucuagguucacaggaaggugcaaugcauacagcucuaacgggugcaacagagauucaaacuagcgggaccacaaccauauucgcgggacauuuaaaauguagacuaaaaauggacaaacugacuuuaaaaggcaugucuuauguuaugugcaccggcucuuuuaaacucgagaaagaaguagcugaaacucaacacgguaccguacugguacagauaaaauaugaaggaacggaugccccuugcaaaauacccuucaguacucaggaugaaaaaggagugacccaaaacggacgacuaauaacugcuaacccaauagugacagauaaagaaaaaccaguuaacauugaagcagaaccaccauuuggagagagcuauaucgugauuggugcaggagagaaagcauuaaaacuaagcugguuuaagaaaggaaguuccaucgguaagauguuugaagcuacagcaagaggugcgcgaagaauggccauucuuggugauaccgccugggauuuugggucuauuggaggcguuuuuaccagcgugggaaagcuaguacaucaaauuuuugguacggcauauggagucuuauuuucgggaguaagcuggacuaugaagauaggcaucgguguucuucucacauggcuuggucuaaauucccgcaguacaucguuaaguaugacauguauagcgguaggauugguuacguuguaucuuggcguaauggugcaggcagacagcggcuguguuauaaauuggaagggaagagaacuaaagugcggaucugggauauucgugacuaacgagguacauacauggacggagcaguacaaauuucaagcagauucgcccaagcgacugucugcugcaauaggaaaagcgugggaggaaggagugugcggaauuaggucggcuacaagguuggagaauauaauguggaaacagauuagcaacgaacuaaaucauauauugcuugaaaaugacaugaaauuuacggugguuguaggggaugucgcggggauccuugcucaaggcaagaaaaugaucagaccacaaccaauggaauauaaguacaguuggaaaaguugggguaaagccaaaaucauuggcgcugauguccaaaacaccacauuuauaauagacggaccaaauacaccagaaugcccggacgaccagcgugccuggaacauaugggaaguugaagauuauggguucggaauauucacuacaaacauauggcuaaaguuaagggacucguacacgcaaguaugugaucauaggcuaaugucagcugcgauuaaggauaguaaagcgguacacgcggacaugggcuauuggaucgaauccgaaaagaacgaaaccuggaaguuagccagagcgagcuuuauagaaguuaaaacuuguaucuggccaaagagccauacccuuuggaguaauggugugcuggaaucagaaaugauaauacccaaaauuuauggagguccuauaagccaacacaacuauagaccaggauauuuuacacagacagcgggacccuggcaucucgguaaacucgaauuggacuuugauuuaugugagggcacaacaguuguaguagaugaacauugcggcaaccgaggaccaucguuaagaacaacaacugugacggguaaaaucauucacgagugguguugcagaucuugcacauuaccaccuuuaagguucagaggagaagauggauguugguauggaauggaaauccggcccguaaaagaaaaggaagaaaaccuaguuaaaucaaugguauccgcgggauccggagaaguugacucguuuucacucggcuuacuaugcaucagcauuaugauugaggaagugaugcggucaagauggucaagaaaaauguugaugacaggaacucucgcaguauucuuucuacucauuaugggacaacucacguggaaugauuuaauaagacucuguauaaugguuggugcuaaugcgucggauagaaugggaaugggcacaacuuaccuagcauugauggccacuuuuaaaaugcggcccauguuugcaguagggcuacuguuccgacgucuuacgucaagagagguccuacuccuuacaauugguuuaucauuaguagcaagcguugaauuacccaauagcuuggaggaacucggagacggguuagcaaugggcauuaugauauuaaaacuuuuaacagauuuccaaagccaucaacuuugggcuacauuacuaucucuuacuuuuauuaaaaccacuuuuagccuacacuacgcauggaaaacaauggccaugguuuugucuauuguaagucuuuuuccauuaugccuuucgaccaccucacagaaaacgacuuggcuaccuguauuacuagggucacuaggauguaaaccauuaacaauguuauuaauugcagaaaauaaaauauggggaagaaggaguuggccacucaacgaagggauuauggcaguugggauagucagcauucuauuaucaucacuucucaaaaaugacguaccauuagcaggcccgcuaaucgccggcgguaugcuaauugcauguuacguuaucaguggcucuagugcugcgcugucuuuagaaaaggcugcagaaguaucaugggaagaagaagcagaacauucaggagcuagucauaacaucuuaguugaaguacaagacgacgguaccaugaagauaaaagaugaagaacgcgaugauacccuaacgauucuccuaaaggcaacccuccucgcagugaguggugucuauccuuuaucuaucccagcaacgcuauuuguaugguauuucuggcaaaagaagaaacagagaagcgggguguuaugggacaccccuaguccaccagaaguuggacgagcaguacuagaugauggcauuuauaggauaaugcaaaggggccugcuaggcagaucacaaguuggcguggguguauuucaagagaaugucuuucacacgauguggcauguaacgcgaggugcgguucuuauguaccaggguaaacguuuagagccaucaugggcuuccguuaagaaagaccuuaucuccuacgguggaggguggcgauugcaaggaucauggaauacgggcgaagaaguucaaguaauugcagucgaaccagguaaaaauccgaagaauguucaaacagccccgggcacauucaaaacaccugaaggcgagguuggagcuaucgcauuagauuuuaaaccgggaacuagcggguccccuauuguaaaccgugaaggaaaaauuguuggguuguacggcaacggcguaguaacaacaucagggacuuauguuagugcaaucgcacaggcaaaagcaucucaggaggguccguuaccagaaauagaagaugagguauuucguaaacgaaaucuaacuauaauggacuuacacccaggaaguggaaaaacgcgacgauaccuaccagcaauaguuagggaagcgauuaaacguaaauuaagaacccuaauccucgccccgacucgagucguugcaagugaaauggccgaagcccuuaaaggaaugcccauuagauaccagaccacagcaguuaaaagugaacauacugggaaggaaauuguagaucuuaugugucacgcuacauucacaaugagauuacuaucucccguaagaguuccuaacuauaauaugauaauaauggaugaagcccacuuuacagauccaucaucgauugcugcacgaggauauauaagcacgcgugugggaaugggagaagcugcugccauuuuuaugacagcaacaccaccaggauccguggaagcauucccccaaaguaacgccguaauacaagaugaagagagagauauuccugagcgcagcuggaauagcggcuacgaauggauuaccgauuuucccggaaaaacgguuugguucgucccaucaaucaaauccgggaacgacaucgcuaauuguuuaaggaaaaauggaaaaagagugauucaauugucaagaaaaacauuugauacggaguaucagaaaacaaagaauaaugacugggacuacguuguaacuacugauaucagugaaaugggagccaacuucagagcugauagaguuauagauccgcggcggugcuuaaaacccguuauccuaaaagaugggccugaaaggguaauccuagcuggucccaugccuguaacuguggccucagccgcacagaggcgaggaagaauaggaaggaaucauaauaaagaaggagaccaauacauauauaugggacagccgcuaaacaacgacgaagaccaugcgcacuggacggaggcuaaaaugcuguuagacaauauaaauaccccggaaggaauaauuccagcguuauucgaaccggaaagagagaaaagugcagccaucgacggagaauauagacuuagaggggaagcacgaaaaacguucgucgaauugaugcgccgaggagaucuaccaguuugguuaaguuauaagguugcgucagagggauuucaauauuccgacaggcgcuggugcuuugacggggaacgaaauaaucaaguacuagaagaaaacauggauguggaaauauggacuaaagaaggugaaagaaagaaacucagaccuaggugguuggacgcucgaacauauucggacccucuagcguugcgagaguuuaaggaauuugcagcgggacgccgcucuguaucgggagauuugauacuugagauaggaaagcucccccaacaccuuacgcaaagagcacaaaacgccuuggacaauuuaguaauguugcacaauucugaacaagggggucgagcauauagacaugcaauggaggaguuaccugauacgaucgagacauuaauguugcuggcacuuauugcuguucuaacaggcggcgucacacuauucuuucuaucaggcagaggauuagguaaaacgucaauaggucuucucuguguaauggcuuccagcguucugcucuggauggcuucuguugaaccccauuggauugcugcuucgauaauauuagaguucuuccucaugguacuccuaauucccgaaccugacaggcaaaggacaccacaggauaaccaauuggcauauguugucaucggauuacuauucaugauacuaacgguugcagcuaacgagaugggauuguuagagacuacuaagaaagaccuagguauaggccaugucgcgguagaaaaccaucaucaugcagccaugcuggaugucgaucuacacccagccucagcauggacauuauaugccguagcaacaacuauuauaacacccaugaugagacacacgauugaaaacacgacggcaaauauuucacugacagcaauagcaaaccaagcggcaauacuuaugggcuuggauaaaggguggccaauaagcaaaauggauauagguguaccgcuauuagcucucggguguuauucgcaaguaaauccguuaacucuaacagcagccguccucauguuaguagcacacuaugcaauaauaggaccuggacugcaagcuaaggcaacgagggaagcacagaaaagaacugcagcaggcauuaugaaaaacccuacgguggaugguauaguugcaaucgaccucgacccagugguauaugacgcuaaauuugaaaaacaguuaggacagauaaugcuccuaauauuauguacaucacaaauuuuacucaugcguacgacgugggcguuaugcgagucaauaacccuugcuacggguccauugacuacguuaugggaaggcucaccaggaaaauuuuggaacaccaccauugcggucuccauggcaaacauuuucagagguagcuauuuagccggugcgggacuagcauuuucacuuaugaaaucguuaggcggugggcgucgaggaacaggugcucagggcgagacucuaggagaaaaauggaaacgccaauugaaccaacuauccaaaagcgaguuuaacacauauaagagaucagggauaauggaaguugauagaagugaggccaaagaaggcuuaaagcgcggagaaacaaccaaacacgcgguuaguagaggaacagcaaaacuacgaugguuuguagaaagaaauuugguaaagccugaggguaaaguaauagauuuaggauguggaaggggcggcugguccuauuauugugcuggacuuaaaaagguuaccgaggucaaaggauacacgaaaggugggcccggucacgaagaaccgauaccaauggcgacuuaugguuggaaucuagugaagcuccauucuggaaaagacguauuuuucaucccaccagagaaaugcgacacacuauuaugugacauaggcgaaucuaguccgaauccgacaauugaagaagggagaaccuuacgaguucuaaaaaugguugaaccuuggcuaagagguaaucaauucuguauuaagauauuaaauccauauaugccuucgguaguggagacgcuggaacaaaugcaacgaaagcauggcggaauguuaguacguaauccgcuuaguagaaauaguacgcacgaaauguauuggguauccugugguacgggaaauauuguuagugcaguaaauaugacgagucgaaugcuacuuaacagauuuacaauggcccacaggaaacccacguacgagagagauguagauuuaggugcgggaacucgucauguagcaguugaaccagagguugcaaaucuggauauaauuggucaaagaaucgaaaauauuaaacaugagcacaaaucaacuuggcauuaugacgaagacaacccguacaaaacuugggcauaucacgggagcuacgaagucaaacccagcgguucagcguccucgauggugaauggcguggugaaacuauugacaaaacccugggaugucauaccaaugguuacacaaaucgcuaugacagauaccacgccauuuggacaacagagaguuuuuaaagaaaaggucgauacaagaacaccaaaagcaaaaagaggaaccgcccagaucauggagguaaccgcaaaaugguuauggggguuucucucaagaaauaagaaaccacguauauguaccagagaagaguucacuagaaaaguacgcucaaacgcagcuauaggagcaguuuucgucgacgaaaaccaauggaauagugcuaaagaagcaguugaagaugaacgguucugggaucuaguacacagggaacgagaauuacauaaacaggggaaaugugcgacaugcgucuacaauaugaugggaaaaagggagaagaaacuaggagaauuugggaaggcaaaagggagcagggccauaugguauauguggcuaggugcacgcuuccucgaguucgaagcacuuggcuucaugaaugaggaccauugguucagcagagaaaauucucuaaguggcguagagggagaaggucuucacaaauuagguuauauacugagagauauuaguaacaucccagguggaaauauguaugcugaugacacugcagguugggauacaagaauuaccgaggaugauuuacaaaacgaagcaagaauuaccgauauaauggaaccagagcaugcucuccucgcaaaaagcauuuucaaacuuacuuaucaaaauaaagucguaagggugcaacgcccuacuaagaauggaaccguuauggauguaauaucucgccgagaucaaagagggucaggacaaguaggaaccuaugguuuaaauacauuuacgaauauggaagcacaacuaauaagacaaauggaaagcgaaggaauauuuuccccgagugagcuugaaacaccaaaccuagcugaaagaguauuagacuggcuggaaaaauaugguguagaacggcucaaacgaauggcaauaucgggagaugauugcguagugaaacccguagaugaucgauuugccacagcauugacggcauugaaugauaugggcaaagugaggaaagacauaccacagugggaaccauccaaaggcuggaacgauuggcaacaaguuccguuuugcagucaucauuuccaucaacuuauuaugaaagacgggagagaaauaguaguaccuugcagaaaucaagacgaacuuguagggagagcuagagucucccaaggagcggguuggucacuccgcgaaacugcaugccuuggaaagucuuaugcacagauguggcaauugauguauuuucaucgaagagaucuuagguuagcagccaacgcuauuuguagcgcugucccagucgacuggauaccuacuucaaggacaacuuggaguauucacgcgcaccaccaauggaugacgacagaggacaugcuaagcguauggaacagaguauggauagaagaaaauccauggauggaagauaaaacacauauaucgucauggggagauguuccauaccuagggaaaagagaagaucaguggugcgguagccuaauuggacuuacagcccgagcuaccugggccacgaauauccaagucgcaaucaaucaaguaagaaggcugauagguaacgaaaauuacuuggacuauaugacaucaaugaaaagguuuaagaaugaaagugacccagaaggagccuuaugguag

SEQ ID NO: 21488 - RNA, 9879 nt, Artificial Sequence
  derived and/or modified CDS sequence (opt6) from DENV-1__FJ024433__SS-prME
ucuguaacaauguuacuuauguuaaugccaacagcauuagcguuucaccuuacaacacgcggcggugaaccucauaugauaguaucaaaacaagaaaggggaaaaucucuacucuucaaaacuucagccgguguaaacauguguacuuuaauagcgauggaccuaggcgaauugugugaagacacaaugacauacaaauguccuagaauaacggaaacugaaccagaugacguagauuguugguguaacgcuacagauacguggguuacauaugguacuugcucgcaaaccggugaacaccgaagagacaaaaggucgguagcacuggcaccacauguaggcuugggcuuggaaacuagaacagaaacuuggaugagcagugagggcgcauggaaacagauccaacgaguugaaaccugggcacuucggcacccagguuuuaccguuauugcucuguuuuuagcucacgcaauagguacaaguauaacacaaaaaggaaucauauuuauauugcugaugcuugucacuccgagcauggcaaugcggugcguaggaauuggaucacgagacuucgucgaagggcucagcggagcaacauggguugauguaguucuggaacauggaucgugcguaacaacaauggcaaaagauaaacccacguuagauauagaacuauuaaaaacagaaguuacgaauccagcaguauuacgcaaacuguguauugaagcaaaaauuaguaauacaacgacagacuccagauguccaacucaaggugaagcaacucuaguggaggaacaagaugcuaauuucguuugccgaagaaccuucguugacagagguugggggaacggaugcggacuauuuggaaaagguagccuuaucacgugcgcuaaauuuaaaugcguaacuaaauuagaagguaagauugugcaauacgaaaauuuaaaauauagcguuaucguaacuguacacacaggugaucaacaucaaguaggaaaugagucaacagaacacggaacuacugcgacgauaacaccucaagcaccuacaacagagauucaacuuacugacuacggugcucuaacguuagacuguaguccucguacagggcuagauuuuaacgaaaugguucuuuugacuaugaaagaaaagucuugguugguucauaagcaaugguucuuagauuuacccuuaccauggacaaguggugcuuccauaucgcaagaaacauggaacagacaagauuuacuuguaacuuuuaaaacugcacaugccaagaaacaagaagucguaguuuuagguagccaagaaggagcaaugcacacugcguugaccggcgcgacggagauucagaccaguggaacaacaacaauuuuugcgggucaucuuaagugucgauuaaaaauggauaaacucacauugaggggcaugucuuacgucauguguacugggaguuucaaauuggaaaaggaaguggcagaaacccagcauggaacagucuuaguacagauaaaauaugaggguaccgaugcgccuugcaaaauaccuuucucgacucaagaugaaaaaggaguaacucaaaacggcagauuaauaaccgcuaauccuauagucaccgauaaagaaaaaccgguaaauauagaagcagaaccgcccuucggagaaucuuauaucguaauaggugcaggagaaaaagcacugaaauugucgugguuuaagaaaggcucaucaauaggaaaaauguuugaggcuacagccagaggggcacguagaauggcgauccuuggggacacggccugggauuuuggaucgauuggaggcguguuuacuagcgucgguaagcucguacaucagauauucgguacagcauacggagucuuguuuuccgggguuuccuggacgaugaaaauugguaucgggguccuauuaacauggcucgggcucaacagccgguccacuagccuaagcaugacauguauugcgguaggguuaguaacguuauaccuuggaguaaugguacaagcagauagcggaugugucauaaacuggaaagggcgugaauugaaauguggaagcgguauauucguaacuaacgaaguccacacauggacagaacaauauaaauuucaagccgauagcccaaagagacuaagcgcagcuauugguaaagcaugggaggaaggaguuugugguauuagaucggcuacaagauuagagaauauuauguggaaacaaauuuccaaugaacuaaaucauauacuauuagagaaugauaugaaauucacaguuguuguuggggacguugcggguauccuugcccaagggaagaaaaugauucgcccccagccuauggaacacaaauauucauggaaaucguggggaaaagcuaagauuaucggugcagauguacagaacacuaccuucauuauagacgguccgaauacgccugagugcccugacgaccaaagagccuggaacauaugggaaguagaagauuacgguuuuggaauuuuuacaacaaacauauggcuuaaacuucgugauucauacacacaaguaugcgaucaucgacugaugucagcugcaauaaaagacaguaaagcuguucaugcggauaugggcuacuggaucgagucggaaaagaaugaaaccuggaaguuagcgagagcaaguuuuauugaaguuaaaacauguauuuggccuaaaagccacacacuauggucaaauggcguccuagagagcgaaaugauaauaccaaaaaucuacggaggccccauaucacaacauaacuaccgaccuggcuauuuuacucaaacagcuggaccguggcaccugggaaaacuagagcuagacuucgaccuuugcgaggggacaacuguuguuguagaugagcacuguggaaauagggguccgagucuuagaacaacuacagugacgggcaaaauaauacacgaaugguguugccgaucaugcacguuaccuccacuaagguuucgcggggaggaugguugcugguaugguauggaaauaaggccugucaaggaaaaagaggaaaaccuuguuaaaucaaugguaagcgccggaagcggugaaguagacuccuucucauuaggccuucuaugcauaaguauaaugauugaagaaguuaugagaucaagaugguccagaaagaugcucaugacugggacacuugcuguguuuuucuuacucauuaugggacaauugacauggaaugaccuaauaagauuaugcauuauggucggggcaaacgcgucugaccguaugggaaugggcacaacauauuuagcauugauggccaccuuuaagaugagaccgauguucgcaguaggcuugcucuuucgccgacuaaccucgcgugagguuuuguuguugacuauagguuuaagccuagucgccaguguagaacuaccaaacucauuggaagaguuaggagacggacucgcuaugggaauuaugauacucaaauuacuuacggauuuccagucgcaccaacucugggcuacacuacucucccuuacuuuuauuaaaacaaccuucagucuucauuaugccuggaagacgauggcgauggucuugagcauuguaucacuauucccuuuaugucuuaguacaaccucccagaaaacaaccugguugccaguacuacuuggaucacuagguuguaaaccuuuaaccauguuucugauagcggaaaacaaaauuuggggucgacgcucauggccacugaaugaaggcauuauggcagugggcauuguuagcauuuuauuaaguaguuuauugaaaaaugacgugccucuggcaggcccacugauagcagggggaauguuaaucgcauguuaugugauauccgguucgagugcagaccuaucgcuugaaaaagcagccgagguaaguugggaagaagaagcugaacauaguggagcaucccacaauauuuuagucgaagugcaagaugauggcacgaugaaaauaaaagaugaagagagagaugauacgcugacaauauuauugaaggcaacacuuuuagcuguaucuggaguguacccccugucaauaccugcaacauuguucgugugguauuucuggcaaaagaagaaacaacgcucagggguauuaugggauacucccaguccuccagaaguagaaagagcaguacuggaugaugguauauauagaauuaugcaaagaggauuacuaggacguagccaaguugguguagguguauuucaagaaaauguguuccauacaauguggcacgugaccagaggugcgguucucauguaucaaggaaaacgcuuagagccaucuugggcaaguguuaagaaagaccuuauuagcuauggaggaggcuggcgacuucaggguucuuggaacacaggagaagagguccaaguuauagccguagagccagguaagaauccgaaaaauguacagacugcaccuggcacguuuaagacuccugaaggcgaaguaggagcuauagcacuggacuuuaagccaggaacaagugguaguccuaucguaaaccgugaagggaaaauaguuggacucuauggaaacggcguggucacgacaagugguacauauguuuccgcuaucgcacaggcaaaagcaagccaagagggcccucuacccgaaauugaagaugaaguuuuucgcaagagaaaccucacgauaauggauuuacauccaggaucagggaaaacaagaagauaccuccccgcaaucguuagggaagcaauuaaaagaaagcuacgaacucuaauucuagcuccuacaagaguuguagcaucagaaauggcugaggccuuaaaaggaaugccgauccgauaccagaccacagccgugaaaagugagcauacaggcaaagaaauuguggaccucaugugccaugcaacuuucacgaugagauuacuuucaccagugaggguuccaaauuauaauaugauaauuauggacgaagcccacuucaccgacccaucgagcauagcggcuagaggguacauuaguacaaggguaggaaugggcgaagcggcugcaaucuucaugacugccaccccaccaggcaguguugaggccuuuccacaaucaaaugcaguaauucaagacgaagagagagauauacccgaaagaucuuggaacucagguuaugaauggauaaccgacuuuccagguaaaacaguuugguucgucccuucaauaaaaaguggcaacgauauugcaaauugucuaaggaaaaaugguaagagaguaauacaacuaagucgaaaaaccuucgacacggaauaccagaaaacaaagaacaacgacugggacuauguaguuacuaccgauauaucagaaaugggugcgaauuuuagagcagacagaguuauugauccucgacguuguuugaaaccaguaauacucaaggaugguccagagagaguaauacucgcgggaccaaugccuguaacugucgcuagugcugcucaaagacgaggcagaauaggaagaaaucauaauaaagaaggagaucaauacaucuauauggggcagccacuuaacaaugacgaagaccaugcucauuggacagaagcuaaaaugcuucuagauaauaucaauacgccggagggaaucauuccggcgcuauucgagccugaaagagagaaaucagcggcaauagacggggaauaucguuugagaggagaagcucgcaagacauucguagagcugaugcgcagaggcgacuugccgguuugguuaaguuauaaagucgcgagcgagggauuucaauacagcgaccgaagaugguguuuugacggagaaaggaauaaucaaguacuggaagaaaauauggauguggaaaucuggacgaaagagggagaacggaagaaauuacgaccucgaugguuggaugccagaacguauagugacccacuagccuuaagagaauuuaaagaauuugcggcagggcgaaggucgguaaguggugacuugauccuggagaucggaaaacuuccacaacacuuaacacaaagagcucagaaugcucucgauaauuuaguuaugcuacacaauagugaacaaggcggcagagcguauagacaugcuauggaagaauuaccagauaccauagaaacucuuaugcuauuagcacugauagcuguacuaacagggggaguaacauuguuuuucuuaagugguagagggcugggaaaaacaucuaucggauuacuaugcgugauggccagcuccguacuacucuggauggcaucaguagaaccucauuggauagcagcaucuauuaucuuagaguuuuuccuaauggugcucuugauaccggagccugacagacaacgcaccccacaggauaaccaguuagcuuauguuguuauaggacuuuuguuuaugauacuaaccgucgccgcuaaugagaugggacuacuagaaacaacuaagaaagaccuaggaauaggccacguggcaguagaaaaucaucaccaugcugcgaugcucgaugucgaccuacaucccgcaucagcuuggacacuauaugccguagcgacuacuauuauaacccccaugaugagacauacgaucgaaaauacaaccgcgaacauauccuugacggcaauagcuaaccaagccgcaauucugaugggacuugauaaggguuggccaaucuccaaaauggauauuggagugccucuguuagcucuggguuguuacucgcaaguuaacccacuaacucuaacggcagcuguauugauguuaguagcccacuacgcaauaauaggcccuggacuccaagccaaagcuacacgggaagcucagaaaagaacugcagcuggcauuaugaaaaauccgacugucgauggaauugucgcgauagacuuagauccaguagucuacgaugcaaaguucgagaagcaacucggacaaaucauguuguuaauacuuuguacuagccaaauucuauugaugaggacaacgugggcccugugugaaucgauaacauuggcaacaggaccguuaacaacucugugggaaggaucaccaggaaaauucuggaauacgacaaucgcaguuucaauggcaaacauuuuucgagggucguauuuagcuggagcuggauuagcauucucacugaugaaaucacucggagggggcaggagagguaccggagcacaaggagaaacccuaggagaaaaauggaagagacaauuaaaucaacuuucaaaaucagaguucaauacauauaaaagaucgggaaucauggaaguugaccgguccgaagccaaagaaggguugaaacgcggugaaacaacaaagcaugcuguaucacgugguaccgcaaaauugaggugguuuguagaaaggaacuuagucaaaccagagggaaaaguaauagaccugggaugugggcgcgggggauggaguuauuacugugcaggucucaagaaaguuacagaaguaaaggguuauacuaaaggagggccaggccaugaagaaccuauaccaauggcaacauauggauggaauuuaguaaagcuacauucuggcaaggacgucuucuuuauaccaccggaaaaaugugauacgcuacuuugcgacauuggggaaaguagcccaaauccaacuaucgaggaagguaggacgcuucgcguucuaaaaauggucgaaccauggcuuagagguaaccaguuuuguauaaaaaucuugaacccguauaugccuucuguaguagaaacguuagaacaaaugcagaggaaacauggaggaaugcuaguccguaauccacuaucacguaauaguacccaugaaauguauuggguaucgugugggacgggcaauauaguaucggcuguaaacaugacuagccggaugcuacuuaauagauucacuauggcacaccgaaaaccuacauaugaaagagacguagacuuaggugcaggaacgcgacacguagcaguugaaccugaaguagcgaaucuagauauaaucggacagaggaucgaaaacauaaagcaugagcauaaaagcacguggcauuacgacgaggacaauccauauaaaaccugggcuuaccacgguucuuacgaagucaaaccguccggauccgcuucaucuaugguaaauggagucguaaaauuguuaacaaaaccuugggauguaauaccgaugguuacucaaauagcgaugacagauaccacgcccuuuggccaacaaaggguauucaaagagaaaguagauacaagaacuccuaaagcuaaaagggguacagcccaaaucauggaagucaccgcaaaaugguuaugggguuucuugucccgaaauaagaaaccacgaauuuguacacgagaagaguucacaaggaaaguccgaucuaacgcugcaauaggggcaguauuuguagacgaaaaccaguggaacucugcuaaagaggcaguggaggaugaacgcuucugggacuugguccaucgcgaacgugaauugcauaaacaagggaagugugcgaccugcguauauaacaugaugggaaagagagagaagaaacucggagaauuuggaaaagcuaaaggcagccgagcaaucugguauauguggcuuggagcacgauucuuggaauuugaggcacuaggcuuuaugaaugaggaccauugguuuucacgagagaacucacuaucagggguugagggugaggggcuacauaaauuaggauacauacugcgagauauaucuaaaaucccugggggaaacauguaugcagaugauacugcugggugggauacacggauuacugaggaugauuuacagaaugaggcccgcauuacggacauaauggaacccgaacaugcucuccuagcaaaaucaauauucaaauuaacauaucaaaauaaaguuguuagaguccaaagaccagccaaaaaugguacaguaauggaugucauaucaagaagagaucaaaggggcaguggccaagucggcacauacggucucaacacuuucaccaacauggaagcucaacugauacgacaaauggaaucugaaggaauuuuuagcccuucggagcucgaaacaccuaacuuggcugaacggguacuugauugguuggaaaaauacggugucgagagacucaaaagaauggcaaucucaggcgacgauuguguuguuaaacccauagaugaccgguuugcgacggcccuaacagcauugaaugacaugggaaagguaagaaaggacauuccucaaugggaaccaucuaaagguuggaaugacuggcaacaggugccauuuugcagucaucacuuccaucaacuuaucaugaaggauggcagagaaauagugguucccugcagaaaucaagaugagcuaguaggcagggcucggguaagucagggagcuggauggaauuuacgcgaaacagcuugccuaggaaaauccuacgcacaaauguggcagcuuauguauuuucacagaagagaccucagacuagcagcuaaugcaauauguucagcuguaccuguugacuggauuccaaccucccgaacaacauggucuauccaugcucaucaucaauggaugaccaccgaagacaugcuuucaguauggaauaggguauggauugaggaaaacccuuggauggaagauaaaacacauaucucaagcugggaagaugucccguauuuaggaaaaagggaagaccaaugguguggaaguuuaauaggacuaacagcccgggcgacaugggcgacgaacauucaggucgcgauuaaucagguacgacgucucauaggcaacgaaaacuauuuagauuauaugacuagcaugaaacguuuuaaaaaugagucagauccugaaggcgcgcuaugguga

SEQ ID NO: 21489 - RNA, 9879 nt, Artificial Sequence
  derived and/or modified CDS sequence (opt6) from DENV-1__FJ024434__SS-prME
ucagucacaaugcuuuuaauguuaaugcccacggcguuagcauuccacuuaacuacuagaggaggagaaccacacaugauaguguccaaacaggaaaggggcaagucucuauuguuuaagacaucagcuggugugaacauguguacacuaaucgccauggaccugggcgaguugugcgaggauaccaugacguacaaauguccaagaauuaccgaagcggagccagaugacguagauuguugguguaaugcgaccgacacgugggucacuuauggcaccugcagccagacgggagaacauagacgagauaaaaggaguguugcacuugccccucaugucggucucgggcuggagacgcgaacugagacuuggaugagcucggaaggagcuuggaaacagauccaacgcguagaaacgugggcgcugagacauccaggauucacuguaauugcucuuuuuuuagcacacgcgauugguacgucuauaacacagaaagguauaauauucauuuuacuaauguugguaacuccuucaauggccaugcguuguguaggcauaggaucaagagauuuuguugagggucucucaggggcaacauggguugauguagucuuagagcacgggaguuguguaacgacaauggcaaaagacaagcccacauuagauauagagcuccuaaaaaccgaagugacaaauccugccguuuuaagaaagcuuuguauagaagcaaaaauaaguaauaccacaacggacucacgauguccuacccaaggagaagccacacuaguggaggaacaagacgcuaacuuugugugccgaagaaccuucguggauaggggaugggguaacgguugcggucuuuuugguaaagggucccuuaucaccugugcgaaauuuaaaugugugacaaaacucgagggcaaaauuguccaauaugagaaucucaaauauagcguuauagucacaguucauacaggagaucaacaucaaguggguaacgaaagcaccgaacacggaacaacagcaacaauaacuccacaggcccccaccacagaaauucaauugacugacuauggugcuuuaacguuagacuguagcccacgcacaggacuagacuuuaaugaaaugguuuuacuuacaaugaaggaaaagucuugguuaguccauaagcaaugguuuuuagaccuaccgcugccuuggacaagcggcgcauccacaucccaagaaacuuggaauagacaagaccuauugguaacauucaagacggcacacgccaaaaaacaagaaguuguaguguuaggaagucaggagggcgcaaugcauacggcuuuaacaggcgcgaccgaaauccaaacuagcgguaccacaaccauuuuugccggccacuugaaaugccgacuaaagauggauaaacuaacauuaaagggaaugucuuauguuaugugcacuggcucuuuuaaacuggaaaaagagguugccgaaacacaacacggcaccgucuuaguucaaauuaaauaugaaggaacugacgcucccugcaaaauccccuuuaguacacaagaugaaaaaggaguuacccagaacggccgucuuauaacggcaaauccaaucguuacggacaaagagaagccagugaauauugaagcagaaccgccuuuuggggaaucguauaucgucauuggugcaggagaaaaagcucuaaaacuaucgugguucaaaaagggaucuucaauugguaaaauguuugaagccacagcucguggggccagacguauggcuauacuuggagauacagccugggauuuugguaguauaggaggugucuucacaucuguggggaaacuuguacaucagauauuuggcacagcguauggagugcuauucucuggcguuucuuggacaaugaaaauagggauaggaguucuucucaccuggcugggauuaaauucgagaagcacaagucuaaguaugacaugcauagcggugggguugguuacuuuguacuuaggaguaaugguacaagcggauucuggaugcguaauaaauuggaaaggcagagaacugaaaugugguucaggaauuuuugugacuaacgaaguacauaccuggacugagcaauacaaauuucaagcagauaguccaaaaaggcucucagcagcaauagggaaggcuugggaagagggaguuugcgguauacguucugcgacaagacuagaaaacaucauguggaaacaaauaaguaacgagcuaaaccauauuuuacuugaaaaugauaugaaacuaacugucguaguuggagauguugcuggaauucuaggacaaggaaaaaagaugauccggccucagccaauggaguauaaauauaguuggaaaucaugggguaaagcaaaaaucauaggagcugaugcacaaaauacgacauuuauaauagacgguccgaacacuccggaaugucccgacgaccaaagggcuuggaacauuugggaaguugaggacuauggcuuuggaaucuucacaacuaacaucugguuaaaacugcgagacaguuauacacaaguaugugaucacagauuaauguccgcagcgauaaaggacucaaaagcagugcacgcggauaugggauauuggaucgagucugaaaagaacgaaacauggaaauuagcccgugcaaguuuuauagaaguuaagacguguaucuggcccaaaucucacacacuauggagcaaugggguacuagaaucagagaugauuauuccaaaaauauauggggguccaauaagccaacacaacuacaggccagguuacuucacucaaacugcaggacccuggcacuuggggaaacuagaauuagauuuugaccuuugugaagguacuacaguagucguugaugagcauuguggaaaccgcggacccucauuaagaaccaccacaguuacuggcaaaauuauacacgagugguguugccggucuuguacuuuaccaccccuacguuuucgcggcgaggauggguguugguauggcauggagauacguccuguaaaggaaaaggaagaaaauuuaguaaaaaguauggucucugccggcucaggugaaguugauaguuuuagccuuggacuuuuguguauuaguauaaugauugaagaaguaaugaggagcaggugguccagaaaaauguuaaugacagguaccuuggcaguguuuuuucuucucauuaugggacaauugacauggaaugacuuaauacgauugugcauuaugguuggugcuaaugcguccgaucgaaugggaaugggaacaacuuaucucgcucugauggcuaccuucaagaugagaccuauguuugcaguagguuuauuauuuaggcgcuuaacguccagggaaguccuacuguugacgauaggcuuauccuuggucgccagcgucgaacuuccgaauucauuagaagaauuaggggacggacuagcaaugggcaucaugauauuaaaacucuuaacagauuuucaaucucaucaacuaugggcaacauuauuaucacuaacauuuaucaaaacuacauuuucccuucauuacgccuggaaaacuauggcuaugguuuuauccauaguaucacuuuuuccauuauguuugucuacuacuucgcagaagacuaccugguugccaguucuacuuggcagucuuggauguaaaccacuaacaauguuucuaauagccgaaaacaaaauaugggggcgaaagucauggccuuuaaaugaaggaauaauggcuguaggaauaguaucaaucuugcuuuccucccucuugaaaaacgacguuccacucgcuggaccucuaauugccggcggaaugcugauagcguguuaugugauaagcgggucguccgcugauuuaagccuagagaaagcagccgaagucaguugggaagaagaggcugagcauucuggagccucucacaacauucuaguugagguacaagacgauggaacgaugaaaauaaaagacgaagaaagagacgauacucuaaccauacuacuaaaagcaacacuacuggcaguuagcggaguuuacccguuauccauaccagcaacacuuuucguuugguauuucuggcaaaaaaagaaacagcgauccgggguguuaugggauacaccaagucccccugaaguagagcgagcagugcuagaugacgggauauaucggauaaugcagcggggguugcucggacgaucccaaguaggcguuggggucuuucaagagaauguauuucauacaauguggcauguuacgcgcggcgcgguccuaauguaucaaggaaaaagacuggaaccaagcugggccuccguaaaaaaagaucuuaucucuuacgguggcggauggcggcuacgaggguccuggaauacgggugaggaaguacaggugauagcaguggaacccggaaaaaacccuaaaaauguacaaacagcaccuggaacguuuaaaaccccugagggagaagucggcgcaaucgcauuagacuuuaaaccuggaacuucagggagucccauaguuaauagggaaggaaaaaucguuggucuauacggaaacggaguuguaacaacgucaggcacuuacguguccgcaaucgcacaagcaaaagcgucccaggaaggaccguugccagaaauagaagaugagguauuucggaagagaaaucucacaauuauggacuuacauccuggaucagguaaaacucggcgcuauuuaccggccaucguccgcgaagcuaucaagagaaaacuacgaacccuaauucuagccccaacgaggguaguagcuucggaaauggccgaagcacuaaaaggcaugccaauuagguaucagacaaccgcuguuaaaagcgaacacaccggaaaagaaauaguagauuuaaugugucaugcuacauucaccaugagacuucucucgcccguacguguaccaaauuauaauaugauuauaauggaugaagcacauuucacggacccuagcuccauagcugcaagaggauacauaucuacacgaguaggcaugggagaagcagcugcgauauuuaugacggcgacucccccagguaguguugaagcauucccacagaguaaugcaguaauccaagacgaagagcgagacauaccggaaagaucauggaauucagguuaugaguggauaacagauuuuccugggaaaacaguaugguuugugccaucuauuaaaagcggaaacgacauugcaaauuguuuacgaaaaaacgggaaacgagugauucaacugagcagaaaaacguuugauaccgaguaucaaaagacaaagaauaacgauugggauuauguagugacuacagacauaucagagaugggggcgaauuuucgagcggauagaguuauagauccacgacguugccugaaaccaguaauacuaaaggaugguccagaacgugugauauuagcuggaccaaugccaguaacuguugccucugcggcucaaagacgaggacgcauaggucgaaaccauaacaaagaaggcgaucaguauauauauaugggacaaccauuaaauaaugaugaagaucaugcccauuggacagaagcaaaaauguugcuagauaacauaaacaccccagaaggaauuauaccagcacuauucgaaccagaacgugaaaaaucugcugcaguugacggagaguacagauuaaggggggaagcacgaaaaaccuuuguugagcuaaugagacggggugacuuacccguuugguugagcuacaagguggccagugaaggguuucaauauucagauagacguuggugcuucgacggggaaagaaacaaucaggucuuagaggagaacauggauguagaaauauggacuaaagaaggagagaggaaaaaacuaagaccgaggugguuggacgcacgaacauauagugauccucuugcacuuagggaauauaaagaauuugcugcaggaagaagauccgucaguggcgacuuaauacuugaaauaggaaagcuaccucaacaucuuacccaaagagcucagaaugcacuugauaaucuuguaaugcugcauaauucugaacaaggcgguagagcauacaggcaugcaauggaggaacuuccugauacuaucgaaacauuaauguuacuggcuuuaauagcuguuuuaacugguggagucaccuuguuuuuucuaucaggaagaggacuugggaagacaagcauuggccuccuaugugucauggcuagcagcguauuacuauggauggcaagcguggaaccacauuggauagcagcaucuauuauuuuagaauuuuucuuaaugguacuguuaauaccagaacccgaucgacaacggacaccacaagauaaccaacuagcuuacgugguaaucggguugcuuuucaugauucuuacuguagcagcgaacgagaugggacugcucgaaacaacuaagaaagauuuaggaaucggccauguagcaguagaaaaccaccaucacgcagcuaugcuagauguggaucuacauccugcaucagcauggacuuuauaugcaguugcaacuaccauaauaacgcccaugaugcggcauacuauagagaacacgacggcaaauauaagcuuaacagcaauugcaaaccaagcagcaaucuuaaugggauuggauaaaggauggcccauaaguaaaauggacauuggcguaccacuacuugcuuugggaugcuacagccaaguaaauccacugacacugacugccgcaguacuaaugcucguagcccauuacgcgauaauuggaccaggauuacaggcgaaagcuaccagggaagcucaaaagagaacugcagcggggauuaugaaaaaucccacugucgacggaauugucgcaauugauuuggacccgguuguauacgacgcaaaguucgagaagcaguuaggacagaucaugcuacuuauacuguguaccagucagauauuacuaaugcguacuacuugggcguugugcgaaucaauaacacucgcugcugguccacucacaacacucugggaaggaucucccggcaaguuuuggaauacaacgauagcaguaaguauggcaaacauauuuaggggaucuuaucuagcaggcgcaggucuagcguuuagcuuaaugaaaagucuuggggguggcagaagaggcacuggcgcgcaaggugagacauuaggagaaaaauggaaacgacaacugaaccaacuuucaaaaagcgaauucaauacguacaaaagaucaggaauuauggaagucgauagauccgaggccaaagaaggccugaagagaggugaaacuaccaaacacgcgguuagucgaggaacugcaaaacuacguugguuugucgaaagaaaccuaguaaaaccugaagguaaaguaauagaccuugguuguggaagaggcggauggucauacuauugcgcagggcugaaaaaggucacggagguuaagggauacacgaaagguggcccaggacaugaagagcccauuccaauggcgacauaugguuggaaucuuguuaaacuccauuccggaaaagauguauucuuuauuccaccagaaaaaugcgauacuuuacuuugugauauaggggagaguaguccaaauccgacaauagaagaaggacguacauuacgaguguuaaaaaugguugaacccuggcuaagagguaaccaauuuuguauaaaaauacugaauccuuacaugccaagcgucguagaggcucuugagcaaaugcaaagaaagcacggcggaaugcugguucgaaauccucuaaguagaaauucaacucaugaaauguauuggguauccuguggaacggggaacaucguuagcgcgguuaacaugaccaguagaaugcugcuaaauagauucacuauggcucaccggaaacccaccuacgagagagacgucgaccucggaacaggaacgcgucacguagcuguugaaccugaaguagccaaccuagacaucauaggucaaagaauagaaaauauaaaacaugagcacaaaucgacuuggcauuaugaugaagauaacccguauaaaacaugggccuaucauggcuccuacgagguaaaaccaucagguagugcgucgucuaugguuaacggugucgugaaacuacuuaccaaaccuugggaugucauuccaaugguaacacaaauugcgaugaccgauaccacacccuuugggcagcaacgagucuucaaagaaaaagucgauacgcggacaccgaaagcaaaacgugguaccgcacaaauaauggagguaacagcaagaugguuguggggcuuucuuagcagaaauaaaaaaccucgaauuuguacgagagaggaauucacccgaaaaguucgcucaaaugccgcaauuggcgcaguauucguggaugaaaaucaauggaauucagccaaagaagcagucgaagacgaaagauuuugggaucuaguacacagagaacgagaacuucauaaacaaggcaagugugcaacuugcguauacaauaugaugggcaagcgggagaaaaaacuaggagaguucggcaaagcaaaagguucccgagcuauuugguauauguggcuuggugcaagguuucuagaauuugaagcacucggcuuuaugaacgaagaccacugguuuucgcgagaaaacucacuguccgguguagagggcgaggguuuacacaaauuagguuauauucuuagggauauuagcaagaucccuggugguaauauguaugccgacgauacagccggaugggacacacguauaacugaggacgacuuacaaaacgaagccaaaauaacugacauaauggaaccugaacacgcacuauuagcaaaagcaauuuucaagcucacauaucaaaauaaagucgucagagugcaaaggccugcuaaaaaugguacugucauggauguaaucucacgcagggaccaacgaggaagcggccaggucggcacauacggacugaacacuuuuacaaacauggaagcccaacucauacgacaaauggagucugaagguauuuucaguccgucagaacuugaaacuccuaauuuggccgaacgagcuuuagauugguuagagaaguauggaguggaaagacucaaacgaauggcuauauccggugacgauuguguagucaagccgauugacgauagauuugcaacagcacucacagcacuaaacgacaugggaaaaguccguaaagauauaccucaaugggaaccgucaaaaggcuggaaugauuggcaacaaguacccuuuugcucccaucacuuucaucaauugaucaugaaagacggaagggagauaguuguacccugcaggaaucaagacgaauuagucggcagggcacguguaagccagggugcaggauggagcuuaagagaaaccgcuugucuaggaaagagcuacgcacaaauguggcaacugauguauuuucauagaagggacuugagguuagcugcgaaugcaauuuguagugcaguuccuguggauuggguuccaacaucccguacuacguggucuauacaugcccaucaccaauggaugacuacagaggauaugcugucaguauggaaucgagucuggauagaagagaacccauggauggaagauaaaacacauauaucuucaugggaagacguaccauauuuaggaaagcgugaagaucaauggugcggcucacuaauaggauugacagcucgagccaccugggccacaaacauucaggucgcuauaaaucaagucagacgccucauaggaaaugaaaauuacuuagauuauaugauaagcaugaaaagguuuaagaacgaaagugaucccgaaggagcauugugguaa

SEQ ID NO: 21490 - RNA, 9879 nt, Artificial Sequence
  derived and/or modified CDS sequence (opt6) from DENV-1__FJ024435__SS-prME
agugucacaaugcuccucaugcuaaugccaacagcguuggcauuccacuuaacaacuagaggaggagaaccacacaugauugucaguaaacaagaacguggaaagagcuugcuuuuuaaaaccagugccgguguaaauaugugcaccuugauagcuauggacuugggagaacuaugugaagauacaaugacguauaaauguccacguauuacagaaacggaaccggacgauguugacugcuggugcaaugcgacagacacaugggugacguauggaaccuguucgcaaacaggagaacaucggagagacaaacgcucugucgcacuugcaccucacguuggucuaggacuggaaacacgaacggagacguggauguccagcgaaggagcuuggaaacagauucaacggguagaaacgugggcauuacgucauccuggcuuuacgguaacggcauuguuucuagcacacgcaauaggaacaucaauuacucaaaaaggaauaauuuuuauucuacuaauguuagugacacccucaauggcaaugagauguguagguaucggcaguagagacuucgucgaagggcuaucgggcgcgaccugggucgacgucguauuagaacacggaucaugcguuacgacuauggcuaaagauaaaccaacgcuagacaucgaauuacuuaaaacggagguaacaaauccggcuguacugagaaaacuuuguauugaggcaaaaauaucuaacacuacaacggacucacguuguccaacucaaggcgaagcuacguuagucgaagaacaagacgcaaauuucguaugucgccgcacauuuguggacaggggaugggguaacggauguggucuauuugguaaaggcaguuuaauuacuugugcgaaauuuaaauguguuacaaaauuagaggguaaaauaguacaauaugaaaacuuaaaauacucaguuauuguuaccguucauaccggggaucaacaucaaguagggaaugagagcacugaacauggaacaacggcuacgauuacaccacaagcaccuacuacugaaauacaacuaacagauuauggugccuuaacucucgacuguagcccgagaaccggauuagauuuuaaugagaugguuuuauugacaaugaaagagaaaucuuggcuuguacacaaacaaugguucuuggauuuaccacuucccuggacgagcggggcuaguacgagucaagaaacguggaauagacaagacuuguuaguaacauuuaaaacugcccacgcuaagaaacaagaagucguaguuuuaggaucacaagaaggggcaaugcauacagcucucacaggggcaacggaaauucaaacaaguggaacaaccacuauauuugcaggacauuuaaaauguaggcuuaaaauggacaagcugacauuaaaaggaaugucuuacguaauguguacagguaguuuuaaacuagaaaaagaacuugccgagacacagcacgggacaguauuaguacaaaucaaauacgaggguacagacgcuccaugcaaaauuccguuuucuacccaagacgaaaagggugucacucaaaacgguagacuuauuacugcaaauccaauaguuacagacaaggagaaaccgguuaacauugaagcggaaccaccauuuggagaguccuacauugucauaggagccggugaaaaagcguuaaaauuaucuugguuuaagaagggcucuaguaucgguaaaauguucgaagccacugcacgaggagcaaggagaauggccauacucggggauacagcaugggauuucggcucgaucgggggaguguuuacuucgguaggcaaauuaguacaccaaauauuuggaacagccuacggaguucuauuuuccggaguuagcuggacaaugaaaauaggaauaggcguccuauugacaugguuaggucuaaacagcaggucaacgagucuaucaaugacuugcauagcaguaggccuuguaacuuuauauuugggggugaugguacaagcagacucuggaugcguaauuaauuggaaaggaagagaacuaaaaugugguucaggaauuuucguuaccaaugaaguacauacauggacugaacaauauaaauuucaagcugauucaccuaaacgcuuaagugccgcuauugguaaagccugggaggaaggaguuugugguauacgaucagccacaagacuggaaaauauuauguggaaacaaauaucuaacgaguugaaccacauucuauuggaaaaugauaugaaauuuacgguuguagucggcgacgucgcaggcaucuuggcgcaagguaagaaaaugaucagaccccaacccauggaacauaaauauaguuggaaaucuugggguaaagcuaaaauaauaggagccgacguacaaaauaccaccuucauuauagacgguccaaacaccccagaauguccagaugaucaacgagccuggaauauuugggaaguugaggacuauggauuuggaauauuuacuacgaauauauggcucaaauuaagagacuccuacacccagguuugugaucaucgucuuaugucagcagccauaaaagacaguaaagcaguacacgccgacauggguuacuggaucgaaagcgagaaaaaugagacauggaaguuggcucgugcgucuuuuauagaaguaaagacuuguauauggccgaaaucacacacguuauggucaaauggaguucuggagucagaaaugaucauuccuaaaauuuauggaggaccaauaucacaacacaacuauagaccaggauacuucacacagacggcaggcccauggcaccuaggaaaauuagaguuggauuucgaccuuugcgaggguacaaccguaguagucgaugagcacuguggaaacagagggccuucacuuagaacaacaacagucacaggaaaaaucauuuaugaaugguguugucgaucguguaccuuaccgcccuuacgcuuuaggggcgaagauggaugcugguaugguauggaaauacgaccuguaaaggagaaggaagaaaaucuagucaagucgauggugucggccggaaguggagaaguugauaguuucagucuuggcuuauuaugcauuaguaucaugauagaggaaguuaugaggucucgguggagucgaaaaauguuaaugacagguacuuuagcgguauucuuucuccuaauugugggacaacuaacauggaaugaccuuauaagacuauguauaauggucggagcaaacgcaucagauagaaugggaauggggacgacauauuuagcucucauggcgacuuucaaaaugaggccuauguuugcuguuggacuuuuguuucgucgucuuaccucacgcgaaguccuuuuacuuacuauaggacugucacuuguagcaucuguagaacuaccuaauucguuggaagaacugggcgacggauuagcuauggggauaaugauacugaaacuauugaccgacuuccaaucucaccaguugugggcuacacuacuuucacugacauuuaucaagacaacauucucucuacauuaugcguggaaaaccauggccaugguacuuagcgucguaucacuuuuccccuuguguuuauccacuacgagucagaaaacuacauggcuaccaguuuuguuagguagcuuaggauguaagccucugacaauguuucucauugccgaaaauaagaucuggggcaggagaucauggccacucaacgaaggaauaauggcagucggaauaguuucgauacuauuaucgagcuuacuaaagaaugauguaccauuggccgggccuuuaauugccggugggauguuaauagcgugcuaugugaucucgggaucgucagcagacuugagcuuagaaaaagcggcugaaguaagcugggaagaggaagcagaacauucgggcgccucacauaacauauuaguagaaguacaagaugacgggacgaugaaaauaaaagaugaagaacgagaugauacauuaacaauacugcuuaaagcgacacuauuagccguaucuggcguguacccuuuaucaaucccagcuacucuuuucguaugguacuucuggcaaaagaagaaacaaagaucagggguucuuugggauaccccuuccccgccagaaguagagagagcugugcuagaugauggcauuuacagaaucaugcaacgcggguuacuuggacggucucaaguuggcguuggaguauuccaagaaaauguuuuucacacaauguggcauguaacuagaggagcaguauugauguaccaggguaagagauuggaaccaaguugggcgagcgugaagaaagauuugauuagcuauggcggagguuggcgauuacaaggcagcuggaacacaggggaggagguccaagugauugcaguagaaccuggcaaaaacccgaagaacguccaaacugcacccggaacuuucaaaacccccgagggugaagugggugcaauagccuuagacuuuaaaccagggacaucuggaaguccgauugucaaucgagaagggaaaauaguaggacuuuauggcaacgggguaguuacaaccagugguacuuacguaucggccauugcgcaagcaaaggcuucgcaggaggguccccuccccgagauagaagacgagguauucagaaaaagaaaucugacaauuauggacuuacauccgggguccgggaaaacuagacgauaucuaccagcaauagugagggaagcuauaaaaagaaaguuaagaacuuuaauuuuagccccgaccagaguuguagccuccgagauggcagaggcauuaaaaggaaugccaauaagauaucaaacuacagcaguaaaaucggagcacacaggcaaagaaauagucgaucuaaugugccaugcuacauucacaaugagacuauuaagcccaguuagggugccgaacuacaauaugauuauaauggaugaagcucauuucacggauccguccagcauugcagcccgaggauauaucaguacuagaguggguaugggggaagcggcugcaaucuuuaugacagcaaccccaccggguaguguugaggcauuuccacaaagcaaugcagugauccaagaugaggagcgugacauuccggaacgaagcuggaauaguggauaugaauggauuacagauuuccccgguaaaacaguaugguuuguuccaucaaucaaaucagggaaugacaucgccaauugucuaaggaagaaugggaaaagggugauucaacuuuccaggaaaacuuucgauacagaguaucagaaaacgaaaaacaaugacugggacuauguuguaacuacagauauaucagaaaugggagccaacuucagagcugauaggguaauagacccgagaagauguuugaaaccaguaauucuaaaagacgguccagaacgagucaucuuggcugggcccaugccuguuacuguugccucagcagcacaaagacggggaagaauuggccgaaaucauaauaaggaaggggaucaauacauauauaugggacaaccuuuaaauaacgacgaagaccacgcgcauuggacagaagcuaaaaugcugcuugauaacauaaauacaccugaaggaauuauaccagcgcuuuucgagcccgaacgagagaagagugccgcaauagauggcgaauacagacuuaggggugaagcacgaaagacguuuguugagcuaaugaggagaggugauuuaccaguuugguugagcuauaagguugcaucagaagguuuucaauauucagauagacgaugguguuucgacggcgaaagaaauaaccaaguucuagaagagaacauggauguugaaauuuggacaaaggaaggagaacgcaaaaagcugaggcccagaugguuagaugcuaggacuuacuccgaucccuuagccuuacgugaauuuaaagaguucgccgcaggaagacguucuguaagcggagauuuaauccuugaaauaggcaaauuaccgcaacaucuuacucaaagagcucagaacgcacuagauaauuuaguaaugcuacauaauagcgagcaagguggcagagcuuauagacacgcgauggaggaauuaccggauacaauagaaacucugaugcuccuagcccugaucgccguccuaacuggaggggugacucucuuuuuccuaucgggacgugguuugggcaaaacuucuauuggcuuacucugcguuauggccucaaguguacuauuauggauggccucaguagaaccucauuggaucgcagcaucgauuaucuuagaguucuuucuaaugguucugcucaucccugaacccgacagacaaagaacgccccaagacaaucagcuugcguacguugugauaggguugcuuuuuaugauauuaacgguagcagccaaugaaaugggucuccuggagaccacuaagaaagaucucggcauaggacacgucgcugucgaaaaucaucaucaugcugccaugcucgauguugauuuacacccagcuucugcauggacacuauacgcgguagcuacgacaauaauuaccccaaugaugaggcauaccauugaaaacacaacagcuaacauauccuugacggcaauugccaaucaagccgcuauacuaaugggccucgauaaaggguggccuauaagcaaaauggacauuggaguaccacuguuggcccuuggaugcuauucccaaguaaauccguuaacucuuacagcagcugugcuaaugcuaguagcacauuaugccaucauaggaccagggcuccaggcaaaagcgacuagagaagcacaaaagcguacagcagcgggcaucaugaaaaacccuacgguagacggaauuguagccauagauuuagauccgguuguauaugacgccaaguucgaaaaacaacucgggcaaauaaugcuucuaauauuauguacaucccaaauucuacuaaugaggacaacuugggcacuaugugagucaauaacauuagcuacuggacccuuaacaacacuaugggagggaaguccggggaaauuuuggaacacuacuauugcaguaucuauggcuaauauauuccgcgggaguuacuuagccggugcagggcuagcauuuaguuuaaugaaaaguuugggaggggguagaagagggacgggcgcucaaggagaaacccugggugaaaaauggaaaagacaauuaaaucagcuaucaaaaucugaauuuaacaccuacaagcggucugggaucauggaggucgauagaagugaagcuaaggaagggcuuaaacgaggggaaaccacgaaacaugccguuuccaggggcacagcaaagcuacguugguucguagaaaggaaucuagugaaaccagaaggaaaaguuauagaucuaggauguggaaggggaggguggucuuacuacugcgcaggccuuaagaaggugaccgagguaaaagguuacacgaaaggaggaccaggacaugaggaaccuauaccaauggccacguacggauggaauuuaguuaaacuucacucaggcaaagacguuuucuucaucccgcccgaaaaaugugauacacugcuaugugauauaggugaaucgaguccaaacccaacuauugaagaggguagaacacugagaguacugaaaaugguugaaccuuggcuuagagguaaccaguucuguauuaaaauacucaaccccuauaugccauccguaguugaaacacuagaacagaugcagagaaagcacggagguauguuggugcgaaacccauuaucaagaaauaguacacacgaaauguacugggugucaugcggaacaggaaacaucguaucugcaguaaauaugacaucccgaauguuacugaaucguuucaccauggcccaccgcaaaccaacguaugaaagagauguagaucucggagccggaacacgacauguagcgguagaaccagaaguugcuaacuuggauauaauuggucagagaaucgaaaacauuaagcaugaacauaaaaguacauggcauuacgaugaggacaacccauacaaaacgugggcauaucacggauccuacgaagugaaaccaagcggcucagccuccuccaugguaaaugggguugugaaacuauuaaccaaaccaugggauguaauacccaugguaacacagauagcaaugacagauacaacgccuuucggucaacaaagaguauucaaggaaaaaguggacacaaggacuccgaaagcgaaacgagguacagcccaaaucauggaaguuacugccaaauggcucugggguuuucuaaguagaaacaagaaaccgcgcauauguacuagagaagaguucacucgcaagguucguaguaacgcagcaauuggcgcgguuuuuguagacgaaaaccaauggaacucagcaaaagaagcagucgaagacgaacgauucugggaccugguacaucgagaacgagaauuacacaaacaagguaaaugugcaacaugcguauauaauaugaugggaaaaagagaaaagaaauuaggagaguucggaaaagcgaaaggaagucgagcuauaugguauaugugguuaggagccagguuucuugaauuugaagcauuaggauuuaugaacgaggaccauugguuuucccgcgagaacucacuuuccgggguugaaggcgaaggccugcacaaauuaggcuacauacuacgagauauaaguaagauaccaggagguaauauguaugcagaugacacugcgggaugggacacucgaauaacagaagaugaucuccagaaugaagcaaggaucaccgacauuauggaaccagaacaugcauugcucgcaaaaucaauuuuuaaguuaaccuaccaaaauaaggucguucgagugcaacggcccgcuaaaaaugguacagucauggacguuaucucgaggagagaccagagagggucaggacaaguuggaaccuauggcuugaauacuuuuacaaauauggaagcgcaacucauuagacaaauggaauccgagggaauauuuucuccuucagaguuagagacgcccaauuuggcggaacgcguacuagacuggcuggagaaauacggcguagagcgccuaaaaaggauggcuauauccggagaugacuguguuguaaaaccaauugaugaccguuuugccacagcgcugaccgcucugaaugauauggggaaaguaaggaaagauaucccucagugggaacccucuaaaggguggaacgauuggcaacaaguaccguuuugcucucaccacuuucaucaacuaauuaugaaagauggcagggaaauaguagugccuugccguaaucaggaugagcuagucgggagagcacguguaagccaaggugcgggauggucauugcgggaaacggcaugucuugggaagaguuaugcucaaauguggcaacuuauguauuuucacagaagggauuugcgauuagcagcaaaugcaauauguagugccgucccaguugauuggauaccuaccagccguacaacauggucuauacacgcacaucaccaauggaugacuacggaggauaugcuaucaguauggaacagaguauggauagaggagaacccuuggauggaagauaaaacacauauaagcucauggggcgacgugccuuaccuuggaaaacgcgaagaucaaugguguggcagccuaauaggccuaaccgcucgagcaacuugggcaacaaauauacaaguugcuauaaaucaagucagacgacuuauaggaaaugaaaacuauuuagauuauaugacuagcaugaaacgauucaaaaaugagucagacccagaaggcgcauugugguaa

SEQ ID NO: 21491 - RNA, 9879 nt, Artificial Sequence
  derived and/or modified CDS sequence (opt6) from DENV-1__FJ024436__SS-prME
ucaguaacaaugcuccuuaugcuaaugccgaccgcacuugcuuuucauuuaacaacaagagguggagaaccacauaugauaguaagcaaacaagaaaggggaaaaucuuuacucuuuaaaacaagugcuggaguaaacaugugcacccuuauagcaauggauuuaggagaauuaugugaagacacaaugacuuauaaauguccccguauaacggaagcggaaccugaugacgucgauuguugguguaaugcaaccgauacauggguaacauauggaacauguucucaaaccggugaacauagacgagauaaaaggaguguagcauuggcaccgcaugucggucuaggucuugaaacaagaaccgaaaccuggaugaguagugaaggggcauggaaacaaauacaacggguggaaacaugggcucucagacaucccggauuuacuguaauugcacuauuuuuggcacacgcaaucggaacgaguaucacacaaaaaggaaucauauucauauuauuaaugcuaguuacaccaucaauggcuaugcgaugugucggaaucgguucaagggacuuugucgaggguuugucuggugcaacuuggguugacguugucuuggagcacggaaguuguguaacaacaauggccaaagauaaaccgacucuagauauagaacuauuaaaaacugaagucacgaauccugcaguacuaagaaaacuaugcauagaagcaaaaaucaguaauaccacaacagauucgagaugcccgacacaaggagaagcaacauuaguggaagaacaagaugccaauuucguaugucguagaacuuuuguggaucggggauggggaaacgguugcggacuauuuggcaaaggaucauugauuacaugugcaaaauucaaaugcgugacaaaacuagaaggaaaaauaguacaauaugaaaacuuaaaauauucaguaauugugacaguacacacuggggaccaacaccaaguugggaacgaaaguacagaauacggaaccacggccacaauaacaccacaagccccaucaacugaaauacaauuaacugauuauggagcacuaacacuagauugcucaccuagaacaggauuagauuucaaugaaaugguacucuugacgaugaaggagaaaucuuggcuuguacauaagcaaugguucuuagacuugccguugcccuggacaaguggugccucgaccagccaagaaacauggaacagacaagaucuguuaguaacauuuaaaacugcacaugcaaagaaacaagaaguuguaguccucggaucgcaagaaggagccaugcauacagcucuaaccggugcgacugaaauacaaacgucaggaacuacgacuauuuuugccggacaucuuaaauguagauugaaaauggauaaauugacauuaaaagguaugucuuacgucauguguacaggcucguucaaacuggaaaaagagguagcugaaacacagcauggcacagugcuaguucagauaaaauacgaaggaacugaugcaccuuguaagaucccuuucaguacacaagaugaaaaaggaguaacgcaaaacggaagguuaauaacagcaaauccgauaguaacugacaaggaaaaaccaguuaacauagaagcggaaccgcccuuuggcgaaucauacauagugaucggcgccggggagaaggcuuugaaauuauccugguuuaagaaagguucuaguauugguaaaauguuugaagcuacagcacgcggagcacgaaggauggcuauauuaggagacaccgcuugggauuuuggcaguauuggggguguuuuuacgucaguagguaagcuagugcaccaaauuuuuggaaccgcauacgggguguuauuuucggggguuucguggacaaugaaaauagggauaggcguacuucuaacaugguuagggcuaaauagcaggaguacaucauuaagcaugacguguauugcgguuggccuaguuacuuuauacuuaggagugaugguucaggcugauaguggaugcguaaucaauuggaaaggucgggagcuaaaauguggauccggaauauuuguuaccaaugaaguucauacauggacugaacaguacaaauuccaagccgauagcccuaaacguuugagcgcugcuauuggcaaagcaugggaugagggaguauguggaauaaggucagcuacacgauuagagaauauaauguggaaacaaaucaguaacgaauuaaaucacauacuacuggaaaacgauaugaaguuuacaguugucguuggggacguugcugguauucucgcucaaggcaagaaaaugauacguccacaaccgauggaguacaaauacucauggaaaucauggggaaaagccaaaauuauaggagcagacguucaaaacacaaccuucaucauugauggaccaaacaccccagaguguccggaugaccaaagggccuggaacauaugggaaguugaagauuaugguuuuggaauuuuuacaacuaauauaugguuaaaauuaagggauaguuacacgcaaguaugcgaccauaggcuaaugucggccgcuauaaaagacucuaaagcagugcacgccgauauggguuauuggauagagucagagaaaaaugaaacauggaaauuagcgagagccagcuuuauagaaguuaaaacaugcauauggcccaaaucacacacccuuuggaguaauggggugcuugagagcgaaaugauaauuccaaaaauauauggaggaccaauuucacaacauaacuacagacccggcuacuuuacucaaacagcaggaccguggcacuugggaaaauuagagcuagauuuuaacuugugcgaaggaaccacggucguaguggaugaacacugcggcaaucgggguccaagccucagaacaacgacgguuacagguaaaauaauucaugaaugguguugcagguccugcacguuaccaccacugagauuuaaaggcgaggacgguuguugguauggaauggagauaagaccugucaaagaaaaagaagaaaaucuagugaagucuauggugagcgccggauccggugaagucgacucuuuuucccuaggacucuuaugcauaucuauuaugauugaagaggucaugaggucuagguggaguagaaaaauguuaaugacaggaacauuagcuguguuuuucuuacucauuaugggccaauuaacauggaaugacuugaucagacuaugcauaauggucggcgcgaaugccuccgacaggauggguauggggacaacuuaucuagcccugauggcgaccuuuaaaaugaggccuauguuagcaguagggcuacuauucagaagacuuacguccagggaagugcucuuauugacaauagggcucucacucguugcuuccguugaacucccuaauagucuugaagaauugggcgacgguuuagcuaugggaaucaugauucucaaguuguugacagacuuucaaucucaccaauuaugggccacacugcucagucuaaccuucauuaaaacuacauauaguuugcauuacgcuuggaaaacuauggcaaugguauuaucgauaguaucauuauuuccacucugccuaucgacgacaucccagaaaaccacauggcuacccguucuacuaggcucccuagguuguaaaccauuaacuauguuuuuaauugcagaaaacaaaauuuggggaaggaaauccuggccucuaaacgagggaauaauggcaguagguauaguuucuauccuccuuuccucauugcugaaaaacgacguuccauuagcugguccauugauagcaggcgguaugcucauugccugcuacgucaucucagguucgagugcugaccuaaguuuagagaaagcagcugagguaucuugggaagaagaagcugaacauucuggcgccucucacaacauccuagucgagguucaggacgaugggacuaugaagauaaaggaugaagagagagaugacacgcuaaccauauuacucaaagcaacgcuacuggcuguuucuggaguauauccuuuaaguauucccgcuacucucuucguaugguauuuuuggcagaagaagaaacaacguagcgguguacucugggauaccccaucaccuccggaaguagagcgcgcuguucuagaugacggaaucuaccgaaucaugcaaagagguuuacuaggccguucccaaguuggaguagguguuuuccaggagaaugucuuccauacgauguggcacguaacaaggggugcgguauuaauguaucaaggcaagcgguuggaaccuuccugggcaaguguuaagaaagacuuaauuagcuacggaggcggauggaggcuacagggaaguuggaauacaggagaagaaguacagguuauagcuguugaaccuggaaagaaucccaaaaacguccaaacagcgccaggaaccuucaaaaccucugaaggagagguuggugcgauagcauuagacuucaagccagguacgucuggaucuccaaucgucaaccgcgaagguaaaauugucgguuuguacggaaacgguguaguuacaaccagcggcacuuaugugucugcuaucgcccaggcuaaagcaucacaagaggguccccuuccagaaauagaaaaugaaguuuuuagaaaaagaaaucucacgauuauggauuuacacccuggaaguggcaagacacgacgguaucuaccggcuauaguacgugaagcuauaaaaagaaaacuacguacgcuuauacuagcccccacucgagucguagcuuccgaaauggcugaagcucuuaaagguaugccaauaagguaccagacaacagccgucaaaucagaacacacaggcaaagagauuguugauuuaaugugccaugccaccuuuacgaugcgacucuuaagcccgguuagaguuccuaauuauaauaugaucauaauggaugaagcacauuucacugacccuagcucaauagcugcgcgugguuacauuagcacaagaguuggcaugggagaagcggcggcuauuuuuaugacagcaacacccccaggcagcguagaagcauuuccacaaucgaacgcagucauacaggacgaggaaagagauauuccugagagaaguuggaacucggguuaugaauggauuacagacuuuccagguaaaacggucugguuuguaccuagcauaaagagugggaacgacauagcuaacuguuugaggaaaaauggaaaaaggguuauccaacuuagucgaaaaacauuugauacugaauaucagaaaacgaaaaacaaugauugggauuauguggugacaacugauauuucggagaugggagcgaauuuuagagcggauagagucaucgacccacgacggugucuaaaaccugugauacucaaagacggcccagaaagaguaauacuagcuggaccaaugccaguaaccguugccagugcugcucaaagaaggggucgaauaggccgaaaucacaauaaagaaggugaccaauacauauauaugggacagccgcuaaacaacgaugaagaucacgcucauuggaccgaagcaaagauguuacuagacaauaucaauacaccagagggaaucauaccugcauuguuugaaccggaaagagagaaaucggcagccauugauggcgaauacaggcuacgcggugaggcgaggaaaacguuugucgaacucaugcgacgcggugauuuaccgguauggcuuucauauaaaguagccuccgaaggcuuucaauauucggaucguagauggugcuuugacggagagcguaauaaccaagucuuggaagaaaauauggacguugagauauggacuaaggagggagaaagaaagaaacuaagaccccgaugguuagaugcgagaacguauucugauccucuagcauugagagaguucaaggaguucgcagccgguagaaaaucuguaucaggugaccuuauacuugagauaggaaaguugccgcagcaccuaacgcagcgugcucagaacgcccuagacaaccuuguaaugcuacauaacucugaacaaggaggaagggcguacagacaugccauggaggaacuuccagauacaauugagacucuaaugcuacuugcguuaauagccguacuaacaggaggugucacccucuucuuuuuaucggggcgaggacuaggcaaaaccucgauaggcuuacuuugcgucauggcuagcuccguauuacucuggauggcaucaguagagccucauuggauagcagccucaauaauccuagaguucuucuuaaugguauuauugauaccggagcccgacagacaaagaacuccacaggacaaucaacuugccuacguagucauaggucuguuauuuaugauauugacagucgcggcaaacgaaauggggcuccuagaaacuacuaagaaagauuuaggaauuggccacgucgcaguagaaaaccaccaucacgccgcaauguuagauguagaccuacacccggcaagugcauggacacuauaugcuguagcgacgacaauuauaacaccaaugaugagacacacuauagaaaauacaacagcaaauauaagccuuaccgcaauagcaaaccaagccgcuaucuuaaugggacuagauaaaggauggccaauuagcaaaauggauauuggaguuccccuuuuagcauugggauguuauucucaaguaaauccacuuacauugacagcggcagugcuaauguuagucgcccauuacgccauuauaggaccugguuuacaggcuaaagcuacucgugaggcgcaaaagagaacugcagcaggcauaaugaaaaacccuacggucgacggaauuguagcuauugaccuugacccugugguauaugaugcaaaauucgaaaaacaauuaggccaaauaauguuacuaauauuauguacaucgcaaauuuugcuaaugcguacaaccugggcuuuaugcgagucaauuacucuggcaaccggaccucuaaccacgcuaugggaaggcagcccaggaaaauucuggaauacaacuauugcgguaaguauggcuaacauauucagggguucuuauuuggccggagccggacucgcuuucucgcucaugaaaaguuugggaggcggcagacggggaaccggagcccaaggggaaacacuaggcgaaaaauggaaaaggcaacucaaucaguuaaguaagucagaguucaauacauacaaaagaucaggaauuauggaaguagauagaucggaagcaaaggaaggguuaaaaaggggugaaacaacuaagcacgcaguaagucgagggacugcaaaauugagaugguuuguugagagaaauuuggucaagccagaaggaaaagucauugaucucggaugcgggcguggaggcuggucauauuauugugcaggccuuaagaaaguaacagaaguuaaagguuauacaaaagguggcccaggucacgaagaacccauaccaauggcaacuuaugguuggaauuuaguuaaacuucauuccggaaaggauguauucuucaucccuccagaaaagugugauacguugcugugcgauauuggugagucuucgccaaacccgacaauagaggagggacguacccucaggguacucaaaaugguagagccaugguuaagaggcaaucaauuuuguaucaagauauugaauccguacaugccaucaguaguagaaacccuugaacaaaugcaacgaaaacauggaggaaugcuagucagaaauccauuauccagaaacucaacucacgaaauguacugggugaguugugguacagguaacauagucagugcagugaacaugaccaguagaaugcuuuuaaacagauuuacaauggcucaccgaaagccaacauaugaaagagaugucgauuugggagccggaacacgucaugucgccguagaacccgaagucgcuaauuuagauauaauugggcaaaggauugaaaauauaaagcacgaacacaagaguacuuggcacuacgacgaagacaauccauauaaaacuugggcauaccacgggaguuaugaaguaaaaccaagcgggucugccucaaguaugguaaauggaguagucaagcuauugacaaaacccugggacguaauuccaaugguaacccagauugcaaugacggacacaacaccuuuuggccaacaaagaguguucaaagaaaaggucgauacacguaccccuaaggccaagagaggaacagcacaaauaauggaaguuacggcuaaauggcuauggggguuucuaucucguaacaaaaagccucgaauuugcacacgggaagaauuuacacgcaaagugcggucaaaugccgcgauuggagcuguuuucguagacgaaaaccaauggaacuccgcaaaagaagcaguugaggacgaacgauucugggaucuaguucacagagaaagagagcuccauaaacaaggcaagugugcaacuugcguuuacaacaugaugggaaaaagagaaaagaaacuuggugaguucggcaaagcuaaaggaagccgagcgauuugguauauguggcuaggugcacgauuuuuagaauuugaagcgcuaggguucaugaacgaagaccauugguuuaguagagaaaauuccuuaaguggggucgaaggugaagggcuacauaaauuaggauacauccuuagagauauaucgaagauccccggcgguaacauguaugcggaugacacagccggaugggauacaagaauaacagaagaugauuuacaaaaugaggcaaaaauaaccgacauuauggaaccggaacacgcuuuacuugcaaaaaguauauuuaaauuaacauaucaaaacaaagucguaagaguacaacgcccugccaaaaauggcacagugauggauguaauaagccgaagagaccaaaggggcaguggccaaguagguacauauggucuaaacacauucacaaacauggaagcgcaauugauuaggcaaauggaaucagaagggauuuuuaguccuucggaauuagagacacccaauuuagcaggaagaguguuggacugguuagaaaaacauggaguugagagacuuaagcguauggccauauccggugacgauuguguggugaagcccauagaugacagguucgcaacugcucuaacagcauugaacgauaugggaaagguccguaaggauauaccccaaugggaaccgaguaaaggauggaaugacuggcaacaagugccuuuuuguucacaucacuuccaucaguuaauaaugaaggauggacgugaaaucguuguaccuuguagaaaccaagacgaguuggucggcagagcacguguaagucaaggagcuggauggagccuccgagaaacugcaugucuaggaaaguccuacgcucaaauguggcaauuaauguauuuccaccgaagagaucuucgccucgcugcuaaugcuauauguucagcaguaccaguagacugggucccuacaucuagaacuacauggucuauucacgcacaccaucaauggaugacgacugaggauaugcucucuguauggaaccgaguauggauagaagaaaauccauggauggaagauaaaacacauauauccuccuggggugauguacccuauuuaggaaaaagagaagaccaaugguguggcucccuaaucggucuaacagcccgggcuacaugggcaacgaauauacaaguugcaauaaaucagguaagacgacuaauagggaacgaaaauuacuuagacuacaugaccucgaugaaacgguucaagaacgaaucagacccugaaggugcgcucugguaa

SEQ ID NO: 21492 - RNA, 9879 nt, Artificial Sequence
  derived and/or modified CDS sequence (opt6) from DENV-1__FJ024472__SS-prME
ucuguuacaaugcuuuugauguuaaugccgacagcauuagcguuucauuuaacuacucguggaggugaaccgcacaugauaguuucaaaacaggaaagaggaaaaagccuguuguuuaaaacaagugcuggaguuaacauguguacgcucauugcaauggaucugggcgaacuuugugaagacacaaugacguacaaauguccucgaauaaccgaaacagaacccgacgacguugauuguuggugcaaugcgacagauacauggguaacguacggaacauguagccaaacaggagaacauagaagagacaaacgaucaguggcuuuagccccacauguaggucugggcuuagaaacaagaacagagacauggaugucuucagaaggggcauggaaacaaauccagcgcgucgaaacgugggcucuacggcauccaggcuuuacagugauagccuuauuuuuagcacacgcuauaggaacauccauaacacaaaaagguauuauuuuuauacuucuaaugcucguuacaccaucuauggcgaugagguguguagguauaggaaguagagauuuuguugaaggucuuagcggagcaaccuggguugauguaguccuugaacauggaucgugugucacuaccauggcuaaagauaaaccaacacuggacauagaacugcugaaaacagaaguaacuaacccagcaguuuuacguaaacuauguauugaagcuaagauaagcaauacuacaacagacucuagaugccccacgcagggugaagcgacgcuuguugaagaacaggacgcaaacuuuguaugccggcguacuuuuguggaccgugguuggggcaauggaugcggacuuuucgguaaaggaucacuuaucacuugugccaaguucaaaugcguaacgaaacuagaaggaaaaauaguucaauaugagaaccuaaaauauaguguaauagugacuguccacacuggcgaucagcaucaaguaggaaacgagucaaccgaacauggaacgacagccacaaucacaccacaagcacccacuacggaaauucaacuaacagauuauggugcucuuacauuggacugcaguccuaggacuggguuagauuuuaaugagaugguauuacucacaaugaaggaaaaaucaugguuaguacauaaacagugguucuuggaucuuccccuaccuuggacuucaggggcaucaacaagucaggagacguggaaccgccaagauuuauuaguaacuuuuaagaccgcacacgccaagaaacaggaagucgucguacuugggucucaagaaggagcaaugcauacugcguuaaccggugcgacugagauucagaccucaggcacaacaacaauuuucgcuggacacuuaaaaugcagauuaaaaauggauaagcuaacuuuaaaaggaaugagcuacguaauguguacuggaucauuuaaguuagaaaaagaacuugcggaaacacaacacggcacagucuuaguucaaauaaaauaugaagguacugaugcaccaugcaaaauacccuuuagcacgcaagacgaaaaagggguuacacagaauggacggcuaauaacagcgaauccuaucguaaccgauaaagagaagccaguuaauaucgaggcggaaccucccuucggagaaucguacauaguaauaggagcaggagaaaaggcauuaaaacuaucgugguuuaagaaaggaaguaguauagguaaaauguuugaggcaaccgccagaggagcgagaagaauggcgauauugggugacacugccugggauuuuggcaguaucggaggaguguucacaaguguuggaaaacucguacaccaaauauuugguaccgcauauggcguacuauucagcgggguuagcuggacuaugaagauugguauugguguacuucuaacuugguuggggcuaaacagucgaagcacaagccuaucuaugaccuguaucgcugucgggcuuguaacucucuaucuaggaguuaugguacaggcagacucagguuguguuauuaauuggaaaggucgagaauugaaaugcggaucugguauauuugugacgaacgaaguccacaccuggacagaacaauacaaauuucaagcugauaguccuaagagacuauccgcugcaguagguaaagccugggaagagggaguaugcgguauaaggucagccacaagauuagaaaacaucauguggaagcagauaagcaacgaacuaaaucauauuuuauuagaaaaugauaugaaauuuacgguuguagucggugacguagcggguaucuuagcgcaaggaaagaaaaugauaagaccacagccuauggaauauaaauauucuuggaaaucgugggguaaagcaaagauuauaggagcugacguacaaaauaccacauucauaauugauggaccuaauacaccugaauguccagaugaccagagggcauggaacaucugggaaguugaagacuacggcuuuggaauauuuacaacaaacauauggcuuaaauugcgcgauucguauacccaggugugcgaucaucgguuaaugucggcggcuauuaaagacuccaaggccguucacgcagauaugggauauuggaucgagucagagaaaaaugagacauggaaacuagcucgugcgaguuucauagagguaaaaacuugcauauggccuaagucccauacauuguggucaaauggaguacuggaaagcgagaugauaauccccaagauuuaugguggcccgauaagucagcauaauuacagaccaggauacuucacacaaacugcaggaccauggcauuuaggaaaacuugagcucgauuuugaccuaugcgagggcacaacaguugugguagacgaacacugugguaauagaggaccaagucucaggacaacuacaguaaccgguaagauuauacaugagugguguuguagaagcuguacucuaccgccuuuaagauucaggggagaagacggaugcugguaugguauggaaauaagaccagugaaagaaaaagaagagaaucuaguuaagucaauggugucugcagggagcggcgaagucgauucguucaguuuagguuuacuauguauaucaauaaugauagaagaaguaaugcgaucgcgauggagccgaaaaauguuaaugacuggcacuuuggcugugauauuucuacuaaucaugggucaauugacauggaaugaucucauaaggcuauguauaauggucggugcuaaugcuagugaucggaugggaaugggaaccacauaucuagcauuaauggcaacguuuaagaugcgcccuauguucgcuguaggauuguuauuccgaaggcucacaucuagagaaguccugcuucugacgauaggucugucacucguagcaucaguagaguuaccaaauucacuggaggaauuaggugacggguuagccauggguauaaugaucuugaagcuacucacugauuuccaaucccaucaacuaugggcuacuuuguuaaguuuaacuuucaucaaaacuacauuuaguuuacacuaugcauggaagacaauggcgaugguucuuucgauugugagucucuucccacuaugcuugucaacaacgucacagaaaacuacauggcuacccgugcuauuagggucucugggcugcaaaccacuuacaauguuucuuauugcugaaaauaagauuuggggacgaagaucauggccacuaaacgaagguauaauggcgguagguauaguaucuauuuugcuaaguucccuucucaaaaacgacguaccacuagcgggaccauuaauagcugggggaaugcugauagcgugcuaugugauuucaggaucaagugcagauuugaguuuagagaaagcugcugaaguaucuugggaagaagaggcggaacacucaggugcaucacacaauauccuaguugaagugcaagaugauggaacgaugaaaauaaaagaugaagaaagagacgacacacuuacgauucuccuuaaagcgacauuguuagcaguuucaggcguuuacccacugaguauuccagccacccuguucgucugguauuuuuggcaaaagaagaaacaacgauccggaguccuaugggauacuccuagcccaccugaaguagaacgugcgguacuagaugacggaaucuauagaaucaugcaacgaggacuauuagguagaucacaaguuggcgucgguguguuccaagaaaacguauuccacaccauguggcauguuaccagaggggcuguacuaauguaccaaggcaaacgucuggagccaucuugggcaagcguuaagaaagacuuaauaucuuaugguggaggauggcgcuuacaagguucguggaauacaggugaagaagugcaaguuauagcaguagaaccuggcaaaaaucccaaaaacguucagacagcgcccggaacauuuaaaacaccggaaggcgagguaggagcaauugcauuagauuuuaaaccggggacauccgggaguccaauuguaaauagagaagguaaaaucguaggcuuauacgguaauggaguagucacaacaaguggaacauacgucucggcaauagcacaagcuaaagccagccaagaaggaccuuuaccggaaauugaggaugaaguguuuaggaaaagaaaccuaacaauuauggauuuacacccugguucagggaaaacccgucgauaccuucccgcaaucgugcgagaagcaaucaaacgcaagcuaagaacucucauacuagcaccaacacgugucguggcuucagaaauggcggaggcucugaaagguaugccuauaagauaccaaacaaccgcagugaaaucugaacauaccgggaaagaaauuguagaccuaaugugucacgcgacauucacaaugagacuauuaaguccuguaagagugccaaauuacaacaugauaauaauggaugaagcacacuuuacggacccgucuaguaucgcagccagaggguauauuucaacgaggguaggaaugggugaagcagcagccauuuuuaugacggcuacuccuccggguucugucgaagcauuuccccaguccaaugcaguuauacaagaugaggagcgugacauaccagaacgcaguuggaacagugguuaugaguggauuacugacuuuccagguaaaacaguaugguuuguccccagcaucaaaucaggcaacgacauugcaaacugucugaggaaaaauggcaaacgugugauucaacuaaguaggaaaacuuuugacacagaauaucagaaaaccaaaaacaaugauugggacuacgugguaacaacagauauuagcgagaugggugccaauuuccgagcagauagagucauugauccuagacgaugccuaaagccugucaucuugaaagauggaccggaacgugucaucuuggcaggaccaaugccugugacgguagcauccgcggcgcagagacgagguaggauuggccgaaaucauaacaaagaaggagaccaguacauauauaugggacaaccucuuaacaaugacgaagaccaugcgcauuggaccgaagcgaaaauguuacucgacaacauaaauacucccgaaggcauaauacccgcucuauuugaaccagaaagagagaaaagcgcugcaaucgacggagaauaucggcucagaggggaagcacggaaaacauucguagagcucaugcggaggggugaucuaccggugugguugucauauaaaguugcaucugaggguuuccaguauucagaccgacgcuggugcuuugacggggaacgaaauaaucaaguguuagaggagaauauggauguugaaauuuggacuaaggaaggugaacgcaagaaacuuaggccgagguggcuugaugcgcgcaccuauuccgacccucuggcauugcgggaauuuaaagaguuugcggcuggacgacgcagcguuucgggcgaccuaauacuagaaauaggaaaauuaccacaacacuuaacacaaagggcccaaaaugcacuggauaacuugguuaugcuucacaauucggaacagggaggccgcgcauaucgucaugccauggaagaauuaccugauacaaucgaaacucuaaugcuacuagcccugauagccguauuaaccgguggcgugacauuauucuuucugucugguagaggacuuggaaaaacaaguaucggguuacuuuguguaauggcgagcaguguuuugcucuggauggcaagcguugaaccacauuggauagcugcgucuauaauacuagaguucuuuuugaugguauuacugauaccagaaccagacagacaaagaacaccgcaagauaaccaacuugcauacguuguaauaggucuacuauuuaugauacuaacaguagcugcuaacgaaauggguuuacuagaaacuacuaagaaagaucucggaauaggacacguagcuguagagaaucaccaucaugcagcaauguuagauguagaccuacacccggcgagugcguggacacucuaugccguugcaaccaccauuauaacgccgaugaugaggcacacaauagagaauacuacagcaaacaucagucugacagcgauagcaaaccaagccgcuauauugaugggauuagauaaagguuggccgauaucuaaaauggauaucggcgugccucuuuuagcuuuaggaugcuauucacaggucaauccccuaaccuuaacagccgccguguuaaugcugguugcacacuaugcaauaauuggcccaggacuacaagccaaagcgacgcgugaggcucaaaagcggacugcggccgggauaaugaagaauccgacaguagacgguauaguggcaauagaucuagauccaguaguguaugaugcgaaauuugagaaacaacuaggccagauaaugcuccuaauccuauguacaagccaaauacuccugaugaggacaacgugggcauugugugagaguauaaccuuagccacgggaccauuaacuacuuugugggaggguucuccggggaaauuuuggaacacuacaaucgcaguauccauggcaaauauauuucgaggcucauauuuggcaggagcgggacuagcauucucucugaugaaauccuugggaggaggcagacgagguaccggggcgcagggagagacccuaggagagaaauggaagagacagcuuaaucaauuaagcaaaucagaauuuaauacuuauaaaaggagcgggauaauggaagucgaucgaucagaagccaaagaaggguugaagcggggagaaacaacuaaacaugcaguaucaagaggaaccgccaaacuccgaugguuuguugaacgaaaucuagucaaaccugaaggaaaaguaauagaucuuggaugcggaagagguggauggaguuauuacugugcaggcuugaaaaaggugacggaaguaaaaggauacacgaaaggagggccaggacaugaggaaccaaucccaauggcuacguacggcuggaaucugguaaaacuucacagcggaaaagauguauucuuuauaccaccagagaaaugcgacacgcuucuaugugauauuggugaaucuucaccuaacccgacgauugaagaggguagaacucuacguguccuaaaaaugguugaaccuugguugaggggcaaccaauucuguauaaaaauacuuaauccauauaugccuucugucguggaaacacuagaacaaaugcaacguaaacauggaggaauguuggugcgcaacccauugucgaggaacagcacacaugagauguauugggucucuugcggaacuggaaauauuguuucugcuguuaauaugaccucacguaugcuccugaaucgauucaccauggcacauagaaaaccaaccuacgaacgugacguugacuuaggugcaggaacaagacauguugcagucgaaccagagguagcaaauuuagacauuauuggucagcggauagagaacaucaagcacgagcacaaaucgacuuggcauuacgaugaagauaacccuuacaaaaccugggcuuaccauggaaguuaugaaguaaaaccgaguggaucggcuaguucaaugguuaauggagucgugaaacuacugaccaaaccaugggaugugauaccaaugguaacucaaauagcgaugaccgauacuaccccuuuuggucaacagagaguauuuaaagaaaaaguugauacuagaaccccuaaagcuaagcgaggaacggcucaaauuauggaagugacugcaaaauggcuauggggguuccucucaagaaauaagaaaccuagaauauguacucgagaagaauuuacuaggaaaguacgaucuaacgccgcuauaggcgcuguauucguagaugaaaaucaauggaacagugcuaaagaagcuguugaagacgaaagauucugggaucuugugcauagggaaagggaauuacacaaacaaggaaagugugcaaccugcguuuauaauaugauggguaagagagagaaaaaguuaggagaguuuggaaaagcaaaagguagcagagcaaucugguauauguggcuuggcgcgcgcuuuuuagaauuugaagcacuaggauuuaugaaugaagaucauugguuuagcagagagaacucccuauccgguguggagggggaaggauuacauaaauuaggcuacauacuccgagauaucaguaaaauaccagggggaaauauguaugcagaugauaccgcagguugggauacacgcauuacugaggaugauuugcaaaacgaggccaggauuacagauaucauggaaccagaacacgcgcuguuagcaaaaaguauauuuaaacugacguaccaaaauaaagucgugcgcguacaacguccagccaaaaacggaaccgugauggaugugauuucaagaagagaccaaaggggaagcggacaaguugguacuuauggccuaaacacauucacuaacauggaagcacagcugaucagacagauggaaagugaaggaaucuucagcccaagugaguuagaaacacccaacuuagccgaaagaguucuugacuggcuggagaaauacgguguugagagacuuaaaagaauggcaauaucgggagaugauugcgugguuaaaccuauagaugauagauuugcaaccgcauugaccgcguugaaugacaugggcaaaguaagaaaagauaucccgcaaugggagccaucaaagggauggaaugauuggcaacaggugccauuuugcucacaucacuuucaucaauuaauuaugaaagacggacgagaaaucgugguaccuugcagaaaucaagacgagcucguugguagagcccgagucucccagggcgcaggguggagcuuaagagaaacagcuugccugggaaaaagcuaugcacaaauguggcaacucauguauuuucauagaagggaucuaagguuggccgcaaacgccauauguucugccgucccaguagauuggauuccuaccuccagaacaacauggucgauccaugcacaucaucaguggaugacuaccgaagacaugcuaucaguauggaauagaguuuggaucgaagaaaaucccuggauggaagauaaaacucauauuaguucguggggcgacguuccauauuuagguaaacgagaagaucaauggugcggaagucuaaucggucucacagcaagagcuacaugggcuacaaauauacagguggcaauuaaucagguaagacgcuugauugggaacgagaauuaccuagauuacaugacgaguaugaaaagguucaagaaugaaucugacccggaaggggcccuuugguag

SEQ ID NO: 21493 - RNA, 9879 nt, Artificial Sequence
  derived and/or modified CDS sequence (opt6) from DENV-1__FJ024439__SS-prME
aguguuacuaugcuuuuaauguugaugccgacugcucuagcauuccauuuaacgacucgugggggagagccgcacaugaucgucucaaaacaagaaagagggaaaucccuauuguucaaaaccagugcuggcgucaauaugugcacuuuaauagcuauggaccuaggugaauugugugaggauacuaugacguacaaauguccaagaauaaccgaaacagagccugaugauguggauugcugguguaacgcgaccgauaccugggucacauacgguacuugcucccaaacuggagagcaucgaagggauaaacgcucggucgcccuagcaccucacgucggauugggucuggaaaccagaacagaaaccuggaugaguagugagggggcuuggaaacaaauacaaagaguugagaccugggcccugcggcauccugguuuuaccguuauagcauuguuccuagcgcaugcaauugguacaaguauaacucagaaaggcauaauauuuauauuacuaauguuagugaccccgucgauggcuaugagaugcgucgguaucggcucuagagacuuugucgaaggauugagcggagcuacguggguugacguaguacuugaacauggcaguugcguaacuacaauggcaaaagacaaaccgacccuugacauagaauuacuuaaaacagagguaacuaauccagcaguacuacgaaaauuauguauugaagcgaaaauaagcaauacaacaacagauagucgcuguccgacacaaggugaagcaacgcuuguagaagaacaagaugcaaacuucguuugucgaaggacauuuguugauagggguugggguaauggauguggccuuuuugguaaaggcagccugauuacgugugcuaaauuuaaauguguaacgaaauuggaagggaaaauugugcaauacgaaaacuuaaaauauuccguaauaguaacaguucauaccggugaucagcaccaaguuggcaaugaaagcacagaacacggaacaacagccacgauaacuccccaagcuccgacaacugaaauacagcugacggauuacggugcauuaacccuugauuguaguccaagaacaggauuagauuuuaaugaaaugguacuauugaccaugaaagaaaaaucuuggcuuguucauaaacaaugguucuuggauuuaccccuccccuggacaaguggggccaguaccagucaagaaacuuggaauagacaagacuuacucguaacuuuuaaaacggcucaugccaagaaacaggagguaguagucuuaggaagccaagaaggagccaugcacaccgcacuaacaggagcaacggaaauacaaacaucaggcacuaccacuauauuugcuggacaccucaaauguagguuaaaaauggauaaguuaacacuaaaaggaaugucguacguaaugugcacaggcucauuuaaauuagaaaaagagguagccgagacccaacaugguacuguauuaguacaaaucaaauaugaagggacagaugcucccugcaaaauaccauuuucaacucaagacgaaaaaggcguuacgcaaaauggacgucuaauaacugcaaaccccauaguaacagauaaagaaaaaccaguaaacauugaagcugagccuccguuuggagaaagcuauauaauuauaggagcuggagaaaaagcgcuaaaacugaguugguuuaagaaaggaucaucuauugggaaaauguuugaggcaacugcaagaggcgcacgucgaauggcuauauugggugacacagcgugggacuuuggaucaaucggagguguuuuuacgucaguuggaaagcuaguccaucaaauuuucgguaccgcauacggugugcuguuuaguggggugucauggacaaugaaaauagggauaggagugcuccugacauggcuggguuuaaauucaagaucuacaaguuuuaguaugacauguaucgccgucggacugguuacacuauacuuaggggucaugguucaagcagauagcggaugcguuauuaacuggaaaggccgggaacuuaaaugcggcagcggaaucuuugugacaaacgaagugcauaccuggacugaacaauauaaguuucaagccgacucaccaaaaagguugagcgcagcuauugguaaagcaugggaagaagguguuugcgguauuagaagcgcaacaaggcucgaaaacauaauguggaaacagauuuccaaugagcuaaaucauauacuucucgaaaaugauaugaaauuuacaguuguaguuggagauguggcggguauuuuagcucaaggcaagaaaaugaucagaccacagccuauggaguacaaauauuccuggaaaagcuggggaaaagccaaaaucauuggggcagacguucaaaauaccacuuuuauaauagaugguccaaauacacccgaauguccagaugaccagagagcuuggaauauaugggaaguugaggauuauggcuuuggaauauucacgacaaacaucuggcuaaaauuaagggauucguauacccaaguuugcgaucaccgauugaugucugcggcuauaaaagacaguaaagcaguccacgcagacauggguuacuggaucgaaagugagaagaacgaaacauggaaauuagcaagagccagcuucauagaaguaaaaacaugcauauggccaaaaucucauacccuuuggaguaacggaguuuuagagucugaaaugauuaucccaaaaauauacggcggaccaaucucgcaacauaauuauagacccggauauuucacacagacagcaggaccauggcauuuaggaaaauuagagcuggacuucgaucuuugcgagggaacaacaguugucguugaugaacacuguggaaacagaggaccaagucuacggacuacuacgguaacagggaagauaauacaugagugguguugcagaucuuguacgcuaccuccacugcgcuuccgaggagaggauggcugcugguauggaauggaaauuaggccuguaaaggagaaggaagaaaacuuggugaaaucgaugguaagugcgggguccggagagguugacuccuucucucuuggauuauuauguauaucuaucaugauagaggaaguuaugcguucaagauggucgagaaaaauguuaaugacaggaacacuugcgguauucuuucuucugauaaugggccaacugacauggaaugaccuaauuagguuauguauaaugguuggcgcuaacgcuuccgaccguaugggaaugggcacaacauaccuggcauugauggcaaccuuuaagaugaggccaauguucgcgguaggguuacuauuccgaagacuaaccuccagagaaguauuguuacuaaccauagguuugucccuugucgccucaguagaacugccaaauucacuagaagaauuaggcgauggucuugccaugggaaucaugauacuuaaacuauuaacggacuuccaaucacaucaacuuugggcaacuuuacucagcuugacguuuauaaagacaacauucucucuucacuaugcauggaaaacuauggcaaugguguuaaguauuguaucucucuucccgcugugcuuaaguacgacuagccagaaaaccacauggcugccaguguuauugggaucccuugguuguaaaccccuaacaauguuuuugauagcugaaaauaagaucuggggccgucguagcuggccccuaaacgaggggaucauggcuguggguauagugucuauucuccuaucaaguuugcuaaagaaugauguaccacuagccggcccccucauugcaggagguaugcucauagcaugcuauguuauuagcggaucuucugccgaccuuagucuugaaaaagcugcugaaguuucgugggaagaagaagcagaacacuccggagccagccacaauauacuuguugagguccaagacgacggaacaaugaaaauaaaagaugaagaaagagaugauacgcugacaauuuuguuaaaagcgacauuacuggcgguaucuggcguuuaccccuuaucgauucccgcuacuuuguuuguaugguauuucuggcagaagaagaaacaacguucaggagucuuaugggacacaccaucuccacccgaagucgguagagcaguauuagaugacggaauuuacaggaucaugcaacgggggcuucuuggcagaucacaaguggguguagggguuuuccaagaaaauguauuccacacaauguggcacgugacuagaggagcuguacucauguaucaaggaaaacggcucgaaccgucaugggcgaguguuaagaaagaucugauaucauauggaggaggauggcgacuacaagguucuuggaauacaggcgaagaaguucaagugauagccgucgagccaggaaagaauccuaaaaacguacaaacagcgcccggaacauucaagacgccugaaggggagguaggagcaauugcauuagacuuuaaaccagggacgucugguagcccaauagucaaucgugaggggaaaaucgucggacuguauggaaauggaguaguuacaacaucuggaacguauguuagugcgauugcacaagcaaaggcaagucaagaaggaccguugccugaaaucgaagacgaaguuuuccgaaaaaggaaucugacuauuauggacuuacacccagguaguggaaagacuagaagauaccuaccagcaauaguucgugaagcaaucaaaaggaaauuaagaacgcucauacuggccccgacaaggguaguggcuuccgagauggcagaggcacuaaaaggaaugccgauuagauaucaaacgacagccguaaaauccgaacauacagggaaagagauaguugaccuaaugugucaugcaaccuucacaaugagauuguuaucuccagugagaguaccaaauuacaauaugaucauuauggaugaagcucacuuuacugauccuuccagcauagcggcccguggcuauauaagcacacgaguuggcaugggugaagcugcagcaauauucaugacugcuacaccaccagguucagucgaggcuuucccucagagcaaugcaguuauacaagaugaagaaagagauauucccgaaaggaguuggaauagugguuaugaauggauuacggauuuccccgguaaaacaguuugguuuguucccucuauuaaaagugguaaugauauagcgaacuguuugaggaaaaacgguaaacguguuauucaacuuucuagaaagacauuugauacggaauaucagaaaacgaaaaauaaugacugggacuaugucgugaccacagauaucagugaaaugggagcuaauuucagagcagaucgaguuauugauccaagacgauguuugaaaccaguaauucugaaagacggccccgagagagucauuuuagcggguccaaugcccgugacaguagcaucagcagcacaacgacgcgguagaauaggcagaaaucauaauaaagaaggggaccaauacauauauaugggacaaccucuaaacaaugaugaagaucaugcacauuggaccgaggcgaaaauguuguuggauaauauuaauacuccagaagguauaauaccagcauuauucgagccggaacgagaaaagucagcagcaauagauggagaguacagacuaagaggagaggcacguaaaacauuuguggagcugaugcgucgaggggacuugccaguguggcuaucuuacaaggucgcaagugaagguuuccaauauucggauaggcgaugguguuuugauggcgagaggaauaaucaagugcuagaagagaacauggauguagaaauauggacuaaagagggagaaaggaagaaacuaagaccucguugguuagacgcgcggaccuauucagauccgcuugcgcuucgagaauuuaaagaauuugcugccggaagaagaaguguaucuggggaucuaaucuuagaaauaggaaaacucccacagcauuuaacacaacgggcgcaaaacgcuuuagauaaucuaguaaugcuccauaauagugaacaaggugguagagcguaucgccaagcaauggaagaguuaccagauacaauagaaacucugaugcuacuugcauuaauugcaguauugacaggaggagugacauuauucuuucucaguggacgagggcuaggaaagacuucaauuggauuauuguguguaauggcgucuucuguccucuuauggauggcuuccguggaaccacacuggauugcagcuucaauuaucuuagaguucuuucuaauggucuuguuaauaccggaaccagacagacagagaacaccucaggauaaccaauuagcauaugucguaauaggauuacucuuuaugauacuaacuguagcggcuaaugaaauggguuuacuagaaacaacuaagaaagaccuagggauaggucacguagcggucgaaaaucaucaucacgcugcuaugcuggauguugauuuacauccggcaucugcauggaccuuauaugcaguagcaaccacuauuaucacuccuaugaugagacauacaauagaaaauacaacugcuaauauaaguuuaacugcaauugcaaaccaggccgccaucuuaauggguuuagacaaaggguggccaauuucaaaaauggacaucggugugccacucuuggccuuggggugcuacucacaggugaauccacugacuuugacagcugcaguacucaugcuuguagcacauuaugcaauuauaggacccggacuacaagcaaaagccacaagagaagcacaaaagagaacagcggcaggcauuaugaagaauccgacaguagauggaaucguagcaauagaccuagacccgguggucuaugaugcaaaguuugaaaagcaacucggacaaaucaugcuauuaauccuguguacaagucaaaucuuguugaugcgaacuaccugggcauugugugaaaguauuacauuagcaacagguccguugacuacauuaugggaaggaaguccagguaaauuuuggaauacuacuauugcgguuaguauggcgaacauauuccgcggcaguuacuuagcaggagcugguuuagcuuuuagccucaugaaaucacuaggcggaggacgacgugguacaggugcccaaggugaaaccuuaggugaaaaauggaaaaggcaacuaaaucaguuaaguaaaucagaauuuaacaccuacaagcgaucaggaauaauggaaguagauagaucagaagcaaaagaaggauuaaagagaggagaaacaacgaaacacgcaguuucacgagguacagcgaaacugcguugguucguugaaagaaaucucgucaaaccugaagguaaggucauagauuuaggcugcggccguggcggaugguccuacuauugugcugggcucaagaaagucacggagguuaaagguuacacuaaaggaggaccgggccaugaggagccaauacccauggcgacguauggauggaacuuggucaaacuccauagcgggaaagauguauuuuucauaccaccugaaaaaugugauacauuguugugcgacauaggagaaagcucaccaaauccaacuauugaagaaggacgaacccuccgaguguugaagaugguggaaccaugguuaagggguaaccaauuuugcauaaaaauacuuaaucccuauaugccuaguguaguugaaacacuagaacaaaugcaacguaaacauggcgggaugcuuguacggaauccuuuaucaagaaauucaacccacgagauguauugggugucuugcggcacagguaauauuguaagugcaguuaauaugacaucuagaaugcuacuaaaccgguucacaauggcacaccggaaaccaacauaugagagagauguagaccucggagcaggaacacgucauguugccguugaaccggaagucgccaaucucgacauaauagggcaaaggaucgaaaauaucaaacacgagcauaaaaguacauggcauuaugacgaagauaaucccuacaaaacaugggcauaucacggaagcuacgagguuaagccaagcggaagcgccucgucaaugguaaacggugugguaaaacuuuuaacaaagccaugggacguaaucccaauggucacucaaauugccaugacagauacaacuccauuuggucaacaaaggguauucaaagaaaagguggacacgagaacuccaaaagccaaacgcggaacugcucaaaucauggaaguaaccgcgaaauggcuauggggcuuccucaguaggaauaagaaaccucguaucuguacaagagaagaauuuacacgaaaggucaggucuaacgcugcuauuggagcgguauucguagacgagaaucaauggaauagcgcaaaagaggcaguagaagacgaacgauuuugggaucuuguccaucgagaaagagaacuacauaagcaaggaaaaugugcuacuuguguauauaacaugaugggaaagagggagaagaaauugggugaauuuggaaaagcuaaagguagucgagccauaugguacauguggcugggggcacgauuuuuagaguuugaggccuuggguuucaugaacgaagaucacugguucagucgagaaaacucauuaucuggaguugaaggggagggauuacauaagcucggauacaucuuacgcgacauuuccaacauuccuggcgguaauauguaugcugaugauacugcagggugggauacaagaauaacagaggaugaccugcaaaacgaggccaggaucacugauaucauggaaccugaacaugcucuuuuggcuaaaucaauuuuuaaauuaacauaucaaaacaaaguagugagaguacaaaggccagccaaaaauggaacgguuauggaugugauuagucgacgcgaucaaagagguagugggcaaguaggaacuuacggauuaaauacauuuacgaacauggaagcgcaacugauaagacaaauggaguccgagggaauauuuagcccaucugaauuagaaaccccaaaucuagcugaaagaguacuugauuggcuugaaaaauacgggguagaaagauugaagaggauggcaauaaguggagaugauuguguuguaaagccaauagaugauagguucgcgacagcucuuacagcacuuaaugauaugggaaaagucaggaaagacaucccucaaugggaaccaucuaaaggcuggaaugauuggcagcaagucccuuucugcucacaucacuuccaccaacuaaucaugaaagacggccgugaaauaguagugccuugccgcaaccaggacgagcuaguaggacgagcacggguuucucagggggcuggauggucacuuagagaaacagcuuguuugggaaagucguaugcacaaauguggcagcugauguacuuucauagacgugauuuaagacucgccgcaaacgcaauauguagcgccguuccuguagauuggauuccaacuucacggacuaccuggaguauacaugcucaccaucaauggaugacaacugaagauauguuaucgguuuggaaucggguuuggaucgaagagaacccauggauggaggauaaaacacauaucucgaguuggggcgauguaccauaccuugggaaaagagaagaucaauggugugggaguuuaauuggucucacggcgcgugccacaugggcaacuaacauacagguugcaauaaaucaaguucgacgcuuaauagguaaugaaaauuaccuagauuacaugaccucaaugaaaagauuuaaaaacgagagugauccggaaggugcuuuaugguga

SEQ ID NO: 21494 - RNA, 9879 nt, Artificial Sequence
  derived and/or modified CDS sequence (opt6) from DENV-1__FJ024441__SS-prME
aguguaacuauguuacugaugcuuaugccuacggcguuggcauuccaccuaacgacucgaggaggggaaccccacaugauuguaaguaaacaagaaagagguaaaucacuauuauucaaaacaagcgccggagucaauauguguacucucauagcuauggaucuuggagaauuaugugaagacacuaugaccuauaaauguccgcgcauaacugaaacugaaccggacgauguagauugcuggugcaaugcuacggauacaugggugaccuacggaaccuguucucaaacgggagaacaucguagagacaaacgaaguguagcauuagcaccucaugucggauuaggacucgaaacgcggacggaaacauggaugucaagugaaggugcuuggaggcaaauacaacgaguagagacaugggcacucagacauccuggauuuaccguaauugcauuauuuuuagcucaugccauagguacaucuauaacacaaaaaggaaucaucuuuauacuguuaaugcuuguaacacccucaauggcuaugcgauguguagggauuggcucgcgagauuucguagagggccucucuggagccacaugggucgauguaguacuggaacacgguucuugugucacuacaauggccaaagauaaaccaacgcuggauauagaacuacucaaaaccgaagugacgaauccagcaguguuaagaaaauuauguauagaagcgaaaauaucaaacacuacuacagacucuagauguccuacccaaggugaagcuacccuaguagaagaacaggacgcgaauuucguuugucgacgaaccuuuguagaccgcgggugggggaacggauguggucuauucggaaaagguaguuuaauaacuugcgcaaaauucaaaugugucacuaaacuagaagggaaaaucguccaguaugagaauuuaaaauacaguguuauaguuacuguucacacaggagaucaacaucaaguuggaaacgagaguacggaacaugguacaaccgcuacgauaacaccucaagcaccaacuaccgaaauacaauugacagacuauggagcacuaacucuugauuguaguccaagaacaggacuggacuuuaaugagaugguauuauugacaaugaaagaaaaaucauggcucguucauaaacaaugguuuuuggacuuaccccucccauggacgucaggagccucgacaagucaggaaacuuggaaucgacaagaucugcuggugacuuuuaaaacugcucaugcaaagaaacaggaaguaguaguacuugggucucaagagggcgcaaugcacacugcucuaacuggcgcuacggaaauacaaacaaguggcacaacuacuauauuugcuggacacuuaaaauguagauuaaaaauggauaaacuuacauuaaaaggaaugucuuauguaauguguacaggauccuuuaaacuagaaaaagaaguggcugaaacgcaacauggaacuguauuaguacagaucaaauaugaagggacagacgcacccugcaaaauaccuuuuuccacucaagacgaaaaaggaguuacacagaaugggcgguuaauaacagcaaauccuauaguuacagacaaggagaagccaguuaauauagaagcagaaccacccuucggagaaagcuauauaacaauaggugcgggagaaaaggccuugaagcucucgugguucaagaaaggcagcagcaucggaaaaauguuugaagcaacggcaagaggagcgagaaggauggcuauccuaggugauacagccugggauuucgguucgauaggaggaguuuucacgucaguaggaaaauuaguacaucagauauuuggaacggccuacggaguauuauuuucuggaguaucauggacaaugaaaauuggaaucggaguauuauugacauggcucggucucaacucaagaaguacaagccuaucaaugacuugcaucgcggugggacuugugacauuauaucuugggguuaugguccaggcagauucuggaugcguuauuaacuggaaaggacgugaguuaaaaugugguucagguauauucguaacuaacgagguacauacauggacagagcaauauaaauuucaagccgauucgccgaaaagacugucagcagcuauagggaaagcaugggaagaaggagugugugguauccggucagcaacacgauuggaaaacauaauguggaaacaaauuaguaacgaauugaaccauauucuucucgaaaacgauaugaaauuuacugugguaguaggcgacguagcagguauacucgcucaaggcaagaaaaugaucaggccgcaaccaauggaauacaaauacucuuggaagucaugggguaaggcuaagauaauaggagcagauguacaaaauacaaccuucauaauugaugggcccaauacgccagagugcccagaugaccaaagagccuggaauauuugggaaguugaagauuauggauucggaaucuuuacgaccaacauauggcuaaaauuacgcgauucauacacucaaguaugugaucaccgucuaaugucagccgcuaucaaggauaguaaagcaguacacgcagacaugggauauuggauagaaagugagaaaaaugaaaccuggaaguuggcuagagccaguuucauugaaguaaagacauguguauggcccaaaagccauacacucuggucaaauggagugcuagaguccgaaaugauuauaccuaaaauauacgguggcccaaucucacaacauaauuauaggccaggcuauuuuacucaaacagccgggccguggcauuuagggaaguuggaacuagacuucgacuugugugaaggaaccacugucguaguagaugaacauuguggaaaccgggggccaagucuacguaccacaacagucacagguaagauaauacaugaaugguguuguagaagcugcacacuaccacccuuaagauuucggggugaggacgguugcugguacggaauggaaauaagacccgugaaagaaaaagaagagaauuugguaaaaaguaugguaagugcuggaucgggugaggucgauucauucucucucggcuuauuauguaucagcaucaugaucgaggaagugaugagaucaagguggucaagaaagauguuaaugacaggaacacuagcaguauucuuuuuauuaauaaugggacagcuuacauggaaugaucuaauaagacuauguauuaugguuggugcaaacgcaagugacaggauggguauggguacaacauauuuagcucuaauggcgacauucaagaugcguccaauguuugcgguugggcuauuauucagaagacugacaucaagggaagugcuauuacucacaaucgguuuaucccuuguugcaucagucgaacuacccaauucccuggaagaauuaggggaugggcuggccauggguauaaugauauuaaagcugcucacugacuuucaaucacaccaacuuugggcaacucuuuuaucgcucaccuucauaaaaacaacauuuagucuccauuacgcauggaaaacaauggcuaugguccuaucaauagugagucucuuuccguuauguuuaucaacaacaagucaaaagaccacuugguuaccuguguugcuaggaucauuaggauguaagccauugacuauguuccuaaucgccgaaaauaaaauaugggggagaaggaguuggccuuugaaugaaggaaucauggcugucggaauaguuucgauccuacuuagcucacuguugaaaaaugacguaccucuagccgguccucuuauagccggagggaugcucauagcuuguuauguaaucagcgguucaucugcggaccugucacucgaaaaagccgcagagguaagcugggaggaagaggccgaacauagcggagcaucccauaauauccucguagaagugcaagaugaugguacgaugaaaauaaaagaugaagaaagagacgacacgcucacaauucuacuaaaagcaacauuacucgcaguaagcggcguuuauccacuuaguauaccagcgacacuuuuuguaugguauuuuuggcagaagaagaaacagcggucaggaguuuuaugggacacaccuucucccccggaaguugaacgugcagucuuagacgauggaauauaucguauuaugcagcggggcuugcuuggccgcagccaaguaggaguuggaguguuucaggagaaugucuuccacacaauguggcauguaaccagaggagcuguacuaauguaccaaggaaaacgacuugaaccuaguugggcgagcguuaagaaagaccuuauaaguuauggugggggauggaggcuccagggcaguuggaauacgggugaggagguccaagugauagccguagagccagguaagaaccccaaaaacgugcaaacagcacccggaacauuuaaaacuccagaaggagaaguuggggcaaucgcucucgauuuuaagccugguaccaguggaucaccaaucguuaaccgcgaggggaaaaucguugguuuauacgguaauggcgucguaacgacgucaggaacauaugugagugcaauagcgcaagcuaaagcuagccaagagggaccuuuaccugaaauugaggaugagguauucagaaaaaggaacuugacuauuauggacuuacauccagguagugggaaaaccagaagauaucuuccugccauagucagggaggcaauaaaaagaaaauuaagaacucuuauacuagcgccgacaagaguuguugcaagcgaaauggcagaggcuuuaaagggcaugccaauacguuaccaaacuacugcgguaaaaagcgaacauaccgggaaggaaauuguagacuuaaugugucacgcuacauuuacuaugagauuauuaagcccggucagaguaccgaauuauaacaugauuauaauggaugaagcccauuucacagauccaucuucuauugccgccaggggguauaucucuacgagaguaggaaugggugaagccgcagccauuuuuaugacagcaacaccgccaggcucgguggaggcuuuuccgcaauccaacgcaguaauucaagaugaagaaagagacauaccagaacguucauggaacagcggguacgaauggauuaccgacuucccggguaaaacaguuugguuuguaccauccauaaaaucuggaaaugauauugccaauugcuuaaggaaaaaugguaaaagagugauacaauuaucuaggaaaacguuugauacugaauaccagaaaacuaaaaacaaugauugggacuacgugguuaccacagacauauccgaaaugggggccaauuuuagagcggauagggucauugacccccgcagaugcuuaaagccaguaauacucaaggaugggccagaaagggugauauuagcuggcccgaugccuguuacaguagcauccgcggcccaaagacgagguagaauuggccgaaaccauaauaaagaaggggaucaauauauauauaugggacaaccauuaaauaaugacgaagaucaugcccacuggaccgaagcgaagaugcuuuuagauaauaucaauacaccagaaggaauaauacccgcauuguucgaaccggaaagggaaaagucagcugccauagauggagaauauaggcucaggggagaagccagaaagacguucguagaauugaugagaagaggagaucuaccagugugguuaucauauaaaguugcaucugaaggguuccaauauagugacagacgaugguguuuugauggugaacgcaacaaucaaguguuagaagaaaacauggauguagagauuuggacuaaagaaggggagcgaaagaaauuacguccuagguggcucgaugcaagaaccuauucugauccucuagcuuuaagagaauuuaaagaguucgcugcagguaggcguuccgucaguggugaucuaauauuggaaauaggaaaacuaccucaacacuugacacaaagggcucaaaacgcuuuagauaaucucguaaugcuccacaauagcgagcaaggaggcagagcguaucgccaugcaauggaagaguuaccagauacaauagaaacauuaaugcuguuggcacugauugcggugcucacuggaggaguuacguuauucuuuuuaucaggacguggguuaggaaagacaaguauaggacuccuuuguguaauggcaagcucgguucuucuauggauggcaagugucgagccacauuggauugcagcaaguauaauccuugaauuuuucuugaugguccuccugaucccugaaccggaucgacaacgaacgccacaagauaaucagcuagcauacguaguaauaggccuucucuuuaugauauuaacgguagcagcaaacgaaauggggcuacuggaaacaacuaagaaagaucuggguauuggccaugucgccguagagaaucaccaucacgcggcuauguuagacgucgaucuacaccccgcuucugccuggacguuauacgcaguagcuacaacgauaauaacaccaaugaugagacacaccauagaaaauacuacggcaaauauauccuuaacagcuauugcaaaccaagcagcaauuuuaaugggguuggauaaaggguggcccauaucuaaaauggauauaggcguccccuuacuagcauugggcuguuauucccaaguaaauccucuaacauuaacagcugcugugcuaaugcuaguagcccacuaugcaauaauaggaccuggcuuacaagcgaaggcuacccgugaggcacaaaaacgaacggcagcaggaauuaugaaaaauccaacaguggauggaauaguagcaaucgaucuagacccggucguauaugacgcuaaguuugagaaacaauuaggacagauaauguuauuaauacuauguacaagccaaauacuucugaugaggacaacaugggcgcuaugugaaucaauaacuuuagcgacuggcccuuuaacuacucugugggaagguaguccaggaaaauuuuggaauacgacuauagcagugucaauggcuaauauuuuuagagggucauauuuagcaggagcaggccuugcauuuucuuuaaugaagucacuugguggagguagacgcgggacaggcgcacaaggugaaacuuuaggagagaaauggaaaaggcagcuaaaucaauuaaguaaaagcgaauuuaacacuuacaagcgaagcggcauaauggagguagaccgaagugaagcgaaagaaggacuuaaacggggagagacgaccaaacaugccguaucacgaggcacugcaaaauugcggugguuuguagaacguaaccuuguaaagccugaaggaaaaguaauagaucucggauguggaagaggaggauggucguauuacugugccggccucaagaaaguuacugaaguaaagggguacacaaaagguggaccuggacaugaagaaccaauaccgauggcuaccuacggauggaacuuggugaaauuacacuccggaaaagacguauucuuuauaccaccugagaaaugcgauacauuacuaugugacauaggagagucuagucccaauccgacgauugaagagggacggacgcuuagaguccuaaaaaugguagaacccuggcucagagggaaucaauucuguauuaagauauuaaauccauauaugccuagugugguggaaacucuagagcaaaugcagcguaaacauggaggcaugcuagugagaaauccguuaagucggaacucaacacaugaaauguauuggguuuccugugguacaggaaauaucguaucugcuguaaauaugacaucaagaaugcuguuaaaucgauucacaauggcccacagaaaaccaacauacgagagagacguagaccugggagcggggacaagacauguagcgguugagccagagguugccaacuuggauauaaucgggcaaagaauagagaacauaaagcaugagcauaaaucuacauggcacuaugaugaagauaaucccuauaagaccugggcauaccauggcaguuaugaaguaaaaccgagugggucagccucaaguaugguaaaugguguggugaaauuacugacaaaaccuugggacgugauuccgaugguuacgcaaauagcgaugacagauacaacaccuuuuggccaacagagaguauucaaagaaaaagucgauacgcggacuccgaaagccaaaagaggaacagcucaaauuauggaagucaccgcuaaauggcuuuggggauuucucucccgcaauaaaaagccgcguauuugcacuagagaagaauuuacaagaaaaguuaggaguaaugcggcaauaggagcaguuuuuguagaugaaaaucaauggaacagugccaaagaggccguagaagacgaaagauucugggauuuaguacacagagaaagagaguugcauaaacaagggaaaugugcuacaugcgucuauaacaugaugggcaaaagggaaaagaaguuaggugaguucgguaaagcuaaggguucaagagcuauaugguacaugugguuaggugcaagauuucuagaguucgaagccuuaggcuucaugaaugaagaucauugguucuccagagaaaacagccucucgggagucgaaggagagggauuacauaaauuaggcuauauacuccgggauauuucaaaaauuccugggggaaacauguacgccgaugacacggccgguugggauacaaggaucacagaagaugaucuacagaaugaagcaagaauaacugauaucauggaaccugaacaugcacugcuugcgaagucaaucuuuaaauuaacauaucaaaauaaagugguccggguacaaaggccugcaaagaaugggacagugauggacguaauaucaagaagagaccagcgcgguucaggccaagucggaacauauggacucaacaccuuuacaaauauggaagcacaauuaauuagacaaauggaaagcgaagguaucuucaguccguccgaguuagaaacuccaaaccuagcggaacgaguauuagauuggcuugaaaaauauggcgucgaaagauuaaagagaauggccauaucuggagacgauuguguugugaagccgauugaugauagguucgcaacagcucuuacggcacugaaugacauggguaaagugcguaaggauaucccccaaugggaaccaaguaagggauggaaugacuggcaacaaguacccuuuugcucgcaucauuuccaucaacuaauaaugaaagacgguagagaaauugugguuccuugcaggaaccaagaugagcuaguugggcgcgcacgcguaucccaaggagcuggcuggaguuuacgagagacagcauguuuagguaaaaguuaugcccaaauguggcaacuaauguacuuucauagaagggaucuacgacuggcugcgaacgccauauguucagccgugccaguagauuggauaccuaccucaagaacgacguggagcauucaugcacaucaccaauggaugacaacagaagauaugcuaucuguauggaaucgagucuggauagaagaaaauccguggauggaagacaaaacccacauaucaucguggggagauguacccuaucuagguaaaagagaggaucaauggugcggaagccugauuggacuaacggcuagagccacaugggcuacuaauauccaaguugccaucaaccaaguaagaagacuaaucggaaaugaaaacuauuuagacuauaugaccuccaugaaacgauucaaaaacgagucagauccagaaggagcguuaugguaa

SEQ ID NO: 21495 - RNA, 9879 nt, Artificial Sequence
  derived and/or modified CDS sequence (opt6) from DENV-1__FJ024442__SS-prME
agcguaacuaugcuacuaaugcuaaugccaacugcucucgcauuccauuuaacaacgcgcggcggagaaccucauaugauagucucaaaacaagaacgaggcaaaaguuugcuauuuaaaacauccgcugguguaaauaugugcacacuaauugcaauggacuugggugaacuuugugaagauacaaugacguacaaauguccaagaauaacggaaacggaaccugacgauguagacugcuggugcaaugcuacagacacauggguaacguauggaaccuguagucaaaccggugaacauagaagggauaaacgcucaguagcacuagcgccccacguaggccuggguuuggaaacccggaccgaaacauggaugucaagugaaggagcauggaagcaaauacaaaggguugaaacaugggcauuacgucauccugguuucacagugauagcacucuucuuagcacacgcaauaggaacaucaaucacucaaaaaggaauaauauucauccuacugaugcucguuacaccaaguauggcuaugagaugcguagguaucggcucucgggauuucguagaagggcuaucaggcgcaacauggguagacgugguccucgaacacgggagcuguguaacgacaauggcaaaagauaaaccgacauuagacauagaauuauuaaaaacagaagucacaaaccccgcaguacuccggaaacuauguauugaagccaaaauaagcaacaccacuaccgacucacgaugcccaacacaaggagaagccacucucguagaagaacaagacgcaaacuuuguaugucgaagaaccuucguagacagaggaugggggaacgguuguggacuguuugggaaagggaguuuaauaacaugcgcaaaauuuaaaugcguuacuaaacuagaagggaaaauaguacaauaugaaaauuuaaaauauucugugauugucacaguacacaccggagaucaacaucagguagguaacgaauccacagaacaugguacaaccgcgacuauaacgccgcaagcaccaacgaccgaaauacaacuuacugauuauggagcauuaacccuugacugcuccccacguaccggucuagauuucaaugaaaugguacuacuaacaaugaaagaaaaaucaugguuaguacacaaacaaugguuccuagauuuaccauuaccauggacuagcggcgccucaacgagccaagaaacauggaaucgacaggaucuauuaguaacguucaaaacggcgcaugcaaagaaacaagaaguaguagucuuaggcagucaagaaggggcuaugcauacagcccuuaccggagcuacggaaauacaaacaaguggaacaacgacaauauucgccggacauuuaaaaugcagacugaaaauggauaaauuaacguuaaaaggaaugagcuacguaaugugcacugggucuuucaaacuagaaaaggaagucgcggaaacacagcacggaacaguccuaguccaaauaaaauacgaagguaccgaugcuccauguaagaucccguuuuccacacaagaugaaaaaggaguuacacaaaaugggcguuugauuacugcaaauccaauagucacggacaaagagaaaccaguuaacauugaggcugaaccaccauucggugaguccuacauaauaauaggugcgggagaaaaggcucucaaacucucaugguuuaagaaaggauccaguauugguaaaauguuugaagccacugcgcgaggagcuagaagaauggcgauuuugggugauacagccugggauuuuggcaguauuggaggagucuuuacgucuguuggaaaauuaguccaccagauauuuggcaccgcuuaugggguauuauucucggggguuagcuggaccaugaaaauuggaauuggaguauugcuaacaugguuaggauuaaauucacgcucaacaagucuaagcaugacauguauugcuguuggguugguaacuuuauauuugggaguuauggugcaagcugacucaggcuguguaauaaacuggaaaggucgagaacuuaagugcgguucuggcauauuuguaacuaaugaaguacacacguggacagaacaauauaaauuccaagcagacucaccaaaaagauuaagugccgcaaucgguaaggcgugggaagaaggagucuguggcauacgcuccgcuacaagauuagaaaacauaauguggaaacaaauaucaaaugaacuuaaucauauauugcuagaaaaugauaugaaauucacuguggucguaggcgacguggcugggauacuagcacagggcaagaaaaugaucagaccgcaaccaauggaauacaaauacagcuggaaauccuggggaaaagcaaagaucaucggcgcggauguacaaaacaccacuuuuauuauagauggcccuaacacaccagagugucccgacgaucaacgugccuggaacauuugggaaguagaagauuacggauucggaauauucacaacuaacauaugguuaaagcuacgugauucauacacucaagugugcgaucaccgccuuaugagugccgccaucaaagauaguaaagccguucacgccgacaugggauacuggauagaaucagagaaaaaugagacauggaaauuagcccgagccaguuuuauugagguaaaaacuuguauuuggccaaaaucucauacuuuaugguccaacgggguauuagagagugaaaugauaauaccaaaaauuuacggagggcccauaagccagcauaauuauagaccuggauacuuuacucaaaccgcagggccuuggcaucuaggcaaauuagaguuagauuucaaucuaugcgaagguaccaccgugguuguagacgagcacugcggaaaccgagguccaagucuaagaacuaccacaguaacgggcaaaauaauacacgaauggugcugccggagcugcacguuaccaccuuuacgcuuucguggagaagacgguuguugguauggaauggaaauaagaccaguaaaagagaaagaagaaaacuuagugaaaucaaugguuucugcaggauccggagaaguugauagcuucaguuugggccuacuaugcauuaguauuaugauugaagaaguuaugcggaguagauggagucgaaaaaugcuuaugacugguacacuggcaguauucuuucuauuaauaaugggacaacuaaccuggaacgaccucauaagacuuuguauuauggucggggcaaaugcuucugacagaauggguaugggaacgacauaccuagccuuaauggcuacauucaaaaugcgcccaauguuugcaguuggacuuuuguuucggaggcuaacuagcagagaaguuuuauuacuaacgauaggguuaucgcuuguagcuagcgucgaacucccuaauagcuuagaagaauuaggugaugguuuagcaaugggcaucaugauauuaaaacuguuaacagacuuccaaagucaucagcuaugggcaacccuauuaucucuaacauuuauuaaaacaacuuucucuuuacacuaugcauggaaaacaauggcaaugguucuaucaauuguuagcuuguucccauuaugccuuucuacaacaagccagaagacuaccugguuaccuguacugcuaggcucgcucgggugcaaaccccuaacaauguuccuaaucgcugagaauaagauuuggggaagacguaguuggccgcuaaaugaaggcauuauggcgguaggaauaguuucaauacuucuuagcagccuacucaaaaaugacguacccuuagcagguccuuuaauugccggugggaugcucaucgcaugcuacguuaucagcgguucaagugcagaucuaucauuagagaaagcagcagagguuuccugggaagaagaggcugaacauaguggagcgucccauaacauauuaguugagguccaagacgacggcaccaugaaaaucaaagacgaagaaagagaugacacgcuaacuauuuuacugaaagccacgcuacucgcugucagugggguuuauccacucucaauaccugcaacccucuucgucugguacuucuggcagaagaagaaacagcgaucuggagugcuaugggauacaccaucuccuccagaaguggaaagagccguauuagaugaugggauauacaggauaaugcaaaggggacuuuuaggccgaagucagguaggggugggcgucuuucaagagaacguuuuucauacaauguggcauguuacucguggugcaguucugauguaccaaggaaaacgucuugagccaaguugggcaucuguaaagaaagauuuaauuagcuaugguggugguuggagacuccagggcucauggaauacuggagaagaaguccaagucaucgcaguagaacccgguaaaaauccuaaaaauguacaaacugcacccgguacuuucaagacaccggaaggcgaaguuggggcaaucgcgcucgacuucaaaccagguacuucuggcaguccgaucguuaauagagaaggcaggauaguaggucuauacgguaacggugucguuaccacaaguggaacauauguaucagcaauagcacaggcuaaagcuagccaagagggcccacuccccgaaauugaagacgaaguuuuucgaaagagaaaucuaaccauaauggaccugcacccagggucaggcaaaacgcggagauaccuaccagcuaucguuagagaagcgauuaaaagaaaguuacgaacccuaauacuugcuccaacucguguuguagcaagcgaaauggccgaagcauuaaaggggaugccgauccguuaucagaccacagcaguuaaaucggaacacacuggaaaagaaauagucgauuuaaugugccaugcaacuuucacgaugagauuacuaagucccguacguguuccaaauuauaacaugauuauaauggaugaagcucauuucacggauccuucgucaauagcagccaggggcuacauuucaacuagaguggguaugggggaagcugcggcgauauuuaugaccgcuacgccacccggguccguagaagcauuuccacaaagcaacgccgucauccaagacgaggaacgugacauaccagaaagaagcuggaaccuggguuaugaauggauuacugacuucccggguaaaacuguaugguuuguuccuucgauaaaaagcggcaaugauauagccaauugucuccgaaagaacggaaaaagagugauucaauuaagucggaaaacauuugacacagaauaccagaaaacuaaaaauaacgauugggauuauguaguaacgacagacauaagugaaaugggagcaaauuuucgagcugauagagucaucgauccucgacguugccuuaaaccagucauacugaaggacgggccugaacgagucaucuuagcgggucccaugcccguuacggucgcgucugccgcacaacgccgcggacgaauuggaagaaaccauaauaaagaaggcgaccaauauauauacaugggacagccucuaaauaacgaugaagaucaugcccacuggacagaagcaaaaaugcuauuagauaacauaaacacccccgaagggauaauaccugcgcuauucgaaccagagagggaaaaauccgcagcuauagacggggaauacagauuacggggagaagcuaggaagacuuuuguugaauuaaugagaaggggugaucuuccgguguggcuauccuacaaggucgcaucagaagguuuucaguauucggaucgacguugguguuuugauggagaacgaaacaaucaaguuuuagaggaaaauauggauguugaaauauggacaaaagagggcgaacgaaagaaacuucguccuagaugguuagacgcgagaaccuacucagacccacuugcuuuacgagaauuuaaagaauuugcagccgggcgccggucaguaucaggugauuuaauacuagaaauaggaaaacuuccucagcaucucacgcaaagagcgcagaaugcacuggacaaucucguaauguuacauaacucugaacaagguggaagggcauacaggcacgcaauggaggaauugcccgauacaauugaaacauuaaugcuucuagcacucauugcugugcuuacuggaggcguuacgcuauucuucuugucaggucgcgguuuaggaaaaacaucgauagggcuccuaugugugauggccucuucaguacuguuauggauggcuuccgucgagccacauuggauagccgcuuccaucaucuuagaguucuuuuugaugguucuccugauaccugagccagaccgacaaagaaccccucaagauaaucaacuugcguaugucguaaucggacuucuuuucaugauacuaacgguagcggccaacgaaaugggacuuuuagaaacaacaaagaaagaccuagguauagggcauguagcgguagaaaaucaucaccaugcagccauguuagacguagauuuacauccugcguccgcuuggacauuauacgcaguugccacaaccauaauuacaccgaugaugcgacauaccauagaaaauacgacugcuaacaucagcuugaccgccauagcuaaucaagcagccauacuaaugggucucgauaagggcuggccuauuucuaagauggacauaggcguaccacuacuagcguuaggaugcuacucacagguaaauccacuuacauuaacugcagccguauugaugcucguagcgcauuaugcaauaauaggaccgggacuucaggcuaaggccacgcgugaagcacaaaagagaacagcagcugguauuaugaagaauccaacuguugacgguauaguugcuauagauuuagacccggugguuuacgaugcgaaauucgaaaaacaauuaggccagauaauguuauuaauacucuguaccagccaaauacuauuaaugcgaacgacgugggcgcuuugugaaucgauaacuuuagcaacaggcccguugacaacgcuuugggaagggucgccagguaaauucuggaacacaacuauugcgguuucgauggccaauauauuccgagggaguuacuuagcgggcgcaggccuagcauucagucugaugaaaaguuuaggugguggcagacguggaacuggcgcgcaaggcgaaacucuaggggaaaaguggaagagacaacuaaaucaacuaagcaagagugaguucaacacauauaaaagaaguggaauuauggaaguugaucguucugaagcgaaggaagguuugaaacgaggagagaccacuaaacaugccguuuccagaggaaccgcaaaauuaagaugguucguagaaagaaacuuggucaaacccgaagguaaaguaauagauuuagguugcggaagggguggauggaguuacuauugcgcaggucucaagaaaguuacugaagucaaaggguacacuaagggaggucccgggcacgaagaaccuauaccaauggcaaccuauggcuggaaucuaguaaaacugcacuccgggaaagauguguucuucauaccgcccgaaaaaugcgacacacuccuaugugacauaggagaauccucgccuaauccuacgauugaagaaggccgcacauuacggguauuaaaaaugguagaaccaugguugcguggaaaucaguuuugcaucaagauacuaaacccuuauaugccuagugucguugagacucucgaacaaaugcagcgaaaacacggagguaugcuggucagaaacccacucucaagaaauuccacucacgaaauguauuggguaaguugugguacggguaacauuguauccgcugugaauaugacaucaagaaugcuccugaauagguuuacaauggcucauagaaaaccaacauaugaaagggacguggaucugggugcuggaacuagacacguggcaguagaaccagaaguagccaauuuagacauuauaggacaacguauugaaaauaucaaacaugagcauaaaagcacauggcacuaugacgaggauaauccuuacaagacuugggcauaccacggcagcuacgaagucaaaccaucagggucagcaucaaguauggugaauggagucguuaaacuuuugacaaaaccuugggauguaauaccaaugguaacacagauugcaaugacagacacuacaccauuuggucagcaaaggguauuuaaagaaaagguggauacacguacgccgaaggcuaaacgaggaacagcucaaauaauggaagucacugccaagugguuauggggauuuuuaucuagaaauaagaagccuagaaucugcacaagagaagaguucacacgaaagguucgaucuaaugccgcgaucggugccguauucguugaugagaaucaauggaacagugcaaaagaagccguggaggacgaaagauucugggacuuaguacauagggaaagagaacugcacaaacagggaaaaugcgcaacauguguauauaauaugauggguaaaagagagaagaaacuuggugaguuugguaaagcaaaagguucacgggcaaucugguauauguggcuaggggcacgguuccuugaguuugaagcgcuugguuuuaugaaugaagaccauugguuuucuagagaaaauuccuuaaguggaguugaaggggaaggucugcacaaguuaggauauauacuaagagacauaucaaaaauaccaggaggaaacauguaugcugaugacacagcuggcugggauacgagaaucacagaagaugacuugcaaaacgaagcacgaauuacggauauaauggagcccgaacaugcauuauuagcuaaauccaucuuuaaacuaacauaccaaaacaaagucguacgaguucaaagaccagccaaaaauggcacaguaauggacguuauaagucggcgugaucaacgagggaguggucagguaggcacauacggauuaaauacauuuacaaauauggaagcucaacugauaagacaaauggagucagaaggcauauucuccccgagugaacuagagaccccaaaccuagcagaaagagugcuggauugguuggagaaguacgguguugaacggcucaaacgaauggcuauaaguggugaugacuguguagugaagcccauugacgauagauuugcaacagcucucacagcccuuaaugauauggguaagguaagaaaagauauuccucaaugggaaccaucuaaaggauggaacgauuggcagcaaguuccuuucugcagucaucacuuccaucaacuuauuaugaaagacggaagagaaauugugguaccaugucguaaucaagaugagcuagucgggcgggcacguguaucccaaggggcaggauggucacugcgugaaacugcaugucuugggaagaguuacgcacagauguggcaacuaauguauuuccaucggcgagauuugagauuagccgcuaacgcaauuuguucggcgguaccggucgauuggauacccaccucuaggacgacguggucuauucacgcgcaucaucaauggaugacaacagaagauauguuaucuguauggaauagaguuuggauugaggaaaacccguggauggaagauaagacccacauuucgucauggggugaugugccauaucucggcaaaagagaggaccaauggugcggaaguuugauaggacuaacagcaagagccacuugggcaacuaacauccaagucgcgaucaaucaaguaagaagacucauuggaaaugagaacuaucuagauuacaugacaucaaugaaaagguuuaagaaugaaggugauccagagggggcacuuugguga

SEQ ID NO: 21496 - RNA, 9879 nt, Artificial Sequence
  derived and/or modified CDS sequence (opt6) from DENV-1__FJ373296__SS-prME
ucaguuacaauguuauugaugcucaugccaauagcucuugcauuucaucuaacaacucgaggaggagaaccacacaugauaguaaguaaacaagaaagaggaaaaucauuauuauuuaaaacaucagcugguguaaauaugugcacauugauagcaauggauuuaggugaauuaugcgaggauacaaugacuuauaaaugcccaagaauaacagaagcggaaccggaugacguggauugcugguguaacgcaacagacacuugggugacuuauggaacgugcucgcaaacgggcgagcauagacgugauaaaagaucaguagcgcuugccccucacguuggcuuaggacuagaaacacguacagagacuuggaugucaagugaaggugccuggaaacaaauccaaagaguagaaaccugggcguuaagacaucccggauucacuguaauagcacucuuuuuagcucacgcgauuggaacuagcauaacacaaaaaggcauuaucuuuaucuugcuuauguuaguaacgccgucuauggcgaugagaugcgucggcauagguucaagagacuuugucgaaggacuuuccggcgcgaccuggguugacgugguauuagaacaugguagcugugucaccaccauggcaaaagacaaaccuacacuagauauagaauuacuaaaaaccgaaguaaccaauccagcaguccucagaaaacugugcauagaagcaaaaauaaguaauaccacuacugacucacgaugcccuacucaaggagaagccacacuuguagaagaacaagacgccaacuuuguauguaggagaacauuuguagauagagguugggggaacgguugcgguuuauuuggaaagggaaguuuaauaacaugcgcaaaauucaaauguguaacaaaauuggaaggaaagauuguucaauacgaaaacuuaaaguauagcgucauaguaacuguucauaccggagaucaacaccaaguuggaaaugaaucgacggagcaugguacgaccgccacaauuacaccacaagccccuaccaccgagauacaauuaacugauuauggagcacuuacacuugauugcagcccgaggacgggauuagauuuuaaugaaaugguacuuuuaaccaugaaagagaaaaguugguugguacacaaacaaugguuucuagaucuaccacugccuuggacaagcggggcuucuacaucucaagagacuuggaauaggcaggaucuauugguaacuuucaaaacugcacaugcgaagaaacaagaaguaguaguccuaggaucccaagaaggagcaaugcauacugcccuuacuggggcuaccgaaauucaaacaucuggaacaacaacgaucuucgcuggucauuuaaaaugucgucuuaaaauggauaagcuaacuuuaaagggaaugaguuacguaaugugcacggguucuuucaaacuggagaaagaggucgcagagacccagcacggaacaguccugguacaaauaaaauacgaagggacagaugcaccgugcaaaauacccuucucgacgcaagacgagaaaggggccacacagaacgguagauugaucacugcuaacccaaucguaacagauaaggaaaagccugugaacauugaagcugagccaccauuuggugaaaguuacauaguaauaggcgcgggugagaaagcgcucaaguugucuugguucaagaaaggaaguaguauagggaagauguuugaggccacagcacggggagcacgaagaauggcuauacuaggugauacugcaugggacuuuggaaguauuggugggguauucacuucagucggcaaguuaguacaccaaauuuuuggaacggcauauggcguccuguucucaggaguauccuggacaaugaaaauaggcauaggaguauuauugacgugguugggauuaaauucgagaucaaccagcuuaaguaugacauguauagccguaggacuugugacuuuguaucuaggagucaugguucaggcagacuccggaugcguaauaaauuggaagggacgagaguugaaaugcgggucggggauuuucgucacgaaugagguacacacauggacagaacaguacaaguuccaagcggauucaccaaaacgauuauccgcagcgauagguaaagcaugggaggaaggggugugcggaauaagguccgcaacaagauuagaaaacauaauguggaaacagauaucaaacgaguuaaaucauauucuguuagaaaaugacaugaaacucacagucgucgugggagaugucgcugguauccugggacaaggcaagaaaaugauacguccacagccgauggaauacaaguauaguuggaagucuuggggaaaagcuaaaauuauaggugcagacgcacaaaauacuacuuucaucauugauggcccuaauaccccggaauguccagaugaccagagagccuggaacaucugggaaguagaggacuauggguucgguauauucaccacgaacauuuggcuaaaacucagagacaguuacacccaagucugugaucauagacugaugucugcagcuauuaaagacucgaaagcuguacaugcggacaugggauacuggauagagagcgagaaaaaugagacuuggaaacucgcuagagcgucauucauagaggucaagacguguauauggccuaaaagucauacacuguggucaaacggagucuuggagucugaaaugaucauuccuaagauuuacgguggcccgauaagucaacauaacuauagaccgggcuauuuuacacaaaccgccggaccauggcaccuagggaaacuagaacuugauuuugaucugugcgaagguaccacaguaguaguggacgagcauugcggaaauagagggcccucauuacgcacaacaacaguaacgggcaaaauaauacacgaauggugcugccguucuuguacccuuccgccgcuuagauucagaggugaagaugguuguugguaugguauggagauacgaccaguaaaagaaaaagaagaaaaccuggucaagagcauggugagcgcaggaucuggagagguugacucguucagucuaggccuacuauguauaucgauaaugauagaggaagucaugcgaucacgauggucaagaaagaugcucaugaccgguacccuagcaguauucuuuuuauuaauaaugggacaacuaacguggaaugaccuuaucagacuaugcauuauggucggugcgaacgcaagcgauagaauggguauggguacuacauaucuagcucucauggccacguucaaaaugagaccaauguucgcagugggacuccucuuuagaagauuaacaagucgagaaguccuucuccucaccauuggccuaucucuaguagcaucaguugaacuaccaaacucuuuggaggaauugggugauggacuugcgaugggaauuaugauucuaaaacuucuuacugacuuccagagucaucaacuaugggcaacacuauuaaguuuaacuuuuaucaagacgacauucagucuacauuaugcauggaaaacuauggcuaugguguugucaauagucagccucuucccauuauguuugaguacuacaagucagaaaacaacguggcuaccgguauuauuaggaucccuugguugcaaaccucuuacuauguucuugauugcggaaaacaaaauauggggaagaaaaaguuggccccucaacgaaggaauaauggcuguagggauaguuuccauacugcuaucaagccugcugaaaaaugacguuccccuagcuggacccuuaauugcagggggaaugcuuauagccugcuauguaauaucugggucaucagcugaucuuucauuagaaaaagcggccgaaguuaguugggaagaggaggcggaacacucuggagcaagucacaauauccuaguagaaguacaagaugauggcacaaugaaaauaaaagaugaggaacgagaugauacauuaacaauuuuauuaaaagcgacacuacuggcaguuagcggaguuuacccauugucaauaccggcuaccuuauuuguaugguauuuuuggcagaagaagaaacaacguucgggcguacuaugggacacuccuuccccucccgaaguagaaagggcaguauuagacgacggcauauacaggauuaugcaacgcggguuauuaggccguucccaaguuggaguggguguauuucaagagaacguuuuccauaccauguggcacguaacucgcggagcgguauuaauguaucaagguaaaagauuggaacccucuugggcgucggucaaaaaggaccugauuaguuauggagggggcuggagacuaagagguaguuggaacacaggagaagaaguucaaguuauagcgguggaacccggcaaaaauccgaaaaauguacagacugccccuggcacauuuaagacacccgagggggaaguaggagcaauagcauuggauuuuaaacccgggacaaguggaucucccauuguuaaccgagaagguaaaauuguaggauuguauggaaacggggucguaacaacaaguggaaccuaugugucagccauagcucaagcaaaagcaagccaagaagggccauuaccagaaauagaagacgaaguauuuagaaaacgaaaccuuacaauaauggaucuccauccagguucagggaagacgaggcgguauuugccggcgauaguaagagaagcuaucaaaagaaaacuucgaacacuaauucuagcaccuacacgagucguugcuucugagauggccgaagcacuaaaaggaaugccaauuagauaccaaacaaccgcaguuaaaucagaacacaccgggaaagaaauaguggaucuuaugugucaugcgacauucacaaugcgguuacuauccccagugcgaguaccuaauuauaacaugauaauuauggacgaagcacauuuuacggacccuuccucaauagcagccagaggguacauuagcacccgaguuggaaugggagaagcagcugcaaucuuuaugacagcuacgcccccaggaucgguagaagccuuuccucagagcaaugcuguaauucaggaugaagagagagauaucccugaacgaaguuggaacucaggauacgaauggauuacagauuucccgggcaaaacaguaugguuuguaccuagcauuaaaaguggaaaugauauagcaaacugccucaggaaaaauggaaaaagagugauacagcugaguaggaaaaccuucgacaccgaauaucagaaaaccaaaaauaaugauugggacuauguagucacaaccgauauauccgaaaugggagcaaauuuuagagcugacagagugauugacccgaggaggugucugaagccaguaauacuaaaggacggaccagaacgaguaauacuggcagggccgaugccaguaacaguggcgucagccgcacaaagaagaggaagaaucggaagaaaccacaauaaagagggugaccaauacauauacaugggucagccacucaacaacgaugaagaucaugcacauuggacagaagcuaaaaugcucuuagauaauauuaacacgcccgaaggcauuauaccugcauuauuugaaccagagcgagaaaaaucggcugccgucgauggggaauaucguuuacgaggcgaagcgcggaaaacauucgucgaauuaaugcgaagaggagaccucccaguuugguuaaguuacaaaguagcaagugaaggcuuucaauauucugaccggagaugguguuuugauggagaaagaaauaaucaaguucuggaagaaaauauggauguugaaauauggacaaaggaaggugagcgaaagaaauugcgcccccguugguuagaugccagaacguauucggacccuuuagcucucagggaauuuaaagaguucgcagcaggucggcggagcguuagcggagaccuaauuuuagaaaucgguaaauuaccccaacaucugacucaacgagcgcaaaacgcacucgauaacuuaguaauguugcacaauagcgaacagggaggucgggccuauagacaugcaauggaggaacuacccgauaccaucgaaacacucaugcuuuuagcauugauagccguacuuacaggagguguaacccuauucuuccuaagugggagaggauuaggaaaaacaaguauaggucuuuuaugcgucauggccaguagugugcuacuuuggauggcaucuguggagccgcauuggaucgcggccucuauaauauuagaauuuuuccuaaugguucuucugaucccagaaccggaucgucaaagaacaccccaagauaaucaauuggcguauguagugauagggcuauuauucaugauucuaacaguugcagcaaacgaaauggggcugcucgaaacgacuaaaaaggauuuaggaauagggcauguagcaguagaaaaucaccaucacgcugcaauguuggaugucgacuuacauccggcaagcgcauggacucucuaugcugucgcaacaacgaucauaacucccaugaugagacacaccauugagaacacgacggcuaauauaucuuuaaccgcuauagcaaaucaagcagccauuuuaauggggcuagauaaggguuggccgaucuccaaaauggacaucggagugccacuacucgcauuaggaugcuacucucaaguaaauccuuuaacauugacugcugcugugcucaugcuuguugcucauuaugcgauuauaggcccugguuuacaggcaaaagccacuagagaagcucagaaaagaacagcagcgggaaucaugaagaaccccacgguagaugguauuguggcaaucgauuuagaucccgugguauaugacgcaaaauuugaaaaacaacuuggucaaaucaugcuauugauccugugcaccucacaaauauuauuaaugcguacaacgugggcgcugugcgaaucgauaacccuggcgaccggaccuuuaacuacacucugggagggcucccccggcaaauucuggaauaccacaauagcgguuagcauggcaaauauauuuagaggaucguaccuagcgggugcuggucuagcauuuaguuugaugaagagucucggcggaggacgacgaggcacaggcgcccaaggcgagacucuaggagaaaaauggaagagacaauuaaaccaauugucaaaaucagaauuuaacacauacaagaggagcgguauaauggagguagaccgaucggaagcaaaagaaggccuuaaacggggcgaaaccacgaaacaugcuguaucuagaggcaccgcaaaguuacgaugguucguagaacgaaaucuaguuaaaccagaaggaaaggucaucgaucuugguugugggagaggaggguggagcuacuacugugcgggucuaaagaaaguaacagaagucaaaggauacaccaaaggaggaccgggacacgaagaaccgauaccaauggcaaccuauggauggaacuuaguuaaacuucauagcggcaaagauguauuuuucauaccaccagaaaaaugcgauaccuuauuaugugauauuggagaaucuagucccaauccaacuauagaagaaggccgcacauuaagaguacuaaaaaugguugaaccaugguuacgcggaaaccaauucuguaucaaaauuuuaaacccauacaugcccagcgucguagaaacacuagaacaaaugcaacggaagcauggaggaaugcuaguacgaaacccauugagcagaaauagcacucaugaaauguacuggguaucaugcggcacaggaaacaucguuagcgcuguaaacaugacaaguagaaugcuccuuaaccguuuuacaauggcucauagaaaaccaaccuacgaaagagacgucgaccugggaaccggaacaagacacguggcgguugaacccgagguagccaaucuugacauaaucggccaaaggauagaaaauauuaagcacgaacacaaaucaacauggcauuaugaugaggacaauccauauaaaacuugggcauaccauggaaguuaugaaguaaaacccuccggcucugcgagcaguaugguaaaugggguuguuaagcuacuuacaaaaccuugggauguuauaccgaugguuacgcaaaucgcaaugacagauacaacaccuuuuggucaacagcgaguauucaaggaaaaggucgacacccguacccccaaagcaaaaagggguacagcacaaaucauggaagugacagcaagauggcuauggggauuucugagucgcaacaagaagccuagaauuuguacacgagaagaguucaccagaaaaguuaggucuaacgcagcaaucggagcaguguuuguugaugaaaaccaauggaacucggcaaaggaagcugucgaagacgaaagauucugggaucucguacauagagaacgagaauuacacaaacaagguaaaugugcaacauguguguauaauaugauggguaagagagagaagaaauuaggggaguuuggcaaagcaaagggcucacgagcuauaugguacaugugguuaggagcacguuuucuugaguucgaggcguuaggauuuaugaaugaagaucauugguuuucaagagagaauagccuuucuggcguugaaggugaaggacuccacaaacucggauacauacugcgugacaucucgaaaaucccaggagggaauauguacgccgacgauaccgccggaugggacacacgaauuacggaagacgauuuacaaaaugaggcuaaaauaaccgacauuauggaaccagaacaugcacuacucgccaaagccauauucaaacucaccuaucaaaacaaaguaguacgcguacaacgaccggccaaaaauggcacaguuauggaugugauaagcagaagagaucaacguggaagcggccaagucggaacuuauggacuaaauacuuucacuaacauggaagcacaguuaaucagacaaauggaaucagaagguauuuucagccccuccgaauuggaaacgcccaaucuagcagaacgcgcuuuggacuggcuugaaaaauacggaguugagaggcucaaacgcauggcgauuucaggagaugacuguguugucaaaccaauugacgaccgauuugcgacggcauuaacugcucuuaaugauauggguaaagucaggaaagacauuccacagugggagccuagcaaaggauggaacgauuggcaacaggugccauucuguucccaucauuuucaucaauuaaucaugaaagaugguagagagauaguugucccuuguagaaaccaggaugaauuaguugggagagcuagaguaucacaaggcgccggguggucgcuucgagaaaccgcaugcuuagggaagaguuaugcacaaauguggcaacuaauguauuuccaucgaagagaucuccgcuuagcagcaaacgccauaugcucugcaguaccaguugacuggguaccaacuagcagaacuaccuggucaauacaugcucaccaucaauggaugaccacagaggacauguuauccguguggaacagggucuggauagaagaaaacccauggauggaagauaaaacacauauuagcagcugggaggauguuccuuaccuaggaaagcgcgaggaucaaugguguggaagucuuauugggcugacagcaagagcaacgugggccacuaauauacaagucgcaauuaaccaggugcgacgacucauuggcaacgaaaacuauuuggauuauaugaccucgaugaagcgcuuuaaaaaugaaagcgacccagaaggugcacucugguag

SEQ ID NO: 21497 - RNA, 9879 nt, Artificial Sequence
  derived and/or modified CDS sequence (opt6) from DENV-1__FJ182018__SS-prME
agugucacaaugcuauuaauguuaaugccuacagcacuagcauuucauuuaacuacacggggaggcgaaccucacaugaucguaucuaaacaagaacgaggcaaaucuuuauuauuuaaaacgagugcugguguuaauauguguacuuuaauugcaauggaccuaggugaacuaugcgaagauacuaugacauauaaauguccaagaauuacggaaacggaaccugaugauguugauugcugguguaacgcgacagauacauggguaacauauggcacgugcucacaaaccggcgaacaccgucgugauaaaagaucagucgcacuagcaccucauguaggccuagguuuagaaaccagaacagaaacuuggauguccagcgaaggggcguggaaacagauucaacggguagaaacaugggcucuacgucauccaggguuuaccguaauagcacuauuuuuagcccacgccauaggaacaucuauuacacaaaaaggaauaauauucauacuuuugauguuaguuaccccaucaauggcuaugcgaugugugggaaucggcucacgugacuucguagagggucuuucaggugcaacauggguugauguagugcuagaacacggcucaugcguuacuacuauggcaaaagauaaaccuacucucgauaucgagcugcuuaaaaccgaagucacuaauccugcuguuuugcgaaaacuauguauugaggcaaaaauuaguaacacaacaaccgauaguagauguccuacgcagggcgaagcuaccuuaguagaagaacaagaugcaaacuucguauguagaaggacauuuguagacagaggauggggaaaugggugcggacucuuugguaaaggaucuuuaauaacuugugcgaaauucaaaugcgucacaaaacucgagggaaaaauaguccaguacgagaaucuaaaauauaguguaauugugacugugcacacuggagaccagcaccagguaggcaaugaaaguaccgagcaugggacaaccgccacgaucacgccacaggcgccaaccacugaaauucaacucaccgacuauggugcccucacgcuugauugcuccccacggacagggcuggauuuuaacgaaaugguucucuuaacuaugaaagaaaaaucauggcuaguacauaaacagugguucuuggaccuaccauugccuuggacaucgggugcgucaaccucacaggagaccuggaaccggcaagaccuucuaguaaccuucaaaacggcucacgccaagaaacaagaggugguagugcuagguagccaagagggcgcaaugcauacggcacuaacaggugcaacagaaauccaaaccagcggaacgacuacuauauucgcuggacaccuuaaaugucgucuaaaaauggacaaacucacgcugaaaggaauguccuauguuaugugcacugguagcuuuaaacucgaaaaagaagucgccgaaacucaacacgggacaguucuaguacaaaucaaguacgaaggaacggacgcuccuuguaaaaucccuuucaguacucaagacgaaaaagguguaacucagaacggucgucuaauuacugccaacccaauagugacagacaaggaaaaacccgucaacaucgaggcggagccuccguuuggcgaaucauacauuauuauaggggcuggugaaaaagcccuuaaguuaaguugguuuaagaaaggcaguaguauugguaaaauguucgaagcaacugcacguggugcucggaggauggcaauacugggagacacagcaugggacuuuggcucuaucggaggcguguucaccagcgucggaaagcucguacaucaaauauuugguacugccuaugggguucuauuuuccggagucaguuggaccaugaaaaucggaauaggaguucuccucacuuggcuaggauuaaauagucgcuccacgucacugucaaugacauguauagcuguugguuuaguuacacuauauuuaggaguaaugguacaagcagauucgggaugugucauaaauuggaaaggucgggaacuaaagugcgguagugggauauucguaacaaacgaggugcauacauggacagaacaguacaaauuccaggcggacaguccaaaacgacuuucagcagcaauaggaaaagccugggaagaaggagucuguggaauaagaucagccacuagacuggagaacaucauguggaaacaaauuucaaaugaacugaaucauauacuacuagagaacgacaugaaauucacggucguuguaggagaugucgcuggaauuuuggcacaaggaaagaaaaugauacgaccacaaccaauggaauauaaauauaguuggaaaucauggggaaaagcaaagauuauaggugcagauguacaaaacaccaccuuuauuauugauggcccuaauacaccugaaugucccgacgaccaaagggcuuggaauauaugggaagucgaagacuauggcuuuggaauauuuacgacuaacauauggcuaaaguuaagagacucccauacgcaaguuugugaucacagacuuaugucagcagcgauuaaggauuccaaagcgguccacgcugauaugggauacuggauagaaucugagaaaaacgaaacauggaaacuugcacgugcaucauucauagaaguaaaaacauguaucuggccaaagucucauacuuuauggucuaauggcgucuuagaaagugaaaugauuauaccaaagauuuacgguggaccaaucucacaacacaacuaccgaccaggcuauuucacccaaacugcugguccauggcaucuagggaaguuagaacuagacuuugauuugugcgaggggaccacagucguugucgacgaacauugcgguaaucgugguccgaguuuacgaacaacuaccguaacagggaaaaucauacaugaaugguguugucgcuccuguacacuuccgccauuaagauucagaggggaagacgguugcugguacggcauggaaauaagacccguaaaagaaaaagaagaaaacuuaguaaaaucuaugguuucagcaggcaguggcgaaguugauucuuuuucguuaggauuauuguguauaucaauuaugauagaagaggugaugaggagcagauggucaagaaaaauguuaaugaccgggacacuagcaguauuuuuccuuuuaauaauggggcaacuuacauggaacgaccuaaucagacuaugcauuaugguaggagccaacgcaucagacaggaugggcaugggaacaacauaucuggcccuaauggcaacuuuuaaaaugcgacccauguucgcaguaggucuacuuuuucgaagacuaacuagcagagagguauuauuguuaacaauugggcuuucucuaguggcuucaguugaauuaccaaauuccuuagaggaauuaggagacggacuugcuaugggaauaaugauccuaaaguuacugaccgauuuccaaagccaucaauuaugggcgacucuauugagcuugaccuuuauuaagacaacguucagccuucauuaugcauggaaaacaauggccauggugcuaucuauaguaucacuauucccauuaugcuugucuacgacgagucagaaaacaacguggcuucccgucuuguuaggaucucuagguuguaagccucucacaauguuucuuauagccgaaaacaaaauuuggggaagacggucauggccucucaacgaagggaucauggccguagggaucguaagcauucuacucagcucccuacucaaaaaugacgugccguuagcagguccccuaauugcaggaggaaugcuuauagcgugcuaugucaucuccgguuccuccgcggauuugucacuagaaaaggcugcugaagucaguugggaagaggaagcugagcauucuggggcaucacauaacauccuuguggagguucaggacgacggaacuaugaaaauaaaagaugaagaacgggacgacacuuuaacaauacuccugaaggcaaccuuacuugcagucucagggguuuauccauuaucgauacccgccacuuuauuuguuugguauuuuuggcagaagaagaaacaaagaagugguguacuaugggauacgcccuccccaccugaaguagaaagagcgguucuagacgauggaauauauaggauuaugcagagaggacuauuagggcgaucacaagucggcguuggcguuuuucaggagaacgucuuucacaccauguggcacguaacacgaggugccguacuuauguaucagggaaagagacucgaaccuucgugggcuagugucaagaaagauuuaaucucuuaugguggggguuggagguuacaagguucauggaauaccggagaagaaguucaaguaauagccguugagcccggcaaaaacccgaaaaacguucaaacggcgccagguacauuuaaaacgccggagggggagguuggcgcuauagcacuagauuuuaaaccagguacgaguggauccccgauaguuaaucgugaaggaaaaauagucggacuguauggaaacggugugguaacaacgucgggaaccuaugucagcgccaucgcacaagcuaaagcaucgcaagaagggccguuaccagaaauagaggacgagguuuucagaaaaagaaaccucacuauaauggauuuacacccuggaagugggaagacucggcguuaucugcccgcaauugucagagaagcuaucaaacgaaaauuacguacacugauucucgcaccaacgagaguugucgcuucagaaauggccgaggcuuuaaaaggcaugccgauaagauaucaaaccacugccguuaaaucugaacacacuggaaaagaaauaguagauuugaugugucaugcuacauucacgaugaggcucuugucaccuguacgggucccuaacuauaauaugauaauaauggaugaagcacauuucacugaucccucaucaauagccgcucguggcuacaucucuacgcgagucgguaugggagaagcagcagcuauauuuaugacagcuacuccaccuggaucaguggaggcauuuccacaaucuaaugcuaucauccaagaugaagaacgagauauccccgagcgcucauggaauaguggguaugaauggauaacagauuuuccugguaaaacaguaugguuuguuccaaguaucaagagugggaacgacauagccaacugucuuagaaagaacggaaagcgagugauccagcuaucuaggaaaacauucgauacagaauaccagaagaccaaaaauaaugauugggauuacgucguaaccacagauaucagugagaugggagcaaacuuuagagcugauagaguuauagauccuagaagaugucuaaaaccaguaauauugaaagaugguccggaaagagucauacuagcaggacccaugccgguaacgguagcuucagcagcacaaaggcgcggaagaauaggucguaaccauaauaaagaaggcgaccaauauauauauauggggcaaccgcuaaauaacgaugaagaucaugcccacuggacagaagcuaagauguugcuagacaauauaaauaccccagagggaauaauacccgcuuuauuugaaccugaaagagaaaaaucggcggcgauagacggugaauacagacugagaggcgaggcucguaaaacguucguugaauuaaugcgcagaggggaucugcccguuugguuaagcuauaaaguugcguccgaaggcuuccaauauucagaucgaagauggugcuucgauggugaaagaaauaaccaaguucuggaagaaaauauggaugucgaaauauggacaaaagaaggugaaagaaagaaacuuaggccucgaugguuagaugcacgcaccuauucagauccacuagcacucagggaauuuaaagaauuugcagcugggcgacgcucagucucgggagacuugauauuagaaauagggaaauuaccccaacauuuaacccaacgcgcucagaacgcauuagauaaucuugucaugcuucauaauagugagcagggagguagggcguauaggcacgcgauggaagaauuaccugauacuaucgaaacacuuauguugcuugcgcugauagcugucuuaacaggaggagucacauuauucuuccuaucaggucgugggcuaggcaaaaccaguauugggcuucuguguguuauggccagcaguguucuccuauggauggcuagugucgaaccccauuggaucgcagcgucuauuauauuggaguucuuuuuaaugguuuuacuuauaccagaaccagauaggcaaaggacaccccaagauaaucaacuugcuuauguaguuauuggguuacuguucaugauucuuacaguugcagccaacgaaauggguuuacuggaaacgaccaagaaagaucucgguauaggacauguggccguagaaaaucaccaucaugcagccaugcuugauguugauuugcauccggcaagcgcauggacuuuauaugcagucgccacaacuauaauuacuccaaugaugagacacacuauugaaaauacgacugcuaacauuucccucaccgcaauugcaaaucaagcagcuauacuaauggggcuagauaaaggauggccaauuuccaaaauggacauuggaguuccauugcuugccuuaggauguuauagccaaguaaauccacuuacccuaacugcagcaguuuuaaugcuaguagcgcauuacgcuauaauagguccgggccuacaagccaaggccacccgagaagcgcagaaaagaacggcagcggguauuaugaaaaauccgaccguagacggaauaguggcaaucgauuuagauccuguaguuuacgacgcuaaauucgaaaagcaguuagggcagauaauguuauuaaucuuaugcaccagccaaauccuauugaugagaacaacuugggcuuugugcgaauccaucacgcuggccaccggaccacuaacuacacuaugggaagguaguccugguaaauuuuggaacacuacaaucgcaguauccauggcuaauauuuuuagaggaucauacuuagcuggugcugggcuagccuuuucgcuaaugaagucacugggcggagguagaagaggaacuggcgcccaaggagaaacacuuggagaaaaauggaaaagacaauuaaaccaacuuucaaaaucggaauuuaacaccuacaaaagaucugggauaauggaaguagauagaucagaagcuaaggaaggacuaaaaagaggggaaacaaccaaacaugccguaagccggggaacugcaaaacuaagaugguucguugaaagaaaccuugugaaaccagaaggaaaggucauagacuuaggaugcggccgcgguggcugguccuacuauugcgcgggauuaaagaaagucacagaaguaaaggguuauacaaaaggaggucccggccaugaagaaccgauuccaauggcuacauauggauggaaucuagucaaguuacauagcggcaaagauguauucuucauaccaccugaaaaaugcgacacacucuuaugugacauaggcgagaguaguccuaaucccacaauagaggaaggucguacauuaagaguacuuaaaaugguugaacccuggcuuaggggaaaucaauucuguauaaaaauacuaaaccccuauaugccguccguuguagaaacuuuggaacaaaugcaaagaaaacacggaggaauguugguaagaaacccacuaucaagaaauaguacacaugagauguauuggguaucgugcggaacagggaauauuguaucagcagugaauaugacaucucgcaugcuauuaaaucgauucacaauggcucauagaaaaccaacauaugaacgggauguagaccuaggagcagguacuagacacguggccguggaaccugaaguugcaaacuuagacauuauaggccaaagaauugaaaacauuaaacacgaacacaaauccacguggcacuaugacgaagacaacccauauaaaaccugggccuaucaugguucauacgaagugaagccgaguggcucugccucgaguauggugaacggaguuguuaaacuuuugacuaaaccgugggauguuauccccauggucacacagauagccaugacagauacaacacccuuuggacaacaacgaguauuuaaagaaaaaguggacacaaggacgccuaaagcaaaacgaggcaccgcccaaauaauggaggugacggcaaaauggcuuugggguuuccuuucuaggaauaagaaaccaagaauaugcacgcgagaggaauuuacacguaaaguacguucgaaugcggcgaucggagcuguauucguggacgaaaaucaguggaacucagccaaagaagcuguagaggacgaaagguuuugggaucuaguacauagagaaagagaacuacacaaacaaggaaaaugugcuaccugcguauacaacaugaugggaaaaagagagaagaaauuaggggaguucgggaaagcaaaaggaagucgugccaucugguacauguggcuaggcgcgagguuccuagaauuugaagcucugggauuuaugaacgaagaucacugguuuucgcgggaaaauucuuugucagguguagagggggagggacuacacaagcuaggauauauacugagggauauaucaaaaauuccagguggcaacauguaugcagacgauacagccggaugggacacacguauuacugaagaugacuuacagaaugaggcgcgcauuacugacaucauggaacccgaacacgcacuucuagcaaagucuauauuuaaacuaacauaucaaaauaaagucguacguguccaaagaccugccaaaaauggaacaguuauggacguaauaucucgucgcgaccaacgugguaguggccagguagguacuuauggacuuaacacguuuacaaacauggaggcgcaguuaauaagacagauggaaagugaaggaauauucuccccuucagaacuugaaacgcccaauuuagcugagaggguucucgacuggcucgaaaaguauggaguagaaaggcuaaaaagaauggccauuucaggagacgauuguguggugaaaccuaucgaugauagguucgcuacugcgcucacugcauuaaaugacauggggaaggugagaaaagacauaccgcaaugggaaccaucuaaaggauggaacgauuggcaacaaguuccauuuuguagccaccauuuucaucaauugauuaugaaggacgguagagagauaguaguaccuugucgaaaucaagacgagcuaguaggacgagcaagagugucucaaggagcaggcuggucacuaagagaaacggccuguuuagguaaaagcuaugcgcaaauguggcaacuuauguacuuucacagacgggaccuaaggcuugcggcuaacgcuauuuguucagcgguaccuguggacuggauucccacaagcagaacuacauggucaauacaugcccaucaccaauggaugacuaccgaagauauguuaucugucuggaauaggguguggauugaagagaauccauggauggaagauaagacucacauaaguagcuggggugauguaccuuauuuaggcaaaagggaagaucaauggugcggcagucugauagguuugacugcuagggcaacuugggcaacuaauauacaaguugcaauaaaucaggugaggaggcuuauaggaaaugaaaauuaucuugacuauaugacaucaaugaaaagauucaaaaaugagggagauccagagggagcauugugguaa

SEQ ID NO: 21498 - RNA, 9879 nt, Artificial Sequence
  derived and/or modified CDS sequence (opt6) from DENV-1__FJ410287__SS-prME
agcguuaccauguuacuaauguugaugcccacggcacuagccuuucaucuuacaaccagaggaggugaaccgcauaugauaguuucgaaacaggaacgugguaaaagccuucucuucaagacgagcgcuggaguaaauaugugcacucucauagccauggaucuaggagaacuaugcgaagauacgaugacauauaaaugccccaggauaacagaaacugagccagacgauguugacuguuggugcaacgccacagacacuuggguuacguaugggacuugcagccagacaggggaacaucgccgagauaaacguaguguugcacuagcaccgcacguaggacuaggauuggagacccgaacugagacauggaugaguucugaaggagcguggaaacaaauucaaagaguagagacaugggcuuuaagacacccuggauucacagugauugcacucuuccuugcacaugccauuggaacaagcauaacacaaaagggaauuauuuucauacuucuuauguuaguaacgccaaguauggcaaugagaugcguagggauaggaucucgcgacuuuguagagggacuaucaggcgcaacguggguugacguuguccucgaacacgguucaugugucacaaccauggcaaaagauaaaccuacucucgacauagaacuguuaaaaacggaagucaccaauccagcaguauugcgaaaauuauguaucgaagccaagaucuccaauacuacgacugauagucgaugucccacccaaggggaagcuacacuaguugaggaacaggacgcaaacuuugucuguagaagaaccuuuguggauagaggauggggaaacggauguggucucuucggaaaggggagucugaucacaugugcuaaauuuaaauguguaacaaaauuggaagguaaaauaguacaauacgagaaccuuaaauauucagucauaguuaccguacacacgggagaccaacaucaggucggaaaugaaucuacagaacauggaacuacugcaacuauuacgagucaggcuccgacaacagaaauacagcuaacagacuacggagcauuaacauuggauugcaguccgcguacagguuuggacuuuaacgaaaugguacuccuaaccaugaaagaaaaaucuuggcuuguucauaaacagugguuccuggauuuaccguugccauggacuucuggagccaguacgucgcaggagacauggaaucgacaggaccuucuuguaacauucaaaacggcacaugcaaagaaacaggaagucguuguguuggguucacaggaaggugcaaugcacacagcccuuacuggcgcuaccgaaauacaaaccucaggaaccacaacaauauuugccggucaucuaaaaugcagacugaaaauggauaagcuuacgcuaaagggaaugaguuauguaauguguacugguaguuuuaaacuagagaaggaaguagcagaaacucaacaugguacaguauugguccaaauuaaauacgaaggaacugaugccccuuguaaaauucccuuuuuaacacaagaugaaaaaggagucacucaaaacgguagguuaaucacugcgaauccuauagucacggauaaagaaaagccagucaauaucgaggcagaaccaccuuuuggagagucauauauuauuauaggcgcuggugaaaaagcccuaaaauuaucaugguuuaaaaaaggaucgagcauaggaaagauguuugaagcaacugcaagaggugcaagacggauggcaauuuugggagauacggcaugggauuucgguagcauagggggagucuuuacaucuguggguaaacucguucaucagauuuucggaacugcauacggugucuuauucucaggugugaguuggacuaugaaaauagguauagggguccuauuaacguggcugggacucaauucgagaaguacauccuugagcaugacaugcauugcagugggcuuagucacguuguaucugggaguuaugguucaggcugauagcgggugcgugauuaacuggaaaggaagagagcuuaaaugcggcucugguauauuuguaaccaaugaaguucacacuuggacugaacaauauaaauuucaggcugacucgccaaagcgucugagcgccgcaauaggaaaagcaugggaagaagguguaugcggaauacgaagugccaccagacuagaaaauaucauguggaaacaaauaucaaacgaacucaaccauauuuuguuagaaaacgacaugaaauucacggucguuguuggggacguugccgguauuuuagcacaggggaaaaaaaugauaagaccccaacccauggaguacaaauacuccuggaaaucauggggcaaagcuaagauaauaggggcagacguacagaacacaaccuuuaucauugauggaccuaauaccccagaaugucccgacgaucaaagagcauggaacaucugggagguggaagauuacggauuuggaauauuuacgaccaauauaugguugaaacuucgggauaguuauacucaggugugcgaucacagacucaugucggcagcaauuaaagacucuaaggcuguucaugcugauauggguuacuggauagaaagugagaaaaacgagaccuggaaauuggcgagggcgucguuuaucgaggucaaaacauguauuuggccuaaaucacauaccuugugguccaauggaguucuagaauccgaaaugaucauuccuaagaucuauggaggcccaauaucucaacauaacuaccguccagguuauuucacacagaccgcggggccauggcacuuagguaaauuagaauuagauuuugaucuaugugaagggaccacaguaguaguugaugaacacuguggcaauagaggaccgaguuugaggacuacaacaguaacaggaaaaaucauacaugaaugguguugucgaucuuguaccuugccuccccuuagauucagaggugaagauggguguugguacggaauggaaauacggcccguaaaagagaaggaagagaaucuugugaaaucaaugguuagcgcagguuccggcgaaguugauucauucagcuuaggcuuauuguguaucaguauaaucauagaggagguaaugcguuccagauggucuagaaaaauguuaaugacgggaacauuggcuguguucuuuuuacucauuaugggccaacucacauggaacgauuuaauaagacugugcauuaugguuggagcaaaugccucugaccgcauggguaugggaacuacauaucuagccuuaauggcuacauuuaaaaugaggccgauguuugccguaggccuuuuguucagaagauugacgucacgugaaguucugcuucuaacgauaggauuaagucuaguugcauccguugaauugccaaauucucuugaggaguuaggcgacggauuagcaauggguauaaugauccuaaaacuauuaaccgacuuucagagucaucaacucugggcaacacuacugagucuuacguuuauaaagacaacuuuuagcuuacacuaugcauggaaaacaauggcaaugguguuaucaauaguuucgcuauucccauuaugucugucgacuacuagucaaaagaccaccuggcuuccuguuuuacuaggaaguuuaggaugcaaaccucucacaauguuuuuaaucgcagaaaacaaaauauggggucguaggaguuggccucuaaaugaagggauaauggcuguugguauugugagcauucuauuaaguagcuuacuaaaaaacgauguuccacuugccggcccuuugaucgcaggcgguaugcuaauugcauguuacguaauuucaggcucuucagccgauuugucacuagaaaaagcugcugaagugaguugggaagaggaagcugaacacaguggugcaucacacaacauauuaguagaagugcaagaugacggcacuaugaaaauaaaagaugaagaaagagaugacacuuuaacaauacugcugaaagcuacgcucuuagcugugucaggaguauacccacuuucgauaccagcuacccuguucguuugguauuucuggcaaaaaaaaaaacagaggucggguguccuuugggauaccccaucgccuccggagguugagagagcuguauuagacgaugggauauauagaauaaugcagcguggauugcugggccguagucagguaggggugggggucuuucaagaaaauguauuucacacaauguggcacguaacgagaggcgcuguucuaauguaucaagguaagagauuagaaccauccugggcgagcguaaaaaaggaucuaaucucauauggcggaggguggcgacuucaggggagcuggaacacgggcgaggaaguccaagucauagcuguagaaccggguaaaaaccccaaaaacguccagacugcucccggaacauucaaaacaccagagggugaagucggagcuauagcucucgacuuuaaaccaggaacaucugguagucccauaguaaauagagaggguaaaauagugggauuguacggaaauggagucguaacaacgaguggaacauauguaagcgcaauagcacaagcaaaggcaucacaggaagggccacuaccugaaauagaagaugaaguauuuagaaaacggaauuugaccauaauggauuuacauccugguuccggaaaaacucggcgcuauuuaccagcuauuguuagagaggcuauaaaacgcaaacuuaggacgcuaauuuuggcuccuacucguguaguagcaucggagauggcagaagcguuaaaagguaugccuaucagauaccagacuacagcuguaaaaucugaacauaccgguaaagaaauagucgaucugaugugccacgcgacauuuacaaugagauuauuaaguccaguucgagucccaaacuacaacaugauuauuauggaugaggcgcauuuuacggacccaucauccauagcagccagaggauauauaucaacaaggguaggaaugggcgaagcagcggcaaucuucaugacagcaacgccuccagguuccguggaagccuuuccacaauccaaugccguaauucaagaugaggaaagggauauaccggaacgaucguggaauucgggauaugaauggauaaccgauuuuccaggaaaaacgguuugguuuguaccaaguauaaaauccggaaaugauaucgcaaauugccuacgaaaaaacgguaaacgaguaauacaacucucacggaaaaccuucgacacagaauaucaaaagacuaaaaacaaugacugggauuauguggugacaaccgauauaucggaaaugggagcaaauuucagagcggaucguguuaucgacccgagaagaugucuuaaaccaguuauauuaaaggacggaccagaacgcguuauauuagcggguccgaugccuguuaccguugcaucagcggcacaaagaaggggacgaauaggaagaaaucacaacaaagaaggagaccaguauauauacaugggacaacccuugaacaacgaugaagaucaugcccacuggacugaagcaaaaaugcuuuuagacaauauuaacacuccggaggguauuauccccgcgcuauuugaaccugaaagagagaaaucagcugccauugacggagaauaucgacugaggggcgaagcgcgaaagacauuuguagaauugaugagaagaggagauuuaccaguauggcugucuuacaaaguagccagugagggcuuucaauacucagauagaaggugguguuuugauggugagaggaauaaccagguacucgaggagaacauggauguagagauuuggacuaaggagggcgaacgaaaaaagcugagacccagaugguuggacgcgagaacuuauagcgauccacuugcacuaagagaguuuaaagaauucgcagcgggacgucgaaguguuucgggagacuuaauauuagagaucgguaaacucccccaacaucuaacacagagagcgcaaaaugcguuagacaaucugguuauguuacauaauagugaacaaggaggacgcgcuuauagacaugcaauggaagaacuaccggacacuaucgagacgcuaaugcuuuuagcuuuaauagccguuuugacgggcggaguuacacuauucuuccuaucugguagaggguuaggaaaaacgagcauaggauuacuuuguguuauggcuucaaguguauuguuauggauggcgucuguagaaccacacuggauugcugcaaguauuaucuuagaguuuuuccuaaugguccuauuaauuccggaaccagacagacaacguaccccucaagauaaucaacuugcauauguagucauagggcuauuauucaugauacucacagucgcugcaaacgagaugggauugcuugaaacaacaaagaaggaucuaggcaucggccauguagcaguagagaaucaucaucacgcagcgaugcuugauguagacuugcaucccgccagugcguggaccuuauacgcaguagcuacuacaauuauaacuccaaugaugaggcauacaauugagaauacuacagcgaauauaaguuugacagcaauugcaaaucaagcugcaauauugaugggcuuggauaaaggauggccaauaucaaaaauggacauagguguaccacuacuagcacuagguugcuacucacaggugaacccucucacacuaacagccgccguuuuaauguuaguagcacacuacgcuauuauaggaccuggauuacaagccaaagcaacucgugaagcucaaaaacgaacagcugcagguauaaugaaaaacccaacaguugauggcauaguagcuauugaucuugacccgguaguguacgacgcuaaguucgagaaacaauuaggccaaauaauguuguuaauauugugcacaucgcaaauacucuuaaugagaacuacuugggcuuuaugcgaaagcauuacauuagcgacaggcccacugaccacauuaugggaggggaguccagguaaauuuuggaauaccacaaucgcgguaucaauggcaaauauuuuucgcgguucguacuuagcgggcgcgggacuggccuuuaguuugaugaagaguuugggugguggaagacguggcacaggugcucaaggagaaacacugggugagaaauggaagaggcaacuaaaucaacuaucaaaaagugaauuuaacacauauaagagaagugggauuauggaaguugaccgguccgaagcaaaggagggacuaaaacgcggagaaaccacgaaacaugcaguuucacgcggaacugcaaaacuacggugguucguagaacguaaucuuguaaaaccagagggaaaagugauugaucuugggugugguagaggaggguggucauauuacugugcugggcugaaaaaagugacagagguaaaagguuauacaaaagguggaccuggucaugaagagccaauacccauggcgacauauggcuggaacuuaguaaaguugcauucaggcaaagauguuuuuuucauaccaccugaaaagugugauacuuuacugugugacauuggugaaucaaguccuaacccaacgaucgaagaaggucgaacauugagaguguugaaaaugguagaaccauggcugcgaggaaaccaauuuugcaucaaaauauugaauccguauaugccuucagucguagagaccuuagaacagaugcaaagaaagcauggaggaaugcuuguacgcaauccccuaagccgaaacaguacacacgaaauguauuggguaaguugugguacaggaaacauaguuagugcaguaaauaugacuucuagaauguuacuaaaccguuuuacaauggcacauaggaagccaaccuaugagagggacguagacuuaggcgcaggaacucgucacgucgcugucgagccggaaguagcaaaccuagauauuaucggccaaagaauagaaaacauuaagcaugagcauaaaaguacuuggcauuaugaugaagauaauccauauaaaacaugggccuaucacggaucuuacgagguuaaaccaucuggcucagcuaguucaaugguaaauggaguagucaaacuacuaacuaagccaugggacguuaucccuauggucacucaaauagcuaugacagacacuacucccuucggacaacagcgggucuucaaagaaaaaguugacacacgaacuccgaaagcuaaaagggguacagcacaaauaauggaaguaacagcuaaauggcuauggggauuccuaucucggaacaaaaagccgcgaaucugcacuagagaagaauuuacuagaaaaguuaggagcaacgcagcuauuggcgcgguuuuuguggacgaaaaucaguggaauuccgcaaaggaggcuguagaggaugagcguuucugggauuuaguacaucgugagcgugaacuccacaaacaagguaaaugugcuacauguguuuauaauaugaugggaaagcgggaaaagaagcuaggcgaguuuggaaaggcaaagggaucucgugcaaucugguacaugugguuaggagcaagauuccuagaauucgaggcccuaggauuuaugaacgaagaucacugguucagccgagagaacucucuuaguggaguagaaggugaagguuugcauaagcuaggguauauacuacgcgauauaucaaaaauacccggcgguaacauguaugcugaugauacugccgguugggacacaagaauaacagaagacgauuuacaaaacgaagcuaggauaacagacauaauggaacccgaacaugcacuacuagcuaaauccauuuucaaauuaacuuaucaaaauaaaguggucagaguccagagaccugcaaaaaauggaacuguaauggauguaaucucuagacgagaccaacgcggauccggacaggugggaacauaugggcuaaacacauuuacaaauauggaagcccaguuaauucgacaaauggagucugaaggaauuuucucuccuagugaauuagaaacgccaaaccucgcagaaagaguacuggacugguuggaaaaauauggugucgagagauuaaaacgcauggcuauuucgggugaugauuguguugugaaaccaaucgacgaccgauuugcuacggcauugacagcguuaaaugauauggggaaaguaagaaaagauauaccacaaugggaaccuuccaaagguuggaacgacuggcagcaaguaccguucuguagccaucacuuccaccaauuaauaaugaaagauggaagagagauuguuguaccauguagaaaccaagacgaacucguugguagagcuagggucagccagggagcaggauggagucugagggaaacugcgugcuuaggaaagagcuacgcacagauguggcaguugauguauuuccauagacgugaccugcgauuagcugcuaaugcaaucugcagcgcaguaccgguagacuggauucccacaucccgaacgacuuggagcauccaugcacaucaccaauggaugacgaccgaggauaugcuaucuguauggaaucguguauggauagaagaaaauccauggauggaggauaaaacacacaucaguagcuggggugacguccccuaucuugggaaaagagaagaucaauggugcggaagcuuaauuggccuaacugcgagagcuacgugggcuacuaauauacagguggcaauaaaucaagugagacgacuuauagggaaugaaaacuacuuagacuauaugaccucuaugaaaagauuuaaaaaugaaggugauccugaaggagcucuaugguga

SEQ ID NO: 21499 - RNA, 9879 nt, Artificial Sequence
  derived and/or modified CDS sequence (opt6) from DENV-1__FJ432719__SS-prME
aguguaacgauguuacugauguuaaugccgacggcacuagcuuuccaucucacuacgcgaggaggagaaccucacaugauuguauccaaacaagaacgugguaagagcuugcuguuuaaaacuagcgcugggguaaauaugugcacguuaauugcaauggacuuaggggaacuaugugaagauacuaugacauacaaauguccgagaauuacugaaaccgaaccagaugauguggacugcugguguaacgcgacugauacuugggugacauacggcacauguagucaaaccggugaacauagacgcgauaaaaggaguguagcuuuggccccgcacguaggguugggacuggaaaccagaaccgaaacauggaugucaagcgagggugcauggaaacaaauacaacgaguagaaacuugggcauuaagacacccgggauuuacaguaauagcucuauuuuuggcacacgcuauuggcacaucuauuacacaaaaagguauuauuuucauuuuacuaauguuaguuacaccaucaauggcaaugcguugugugggaauaggaaguagggauuuuguugaaggccuuaguggagccaccuggguugauguaguacuagaacauggcagcuguguuaccacgauggcgaaagacaaaccuacuuuggacauagagcuauugaaaaccgaaguuacaaaccccgcaguuuugcgcaaacuauguauugaagcuaaaauaaguaauacgacaacggacagccgauguccuacacaaggcgaggcuacacuuguagaagaacaagaugcaaauuuugucuguagaaggacauucgucgaucgagggugggggaaugguugcggauuauuugguaaagggagcuuaauuacaugcgcaaaauuuaagugcguaacaaagcucgaaggaaaaauaguacaauaugagaacuugaaauacucagugauuguaacugugcauaccggagaucaacaucaagucggaaacgaaagcacagaacauggaacaaccgcuaccauaacuccacaagcuccaacugccgaaauacaauuaacggauuacggcgcacuaacucucgauugcucaccccgcacaggauuagauuucaacgaaauggugcuauuaacuaugaaggagaaaucauggcuaguucauaaacaaugguuccuagaccugccucuucccuggaccucuggggccaguacaagucaagaaacuuggaacagacaagauuuacucgugacauucaaaacggcccacgcgaagaagcaagaaguggugguauuaggcucgcaagaaggcgcuaugcauaccgcauuaacgggggcuacagagauucaaacaucggguacaacgacgauauuugcuggccaccucaaaugcagacuaaaaauggauaaacuuacauuaaaagguaugagcuacgucaugugcacaggguccuuuaagcuagaaaaagaacuagcagagacacaacauggaaccguauugguacaaauuaaauaugaagguaccgacgcaccaugcaagauaccguucucuacucaagaugagaaggggguuacacaaaauggaagacuaaucacugcaaauccuauaguaacagauaaagaaaaacccgugaacauugaagcugagccaccauucggggaauccuacauaguaauuggggcuggagaaaaagccuuaaaauuaucaugguucaagaaaggcuccaguauaggcaaaauguuugaagcaacagcuagaggagcuaggcguauggcaauucuaggugauacagccugggauuucgguagcauaggaggagucuuuacauccguugguaaauuaguucaucaaauauucggcaccgcuuaugggguacuauucagcggaguuucuuggaccaugaaaauuggaauuggagucuuguuaacauggcuaggacugaauagcagaagcacuagcuuaucaaugacguguauagcugucggacuuguaacacuuuaucuuggaguaaugguacaagcagauucuggaugcgugauuaacuggaagggacgugaauuaaaauguggcucggguauuuuugugacaaacgaaguacauaccuggacugagcaauacaaauuucaagcggauucgcccaaaagauuaagugcagcuauuggaaaagcaugggaagaaggaguuugugguaucaggucagcgacacgacuagagaacauaauguggaagcaaauuucaaacgaacugaaucacauucuauuagagaaugacaugaaauuuacuguuguaguuggagauguugcggguaucuuagcgcaaggcaagaaaaugauucgaccacagccaauggaauauaaauauucauggaaaagcugggguaaagcaaaaauaauuggagcagacguacagaacaccacauucauaauugaugggccaaacacaccugaaugcccugaugaucaaagagcauggaauauuugggaaguugaagacuaugguuucgggaucuucacaacgaauauuuggcuaaaacuacgugauagcuauacgcagguuugcgaucauaggcucaugucagcagccaucaaagauagcaaagccguccacgcagauaugggguacuggauugaguccgagaaaaaugaaacauggaaacuugcaagagccucuuuuauagaggugaaaacuuguauauggccaaaaagucacacauuguggucaaacggaguucuugaaagcgaaaugauaauucccaaaauuuacggcgggccaauaagccaacacaauuaucgaccgggcuacuuuacacagacagcagguccguggcaccuuggaaagcucgagcuagauuuugacuuaugugaagguacaacaguaguugucgacgaacacuguggaaaccgaggaccgaguuuaagaacaacaacaguaaccggaaaaauaauacaugaauggugcugucggaguuguacauuaccaccuuuaagauuucgaggugaagauggaugcugguauggaauggagauaaggccugugaaggaaaaagaagaaaacuuggugaagucgaugguaagcgcaggcucaggggaggucgauucuuuuagccucggucuauuguguauaucgauuaugauugaagagguaaugcggucaagauggagucgcaagaugcuaaugacgggaacauuagcuguauuuuucuuauuaauuaugggacaacucacguggaaugauuugauaagacuauguaucauggucggugccaaugcaucagaucguaugggaaugggaacaacuuauuuggcgcuaauggcaacauucaagaugagaccuauguucgcggucggauuauuguuucgaagauugaccaguagggaaguauuacuacuaacaauuggccuuuccuuaguagcgaguguggaacuaccuaauagccuugaggaauuaggagauggauuggcuaugggaauaaugauauuaaaacuguuaacugauuuucagagucaucaauuaugggcaacacugcugagucuaaccuucauaaaaacuaccuucuccuuacacuacgcuuggaaaacuauggcaaugguuuugucuauuguaagucuguuuccucugugcuuaucaacaacuucacagaaaacgacauggcucccaguacugcuagggagccuaggauguaaacccuugaccauguuuuugaucgcugaaaauaaaauuugggguagaagaaguuggccacucaacgaaggcauaauggccgugggaauaguuagcauacuucuaaguucgcucuugaaaaaugaugucccccuagccggaccguuaauagcuggugggauguuaauagcauguuaugugauuucagguucguccgccgauuuaagccucgaaaaggcagcggaaguaucaugggaggaagaagcagagcacagcggugcuagccauaacauccuaguagaagugcaggacgauggcacaaugaaaauaaaagacgaagagagagaugacacacugacaauauuauuaaaggccacguuacuagcuguaagcggaguuuaucccuuaaguaucccggcaacauuauuuguaugguauuucuggcagaagaagaaacaaagaucaggaguguuaugggauacgccaucgccuccagaaguggaacgcgcgguucuagacgacggcaucuaucgaauaaugcagagaggacuauuaggaagaucacaagucggaguugguguauuucaagaaaacguauuccacacuauguggcacguuacuagaggugccguauuaauguaucaagggaagcgacucgagccauccugggcaagcgucaagaaagaccucauaucguauggggguggcuggagacuacaagguucauggaauacaggcgaggagguacaaguuauugccguagaaccgggcaaaaauccgaagaauguucagacagcccccgguaccuuuaaaacaccugaaggggaaguaggcgcaauagcgcuagauuucaaaccaggaaccucagguucuccaauaguaaacagagaaggaaaaauuguaggguuauaugguaauggaguaguaacgacuagcgguacguauguaagcgcaauugcucaggcaaaagccagccaagaggguccauuaccugaaauagaagaugaggucuucagaaagagaaauuuaacaauaauggaccuacaucccggaaguggcaagaccagaagauaucugccggccauaguaagagaagcgauaaaacggaaguugcgcacacuaauacuagccccaacuagaguuguugccucggaaauggcagaggccuuaaaaggcaugccuauuagauaucaaacaacugcaguaaaaucagaacauacugguaaagagauaguugaucuaaugugucacgcuacuuucacuaugagacuauuaagccccguacgaguuccgaauuacaauaugauaauaauggaugaggcucauuucaccgacccaucaaguauagcagcacgggguuauauaaguacgagaguuggaaugggagaggcugccgcuauauuuaugacugcgacaccgccaggaucaguugaagcauuuccacaaagcaacgccgugauccaagaugaagaaagagacauuccugaaagaucguggaauagcgguuaugaguggauuacugauuuuccugguaagacagucugguuuguaccaagcauaaagucaggaaaugacauagcaaacugccugagaaagaauggaaaaagaguaauucaacuuucacgaaaaaccuuugauacagaauaccagaaaacuaaaaauaaugacugggacuaugugguaacaacugauauaucagaaaugggcgcaaauuuccgagcugauagaguaaucgacccacgaagaugcuuaaaaccuguaaucuuaaaagaugguccagaacgugugauccuggcugguccaaugccaguaacgguagccucagcagcgcaaagacgaggacgaauaggacguaaucacaauaaagaaggggaccaauauauuuacaugggacaaccacuuaacaacgacgaagaccaugcacauuggaccgaagcuaagaugcucuuagauaacaucaacaccccggaggggaucauuccugcacuuuucgagccugagcgagaaaagagcgccgcaauugacggagaguacagauuacggggagaggcacgcaaaacuuucguugagcuaaugagacguggggaucugccugucugguuaaguuauaagguagcuucagaaggguuccaauacucggaucggcgauggugcuuugacggugaaagaaacaaccaagugcuugaagaaaacauggacguggaaauauggaccaaagaaggggagcgaaagaaauugagaccaagguggcuggaugccagaacguacuccgauccuuuggcuuuaagggaauuuaaagaguucgcugcugguagaaggucagucucaggcgaucuuauucuagagauuggaaaguuaccacaacauuugacgcaacgagcucaaaaugcuuuggacaaucuagucauguugcacaacucagaacaagggggucgcgccuaucgacaugcgauggaagaacuacccgauacuaucgaaacauugaugcuacuggcucuaauagcuguucuuaccggagggguaacccuauucuuucuuucagguagagggcuaggaaaaacgucaauuggccuucucugcgugauggcaaguaguguauuacuauggauggcuaguguagaaccgcacuggauagccgcaaguauuaucuuggaguuuuucuuaaugguguuauuaauuccagagcccgauagacagaggacaccucaagacaaccaguuagcauacguuguaaucggucuucuauuuaugauuuuaacaguugcggcaaacgagaugggauuacuugagacuacgaagaaagaccuuggaauaggccauguagcaguugagaaucaccaucaugcagcuaugcuugauguagauuuacauccggcaucugcuuggacccuauacgccguugcuaccacuauaauaacaccaaugaugagacauacaauagagaacacgacagcuaacaucagcuuaacugcaauugcaaaccaagcagcaaucuugaugggccuggacaaaggcuggccaauaucuaaaauggauauagguguaccccuccucgcacuaggauguuauucacaagucaauccucuaacgcucaccgcagcaguccuuauguuaguagcucacuaugccauaaucgguccagguuuacaagccaaagcuacaagagaagcacaaaagagaacagcggcgggaauaaugaaaaauccaacuguugacggaauuguugcuauagaucuagacccagugguauaugaugccaaauuugaaaaacaauuaggacagauuauguuauugauacuaugcacaagucaaauauuauuaaugagaacaacaugggcucugugugagucaauuacauuagcgacagguccccuaacaacgcuuugggaagggucaccuggcaaguucuggaacaccacaauagcaguaucgauggccaauauuuuucggggcucuuaucuugcaggggcgggacuagcauuuucauuaaugaagaguuuagguggaggcagacgaggcacgggcgcgcagggcgaaacacuuggggaaaaguggaagaggcaguugaaucaauuaaguaaaucugaauuuaauacguauaagcgaagugggauaauggaaguugauagaucagaagcgaaagaaggucuuaaaagaggcgaaacaaccaagcaugcgguuucaagaggaacggcuaaacuucgaugguucguagagcguaaccuagucaagccagaagggaaaguuauagauuuagguuguggaagaggaggauggagcuacuacugcgcggguuugaaaaaggucaccgagguaaaaggauauacaaaagggggaccugggcacgaggaaccgaucccaauggcaacguauggauggaaucuugucaaauuacauucaggaaaggauguguucuucauaccacccgagaaaugcgacacacuccugugcgacauuggugaaucaucccccaauccaaccauagaagaaggucguacccuacggguucucaaaauggucgaacccuggcugcgagguaaucaguucugcauaaagauacuuaaccccuauaugcccucugucgucgagacauuggaacaaaugcaaagaaaacauggcggaaugcuuguuaggaauccguuaucaagaaacuccacgcaugaaauguauuggguaaguugugguaccggcaauauaguauccgcaguaaauaugacauccagaaugcuucuuaaucgauuuaccauggcacaucguaagccgacuuacgaaagagauguugauuuaggcgccggaacucgccauguagcaguggaaccagaaguugcaaaccuagauauaauagggcaaagaauagagaacaucaaacacgaacacaaaucaaccuggcauuaugacgaagauaacccauacaagacaugggcauaucacggcucuuaugaaguuaaaccaaguggaagcgccucuucuaugguaaacggaguaguuaaacuacuuacaaagcccugggacguuauaccgauggugacccaaauugcaaugacagauaccacaccuuucggucaacaaaggguuuucaaagaaaaaguugacacaagaacaccgaaagcaaaaagagguaccgcacagaucauggaaguuacugcuaaaugguuauggggguuccuaagucggaauaaaaagccacgaauuuguacacgagaagaauuuaccagaaaaguaagaucuaacgcugccauaggggccguuuuuguggacgagaaucaauggaacucagcgaaagaggcaguugaagaugagagauuuugggauuugguucaucgugaaagagaauuacauaagcaaggcaagugugcaacauguguauauaauaugauggguaagagggagaagaaacucggcgaguucgggaaagcgaaaggaucgcgggccauaugguacauguggcuaggcgcaagguuccucgaguucgaagcucuuggauuuaugaaugaagaucacugguucaguagagaaaacucccucagcggggucgagggggaaggauugcacaaacuugguuacauacuaagagacauaagcaaaauuccgggaggaaauauguaugccgacgacacugcaggaugggauacaaggauaacagaggaugaccuacagaacgaagcucguauuacggauaucauggagccugaacaugcauuauuggcuaaaucaauuuucaaacuaacuuaucagaauaaagucguacguguacaaagaccggccaaaaacggaacugucauggauguaaucucacgucgagaucaaagggguagcggccaaguuggaacuuauggacuaaauacauuuacaaauauggaagcucaacuaaucagacagauggaaagcgaagguaucuucaguccuagugaauuagagacaccgaacuuagcagaacgcguucuugacuggcucgaaaaguacggagucgagaggcugaagagaauggcaauuucaggagaugauugcguaguaaagccuauugacgacagauucgcaaccgcacuaacagcuuugaaugauaugggaaagguaaggaaggauaucccucaaugggaaccaagcaaaggauggaacgauuggcaacagguaccauuuuguucccaucacuuccaucaauugauuaugaaggaugggcgagaaauaguugugccauguagaaaccaggacgaauuggucggccgagcucgaguuagucaaggugcaggcuggaguuugcgugaaacagcuugccuaggcaaaagcuaugcacaaauguggcaacuaauguacuuucauaggagggaucuaagacuagcagcaaacgcaauuuguucagcaguaccgguagacuggauaccaacauccagaacuacguggucuauucaugcgcaucaucaauggaugacuacugaagauaugcucucgguuuggaaucguguauggauagaagaaaauccguggauggaagauaaaacgcacauuaguagcuggggugauguacccuauuuaggaaaacgcgaagaccaaugguguggcagcuuaauuggauuaacugcucgggcaacaugggcaacuaacauacaggucgcaauaaaccagguucgaagacuaaucggcaaugaaaauuaccucgacuauaugacaaguaugaaacgcuuuaaaaaugaaagugacccagaaggggcacucugguaa

SEQ ID NO: 21500 - RNA, 9879 nt, Artificial Sequence
  derived and/or modified CDS sequence (opt6) from DENV-1__FJ182020__SS-prME
ucuguuaccaugcuacuuauguuaaugccaacugccuuggcuuuccauuuaaccacuagaggcggugaaccucauaugauagugucaaaacaggaacgagguaaaucacuacuuuuuaaaacaucagcgggagugaacauguguacacucauagcuauggacuuaggagaguucugugaagauaccaugacauauaaguguccaaggauaacagaagcagaaccggacgacguagacugcuggugcaacgcaaccgacacauggguuacuuacggaaccuguucccaaacuggagaacauagacgagauaagagaagcguugcauuagcaccacauguggggcuuggacuagaaacgagaacugaaacauggaugagcucagaaggagcuuggaaacaaauacaaagaguagaaacuugggcucucagacauccaggguucacugugaucgcauuauuccuagcccaugcgauaggaacaagcauaacucagaaaggcauaaucuuuauccuguuaauguuagugacgccuaguauggcaaugaggugcguagguauuggaagcagagacuuuguggaagguuugucaggagcuacuuggguagacguuguguuagagcaugggucuugcgucacuacuauggccaaagauaaaccaacacuugauaucgaacuauugaagacggaaguuacaaauccggccguacugcggaaauuaugcauugaagcuaaaauauccaauacuaccacagacucaagauguccaacacaaggcgaagcaacguuagucgaagaacaagacgcgaauuuuguuuguagacguacauucguagacagagguuggggaaacggguguggucuuuucggaaagggaucucuuauaacgugugcgaaguucaaauguguaacuaaacuagaggggaaaauaguccaauaugaaaaccugaaauauucaguuauagucaccguucauacaggugaccagcaucaaguugguaaugaaucgacagagcauggaaccacagcgaccauuacaccacaagcaccaagcacagaaauacaacucacggauuacggugcauuaaccuuagacuguucaccgcgcaccggucuugacuucaaugaaaugguacuuuugacaaugaaagaaaaauccugguugguacauaaacaaugguuucucgauuuaccucuuccguggacaaguggggccucaaccucacaagaaacuuggaacagaaaagacuuauugguuacauuuaaaacugcucaugcuaaaaagcaagaaguaguuguucucgguucucaagaaggggcaaugcauacggcucuaacgggggcaacagaaauacaaacaagcgguacuacaacuaucuuugccggucaucuaaaauguagacuuaaaauggacaagcuaacucucaagggaaugucauaugugaugugcacuggcucauuuaaacuagaaaaagagguugcagaaacucaacacgguacuguauuaguccaaauaaaguaugaaggaacugacgcuccaugcaagauccccuucucgacacaggacgaaaaaggagugacucaaaauggacgacugauaacagcuaacccgauuguaacagauaaggagaaacccguaaauauagaggcagaaccuccuuuuggagaaucguauauugucaucggcgcaggggagaaggcguuaaaacuaaguugguuuaagaaaggaucgagcauaggaaaaauguuugaagcaacugcccgaggugcacggagaauggcaauucucggagacacagcuugggauuucggaaguauugguggcguguuuaccagcguuggaaaacucgugcaucagaucuuugguacugcuuacggugugcuauuuucaggcgucucguggacaaugaagauuggaauaggugugcuacuaacauggcuugguuuaaauaguagaucuacaucucuuaguaugacguguauagcaguaggucuggugacacuauaccuaggagucaugguacaagcagacucgggaugugucauaaacuggaagggccgagagcuuaagugugggucaggcauauuuguuacuaaugaaguacauacuuggacagaacaguauaaauuccaagcagauucgccaaagaggcugucagcagcuauagggaaagcaugggaagaaggaguaugcgguauacgaucggccacuagacuagaaaacauaauguggaaacaaaucucaaaugaacuuaaccauauuuugcuagaaaacgacaugaaauucacaguugugguaggugacgucgcagguauauuggcucaggguaagaaaaugaucaggccucagccuauggaauauaaauauagcuggaagaguuggggaaaagcaaaaauuaucggggcggauguacaaaauacaacuuucaucauugauggaccaaauacaccggaguguccagaugaucagcgcgcguggaauauaugggaagucgaagacuauggauuuggaauuuuuacuacaaauauauggcuaaaauugagagauucguacacccaagugugugaccaccgacuuaugucugccgcaauaaaagauucuaaagccguacaugcugacaugggauauuggauugaaucagagaaaaacgaaacauggaagcuagcucgagcuaguuuuauagaagucaaaaccuguauauggccaaaaagccauacauuaugguccaacggaguacucgaaucagaaaugaucauucccaagauuuauggggguccaauaucacaacauaacuacagacccgguuacuucacgcaaacagcaggaccuuggcaccuaggaaaauuagaacuagacuucgacuuaugcgaggguacuaccguugucguggaugaacacugugguaaccgaggaccuucuuugagaacaacaacagucacuggaaaaauaauacaugaauggugcuguaggaguugcacucucccaccauugagguuuaaaggugaagacgguuguugguauggaauggaaauacgaccagugaaggaaaaggaagaaaaucuuguuaaaucgauggugucagcagguuccggggaaguagauucguucucauuaggucuuuuaugcauaaguauaaugaucgaagaaguuaugagaucccgguggucacgaaaaauguuaaugacgggcacgcuugcaguauucuuuuugcuuauuauggggcaauuaacauggaaugaucuaauucgacugugcauuauggugggggcaaacgcgucagaucgcaugggcaugggcacgacguaucucgcauuaauggcuacuuuuaaaaugcgcccuauguuugcaguuggacuuuuauuccgucgccugacgagucgcgaaguacuucuacugacgauugguuuaagucuuguagcaucaguagaacuaccuaauuccuuggaggaauuaggagacggauuagcaauggguauuaugauacugaaauugcugacugauuuucagucccaucaauuaugggcuacguuacuuagcuuaacguuuauaaaaaccacguuuucauuacacuaugcauggaaaacgauggcaauggugcuaucuaucguuagucucuucccacuguguuuaaguaccacaucucaaaagacaacuuggcuuccuguauuacuuggaucguuaggguguaaaccucuaacaauguuucuuauagcagagaacaaaauaugggguagaaaaagcuggccuuugaacgaagggauaauggcugucggcauaguaucaauucucuuguccuccuuacucaagaaugauguuccuuuagcuggcccuuuaauugcaggagguaugcugauagcuuguuacgucauuucaggaucaucugcagaucuuucucuagaaaaagcggcagagguuucaugggaggaggaagcugaacacucgggugcgucccauaauauucuuguugaaguacaagaugauggaacaaugaagauaaaagacgaagaacgugacgauaccuugacaauauuacucaaggccacuuuacuagcuguaagcggaguauauccucuuaguauacccgcuacacuauuugugugguacuucuggcaaaagaagaaacagcgaucgggaguccuaugggauacuccgucacccccggagguagagagagcaguguuagacgacgguauuuaccgaauaaugcaaagaggguugcuuggaagaucacaaguuggagucgguguguuccaagaaaacguguuccauacuauguggcauguaacaagaggagcaguguuaauguaucaagguaaaagacucgaaccaagcugggcaagcgucaaaaaggaucuaauaucauacggugguggauggcggcugcaagguagcuggaacacaggagaggaaguucaggucaucgccgucgaaccagguaaaaaucccaaaaaugugcaaacagcuccaggaacauuuaaaacaucagaaggggaagucggggcuaucgcacucgauuuuaagccaggcaccucgggaucaccgauaguaaauagagaaggcaaaaucguuggacuauauggaaacggaguuguuacaacuuccgguacuuacguaucagcuauagcacaggcaaaagcaucacaagaagguccacugcccgagauagaggacgagguguuucgaaaaagaaaccuaacuauuauggaucugcauccugggaguggaaaaaccaggagauacuugccagcgauugugagggaagcgauuaaaagaaaauuaagaacuuugauucuagcaccaacgagaguuguugcaagugaaauggcugaagcauugaaaggaaugccaauaagauaucaaacuaccgcaguaaaaagugaacauacaggaaaagagauaguagacuuaaugugucaugcgacguucaccaugcgguuauuaagcccgguaagagucccuaauuauaauaugauaauuauggaugaagcccacuucacugauccuagcuccauagcagcacguggcuauauuagcacacgaguugguaugggcgaagcggcggcaauauucaugacagcgacgccaccaggcuccguggaagcauuuccacaaucuaaugcuguaauccaagacgaagaacgagauauaccagaaaggucuuggaauaguggguaugaguggauaaccgacuucccagggaaaacaguuugguuuguacccucaauaaaaaguggaaacgauauagcuaacugccuaaggaaaaaugguaagagaguaauacaacuaucaagaaaaacauuugacacggaguaucagaaaacuaaaaacaaugauugggacuaugucguuacaacggacauuucggagaugggugccaauuucagagcugaccgaguaaucgauccaaggagauguuuaaagccggugaucuugaaagacggacccgaaagagugauucuagccggcccuaugcccguaaccgucgcuagcgcugcccaaagaagagggagaaucggacgcaaucauaauaaggaaggcgaucaguacauauauaugggucagccgcuaaacaacgaugaggaucaugcgcacuggaccgaggcgaagauguuacuugacaacauaaacacaccggaagguaucauaccugcauuauucgaaccugagagagagaaaucagcagcgauugauggagaauauagacuacguggcgaagcacgaaagacauuugucgaauuaaugcggagaggggaucucccaguuugguuaaguuauaaagucgcaagugagggauuucaguauucagaucguagaugguguuucgacggagagcgaaacaaucagguuuuggaagagaacauggacguugaaaucuggacuaaagagggagaacggaaaaaguuaaggccacguugguuagaugcccgcacauacagugacccauuagcauuaagggaauuuaaggaauuugcagcaggccgaagaaguguaaguggugaucuaauucuugaaaucgguaagcuaccgcaacaccuaacgcagagagcacaaaaugcucuugacaaccugguaaugcuccacaauagugaacaaggagggagagcauaccgucacgcaauggaagaacuaccagauacaauugaaacuuugaugcuucuagcacuaauugcaguccuaacuggagguguaacacuauucuuucucucuggucgaggacuaggaaagacaucuauuggacuauuaugcguuauggcaucuucaguacuccucuggauggcuuccguugaaccgcacuggauagcagcgucaauaauauuagaguucuuccuuaugguacuacuaaucccagaaccagacagacaaaggacuccccaggauaaccaacucgcauauguuguaauaggacugcucuuuaugauauuaacagucgcggccaacgaaaugggauugcuagaaacgacaaagaaagaucucggaauagggcauguugcagucgagaaucaccaucaugcggccaugcuugauguagaucuccauccggcaagcgcauggacauuauaugcgguagccacaacuauuauaacgcccaugaugagacacacuauagagaauacuacugcaaauaucucucuaacggcgauagcaaaucaggcagcuaucuuaaugggccuggauaaaggauggccaauaaguaaaauggauaucgggguaccauuguuggcucuaggaugcuauagucaaguuaauccauugacucucacagcugccguccuaaugcuaguagcucauuacgcaauaauaggaccuggacuacaggccaaggcaacuagggaagcccaaaaacgaacagcugccgggaucaugaagaaucccacgguugacgggaucguugcgaucgaccuagacccagugguauacgaugcaaaauucgagaaacagcugggacagauuauguuacugauuuuauguacaucucaaauucuacuaaugcgaaccacuugggcauugugcgaguccaucacguuagcaacaggaccauuaacuacgcuaugggaagguucuccgggcaaauucuggaacacaaccauugcaguauccauggcgaacauauuuagaggaaguuacuuggcgggagcuggacuugcuuucagucucaugaaaucacucggaggaggacguagaggaacaggugcacaaggagagacacuuggugaaaaauggaaacggcaauuaaaccaacuaucaaagucugaauuuaacacauauaaaagaaguggaauaauggagguagaccgaagugaagccaaagaaggacuaaagagaggagagacuaccaagcaugcgguaaguagggguacggcaaagcuaagaugguucguagaacgaaaucuaguaaaaccggaaggaaaagugauagauuugggguguggcaggggugguuggagcuacuauugcgcgggcuuaaagaagguaaccgaaguuaaagguuauacuaaagguggacccggucacgaagaacccauaccuauggcgacauauggguggaauuuaguaaaauuacacucuggcaaggacguauuuuucauaccgccagaaaagugugauacguuauuaugugauauaggugagagcucucccaacccaacaauagaagaagggcgaacucuuagagugcuaaaaaugguagaaccauggcuacgcggcaaucaguuuuguaucaaaauacuuaaucccuauaugccauccguuguugaaacauuagaacagaugcaacggaaacaugguggaauguuaguucgaaacccguuaucgcgaaacaguacacacgagauguauuggguaucaugcggaacaggaaauauaguaucagcagugaauaugaccucuagaaugcugcuaaaucguuuuacaauggcucauagaaaaccaacuuacgaacgagauguugaccuaggggcagggaccaggcacguugcuguagaaccugagguugcuaaccuagauauaauaggacaaagaauugaaaauaucaagcacgaacauaaaaguacguggcacuaugaugaggauaacccauacaaaaccugggcguaccacggaaguuaugaaguaaagcccucgggcagugcuagcucaauggugaaugggguugucaaguuauuaacaaaaccaugggaugugauuccaaugguaacacagaucgcgaugacagauaccacuccuuuuggucagcaacgagucuucaaagaaaaaguugauacaagaacuccaaaagcaaagagagggacugcccaaaucauggaaguuacugcaaaaugguuaugggguuuccuaagucguaacaagaagccccgcauuugcacacgggaagaauuuacccgaaagguuagauccaaugcugcaauuggcgcaguauucguagaugagaaucaauggaacagcgcuaaagaagcaguagaagaugaaagauuuugggauuuagugcaccgagaacgagagcuacauaaacagggcaaaugcgcaaccuguguauacaacaugauggggaaaagagagaagaaacuuggagaguucgguaaagcgaaaggcucaagagcgauuugguauaugugguugggcgcccgguuuuuagaauuugaagcccugggauuuaugaacgaagaucauugguuuucuagagaaaacucauuaaguggaguugagggagaaggauugcacaaacuugguuacauacucagggacaucuccaagauaccuggagggaacauguaugcugacgauacagcaggaugggacacacguauuacggaagacgacuuacaaaaugaagcaaagauaacagacauaauggaaccggaacaugcuuuacucgcaaaaucaaucuuuaaauuaacuuaucagaauaagguuguuagaguccaacgaccugcuaaaaauggaacaguuauggacguaauaaguagacgagaucagagaggaucaggacaaguaggcacguacggauuaaauacauuuacaaauauggaggcccaguugauuaggcaaauggaaagcgaaggaauauuuucuccaucagaacuugaaacgccaaaucuagcuggacgugugcuggauuggcucgaaaaacauggagucgaaagacuaaagaggauggccauaagcggggacgauugcgucguaaaaccaaucgacgauagauuugcuacggcgcucacagccuuaaacgacaugggcaagguacguaaagauauuccgcaaugggaaccuucaaaaggguggaaugacuggcaacaaguucccuuuuguagucaccauuuucaccaguuaauuaugaaggauggacgggaaauaguaguuccuugccguaaucaggacgagcuaguaggacgggcaagaguaagccagggggcuggguggucccuuagagaaaccgcauguuuagguaagucuuaugcccaaauguggcaacuuauguauuuucaucgcagggaucuccgacuagcagcaaacgcgauaugcagugcaguuccuguugauuggguacccacgaguagaacaaccuggaguauacaugcucaucaucaauggaugacgacagaagacaugcuaagcguauggaaucgcguauggauagaggaaaauccguggauggaagauaagacacacauaucgaguuggggagacgugccauacuuagguaagcgugaagaucaaugguguggaucucuaauagggcuaaccgcaagagcaaccugggcgaccaacauacaggucgcuauaaaucaagugcgucgucuaauuggaaacgaaaauuaccuugauuauaugacauccaugaagcgauuuaaaaacgagucagauccagaaggagcguugugguag

SEQ ID NO: 21501 - RNA, 9879 nt, Artificial Sequence
  derived and/or modified CDS sequence (opt6) from DENV-1__FJ182022__SS-prME
ucaguaacaauguuacuaauguuaaugccuacugcauuagcuuuucauuugacaacuaggggcggugaaccccauaugauugugucaaaacaagaacgagggaaaucacuucuuuuuaaaacaucagcgggaguaaauauguguacguuaauugcuauggauuuaggagaauuaugugaagacacaaugacuuauaaauguccgcgaauuacagaaacagaaccugacgacguagauugcugguguaaugcuacggacacuugggugaccuaugguacauguagccaaacuggcgagcauagaagagauaaaagaagcguagcuuuagcgccacacguaggacuaggacucgaaacucgaacggagacuuggaugucaagcgaaggagccuggaaacaaauacaaagaguggagacaugggcccucagacacccgggcuuuaccgugaucgcguuguuuuuagcgcaugcaauaggcacuucuauuacucaaaaaggcauaaucuuuauccuccugauguuggucacuccgucaauggcuaugagauguguuggaauagguagcagagauuucgucgaaggguuaaguggugccacuuggguugacgucgugcucgaacacgguagcuguguaacuacaauggccaaagauaaacccaccuuggauauagaauuacuaaaaacugaggugacgaauccagccguacuacgaaaacucugcauagaagcaaaaauuucaaauacaacuacggauagccgcugccccacucaaggugaagccacucuaguugaagaacaagaugcaaauuucguaugucgcaggacauucguagauagaggaugggguaauggguguggguuguucggcaaaggaagucuuauaacgugugcaaaauuuaaauguguaacaaaacucgaggguaagauuguacaauaugaaaaucucaaauauucgguaauuguaacuguacacacaggagaucaacaucaagucgggaacgaaaguaccgagcacggaacaacagcaacgauuacaccacaagcaccuaccaccgaaauacaacuaacagacuauggggcacuaacacuggacugcagcccuagaaccggguuagauuuuaaugaaaugguccuacugacaaugaaagagaaaaguuggcuuguucauaaacaaugguucuuagaucuaccucuccccuggacaagcggggcaaguaccagucaagaaacauggaacaggcaagacuuauugguaacguucaaaaccgcacaugcaaagaagcaagagguagugguauuaggaagucaagaaggagcgaugcauacugcucuaacuggagccaccgaaauacaaacuucggguacgacaaccaucuuugccgggcaucugaaaugucgccuaaaaauggauaaauugacucuacgcggaaugagcuaugucauguguacuggaaguuucaaauuagaaaaagaagucgcugaaacccaacaugggacaguuuugguacaaauuaaauacgaagguacugacgcgccuugcaagauaccguuuucgacacaagacgaaaaagguguuacacagaauggccgauugaucacugcaaauccaauugucacagauaaggagaaaccugucaauauagaagcugaaccaccguuuggagaaucguacauaguuauuggagcgggagaaaaagcacugaaacuaagcugguuuaagaaaggcagcaguauagggaagauguuugaagccaccgcgagaggggcgagacgaauggcaauucuuggugacacggcaugggacuucgggagcauaggcggugucuucacuucaguuggaaaguugguacaccaaaucuuugguacagccuauggaguacuuuucucaggcguuucguggaccaugaaaauagguauaggcguccuauuaacauggcucggauuaaacucccgaucaacgucccuuucaaugaccuguauagcaguaggucuagucacccuuuaucuuggcguuaugguacaggcugauagcggcugcguaauaaacuggaaaggaagagaauuaaaaugcgguagcggcauuuucguaacaaaugaaguucauacauggacggagcaauauaaauuucaagccgauagcccuaaacgauuaucugcagcaauaggaaaagccugggaagaaggaguaugcgguauucguagugcaacucguuuagaaaauauaauguggaagcaaaucaguaaugaacucaaucauaucuugcucgagaacgacaugaaauucacuguuguaguaggcgauguugccgggauauuagcccaaggcaagaaaaugaucaggccacaaccgauggagcacaaauacagcuggaaaaguugggguaaagcgaagauuauaggggcagacguccaaaacacuaccuuuaucaucgaugguccgaacacucccgaaugcccagaugaccagcgagcauggaauauuugggaaguagaggauuacggauucggcauuuucacgacuaacaucuggcucaaguugagggauucuuacacacagguaugugaccauagacucauguccgcugccauuaaggauucuaaagcuguucacgcagauaugggauauuggaucgagagugagaagaacgagaccuggaaacuagcaagagccagcuuuauagaggugaaaaccuguaucuggccaaaaagucauacgcuguggucgaaugggguacucgaaagcgaaaugauuaucccaaaaauauaugguggaccuauaucucaacacaauuacagacccggauauuucacacaaacagcgggaccuuggcaucucggaaaacucgaacuugauuuugaucugugcgaggguacuacagugguagucgaugaacauugcgguaacagagguccgucucuaagaacgacaacagucacgggaaaaauuauacaugaaugguguuguagauccugcaccuuaccaccccucagauuccgaggagaagacgguuguugguacggaauggaaauaagaccaguaaaagaaaaagaggaaaacuuagucaagaguaugguaagugcaggaucaggagaaguagauaguuucagcuugggauuacuauguauuaguaucaugauugaagagguaaugcggucccgauggucacguaagaugcuaaugacagggacucucgcgguguucuuuuuacuuauuauggggcaauugacuuggaacgacuuaauaagacuauguauaaugguaggcgcaaacgcgagugaccguaugggcaugggcacuaccuaccuggcuuuaauggcaacauuuaaaaugcguccaauguuugcaguaggauuauuauucagacgacuaacgagucgagaaguuuuauuguuaacgaucggcuuaucccuaguagcgaguguggaguuaccuaauucucuugaagaacuaggcgauggcuuagcaaugggaauaaugauacugaaacuacucacggauuuucagagccaucagcuuugggccacguuauuaucccugaccuucauaaaaaccaccuuuaguuuacauuacgcuuggaaaacaauggcuaugguacugucaauuguaucucucuuuccucuauguuuaaguacaaccucucagaaaacaacauggcucccaguccucuuaggcucacuaggauguaaaccucuuacuauguuccucauugcugaaaauaagauaugggguagaagguccuggccacuaaacgaaggcauuauggcuguagguauaguauccauuuuacuaucuucuuuacuuaaaaacgauguaccgcucgccgguccacucaucgcaggcgguauguuaauugcuuguuauguaauaucugguagcucugcggaucugucacuagagaaagcagccgaaguaaguugggaagaggaagcggagcacucgggagcgucacauaauauucugguagaaguacaggaugacggaacaaugaaaauaaaggaugaagaacgugacgauacacuaacuaucuuacuaaaagcgacguuacuagcuguaucaggcguauaucccuuaaguauaccugcaacccuauuugucugguacuucuggcagaagaagaaacagcgaucuggaguguuaugggauacgccuaguccaccugaaguagagagagcaguauuagacgauggaauauacagaaucaugcagcgcggacugcugggucguagccaaguagguguagguguauuucaggaaaauguguuccacacaauguggcauguuacgcggggagcaguauuaauguaucagggcaaaagguuagagccuucaugggcgagugucaagaaagacuuaauaaguuauggcgguggauggagauuacaaggcucuuggaauacgggugaagagguacaagucauagccguagaaccaggcaaaaauccaaagaacgugcaaacagcgccaggaacauuuaaaacuccagaaggugaaguaggugcuauagcauuagauuucaagcccggaacaagcggaucaccuauagucaaucgagagggcaagauuguuggguuauacggcaauggaguagugacaaccaguggaacguauguuuccgcaaucgcgcaagcgaaggcuucgcaggaagguccguuaccugaaauugaggacgaaguguuuagaaagagaaaucuaacuauuauggacuugcaccccggcuccgguaaaacgaggagauacuuacccgcgauagugcgagaagcuauaaaacggaaacugaggacauuaauccuggcuccaacucgagucguagcuucagaaauggcagaagcacuuaaaggcaugccuaucagauaccagacaacagcagucaagucggagcauaccgggaaagaaaucguugaccuuaugugucaugcuacuuuuacaaugcguuugcuaucacccgugcgaguaccgaacuacaauaugauaauuauggaugaagcucauuucacugauccuucaucaauugcggcuagaggcuauaucucuacacgaguaggcaugggagaagcagcggcuauauucaugacggccacgccacccggaagugucgaggcuuucccucaaucaaaugcuguuauucaagacgaggaaagagacauaccagaaagaucuuggaacuccggauaugaauggauaacugacuuuccugguaagaccgugugguucguuccuucaauuaaaucggguaaugacaucgccaacugcuuacgaaagaauggaaaaagaguuauacaacucucaagaaagacguuugauacugaauaccagaaaacgaaaaauaaugacugggacuacguagucacgacggacauaucagaaaugggagcaaauuuccgggccgauagaguaauugacccaagacgaugucucaagccagugauuuuaaaagacgggcccgaaaggguaauauuagcggguccgaugcccgugacgguugcaagugcagcacagcgacguggaaggauaggcagaaaucauaacaaagaaggggaucaauauauuuacaugggucagccccuaaauaacgacgaagaucaugcacauuggacugaagcaaaaaugcuacuggacaauaucaauacacccgaagguauaauaccggcgcuguuugagccagaaagagagaaaagugcugcgauugauggugaauaucgcuuaaggggugaagcaagaaaaacuuucguugaauuaaugcggcggggcgacuuaccaguuuggcuuaguuauaaaguggcuagcgaagguuuucaguauucagauagacgaugguguuuugacggagaacgaaauaaucaaguuuuggaagaaaauauggauguagaaaucuggacaaaagaaggugaaagaaagaaacuaaggccucgaugguuggaugcuaggacuuacagugauccauuggcucugcgggaauuuaaagaauuugcugcgggaagaaggucaguuuccggagaccugauacuggaaauugggaaacucccacaacauuugacccaacgagcgcaaaaugcacuagauaaucuaguuauguuacauaauucggagcaaggaggacgagcauaucgacaugcaauggaagaguuaccagacaccauagagacacuaaugcuuuuagcauugauugccguauuaacgggaggaguaacauuauuuuuccucagcgguaggggguuagguaaaacgucaaucggucugcuaugugugauggcuaguuccguauugcuauggauggccagcguagaaccacauuggauugcagcuucaauuauauuagaguucuuucuaaugguacuucuaaucccugaaccagauagacaacgcacaccacaggauaaccaauuagcauaugugguaauaggacuauuauucaugauucuuacaguugcagcgaacgaaauggggcuacuagaaacgaccaagaaagauuuggguauagggcacguagcuguagagaaucaccaucaugcagcaauguuagacguggauuuacaucccgcgagugcauggacacucuaugcuguggccacaaccauuauaacaccaaugaugagacacacaauugaaaauaccacggcaaauauaucacugaccgcuauugcaaaucaagcagcaauauuaaugggauuagacaagggcuggcccauaagcaaaauggacauaggaguaccgcuguuggcauuggguuguuauucccaaguuaacccauuaacauuaacagcugcgguacuaaugcugguagcacauuaugcuauuauagguccaggguuacaggccaaagcuacacgugaagcacagaaaaggacagccgcuggcauaaugaaaaaucccacaguggauggaauaguugcaauagaucucgauccaguuguauacgaugccaaguucgaaaaacaacuaggucagauaaugcucuuaauccuauguacaagucaaauauugcuaaugagaacaacaugggcucuaugugaaaguauaacucuggcaacaggaccguugaccacauuaugggaagggucgccaggaaaguuuuggaauacaacuauugcaguaucaauggcuaauauauucagaggcucuuaucuugcgggugcaggacuagcauucagcuuaaugaaaagucuuggagguggacgcaggggaacuggugcacaaggagaaacuuuaggcgaaaaauggaaacgccaauuaaaucaguuaaguaaaagcgaauuuaauacauacaaaagaucgggcauaauggaaguagauagaucagaagcaaaagagggguuaaagcguggugaaacaacgaaacaugcaguaaguagagguacagcaaaacuucguugguucguggaacgcaaucucgugaagcccgagggcaaagugauagaucuagguuguggacggggaggcuggucauacuacugcgcaggacucaagaaaguuacagaagugaaaggauauacaaaaggcgggccgggucacgaagaaccuauuccaauggcaacauauggauggaaccuaguuaaauugcauaguggcaaagacguauucuuuauuccaccugaaaaaugcgauacacuucugugcgacauuggcgaaaguucuccaaacccaacuauagaagaaggucgaacauuaaggguauuaaagaugguagaaccauggcugcgaggaaaucaauuuugcauaaaaauucuuaacccuuacaugccgucuguuguagagacguuagagcaaaugcaaagaaagcacgguggaauguugguuagaaauccguugucacgcaacucaacucacgagauguauuggguuuccuguggaacagguaacauaguuucagcaguuaauaugaccucacggaugcuccugaacagguucaccauggcucaccgaaaacccaccuaugaacgagauguagaucucggagcugguacacgacauguagcgguugaaccggaagucgcaaauuuagauauaauuggacaaagaauagaaaauaucaaacacgaacauaaaucuacauggcauuacgaugaagacaauccauacaagacgugggcuuaccauggcaguuaugaaguaaagccaagcgguuccgccaguucuauggucaauggggucguaaaacuucuaacaaagccgugggauguuauaccaauggucacacaaauagcaaugacagauacaacuccauucgggcagcaaaggguuuuuaaggaaaagguugauaccaggacucccaaggcaaaaagagggaccgcgcaaauaauggagguuacugcuaaaugguuauggggauuccucagcaggaauaagaaaccgagaauuuguacgagagaagaauuuacgaggaaaguacguaguaaugcugcgauaggugcaguuuuuguagaugaaaaucaauggaacucagcgaaagaagcaguugaggaugaaagauucugggaccuuguacaccgugaaagagaacuacauaagcaagguaaaugugcaacuuguguguauaauaugauggggaaacgggaaaagaaacuaggagaauuugggaaagccaaaggaagcagagccauaugguauauguggcuaggagcucgauuuuuagaauuugaagcucuggguuucaugaaugaagaucacugguuuucacgagagaacucgcuauccggaguugagggcgagggguuacauaaacucggauacauacuucgagauaucaguaaaaucccaggaggaaacauguacgccgaugacaccgcagguugggacacaagaauaacagaggaugauuuacaaaacgaagcgcgaauaacagauaucauggaaccugaacacgcauuacuugcaaaaaguaucuucaaauuaacuuaucaaaauaagguaguuagaguccagcgaccugcgaaaaacgggacaguaauggacguaaucucgagacgagaucagagggggagugggcagguagggaccuacgggcugaauacauuuacuaauauggaagcccaacucauacgucaaauggaaucugaaggaauauucaguccuucugaguuagaaacaccaaauuuggcagaaagaguacucgacuggcuagaaaaauauggaguugaacgacucaagaggauggcuauuucaggagacgauugugucgugaagccaauagaugaccguuuugcaacagccuugacugcauuaaaugauauggggaaaguuaggaaagauauuccacaaugggaaccgaguaaaggauggaaugauuggcaacagguaccauuuugcagucaucacuuccaucaacucauuaugaaggauggaagagaaauaguaguaccauguagaaaucaggaugaguuaguagguagagcccgugugagucagggagcgggguggaguuugagagaaacagccugccuggguaaauccuacgcacaaauguggcaacuuauguauuuucauaggagggauuugagacuggcggcaaacgcaauuuguucagcagugcccguugauuggauccccaccucaagaacaaccuggucaauccacgcacaucaccaguggaugaccacagaagauaugcuaucagucuggaaucggguuuggauugaagaaaauccuuggauggaagacaaaacacacaucuccucuuggggagacguacccuaucuaggaaaaagagaggaccaauggugcggaucuuuaaucggccuuacugcuagagcaacuugggcaacgaauauacaagucgccauaaaucaagugagacgacuuauuggcaaugaaaacuacuuagauuauaugacgucgaugaaacgguuuaaaaaugaaagcgauccggaaggugcgcuuugguag

SEQ ID NO: 21502 - RNA, 9879 nt, Artificial Sequence
  derived and/or modified CDS sequence (opt6) from DENV-1__FJ024447__SS-prME
uccgucacuaugcuucuaauguuaaugccgacagcauuggcauuucaucuuacgacgagaggaggugagccucauaugauagucuccaaacaagaaagaggaaaaucuuuacuauucaaaacaagugcuggcguaaauaugugcacucucauagcaauggaccuaggagaauuaugugaggacacaaugacuuacaagugcccaagaaucacagaaacugagcccgacgauguagacugcugguguaacgcuacagauaccugggucacauacgguacuugcucacagacaggggagcauagaagagauaaacguaguguagcucuagcaccccauguaggauuaggucuugaaacgagaacagaaacuuggaugagcucggaaggagcguggaagcaaauacaaagaguagaaaccugggcccuacgucauccaggguucacggucaucgcauuguuuuuagcacaugccauaggaacaaguaucacacaaaagggcauaauuuuuaucuuauuaaugcuaguuacucccucaauggcaaugagaugcguuggcauuggaucaagggauuuugucgaaggccuguccggagccaccuggguggauguagucuuagagcacgggagcuguguaacuaccauggccaaagauaaaccuacuuuagacaucgaacuuuuaaagacugagguaacaaauccagcaguuuuaaggaaacuuugcauagaagcaaaaauuucgaauacuacuacggauaguagguguccuacccaaggugaagccacacuuguugaggagcaagaugccaauuuuguuuguagaagaacauucguagaccguggcugggguaauggguguggauuguuugggaaaggcucucugauuaccugugccaaguucaaaugugugaccaaguuagaggggaaaauaguccaauacgaaaaucuaaaauacaguguaaucgugacgguucacacuggggaucaacaucaaguugggaacgagucgacggagcaugggacgacggcaacuauaacaccgcaagcuccuaccaccgaaauucaauuaacugauuacggagcgcucacacuagacugcaguccccguacagguuuggauuucaaugaaaugguacuuuuaaccaugaaagaaaaaucauggcugguacacaaacaaugguuccuagaccuuccguugccguggacaagcggugcuagcacuagucaagaaacauggaaccggcaagaucuucugguuacauuuaagaccgcacaugcaaagaaacaggagguugucgugcucggaucucaagaaggugcgaugcauacagcauuaacaggugcuacugagauucaaacuagugguaccacaacaauuuucgcagggcacuuaaaaugucgcuugaagauggauaaacuaacgcugaaaggaaugucauauguaaugugcacagggaguuucaaacuggagaaagaaguagcagagacacagcauggaacugugcucguacaaauaaaguacgaaggaacagaugcacccuguaaaauaccuuucagcacacaggacgaaaaagguguaacgcagaauggcaggcucaucacugcaaacccaaucguaacagacaaagaaaagccagucaauaucgaagcggaaccaccguuuggagaaagcuauauagucauaggcgcgggagaaaaagcguuaaaauuaagcugguucaaaaaagggagcagcauuggaaagauguucgaagcaacagcgaggggggcgagacgaauggcuauacuaggagauacagcgugggacuucggcucuauagguggaguuuuuacaucagucgggaagguaguacaucaaauuuuuggaacagccuacggaguucuguucucagguguaagcuggacaaugaaaauuggaauuggcguccuuuugacauggcuaggauuaaauucacgaucuacuucccuaaguaugacgugcauugcaguagguuugguaacuuuauacuugggaguaauggugcaagcagauagugggugugucaucaacuggaagggaagagaguuaaaaugugguaguggaauuuuuguaaccaaugaaguacacacuuggacagagcaauacaaauuucaggcagacucaccaaaacgauuaucagcugcaauaggcaaagccugggaagaagguguaugcgggauaagaucugcaacgagauuagaaaacauuauguggaaacaaaucuccaaugaguuaaaccauauucuucuugagaacgacaugaaguucacuguuguuguuggcgauguggcgggcauauuagcucaaggcaaaaaaaugaucagaccucaaccaauggaauauaaauauagcuggaaaagcugggguaaagcaaaaauuauaggcgcagacguucaaaauacuacuuuuauaauagacggaccaaauacaccagagugucccgacgaccagcgagcguggaacaucugggagguagaagauuacggauucggaauuuuuacaaccaacauuuggcuuaaguuacgugauaguuacacucaaguuugugaucauagacuaaugucagcagcaauaaaagauaguaaagcgguacacgcagacaugggauauuggaucgaaagcgagaagaaugagacauggaaguuggcucgcgcguccuucauugaaguuaaaacgugcauauggcccaaaucucauacucuauggucaaauggagugcuggaaucugagaugaucauuccaaaaauauaugggggcccuauaucucaacacaauuauaggccugguuauuuuacacaaacagccggaccguggcacuuaggaaaauuagaauuggacuucgaucuaugugaagguacaacagugguuguugaugaacauugcggaaaccgaggaccaagccuucguacaacuacugucacuggaaaaauaauucaugaaugguguugucgcuccuguacacuaccgccccugagauuuagaggagaggauggaugcugguaugguauggaaauuagaccaguuaaggaaaaagaggaaaaucuuguaaaaucgauggucagugccgguagcggugaaguagauucauucaguuugggauuguuguguauaucaauaaugauagaagagguuaugcgaagccggugguccagaaagauguuaaugacaggcacgcuggcaguauuuuuucuauugauuaugggucaacuuacauggaaugaccuaauccgacuaugcauuaugguaggugcaaacgcuagcgauagaaugggaaugggcaccacauaucuugcauuaauggcuacauuuaagaugcgaccaauguucgcuguuggacugcuauuccgacgacucacgagccgagaaguacuccucuuaacuauuggucuaaguuuaguagcgucuguagaauuaccgaauaguuuggaagaacucggugauggauuagcuaugggaauaaugauacucaaacuacuaacggacuuucaaucacaucaacuaugggcaacgcucuuaagccuaaccuucauaaaaaccacauuuaguuuacacuaugcauggaaaacuauggcgaugguacuaaguauaguuagccuuuuuccauuaugccugagcacuacaucccaaaaaacuaccugguugcccguacuauuaggaucacuaggauguaaaccccuuacaauguuucuuauagcggaaaacaaaauaugggggcgacguagcuggccauuaaacgaagguauaauggcaguuggaauuguauccauauuauuaucaucauuguuaaaaaaugacguaccccuggcugggccccuaauugcuggugguauguugauugcauguuauguaaucucuggcucgucugccgaucuaagccuggaaaaggcggcugagguuucaugggaagaagaagcagagcacuccggagcaucccacaacauuuugguagaaguccaggacgacgggaccaugaagauuaaggacgaggaacgagaugacaccuugaccauucuguugaaggcuacacuucuagcaguaucaggcguauacccucuaucaauaccugcaacacuauucgucugguauuucuggcagaagaagaagcagagaaguggugugcuaugggacacaccaucuccccccgaaguuggcagagcuguauuagaugacggcauauacagaauaaugcagagaggcuuacuugggaggagccaggugggaguaggaguguuucaagaaaacguauuccauacuauguggcauguuacgcgaggggcaguucuuauguaucaaggaaaaagauuagaaccaucaugggcuagcgucaaaaaagaccucaucuccuacggaggaggguggagauugcaagguucuuggaacacuggagaagaaguccaagugauugcggucgagccaggcaaaaacccgaaaaaugugcaaacugccccgggaaccuuuaaaaccccagaaggagagguuggagccaucgcacuagacuuuaaacccgguacuucugguagucccauugugaauagagagggaaaaauaguagggcucuacgguaacggcguaguaacaacaucuggaacauauguaucagcaauugcacaagcuaaagcaucccaagaggguccgcuaccggaaauagaagaugagguauuccguaaaagaaaucuaacaaucauggacuuacacccaggcucagguaagacacgacguuauuuaccugcaauaguucgggaagcuauaaaaagaaagcuuagaacuuuaauucuagcaccuacacgugugguagcgucggagauggcagaagccuuaaaaggaaugccaauuagauaucaaacuaccgcagugaaaagcgaacacacaggaaaagagauuguggauuuaaugugccaugcgaccuucacuaugaggcuuuugaguccaguuagaguuccaaauuacaauaugauuauaauggaugaagcgcacuuuacugauccaaguucaauugcagcgcgcggauauauuaguacucgugucggcaugggcgaagcagccgcuauuuucaugacugcgacuccgccuggaaguguugaagcuuucccacagucaaaugcuguaauccaggacgaggaacgagauauuccagaaaggucauggaacucugguuacgaguggauaacagacuuuccaggaaagacaguuugguucguaccaagcauuaaaucaggaaaugauauagcuaauugccuuagaaaaaaugguaaacgaguaauccaacuaucucgaaaaaccuuugacacagaguaucaaaagacaaaaaacaaugauugggacuauguaguaacaaccgacauaagugagaugggcgccaacuuucgggcggauaggguaauugauccaagacgaugucuuaaaccgguuauuuuaaaagauggaccagaacgcgucauacuagcagggccgaugcccguaaccgucgcgucggcugcccaacggagagguagaauaggaaggaaccacaauaaggaaggggaccaguacauauauaugggacaaccauugaauaacgaugaggaccaugcacacuggacagaggcaaaaauguuauuggauaauauaaauaccccggaaggaauaauccccgcgcuguuugaacccgagagagaaaagucagcagcuauagacggugaauaucgauugcgcggagaggccaggaaaacauucguggaguuaaugagaagaggagaucuaccaguguggcuuucuuacaaaguugcuucagaaggcuuucaauacagugaucgucgcuggugcuucgacggcgaacgaaauaaucaagugcuagaggaaaacauggacguugagauuuggacuaaagagggagagcgaaaaaaauuacgcccacguuggcucgaugcuaggacauauucagacccguuggcacuaagagaauuuaaagaauucgcugccggcagacguucaguaucaggugauuuaaucuuagaaauaggaaaguugccgcaacaccugacacagagagcccaaaacgcauuagauaauuuaguaauguuacacaauagugaacagggaggaagagccuauagacaugcaauggaagaauugccggauacuaucgaaacacuaauguugcucgcccuuauugcgguguuaaccggaggaguaacgcuguuuuuuuugaguggaagaggauugggaaaaacuucaauaggcuuauuaugugugauggcgucaagcguuuugcucuggauggcuucgguggagccacauuggauagccgcaagcauuauauuagaauuuuuucuuaugguacuauuaauaccagaaccagacagacaacguacaccacaagacaaccaacuagcguauguugugauaggacugcucuuuaugauacuaacgguagcagcuaaugagaugggacugcuagaaacuacgaaaaaagaccuaggcauagggcacgucgcagucgaaaaccaucaucacgcagcuauguuagacguugaucuacaccccgcaagcgcauggaccuuauacgccgucgcaacgacuaucaucaccccuaugaugcgucauacuauugagaacacuacagcaaauaucucccuuaccgccauagccaaucaagccgcgauucuuaugggccucgacaaggguuggccaaucucaaaaauggauauuggcguaccucuauuagcacuagguuguuauucucaagucaauccuuuaacacuaaccgcagcaguuuugaugcuuguugcacauuaugcgauuauaggacccggacugcaagcuaaggcgacuagagaagcacaaaagcgcacggcagcuggaauuaugaagaauccaacuguagaugggauaguggcaauugaccuugaucccguuguauaugaugcaaaauuugaaaagcaacuaggacaaauaaugcuuuuaauucuguguacuucacaaauauugcuaaugcgcacaacaugggcacugugcgagucuauaacacuggcuaccggcccauuaacgacacuaugggaggguucuccaggcaaauucuggaacacaacaauagccguaucaauggcaaacaucuuucguggcagcuauuuagcuggcgcgggucuagccuucaguuuaaugaagaguuuagguggggguagacgaggcaccggugcucagggggaaacccuaggagaaaaauggaaacgucaacugaaucaauuaucaaagucagaauucaacacauauaaaaggucgggaauaauggaaguggauagaucagaggcaaaagaggggcuaaaaagaggagaaacgacaaaacaugcuguaaguagaggaacagcaaaacucagaugguuuguagaaagaaacuuggucaaaccagaagguaagguaauugaccugggaugcggcagaggagguuggaguuauuacugcgcgggcuuaaaaaagguaacagaaguuaaaggauauacaaagggcggaccagggcaugaggagccuaucccaauggcuacauacgguuggaauuugguaaaauuacacucuggcaaagacguauucuucauccccccggagaaaugcgacacucugcuaugugacauuggagagagcucgccaaacccaacuauagaagaagguagaacacuucggguucucaaaaugguggaacccugguuacgaggaaaccaauuuuguauuaaaauauuaaacccuuauaugccuucggugguugaaacauuagaacaaaugcaaagaaaacacggaggcaugcucguaagaaacccuuuaagucgcaauucaacacaugagauguacuggguaaguugcgguaccggaaauauuguaucugcuguaaacaugacaaguagaaugcuccuuaacagguucacaauggcucaccguaagcccacuuaugaaagagauguagacuuaggcgcaggaacacgucacguugcaguagaacccgaaguggcuaaucuggauauaaucggacagcguauagagaauauaaaacaugaacauaaaaguacauggcacuaugacgaagacaauccuuauaagacuugggcguaccauggaucuuaugaaguaaagccaucagggagcgcauccucuauggugaaugguguaguaaaacuuuuaacaaaaccaugggaugugaucccgaugguuacucagauagcgaugacagacaccacgccauucggucagcaacgaguuuucaaagaaaaaguagauaccagaaccccaaaagcaaaacgaggaacggcccagauaauggaaguaaccgcaaaauggcuaugggguuuucuaucacgaaauaaaaaaccaagaauaugcacucgugaagaauucacacgcaagguacguaguaacgcagcgauuggagcaguuuucguugacgaaaaucaauggaauagcgcaaaggaagcgguagaagaugaacgcuucugggauuuaguucacagagaaagagaauuacauaagcaagggaaaugugccacuuguguuuacaauaugaugggaaaacgugaaaaaaaauuaggagaguuuggaaaagcaaaaggaagccgggcuauuugguauaugugguuaggugcccgcuuuuuggaauuugaagcucuuggauucaugaaugaagaucacugguucagccgagaaaauaguuuaaguggcguggagggugagggacuucauaaauuaggguacauacucagggacauaucuaauauuccgggagguaauauguaugccgaugauacagccggaugggauacacggaucacugaagaugacuuacaaaacgaagcgagaaucacugauauaauggaaccggaacaugcucugcuagcaaaaaguauauucaaacuaacauaccaaaauaaaguuguacguguacaacggccagccaagaauggaacuguuauggauguuauauccagaagagaucagagggguucgggccaaguaggaacauauggguuaaacaccuucacuaauauggaagcacagcugauuagacaaauggagucagagggcauuuucucaccaagugagcuggagacaccaaauuuggcagagcggguccuugacugguuggaaaaauauggcguugaaaggcugaaacgaauggcgauuucaggagaugacuguguuguaaagccuauugacgaccgguuugcuacugcacuaacagcacuaaaugauauggggaaaguuagaaaggauauuccacaaugggaacccuccaaaggcuggaacgauuggcagcaagucccauuuugcucucaucacuuccaucaacuuauaaugaaagacgguagagagauugucguaccgugcagaaaucaagaugaauugguuggucgggcaagggucagucaaggugcuggguggagucuaagagaaacagcauguuuaggcaaaagcuacgcucagauguggcaacuaauguacuuucauaggagagaccuaagauuggccgcgaaugcuauuuguagcgcaguaccaguggacuggauaccuacaucacguacuacuuggaguauucaugcacaccaccaauggaugaccacugaggauauguuaucaguguggaacagaguuuggauagaagaaaauccuuggauggaagauaaaacucauauuucgagcuggggugacguaccauaucuuggcaagagagaggaucaauggugugggaguuuaauaggcuuaacugcgcgagcaacuugggcaaccaauauacaagucgcuauuaaccaagugagacgguuaauuggcaaugaaaauuaccuggacuacaugaccucgaugaaaagauucaaaaaugaaucggauccagagggggcucuuugguag

SEQ ID NO: 21503 - RNA, 9879 nt, Artificial Sequence
  derived and/or modified CDS sequence (opt6) from DENV-1__FJ182025__SS-prME
uccgugacuauguuguugaugcuaaugcccacagcccuagcguuccauuugaccacacggggaggcgaaccacacaugaucguuaguaaacaagaacggggcaaaucccuucuauucaaaacaucggcugguguaaauaugugcacacuaauugccauggaccugggcgaauuaugcgaagauacuaugacauacaaauguccuagaauaaccgagaccgaaccugacgauguggacuguugguguaaugccacugauacaugggucacuuaugguacauguagucaaaccggcgaacaccgaagagauaaaagaucugucgccuuagcgccacacgugggacuuggauuagaaacaagaaccgaaacauggaugucaucagaaggagcauggaaacaaauucaaagaguugaaacuugggcgcuacgacauccaggauucacaguuaucgcauuguuucucgcacaugcuauugguacuucgauaacgcaaaaagguauaaucuuuauauuacuuauguugguuacuccaaguauggcuaugcguugcgucggcauaggauccagagauuucguugaagggcuuucaggugccacuuggguagauguuguccuagaacacggaagcugcguuacuacuauggcuaaagauaaaccaacucuagacauagaguuguuaaaaacggaaguaacuaacccagccguccuacgaaaacucuguauagaagccaaaauuaguaauacaacaaccgacucaagaugccccacucaaggagaagcuacauuagucgaagaacaagaugcaaacuuugucuguagacguacuuuuguagauaggggcugggggaacggaugcggacuuuucggcaaaggaagccuaauuacgugugccaaauucaaaugcgugacuaaacuggaaggaaaaaucguucaauaugaaaauuugaaauacagugucauuguaaccguucauacaggagaucaacaucaaguugguaacgaaucaacugaacacgguacuacagcuaccauuacuccacaagcacccacgacugaaauacaauuaacggacuauggagcacucacguuagacuguagcccuagaacaggacuagauuuuaaugaaaugguccucuuaaccaugaaagagaaaucaugguuaguccauaaacaaugguuucuggauuuaccuuuacccuggacaagcggugcgagcacaucacaagagacuuggaauagacaagauuuauuaguuacuuuuaaaaccgcucacgcuaaaaagcaagaggucguuguauuagguagccaagaaggcgcaaugcauacggcacugacaggugcuacagaaauccaaaccucugggacuacuacgauauuugcaggucaucucaaaugucgacugaagauggacaaacuuaccuuaaaagguaugucguauguaauguguacgggcagcuuuaaacuugagaaagaggucgcugaaacacaacaugggacuguuuugguacagauaaaauacgaaggaacugacgcaccuuguaaaauaccauuuucaacucaggaugaaaagggggugacucaaaacggucgacuaauaacugcgaauccaauaguuacggauaaagaaaaaccugucaauauugaagccgagccacccuucggugaaucauacauaguaauuggggcuggagagaaagccuugaaauuaucaugguuuaagaaaggaucuucuauaggaaagauguuugaagcgacagcacguggagcgcguagaauggcaauauuaggagacacugcuugggauuucgggucuauaggcgguguauuuacaaguguagguaaguuaguccaccagauuuuugggacagcuuacgguguauuguuuagcgguguaaguuggacaaugaagaucggaauugguguacuacucacauggcuuggucucaauuccagauccaccagcuuauccaugacuuguauagcggugggucuuguuacacuguaccuagguguaauggugcaagccgauucuggcugcguaaucaauuggaaagguagagaauuaaaaugugguagcggcaucuuuguuacaaaugaaguacauaccuggacagaacaauauaaauuccaggcugacaguccaaagagauugucugcggccauaggaaaagcgugggaagaagguguaugcggcauucgcagugcaacuaggcuagaaaacauaauguggaaacagauuucgaacgagcugaaucacauauugcuugagaaugacaugaaauucacgguuguaguaggugauguagcugguauauuagcgcagggcaagaaaaugauccggccacagccuauggaauacaaauauucuuggaaaucaugggguaaagcuaaaauaauaggcgcggauguacaaaauacaacuuuuauaauugauggaccuaauacaccagaaugcccagacgaccaaagggcauggaauaucugggaaguggaggauuauggauucggaauauucacuaccaacauauggcuaaaacugagggauucuuacacgcagguaugugaucacagacugauguccgccgcaauaaaggauucuaaggcaguccaugcggauaugggauauuggauagaaagcgagaaaaaugaaacauggaaacuugccagagcaucauuuauugaaguuaaaaccuguauuuggccaaaaagucacacguuauggucaaaugggguuuuggagucagaaaugauaauaccaaaaauauacggcggucccauaucacaacauaacuauagaccggguuauuucacacaaacugcugguccauggcaucuaggaaaacuagaauuggacuucgaccuaugcgaaggaacgacgguuguuguagaugaacacugcgguaaucgaggccccagucuaagaacaacgacaguuacagguaaaauaauacacgaauggugcugcagaucauguacauuaccaccauugcgguuuagaggugaagauggauguugguaugguauggaaauucgccccguuaaagagaaagaagaaaaccuaguaaaaagcaugguauccgccgggucaggagaaguugacucauuuucccuuggucuauuauguauaaguauaaugauugaagagguuaugcggucucgcuggagucguaaaauguuaaugacaggaacauuggcugucuucuuccucuugaucaugggucaauuaacauggaaugauuuaaucaggcuuugcaucauggucggagcuaaugcaagugauagaauggggaugggaacaacauauuuagcccuaauggcuaccuuuaaaaugagaccuauguucgcaguuggacuucuuuucagaagguuaaccucucgagaaguccuauuguuaaccaucggacuuucauugguagccucgguugaauuacccaauucuuuagaagaacuaggagaugggcucgcaauggggaucaugauccuuaagcuguugacagacuuccaaagucaucaauuaugggccacacuucuaucccuuacauuuaucaaaacuacuuuuucauuacacuacgcauggaaaacaauggcaaugguacuaagcaucguaucccuauuuccucuaugucuuaguacaacgagccagaaaaccaccuggcugccaguucuauuaggaagucucgguugcaaaccgcuuacaauguuccucauugcagagaauaaaaucuggggacggaggucguggccauuaaaugaaggaaucauggcaguuggaaucguuucaaucuuacuuagcuccuuacuaaagaacgauguaccuuuagcgggaccccugaucgcaggaggaauguuaauugcaugcuauguuaucagcggcaguucugccgaccugucccuagaaaaagcagccgaaguaucaugggaagaagaagcagagcauaguggugccucucauaacauauugguggagguacaagacgauggaacuaugaaaauuaaggaugaagaacgagacgauacacuaacuauccuauugaaagcaacccucuuggcaguaucaggcgucuacccgcugucaaucccugcaacauuauuuguuugguauuuuuggcagaagaagaaacaacggucagggguguuaugggauacaccuucuccaccggaaguaggacgcgcgguauuagacgacgguaucuaccgaauaaugcaaagaggccuacuaggacggucucaagugggagucggaguguuucaagaaaauguauuccacacuauguggcacguaacccgaggagcgguauuaauguaccaaggaaaaagacuugaacccucaugggcaagcguaaagaaagauuuaauaucauacggagggggauggcgguuacaagggaguuggaacacuggcgaagaaguacaagugaucgcaguagaaccagguaaaaauccuaaaaauguacaaacagcccccgguacauuuaaaacaccagaaggagaaguuggugcuauagcacuagauuuuaaaccugguacaagugggaguccgauugucaacagagaaggcaaaauugugggacuauacgguaauggggugguuaccacgucuggaacuuauguaagcgcaauagcacaagcuaaggccucucaagagggacccuugccagaaauagaagacgagguuuuucgcaaacgcaaccuaacuaucauggaccugcaucccggcagugguaaaacccgccgguaucugccugccauagugagagaagcaauaaaaagaaaauuaaggacucuuauauuagcuccaacccgcguaguagcuagcgagauggcugaagcauuaaaaggaaugcccauucgauaucaaacgacugcaguuaaaagugaacacacggggaaggagauuguggacuugaugugucaugcaacauuuacaaugcggcuuuugagcccagucaggguuccuaauuacaauaugauaauaauggacgaagcacauuuuaccgacccuucaucaauugcagcucguggguacauauccacaagaguugguaugggagaagcagccgccauauucaugacagcuacgccacccggaagcgucgaggcuuucccgcaaagcaaugcuguaauucaggacgaagaaagagauauuccggaacgaagcuggaauagcggauacgaauggauaacugauuuucccggcaaaacagugugguuuguucccucgauuaagucaggaaaugauauagcaaauugcuugaggaaaaacgggaaaaggguaauucaauuaucuagaaaaacuuuugauacagaauaucagaaaacuaaaaacaacgauugggauuaugucguaacgacagacauaucagaaaugggugcaaacuuucgggcggauagaguaauagacccgagacgguguuugaaaccagucauuuuaaaagacggaccggagcguguaauucuggcuggaccaaugccggugacaguagcgagcgccgcucaaagaagagguaggauaggccguaaucacaauaaggaaggcgaccaauacauuuauaugggccaaccccugaauaaugaugaagaccaugcacauuggacugaggccaaaauguuauuagauaauauaaauacuccagaagggauaauuccagcauuauuugaaccugagagagaaaaaucagccgcuauagacggugaauauagguuaagaggugaagccagaaaaacuuuuguggaguugaugagacgaggagaucugccaguguggcuuucauauaaaguagcaucugagggcuuucaguauucagauaggcgaugguguuucgacggagaaagaaauaaucaaguauuggaagaaaauauggacguagagauauggacaaaggaaggagaaaggaagaaauuaagaccaagguggcucgacgcuaggacauacucagauccucuagcauuacgagaauuuaaagaauuugcggcagggcgucggucaguuuccggugacuuaauccuagaaauugguaaauuaccgcaacaccuaacucaacgagcccagaaugcauuagacaacuuaguuaugcugcauaauagcgaacaaggaggacgggccuauaggcaugcuauggaagaacuaccagacacuaucgagacacucaugcugcuagcacucauagcggugcuuaccggaggggucacucuuuucuuccuaagcggucgagggcuaggaaaaacaucaauuggauuacuaugugucauugcuucaucaguacuguuguggauggccucaguggaaccgcacuggauagccgcaucuaucauauuagaguucuuucucaugguucuucuaauuccagaacccgacagacaaagaacaccacaagacaaucaacuugcuuacguuguuaucgguuuacuuuucaugauucuuacagucgcggcaaacgagaugggguuguuagaaaccacuaagaaagaucuugguauaggacauguagcagucgaaaaccaccaucacgcugcaaugcuggauguugacuugcaccccgcaucugcauggacauuauaugccgucgccacuacgaucaucacuccgaugaugcgucauacaauugaaaauaccacggcuaauaucucauuaacagcaaucgcuaaucaagcagcuauauuaaugggauuagauaaaggguggccgaucucaaaaauggacaucgggguuccauuacuagcacugggguguuauucacaagugaauccucuuacacuaacagcagcgguauugauguuaguugcucauuacgcaauuauuggaccuggacuacaggcuaaagcgacgcgagaagcacagaaacguacugccgcugggauaaugaaaaaccccacagucgaugguauaguugcaauagaccuugauccaguuguuuacgaugcaaaauuugaaaaacaauuaggucaaauaaugcuucucauacuuuguacaucucagauacuuuugaugcgcaccacuugggcgcugugcgaaucgauuaccuuggccacuggaccacuaacaacacucugggaaggcucgccuggaaaauucuggaacacuacaaucgcaguauccauggcaaauaucuuuaggggcucauaccucgcaggagcgggacucgcauucagcuuaaugaaaucgcucgguggaggaaggcgagguacuggagcucaaggagaaacauuaggugaaaaauggaagcggcaacuuaaccaacuaagcaagucagaauuuaacaccuacaagcgaucaggaaucauggaagucgaucgauccgaagcuaaggaggguuugaaaaggggcgaaacgacuaaacacgccguaagccguggaacugcgaaauuaaggugguuuguagagcgcaacuuggucaaaccugaagguaaaguuauagaccuugggugugguaggggaggauggagcuauuauugugcaggucuaaagaaagucacagagguuaaggguuacacgaaaggcgggcccggccaugaagaaccuaucccuauggcgacauacggauggaauuuaguuaaacugcacucagguaaagauguauucuuuauuccucccgaaaagugcgauacuuuacugugcgacauaggugaaaguagcccaaauccgacgauagaagaagguagaacacuacguguccuaaagaugguggaaccuuggcuccgcgggaaucaauuuuguauaaagauucuaaauccuuauaugcccucggucguugaaacacuagaacagaugcaaagaaaacauggagggaugcuaguuagaaacccacucaguagaaacucaacucacgaaauguauugggucucaugcgguacuggaaauauaguaucugcaguuaauaugacuagccgcaugcuacuuaacagauuuacaauggcacacagaaagccuacauaugaaagagauguggacuugggggcagguacuagacauguagcgguagagccagaagucgcaaacuuggacauuauuggacaaaggauagaaaauauuaaacaugaacauaagaguacuuggcacuaugaugaagauaacccauauaaaacaugggcauaccaugggaguuacgaagucaagccaucagggucugcaagcucaaugguaaacggagucgucaaauuauuaacgaaaccaugggacgucauacccauggugacacaaauagcaaugaccgauaccaccccuuucggucaacaacgcguauuuaaggaaaaaguugauacgcgcacaccaaaggcgaagcgaggaacagcccagauaauggaagucacugccaaauggcuuuggggcuuucuauccaggaauaagaaaccaagaauauguacgagagaggaguucaccagaaaaguaagaucgaaugcggcaaucggggcuguauucguugacgaaaaucaauggaacagcgcaaaagaagcuguagaagaugaaagauucugggaucuaguccauagggaacgugaacugcacaaacaagggaagugugcaacaugcguauacaauaugaugggaaaaagggagaagaaacuaggugaauuugguaaagcaaaagguucgagagccauaugguauauguggcuuggugcccguuuucuagaguuugaagccuuaggguuuaugaaugaagaucauugguucucgcgugaaaauucacucucagguguugaaggugagggauugcauaaauuaggcuauauacugagggacaucaguaauauaccagggggcaacauguacgcugaugacacugccgguugggauacaaggauaacugaagacgaucuucaaaaugaggcuagaaucacggauauaauggagccagaacaugcauuauuggcuaaaaguauauucaaauuaacauaucagaacaaagucguuagaguccaaagaccaacuaaaaaugguacuguuauggacguaauaaguaggcgagaucaaagaggaaguggucaaguugggacauauggacuuaacaccuuuacgaauauggaagcgcaauugauacgucaaauggaaagcgaaggaauauucaguccgucggagcuagagacuccaaaccuagcggaacggguuuuggauuggcuagaaaaauacgguguagaaagauuaaagaggauggcaauuuccggugacgauuguguagugaagccgguugaugaucgauucgcgacggcucuaacagcguuaaacgauaugggaaaaguaagaaaagauauuccucaaugggaaccuucaaaaggauggaacgauuggcagcaagucccauuuuguagccaccauuuccaucaguuaauuaugaaggacggaagagaaauugucguccccugccguaaucaagacgagcuagucggucgcgcccgggucucccaaggagcuggcuggaguuugcgugaaaccgcuugccuuggcaaaucauaugcgcagauguggcaacuaauguauuuucauagacgggaccuacguuuagccgcaaaugcuauauguucugcuguuccggucgacuggauaccuaccagucgaacaaccuggucaauacacgcucaucaccaauggaugacaacugaagauauguuaucaguguggaaccgcguauggauugaggagaauccauggauggaagauaaaacacauaucucauccuggggagacguuccauauuuagguaaaagggaagaccaauggugcgggagucugauugguuuaaccgcgagggcaacuugggcuacaaauauacaggucgcaauaaaucaggucagaagauuaauuggaaacgagaacuaccuagauuacaugacaagcaugaaacguuucaagaacgaaucggauccagaaggagcccugugguag

SEQ ID NO: 21504 - RNA, 9879 nt, Artificial Sequence
  derived and/or modified CDS sequence (opt6) from DENV-1__FJ373297__SS-prME
agcguaacgaugcuacugaugcuaaugcccacggcauuagcauuucauuuaacuacgagagguggggaaccccauaugaucguuucuaaacaagagcgggggaaaucgcuauuauuuaaaaccucagcaggggucaauauguguacuuuaauugcaauggaccuaggggaacuaugugaagauacaaugaccuauaaaugcccuagaauaacugaagucgaaccagaugacguagacuguugguguaauacaacugacacauggguaacauauggaaccuguucacaaaccggggaacauagacgugauaaacgaagcguggcucuggcaccucauguuggguugggguuagaaacgagagccgaaacuuggaugucaucugaaggagcuuggaaacaaauccaaaaagucgaaacuugggcuuuaagacacccgggauuuacggugaucgcucuauuucuagcgcaugccaucggaacaagcaucacacaaaaagguauaaucuuuauacuccuaauguugguuacucccucaauggcaaugagauguguaggcaucggaaguagggacuuuguagaaggguuaagcggggcaacuugggucgauguaguacucgaacacggaucaugugugacaacaauggccaaagacaaaccaacacuugacauugaauuauuaaaaaccgaaguaacuaauccugcaguauuaagaaaauuauguaucgaggcaaaaauauccaacaccaccacugacucccgcugccccacccaaggcgaagcaacucuuguagaagaacaagaugcaaauuuuguauguagaaggacauuuguagaucgaggauggggcaacggguguggcuuauuugguaaagguagucugauaacgugcgccaaauuuaaaugugucacgaaacuagaaggcaaaaucgugcaauacgagaaucucaaauauaguguaaucguaacuguacauacuggugaucaacaccagguuggaaaugaaaguaccgaacauggaacuacggcuaccaucacaccucaagccccuacaagcgagauucaauugacggauuauggugcucucacuuuagauuguagcccaagaacuggacucgauuucaaugaaaugguccuuuuaacaaugaaagagaaaucuuggcuggugcacaaacaaugguuucucgacuuaccccugcccuggacaucgggagcuucgaccucacaagaaacauggaauagacaagaucuacuuguuacuuucaaaacugcacaugcaaagaaacaggaaguaguuguauuaggaucgcaagagggggcuaugcauaccgcacuaacaggagcuaccgaaauucaaacuucuggaacaacuaccauuuuugcaggucaucugaaaugcagauuaaaaauggacaaacuaacguuaaaagguaugucguauguaaugugcacuggguuguuuaaacuagaaaaagaggucgcagagacucaacacggaacaguucugguacaaauaaaauacgaagggacagaugccccuuguaagauucccuuuaguacacaagacgagaaagguguaacucaaaaugggagacucauaaccgcaaacccuauuguaacagauaaagaaaagccugugaauauagaagcggaaccacccuucggagaaaguuauaucguuauaggagccggcgaaaaggccuuaaaauugaguugguuuaagaaagggucaagcauuggaaagauguuugaagcaacagcgcggggugcaaggcggauggcaauauuaggagacacggcgugggacuuuggcagcauaggaggggucuuuaccucaguaggcaaauuaguacaucaaaucuucggaacggcauauggcguauuauuuucuggaguaagcuggacuaugaaaauugguauaggcguucugcuuacuugguuaggguuaaacagucgcucaacaucgcuaagcaugacuuguaucgcaguuggauuagucaccuuauauuugggagucaugguucaagcagacucggguugcgugaucaauuggaaaggaagagagcuaaaaugcggaagcgguauauuugucaccaaugaaguucacacuuggacagagcaauacaaauuucaggcugauucgccgaaaagauuaucggcagcuauagggaaggcuugggaggagggaguaugcggaauccgaagcgcgacccgauuagaaaauauuauguggagacaaauaucuaaugaauugaaccauauacucuuagaaaacgauaugaaauucacuguuguuguuggcgauguuguaggcauuuuagcccagggcaagaaaaugauuaggccacagccgauggagcauaaguacucguggaaauccugggguaaagcuaaaauaaucggagccgacguacaaaauacgaccuuuaucaucgauggaccuaauaccccugaaugucccgacgaucaaagagccuggaacauuugggaaguugaagauuacggauuuggaaucuuuaccacgaauauauggcuaaaguugcgugauaguuacacacaagugugugaucacaggcuuaugucugcagcaauuaaagauagcaaggcuguacacgcagacaugggguauuggauagaaagcgagaaaaaugaaacauggaaguuagcuagagcuucauucauagaggucaaaacgugcaucuggcccaaaucacacacauuguggucuaaugggguauuagagucugaaaugauaauaccaaaaauauauggaggaccaauaucacaacauaauuacagaccgggauacuucacccaaacggccgguccauggcacuuggguaaguuagaacuagacuuugaccuaugcgaagguacuaccguagugguagaugaacauugcggcaaucgaggaccaucguuaagaacaacgaccguuacgggaaaaauaauucacgaaugguguuguaggucuugcacuuuaccaccccuucguuuuaaaggugaggauggauguugguacggaauggaaauacgccccguaaaagagaaagaagaaaaucuaguaaaaucuauggugagugcagggucaggugagguagauaguuuuucauuggggcuguuauguauaucgauuaugauagaagagguaaugagaucaagauggagcagaaaaaugcucaugacuggaacacuagcuguauucuuuuuacugauuauggggcaacugacguggaacgacuuaauaagaucguguaucaugguaggugcuaaugcuagugauagaauggggauggggacuacuuacuuagcccuaauggccacuuuuaaaaugaggccuauguuugcuguaggauuauuauuucgacgccuaacgucacgugaaguacuauugcuaacgauagguuuaagccuaguugcgagcguggaguuaccaaauagucuggaagaacugggggacggccuagcgaugggcauaaugauucuuaaacugcuaaccgauuuucaauccuaucaauuaugggcaacacuauuaucauuaacauucauuaaaacaacauuuucgcuucauuaugcguggaagacaauggcuaugguacuaaguauagucucacuauuaccacuaugucugucuacgacaucgcagaaaacgacuuggcucccagugcuacuaggaagucucggauguaaacccuuaacgauguucuugauugcggaaaacaaaauauggggacggaagucauggccucugaaugaaggaauaauggcagugggaauaguaucuauauuauuaucaucucuccucaaaaaugauguuccucuagcaggaccucucauugcgggaggcauguugauagcauguuauguuauaucaggcucaagcgcggauuugucuuuagagaaagcagcagaagucucaugggaggaagaggcagagcauucgggagcaagucauaacauuuuaguagaaguacaagaugauggcacuaugaaaauaaaagacgaagaaagagaugauacccuuacuauuuuauugaaagcgacccucuuggcgguaaguggcguuuacccguugucaauuccggccacacuguuugugugguacuuuuggcagaagaagaaacaaaggucuggcguccugugggauacuccgaguccaccagaaguagagcgagcaguuuuagaugauggcauuuauagaauuaugcaaaggggcuuauuaggacgcucucaaguaggagugggcguguuucaagaaaauguauuucauacaauguggcacguaacuagaggagcaguacucauguaucaagguaaacgauuagagccgaguugggcuucaguuaagaaagauuuaauuucuuacggcggaggcuggaggcuacaagguaguuggaacacaggagaagaaguucagguuauagcaguggaaccgggcaaaaauccgaagaacguacaaacugcuccagguacauucaaaacaccagagggggaaguuggagcaauagcgcuagauuucaaaccagggacaaguggaucaccuauugugaauagggaggguaaaauugugggucuguacgggaauggcguuguuacaacauccgguacuuaugucucugcaaucgcacaggcgaaagcaagccaagaaggcccguugccugaaauugaagaugaaguauuuagaaaacguaauuuaacuauaauggaccuacauccaggaucgggcaagaccagaagauaccuaccagcuauagugcgagaagcaauuaaaagaaaacuucggaccuugauauuggccccaacgagaguaguagcaagugaaauggcagaagcauuaaaaggaaugccaauccgauaucaaacaaccgcuguaaaaucugaacauacagguagagagauaguggauuugaugugccaugcuacuuucacaaugcgacuguuaaguccggugaggguuccaaacuacaauaugauaauaauggaugaagcacauuuuacugaucccaguucuaucgcggcgagggguuauauuuccacgcggguaggcaugggggaggccgcugcgauuuuuaugacugcuacaccacccgggucagucgaagcauucccacagagcaaugcaguaauucaggacgaagaaagagauaucccagaacguagcuggaacuccggauaugaguggaucacugacuucccaggaaaaacagucugguuugugccgaguauuaaaagugggaaugauauagcuaauuguuuaaggaaaaacgguaagcgaguuauucaacugagccguaaaacauuugauaccgaauaccagaaaacgaagaauaacgacugggacuacgucgugacuacagacauaagcgaaaugggggcaaacuuucgggccgaccggguaauagacccaaggcgaugccuuaaaccagugauucucaaggacgggccugaacgcguuauucuugcuggaccuaugccgguaacgguagcaucagccgcucagcgacgaggacggaucgggagaaaucacaauaaagaaggugaucaauauaucuauaugggacaaccauuaaauaaugacgaagaccaugcucauuggaccgaggccaaaaugcugcuagauaacauuaacacaccggagggaauaauaccagcauuauucgaaccugaacgagagaaaucugcugccauagacggcgaauacagauuacgaggagaagccaggaagacauuuguugaauuaaugaggcgaggcgauuugccggucugguuguccuauaaagucgccucagagggcuuccaauauuccgaucgaagaugguguuucgauggugaacgaaacaaccaaguuuuagaagaaaacauggacguagagauauggacuaaggaaggugagaggaagaaauugagaccccgauggcuggacgcuagaacguauagugauccgcuagcuuugagagaguucaaagaauuugcugcgggaagacgaagugugagcggggacuuaauucuugaaauaggcaaguugccacaacacuuaacacaaagagcacagaacgcauuagacaaucuugucauguuacauaauagcgagcaaggcggccgagcauauagacaugcaauggaagaacuaccagauacaauagaaacacuaauguuacuagcccuaauagcgguacuaacugguggaguuaccuuauucuuuuuaucaggcagggggcuagguaagacuucuauagguuuacucuguguaauggcgucgucugcccuguuguggauggcaucuguagaaccucacuggauagcggcuucaaucauauuagaguuuuucuuaaugguguuguugauacccgaaccagaccggcaaaggacuccacaggauaaucagcucgccuauguaguuauuggacuuuuauucaugauauuaacaguggcagccaaugaaauggggcuuuuagaaacaaccaagaaagacuuggggauuggacaugucgcggucgaaaaccaucaucacgcgacuauguuagacgucgacuugcauccagcgagugcauggacgcuauaugcuguggcuacaacaauaauaacaccaaugaugagacacacgaucgaaaacacuacugcuaauauaagccuaacagccauugcaaaucaagccgccauauuaaugggacuugacaaaggauggcccauauccaaaauggacauuggaguaccacuucuggcguuaggauguuauucgcaaguaaacccacucacuuuaaccgccgcgguccuuaugcucgucgcacacuaugcgauaauaggaccgggguuacaagcgaaggcuacacgugaagcacagaaaagaacggcugcgggcauaaugaaaaauccgacaguagacggaauaguugcgauagacuuagacccagugguauaugaugcaaaauuugaaaagcaacuuggacaaauaauguuauuaauccuauguacuagccagauacugcugaugcgaacuacaugggcccuuugugaaucuauaaccuuagcaacaggaccuuuaacaacauuaugggaaggaaguccgggaaaauuuuggaacacaacaauugcaguaagcauggcuaacauuuuucgaggaucauauuuagcuggagcaggguuagcauuuucacuaaugaaaucacuaggaggagggagacgaggaacuggugcccaaggggaaacucugggggaaaaguggaaaagacaacucaaccaacucucaaaaagcgaauuuaacacauacaaaagaagugguauuauggagguagauagaucagaagcgaaagaggguuugagacgcggggaaaccacuaaacaugcaguuagcagagguacagcaaaacuacgcugguuuguagaaagaaacuuagucaaaccggaagggaaaguaauugauuuaggcuguggucgagguggauggaguuacuauugugcgggauuaaagaaaguaacggaaguuaaagguuacacaaagggaggaccugggcaugaggagcccauuccgauggcgacauaugguuggaaucuaguaaaauugcauucagguaaggacguauucuuuauaccgccagaaaaaugcgauacacuccugugugacaucggugagucuuccccaaauccaacgauagaagagggacgaacuuuaagaguauuaaaaaugguugaaccauggcuaaggggaaaucaauuuugcauaaaaauacucaauccuuacaugccaagugucguagaaacucucgaacaaaugcaaagaaaacacggagggaugcucguuagaaacccauuaucucgaaauucuacacacgaaauguauuggguaaguuguggcacaggaaauauaguaucugcgguaaauaugacaucacguaugcuacuaaaccguuuuacuauggcucauaggaaaccgacguaugaaagggacguggaccuaggagcgggaaccagacauguugcaguagaaccagaagucgcaaaucuggauauaaucggacaacguauugaaaauauuaagcaugaacauaagagcacuuggcauuaugaugaagacaacccauauaaaaccugggcauaucacggcaguuaugaaguaaaaccaagugggucagcuucaucuaugguaaaugggguuguuaagcuacuuaccaagcccugggauguuauaccuaugguaacucaaauugcgaugacagauacgacucccuucggacaacaaagaguuuuuaaagaaaaggucgacaccagaacacccaaggcaaaaagggggacagcacaaaucauggaggugacugcuagaugguuauggggauucuuaucaagaaacaagaaaccaagaaucuguacaagggaagaauuuacccgcaagguacggaguaaugcagcaauuggagccguuuuuguggaugaaaaccaauggaacucugcaaaagaagcuguggaagaugagagauuuugggacuuaguucauagagaacgagaauuacauaagcaagguaaaugugcgaccugcguauacaacaugaugggcaagagagagaagaaacuaggugaauuugggaaggccaaagguagccgagcaauaugguauaugugguugggagcucguuuccuagaauuugaggcacuaggauuuaugaacgaagaccauugguuuaguagggaaaauagccuuaguggaguagaaggugaaggguugcacaaacucggauauauacuccgugauauauccaaaauaccaggcgguaacauguacgcagaugauaccgcaggaugggauacacguauaaccgaggacgaucugcaaaaugaggcaaaaauuacggauauuauggaaccagaacacgcucuguuggcaaccagcauauucaaacuaacauaccaaaauaaagucguaaggguccaacgaccagcaaggaacgguacgguuauggaugugauaagccgacgagaccaacgaggcaguggacaaguaggaacauauggauuaaauacuuucacuaacauggaggcucaacugauccgacaaauggaaucagaaggaauauuuucgccaucugagcuagagacuccaaaccuagcggagagaguuuuggauuggcucgagaaacaugguguggaacgacuaaaaagaauggcuauaucaggggaugauugugucgucaaaccaaucgaugacagguuugcaacggccuuaucggccuuaaacgacaugggaaaaguccggaaagauauaccccagugggaaccauccaaagguuggaaugauuggcaacaagugccguucuguucccaccauuuucaccaacuuaucaugaaagauggccgggaaauuguugucccauguagaaaccaagacgagcuaguugguagagcacgagugagccaaggagcaggauggucuuuacgcgaaacugcaugcuugggcaaaagcuacgcgcaaauguggcagcucauguacuuucacagaagggauuugcgcuuggcugcuaaugcuauaugcuccgccgugccagucgauugggugccaacaaaucgaacuacaugguccauucaugcacaucaucaguggaugaccacggaggauaugcuaagcguauggaaccguguuuggauagaggaaaauccuuggauggaagacaaaacgcauauaagcucauggggagaugugccauauuuggguaagcgcgaagaucaguggugcggcucacucaucggacucacagcaagagcgacaugggcuaccaauauacaagucgcuaucaaucaaguacgcagauuaauagggaacgaaaauuaccuagauuacaugacauccaugaaacgcuuuaagaaugacucagaccccgaaggagccuuaugguaa

SEQ ID NO: 21505 - RNA, 9879 nt, Artificial Sequence
  derived and/or modified CDS sequence (opt6) from DENV-1__FJ024448__SS-prME
ucagugacuaugcuccuaauguuaaugccuacugcacuggcuuuucaucucacuacccgaggaggagaaccacauaugaucguaucuaaacaagaacggggaaaaucacuauuauuuaaaacaagugcgggaguaaacaugugcacccuaauugcaauggacuuaggggaauuaugcgaagacacuaucacauacaaaugcccaaggauaaccgaaaccgaaccagacgauguagauuguugguguaaugcaacagauaccugggugacauaugggacuuguagucaaacuggagaacauagaagagacaaaaggucaguggcucuagcaccacauguugggcuuggauuagaaacaaggacagaaaccuggaugucaucggaaggagcauggaaacaaauacaaagaguagaaacaugggcacuccgacauccaggauucaccgucauagcuuuauuucuugcacacgcuauagggacuuccaucacccaaaaaggaauuauauuuauacucuuaauguuaguaacaccuucaauggcuaugagaugcguggguaucgguagucgagauuuugucgaaggguuguccggugcaacaugggucgauguuguucuugaacauggaucuuguguaacgaccauggcaaaagauaaaccuacuuuagacauagaauuauugaaaacagaaguaacaaauccugcgguccucaggaaacuauguauagaggcgaaaauuuccaacacuacaacagauagcagaugcccuacacaaggggaggcuaccuugguagaagaacaagacgcgaauuuuguguguagacgaacguucguugacagagggugggguaaugguugcggacucuuugguaagggaucauugaucacaugcgcuaaguucaagugcguaaccaaauuagaaggaaaaauaguacaauacgaaaauuuaaaguacagugucauagucacaguucacacuggagaucagcaccaagucggaaaugaaaguacagaacacggaacgacugccacgauaacgccacaagcgccaaccacagaaauacaacuaacagacuauggagcacucacccuagauuguucaccuagaacaggauuagauuucaaugaaaugguucuuuuaacaaugaaagaaaaaucuugguuaguacauaagcagugguucuuggaccuuccccuaccauggacaaguggugcaucgacaucacaagaaacauggaaucgccaagaucuguuaguuacauuuaaaaccgcccaugccaagaaacaagaaguagugguauuagguagucaggaaggagcuaugcacacagcauugaccggggcaacagagauucaaacauccggaacuacaacaauauucgcgggacaucugaaguguagauugaagauggauaagcugacauuaagagguaugucauaugucauguguacuggcaguuuuaagcuggaaaaggaaguugcagagacccagcaugggacuguacugguacaaauaaaauaugaagguacugaugccccauguaagaucccauucagcacccaagacgaaaagggcgucacacaaaauggcagguuaaucacggccaauccaaucguaacagauaaagagaaacccgugaauauugaggcugagcccccauucggagaaagcuacauugugaucggggccggggaaaaagcguugaaguugucaugguuuaagaaaggaucaucgauagggaaaauguuugaagcuacggcaagaggugcgagacguauggccauucuuggcgacacagcaugggacuucgguucaaucggugguguguuuacaagugugggaaaguuaguacaccaaaucuuuggcacugcguauggugucuuauuuagugguguaucauggacaaugaaaaucgguauagguguauuguugacuuggcuaggucuaaacucaagaucaacaagccuuucaaugacauguauugcuguuggccuaguaacacuauacuuaggaguaaugguccaggcugacucaggaugugucauaaacuggaaagggcgcgaauuaaaaugugggaguggaauuuucguaacaaaugagguacauaccuggacugaacaguauaaauuccaagcugacaguccaaaaaggcuaagugccgcaauagggaaagcgugggaggaaggaguguguggaauaagaucagcaacacgacuagaaaauauuauguggaagcagauaaguaacgaguuaaaucauauacuauuggaaaaugacaugaaauuuacagucguuguaggggauguugcaggcauucuugcucaagggaagaaaaugauaagaccccaacccauggaacacaaauacucauggaaaucauggggaaaggccaaaauaauaggggcugauguacaaaauacaacguuuauaauugacggccccaauacaccugaaugcccugaugaccaaagagcauggaacauaugggagguggaagauuauggcuuugggauuuuuaccacaaauauauggcucaaauuaagagauucauauacucaaguaugugaccauaggcuuaugagugcugcuauuaaagauucaaaagcaguacacgcugauauggguuacuggaucgaaucugagaaaaaugaaacuuggaaauuagccagagcuaguuucaucgaggugaaaacaugcauauggccaaaaagucauacacuauggaguaaugguguguuagagagugaaaugaucauaccuaaaauauaugguggcccuauaucgcagcacaauuaucggccuggauauuuuacccaaacugcgggaccguggcaccuagggaagcucgaguuagauuuugacuugugcgaaggaacuacuguggugguagaugaacacugugguaaccgugggccaucccuacgaacaacuacugugacagguaagaucauacacgaaugguguugucgaagcuguacacucccgccacuuagauuucgcggugaagacggguguugguaugggauggaaauaaggcccguaaaggaaaaggaggaaaacuugguuaagucaaugguuagcgcuggcagcggggaaguggauagcuuuaguuugggauuacuguguauuucgauuaugauagaagaaguaaugcgcucccgcuggagucgaaaaaugcuaaugacggggacacuagccgucuucuuuuuauugauaauggggcaguuaaccuggaacgacuuaauccgacugugcauaaugguaggagcuaacgcguccgaucgcauggggauggguacuacuuauuuagcgcuaauggcgacuuucaagaugagaccaauguuugcagucgggcuacuguuucguagacucacauccagagagguuuuacuacugaccauuggauuaaguuuagucgcaucgguagaauugcccaacagccuggaagaacucggagacgggcuagcaaugggaauuaugauacuaaaauuacuaacagauuuucaaucgcaucaguuaugggccacucuguuaucacuaacguuuauaaagacgacauuuagucuacauuaugccuggaagacaauggcuauggucuugaguauagucucuuuguucccucucugcuuaucaacaacaucgcagaaaacgacauggcugccuguguuacucggaaguuuagggugcaaaccacuuacaauguucuuaauagcugaaaauaagauuuggggacggagaagcuggccgcucaaugagggaauaauggcagucggcaucguaucuauucuauugucaucgcucuugaaaaaugauguuccauuagccggacccuuaauagcaggggguaugcuuauugcauguuacgugauuaguggcucaucugccgaccucucacuugaaaaagcagcagagguuaguugggaagaggaagcugaacacagcggcgccucucauaacauauuaguggaaguccaagaugacggcacaaugaaaauaaaagacgaggagcgagacgauacgcucacaauauuacuaaaagcaacacucuuagcugcuucuggugucuauccauuguccaucccggccacucuauuuguuugguauuuuuggcaaaagaagaaacaaagaucugggguucuaugggauacgccgucaccacccgaaguugagcgugcgguuuuagacgauggaauuuaucgaauaaugcaaagagguuuauuaggaagaucgcaagugggcguagggguguuccaagagaauguauuucauacaauguggcaugucacacgaggagcaguucuaauguaccaaggcaagagguuagagccauccugggcgucagugaagaaagaucuuaucucguauggaggcgguuggcgcuuacaagguagcuggaacacuggcgaagaagugcaggucauugcaguggaaccagggaaaaaucccaaaaauguccagacagcaccaggcaccuucaaaacuccugagggagaaguuggagcuaucgcccuggauuucaaaccuggaacaucaggcaguccaauuguuaauagggaaggaaagauuguaggguuauacggcaacggaguagucacuacuucuggaacauauguaagcgcuauagcacaagccaaagcgucacaagagggcccauuaccggaaauugaagacgaaguauuccggaaacguaaucuaacaaucauggauuuacauccaggaaguggcaaaacuaggagauauuuaccggcuauaguucgcgaagcaauaaaacgcaagcuaaggacauuaauucuagccccuacuagagugguugcaucagaaauggccgaagcacuaaagggcaugccuauaagguaucaaacaacugccguuaaauccgaacacacggggaaagaaauaguugauuuaaugugccaugcaaccuucacuaugcgacuucuuucgcccguuaggguuccuaauuacaauaugauaauaauggaugaagcgcacuuuacagauccgucuucaauagcugcuagaggcuacauauccacccgaguaggaaugggagaagcugcagcaauuuucaugacagcuacucccccuggcagcgucgaggcuuuuccacaaagcaaugcggugauucaagacgaagaaagggauauaccagagagaucuuggaauaguggauaugaauggauaacagauuucccugguaagacaguaugguucguuccaucgaucaagucaggaaacgauauugccaauugcuuacgaaagaacggcaaacgagugauacagcuaucaagaaagacguucgauacagaguaucagaaaacuaaaaacaaugacugggacuacguuguaacaaccgacauuucagaaaugggcgcuaauuuuagagccgaccgaguaauagaucccagaagaugccuaaagcccguaauccuuaaagauggcccagagcgcguuauucuugccggaccuaugcccgugacagucgccuccgcagcacagagacgaggacggauaggaaggaaucauaauaaagagggggaucaguacauauauaugggacaaccauugaacaacgaugaagaccaugcgcacuggacugaagcaaaaaugcuuuuagauaauauaaauacaccagaagguauuauaccugcgcuauuugaaccggagagggaaaaaucagcagcuauugacggcgaauaucgacuacgaggugaagcgcgaaaaacauucguugaacuaaugcgacgcggugauuuaccuguaugguuaucauauaaaguagcaucggaagguuuucaauacucagaucggagauggugcuucgacggggagaggaauaaccaaguucuagaagagaauauggauguggaaauuuggaccaaagaaggugaaaggaagaaacuaagaccucguuggcuugaugcuagaacuuacucagauccccucgcccuaagggaauuuaaggaguucgcagcuggccgaagaagcguuaguggugauuuaauccuugaaauugguaaauugccacaacaucugacucagcgugcccagaaugcacuagauaaucuugugauguuacauaacagcgaacaaggugggagagcguaucgucaugcaauggaagaauuaccggacacaauugaaacccucaugcuguuagcguugauagcuguucuuacagggggaguuacauuauucuuccuuagcggaagaggguuagggaaaacauccauaggcuugcuguguguaauggcuucgaguguucuuuuauggauggcuucuguagaaccacacuggaucgcugcaaguauuaucuuagaauuuuucuuaaugguccuucuuauaccagaaccugauagacagagaacaccccaagauaaucaguuggcauaugucguaaucggacuucuuuuuaugauucuaacaguggccgcgaacgaaaugggacuuuuagaaacuaccaagaaagaucuggguauuggacacgucgcaguggaaaaccaucaucacgccgcaauguuggacguagaucuucacccggccucugcguggacacucuacgcagucgcgacaacgauaauaacucccaugaugagacacacuauagaaaacacuacugcaaacauuucuuuaacagcuaucgcuaaucaggcagcuauauuaaugggacuagacaaaggauggccgauaaguaaaauggacauuggaguaccguugcuagcauugggauguuauucucaagucaaucccuuaacacucacugcagcuguucuaauguuaguagcgcauuacgccauuaucggaccgggguuacaagcgaaagcaacaagagaagcgcagaaacgaacagcugcggggauaaugaagaauccaacaguagacggaauaguagcuaucgacuuagacccaguaguauaugaugcaaaguucgaaaaacaacuaggccaaaucaugcuacuuauuuuaugcacuucucagauacucuuaaugagaaccaccugggcguuaugcgaaucuaucaccuuagccacaggaccacugacaacgcuuugggaaggaucacccgggaaguuuuggaacacgacaauugcugugucaauggcuaauauauuuagaggaucguacuuagccggugcgggucucgcauuuucauuaaugaagucauuaggcgguggucggagagguacaggugcgcaaggcgagacucuuggagaaaaauggaaaagacaauuaaaccagcuuucaaaaucggaguucaauacuuacaaaagaucaggcauuauggaaguagaucgcagugaagcaaaagaaggauuaaaaagaggcgaaacaaccaaacacgcaguuagcagaggaaccgcuaaacuucgcugguucgucgaaagaaauuuaguaaaaccugaagggaagguuauagauuuaggaugugggcguggggguuggucguacuauugugccggauugaaaaagguaacugaaguuaagggauacacaaaaggugggccagggcacgaggaaccaauaccaauggcaacauauggcuggaaccuggugaaacuucauucuggaaaggaugucuucuucauaccaccugagaagugugauacucuguuaugugauauaggagaaucgucaccaaacccaacgauagaggaaggucgaacacuuagaguguuaaaaaugguagaaccgugguuacgagguaaucaauucuguauuaagauauuaaauccuuauaugccgucaguagucgaaacauuagaacaaaugcagaggaaacacggagguauguuaguaaggaacccucucucuagaaauucaacgcaugaaauguacugggucucaugugggacgggaaacauagugucggcuguaaauaugacaucuagaaugcuuuuaaacagguuuacgauggcacauaggaagcccacguacgaaagggauguagaccuaggagcuggcacuagacauguggcagucgaaccggaaguugcaaauuuagauaucauaggucaacgaauugagaacaucaaacacgaacauaagaguacguggcauuacgaugaagauaauccuuacaaaacuugggcuuaucauggaucuuaugaggugaaaccgagugguucggccucauccaugguaaauggaguggugaagcuccucacaaaaccaugggauguuauucccaugguaacacaaaucgcaaugaccgauacaacuccuuuuggacaacagcgggucuuuaaagaaaaaguagauacacggacucccaaggcgaaaagaggaacggcucaaauaauggagguaacugcuaaauggcuaugggguuuccuaucgcguaauaaaaagccccgaauauguacuagggaggaguuuacgaggaaaguccgaaguaacgccgcuauaggagcaguauuuguggaugagaaccaguggaauagugccaaagaagcaguugaagacgagagauuuugggauuugguacacagggaacgagaauuacacaaacaagguaagugugcgacuugcgucuauaauaugauggggaagagggagaagaaacuaggagaguucggaaaagcuaaagguaguagggcaauaugguauaugugguuaggcgcaagguuuuuagaguuugaagccuuaggguuuaugaaugaagaccacugguuuagccgggagaauagucucaguggaguagaaggagaaggcuuacacaagcucgguuacauccuacgagacauuagcaaaauucccggagguaauauguaugcugaugacacagcagggugggauacuaggauuacagaagacgaucuucaaaaugaggcgaggauuacagauauaauggaaccugaacaugcacuacuagccaagucgauauuuaaacuaacguaucagaauaagguaguuagagugcaacgaccagccaaaaauggcacugugauggaugugauuaguagacgugaucaaagggguucaggacaaguuggaacuuauggguuaaauacuuucacaaacauggaagcccaacugauacgacaaauggaaucggaagguauauucucuccauccgagcuggagacucccaaucuagcugaacguguacuagauuggcucgaaaaauauggaguugagcguuugaagcgaauggcgauaucgggagaugacugcguugugaaaccaauagaugauagguucgcgacggcccugaccgcgcuaaacgauaugggaaaggucagaaaagacauaccacaaugggaaccauccaaaggguggaaugauuggcaacaaguucccuucuguucacaucacuuucaccaacuaauaaugaaggauggaagagagauaguuguacccugcagaaaccaagaugaacuugucggucgagcaaggguaagucaaggagcggguuggucauuacgggaaaccgcaugucuaggcaaaucuuacgcccagauguggcagcuaauguauuuucaccgaagggaucuucgacuagcagcaaaugccauuugcagugcaguuccaguagacuggaucccaacgagucgcacaaccuggaguauccaugcacaccaucaauggaugacaacugaggauauguuguccguauggaauagaguuuggauagaagaaaacccguggauggaggacaaaacacacaucaguagcuggggagauguuccauauuuaggaaaaagagaagaucaaugguguggcagcuuaauaggccugacggcccgggcuacgugggcgacgaauauucaagucgcgauaaaccagguuagaagauugauaggaaaugagaauuaucuagauuauaugacuuccaugaagagauuuaaaaaugagagugauccagaaggcgcucugugguag

SEQ ID NO: 21506 - RNA, 9879 nt, Artificial Sequence
  derived and/or modified CDS sequence (opt6) from DENV-1__FJ182026__SS-prME
ucuguuacuauguuauuaauguugaugccuaccgcauuggcauuucauuuaacgacuagagguggagaaccacacaugauuguaucaaaacaagaacggggaaaaagucuuuuauuuaaaaccuccgccgguguaaauaugugcacuuuaauagcuauggaccuuggggaacuaugugaagacacaaugaccuauaaaugcccuagaauaaccgaaacagaacccgaugacgucgauugcugguguaaugcuaccgacacauggguaacauacgggacgugcagucaaacaggggaacaucgaagagauaaaagaucgguagcauuggcuccgcaugugggauuaggcuuagaaacucguaccgaaacuuggaugagcucugaaggagcauggaagcaaauacaaagagucgagaccugggcuuugagacacccuggauuuaccgucauugcauuauuccuggcucacgcuauugguacaucaauaacacagaaagguauaaucuuuauacugcucaugcucgugacaccuaguauggcuaugcgcugugugggcauugggucucgagacuuuguagaagggcuaaguggagcaaccugggucgacguuguauuggagcacgggucguguguuacuaccauggcuaaagauaaaccgacguuagacauagaacuccuuaaaacugaggucacaaacccugcaguucuacggaagcuauguauugaagcgaaaauaucuaacaccacaacagacagucgaugcccaacccaaggagaagcaacacuuguagaagaacaagaugcuaacuuuguuuguagacgcacauucguagaucgcgguugggggaauggcuguggucuauuuggaaaaggaaguuuaaucacaugugcgaaguuuaaauguguaacuaaauuagaagguaagauaguccaguaugagaacuugaaauacucaguuauugugacaguucauacaggggaucagcaucaaguggguaacgaaucgacagagcauggcacaacugcaacaauaacaccucaagcaccuacaacugaaauucaauuaacagauuacggugcauuaacacuagauuguucacccagaacuggcuuggacuucaacgagaugguauuacuuaccaugaaagaaaaaucauggcuuguacauaaacaaugguuucuggaucuuccauuaccauggacgagcggggcaucaacaucacaagaaacuuggaacagacaagauuuauugguaacauucaaaaccgcacacgccaagaaacaagagguagucguauuaggaucacaggaaggugcaaugcauacggcacugacaggagcaacagagauacaaacuucgggaacuacaacaauauuugcgggacauuuaaaaugccgauuaaaaauggacaaguugacuuuaaagggaaugaguuacgugaugugcacaggaucuuuuaaacuagaaaaggagcuugcagaaacucagcaugguaccgugcuuguacaaauuaaauaugagggcacugacgcaccuugcaagauccccuuuuccacacaaaaugaaaaaggagucacacagaauggacgcuugauaacugcgaauccuauaguaacagauaaagaaaaaccagugaacauagaggcagaaccgccuuucggggaaagcuacauaguuaucggugcuggagaaaaagcacuuaaauuauccugguuuaagaaagguaguagcaucggaaagauguuugaagcgaccgcacguggugcccgacgaauggcaauccuaggagacacagccugggauuucggcuccaucggaggggucuuuaccuccgucggaaaacuuguucaucaaauuuuuggaacugcauauggaguacucuucaguggaguaucauggacuaugaagaucggaauuggagucuuacuaacuugguuaggguugaacucaagaucuacaaguuugagcaugaccuguauugcuguaggucuagucacucuauaucuugggguuaugguucaagcagauucaggauguguaaucaauuggaagggacgagaauugaaauguggcucuggcauuuuuguuacaaaugaagugcacacauggacugaacaauauaaguuucaagcagauagcccuaagagacuguccgcggcgauagguaaggcaugggaggaaggcguauguggcauaaggucagcgacgagauuagagaauaucauguggaaacaaauaucaaaugaacucaaccauauacuucuagaaaacgauaugaaauucacaguaguuguaggagacguggcaggaaucuuagcgcaagguaaaaagaugauuagaccacaaccuauggaauauaaguauaguuggaaaagcugggggaaagcuaaaauuauuggcgcugauguccaaaacacaaccuucauaaucgacggaccaaacacaccugaguguccagaugaucaaagggcauggaauauuugggaggucgaggacuauggguuuggaauuuucacuacuaauauauggcugaaacuuagggauucauacacacaagucugcgaucaccgccuuaugucagccgcaauuaaagauucaaaggcgguucaugcugauaugggauauuggaucgaaagugagaaaaaugagacauggaaacucgcgcgggcuuccuuuauugaaguuaaaacuuguauauggccgaaaucacauacauuaugguccaacgguguuuuagagucugagaugaucauaccaaaaaucuauggaggaccgauaucccaacauaauuacagaccuggauacuuuacccagacagcaggucccuggcauuuggguaaguuggagcuagauuuugaucucugcgaagguacgaccguagucguggacgaacacugcgggaaucgaggaccaucgcuacggacaacuacagugacagguaaaauaauacacgagugguguugucgaucaugcacucucccgccucuucgauuuaggggcgaagauggcugcugguacggcauggaaauucgaccaguaaaagaaaaagaggaaaauuuggucaaaagcaugguuagugcgggaucaggcgaaguagauucauucucgcuuggccuauuguguauaucuauaaugauagaagaggugaugagaucgagguggagucgaaagauguuaaugacaggcacacuugcugucuuuuucuuacuuauuaugggccaacucacguggaaugaccucauccgguuaugcauuauggugggcgcuaaugcuucagauaggauggguauggguacgaccuaucucgcgcuaauggcuacuuucaaaaugagaccaauguucgcggugggguuauuguuccgaagauuaacuuccagggagguucuacuacuaacgauaggauuaucguugguagccaguguugaauuaccaaauagccuugaagaauugggugacggacuagcaaugggaauuaugauacugaaacuauuaacugacuuucaaagucaucaguugugggccacacuauugucacuaacguuuauaaaaacuacauuuucuuuacauuaugcuuggaagacuauggcaaugguuuugaguauagucucuuuauucccucugugcuuaucgacgacaucacagaaaaccacaugguuaccgguuuuauuagggagucuaggcuguaaaccccucacuauguuccuaauagcagagaacaaaauauggggacgccgaaguuggccacuuaaugaagguaucauggcaguugggauugugucuauacugcuaaguagucuuuuaaagaacgaugugccacuagcgggaccauuaauagcaggaggaaugcugauagcuuguuauguuauuucagguucgucugcugaccuaucauuagaaaaagcagcagaagucaguugggaagaagaggcagaacacaguggggccucucauaacauauuaguugagguccaagaugauggaacuaugaaaauuaaagaugaagaaagagacgacacacuuacgauuuugcuaaaagcaaccuuacuggcuguaaguggaguuuauccgcucagcauaccugcgacacuauucguaugguauuuuuggcaaaagaagaaacagcguagcgguguauugugggacaccccauccccaccagagguagagagggcaguauuagaugacgguauauauaggauaaugcaaagaggauuacuuggaagaucucaagucggcguggggguguuucaagaaaauguuuuucauacaauguggcacguuacaagaggagccguauuaauguaucaaggcaaaagauuggaaccaaguugggcaagcguuaagaaagacuuaaucucauacggaggaggauggcgccuccagggaucuuggaaugcuggugaagaaguccaggucauagcuguagaaccaggcaaaaaucccaaaaauguacaaacugccccagguacauuuaaaacgccugaaggagaaguaggugcaauagcuuuagacuuuaaaccaggaacgucugguuccccaauaguuaaccgcgagggaaaaaucguuggacuguacgggaauggaguagugacgacgagcgguacauacguuagcgccauagcacaagcgaaggcaucacaagagggcccacuuccugaaauagaagacgaaguuuuuagaaaacgaaaccuuacgauuauggaucuccacccaggguccggaaaaacaagacguuacuuacccgcaaucguacgagaagcuauaaaacguaaguuacggaccuuaaucuuagcccccacaagagucguugcuagugagauggcugaagcguuaaaaggcaugccaauacgguaccaaacaacagcagucaaaucagagcacaccggaaaggagauuguagauuuaaugugccaugcaacauucacuaugcgguuauuguccccaguaagaguaccaaauuauaauaugauuauuauggaugaggcacauuuuacagauccaaguucgauagcggccaggggguacaucucaacaaggguugggaugggagaagcagcagcaaucuuuaugacagcuacuccgccggguucgguagaagcauuuccccaaaguaaugccguaauccaggaugaggagagagacauaccggaacgaucauggaacucaggauacgaguggauuacagauuucccuggcaaaacuguaugguuuguacccucaauaaaaucagguaaugacauugcuaauuguuugaggaaaaauggcaagcgcgugauacagcuaucacgcaaaacuuuugacaccgaauaccagaaaaccaaaaacaaugacugggauuacguagugacaacugacauuucggaaaugggcgcaaauuuuagagcugaccgcgugaucgauccacgucgaugcuuaaagccagugauacuaaaagaugguccugaaagagucauuuuagcaggaccuaugccuguuacaguagcuagugcggcccaaagacgggggagaauagggaggaaucauaacaaagaaggcgaucaauauauauauauggggcagccacuaaacaaugacgaagaucacgcucacuggacugaagccaagauguuauuagacaauaucaacacuccggaaggaaucauaccagcauuauuugaaccggaaagggagaagucagcagcaauugacggugaauaccgacuaaggggcgaagcucguaaaacuuuuguggaacugaugcggcgaggugauuuacccgucugguuaaguuauaagguagcgagugaagguuuccaguauucugaucgacgaugguguuuugauggagaaagaaacaaccaaguacuagaagagaacauggacguggaaauuuggacaaaagaaggagaacgaaagaaauuacgcccgagaugguuagaugcucguacauauucagauccuuuagcacuucgugaguucaaagaauuugcugcaggaaggcguucuguguccggagaucuaauacuagagaucggcaaacuuccacaacacuugacucaaagagcacaaaaugcccuagacaaccuuguaauguuacacaacucugaacaggguggcagagcuuauaggcaugcaauggaagaacuucccgauacaaucgaaaccuuaaugcugcuagcccuuauugcgguacuuaccggagggguaaccuuauucuuucuuagcggucgaggccuaggaaaaacuucuauaggauuauugugugucauggccuccucgguacuuuuauggauggcuucaguagaaccucauuggauagcagcuagcauuauucuugaguucuuccuuaugguacuauuaaucccggagccagauagacaaaggacuccucaagauaaucaauuagcuuauguugugaucggauuacuauucaugauauuaacuguagcggcgaacgaaaugggccuacuugagacgaccaagaaagaucuagguauaggacacguagcaguagagaaccaccaucaugcggcaauguuagacguagaccuucaucccgcaucugccuggacucuauacgcaguggcuacaacaauaaucacaccuaugaugagacacacuauagagaauacgacggccaacaucagucuuacagcgauagcaaaucaagcagcgauacuaaugggcuuagacaaaggauggccaauuagcaaaauggacauaggugucccauuacuugcuuuaggguguuacucacaagucaauccgcuuacgcuuacagcggcaguucucaugcuuguagcucacuaugcaauaauaggccccggucuucaggcaaaagcgacuagagaagcucagaaaagaacagcagccggaauuaugaaaaacccaacgguagacgguaucguggcaauugacuuagaucccguaguuuaugaugcaaaauucgaaaaacaacuaggacaaaucauguugcuaauuuugugcacgucccaaauauuauugaugcgaacuacgugggcacugugugaaagcauaacucuugcuaccgguccgcuaaccacuuugugggaaggaagcccaggaaaguuuuggaauacuacaauugcgguuucgauggcuaacauuuuucguggaagcuaccuagccggcgcagguuuagcauuuuccuuaaugaaaagucucgguggaggacgucgagggacaggcgcucaaggagaaacucugggggagaaauggaagcggcaauuaaaccagcuaucaaaaucggaguuuaauacguauaaacgaucaggaauaauggaagucgacagguccgaagcgaaggaaggacugaaaagaggagagacuacaaaacaugcaguuucuagaggcacugcuaaacugcggugguucguugaacgaaauuuaguuaaaccagaaggcaaagugauagaccuagguugugguagggguggauggucuuacuauugugcagggcuaaagaaagugacagaggucaaagguuauacuaaaggaggaccaggucaugaagaaccgauaccaauggcaacguauggauggaauuuaguaaaacuacacucaggaaaggacguuuucuuuauaccucccgaaaagugugauacguuguuaugcgauauaggagagagcaguccuaauccuacaauagaggaaggaagaacauugagaguucuaaaaaugguggaaccuugguuaagaggcaaucaauuuugcauaaaaauuuuaaacccuuacaugcccucaguuguggagacuuuagaacagaugcaacgaaaacauggcggaauguuaguacgaaacccccucagcagaaacucgacccaugaaauguauugggucucauguggaacagguaacauagugucugcuguaaauaugacaucgcggauguugcuaaauagguuuacgauggcucacagaaaacccacguacgaaagagacgucgaccuaggugcagguacgcgucauguagccguagaacccgaaguagcaaaccuagacaucauaggucagagaauugaaaacauaaaacaugaacacaaguccacauggcacuaugaugaggacaacccguauaaaacaugggccuaccacggaucauacgaggucaaaccgaguggauccgcuucaaguauggucaauggcguaguaaaacuuuuaacaaaaccuugggacgucauuccuauggucacucaaauagcaaugacugauacaacgcccuuuggucaacaaaggguguucaaagaaaagguugacacgcgaacaccuaaagcaaagagaggaacugcacaaauuauggaggucacugccaaauggcuauggggcuuuuugagccggaacaagaaaccaagaauauguacaagagaagaguucacuagaaaaguaagaaguaaugccgcuaucggagcagucuuuguagacgaaaaucaauggaauagcgcuaaagaggcgguagaagacgaaagauuuugggaucuagugcacagagaacgagaauuacacaaacagggcaaaugcgcaaccuguguuuacaacaugauggggaagcgcgagaagaaauugggugaguuuggaaaagcaaaaggcucacgagcuauaugguauauguggcuuggcgcccgauuucucgaguuugaagcauuggguuucaugaaugaggaccauugguucagcagagaaaauaguuuaucaggaguagaaggugagggucuacacaaauuaggauacauacuccgugauaucucaaaaauccccggcggaaacauguacgccgacgacacggcuggaugggauacgaggauuacugaagaugaccuccagaaugaggccagaaucacagauaucauggaaccagagcacgcuuuacuagcaaaaucaauuuuuaaacugacauaucagaauaaaguuguacguguccaacgaccagccaaaaauggcacagucauggacgucauaucuaggcgagaucagagaggaucaggccagguaggcacauacgguuugaacacauucacuaacauggaggcccaauugauaaggcaaauggaaucagaaggaauauuuucuccauccgaauuggagacuccuaaucuggcagaaaggguucuugauuggcuggagaaauauggcguugaaagauuaaaacgaauggcgauaagcggugaugauugcguuguaaaaccaauugaugacagguucgcaacagcucuuacggcacugaaugauaugggaaaaguaagaaaagauauuccacaaugggagccaaguaaagguuggaaugauuggcaacaaguaccuuucugcagucaucauuuccaccaguuaauaaugaaagacggcagagagauuguaguuccauguaggaaccaagacgaguuagucgggagagcaagagucagucagggagcgggauggucgcugagagaaacggcgugcuuaggaaaaucauacgcgcaaauguggcaacuaauguacuuccaccgaagagaucuccggcucgcggcaaaugcaauuuguuccgcuguuccgguagacuggaucccaacaagccggacuacauggucaauucaugcacaccaccaauggaugacgacugaggacaugcucagugucuggaaccggguguggauugaagagaauccauggauggaggauaaaacgcauauaucguccuggggagacguuccguaucuaggaaaacgggaagaccagugguguggcagcuuaauuggacuaaccgcacgcgccaccugggcuacuaauauucagguagcaauaaaucaaguaagaaggcuaaucgguaaugagaauuauuuggacuauaugacaaguaugaaaagauucaaaaacgaaagugaccccgagggagcauuaugguga

SEQ ID NO: 21507 - RNA, 9879 nt, Artificial Sequence
  derived and/or modified CDS sequence (opt6) from DENV-1__FJ182027__SS-prME
ucuguuacuaugcuuuuaauguuaaugccuacagcuuuagccuuccauuuaacaacuaggggaggagaaccucauaugauuguaagcaaacaagaaagggggaaaucuuuacuauucaaaacauccgcaggaguuaauaugugcacacuaauugccauggacuugggugaacuuugugaggacacuauaacguacaaauguccaaggauaacagaaacggagccugaugacgucgacugcugguguaaugccacggacaccuggguuaccuacgggacguguucgcaaacaggagagcauagacgagacaaaagaucuguugcauuagcaccacacgucggguugggccucgaaaccagaacggagacuuggaugucaucagaaggagcauggaaacaaauacaacgaguagaaaccugggcacuaagacacccagguuuuacgguuauugcacuauuccuagcacaugcuaucggcacaagcauaacucagaaaggaauaauuuuuauacuacuaaugcuaguaacacccaguauggcgaugcgcugugucgguauugguuccagagacuucguggagggguugucaggagcaacuuggguagauguuguauuggaacaugguagcugugugacaacaauggcaaaagacaaaccuacgcuagacauugaauuacucaaaacagaaguaacaaacccugcaguuuuacggaaacuuugcauugaagcaaaaaucagcaauaccacgacugacucccgcuguccaacccaaggugaagcuacucucguugaagaacaagacgccaauuucguaugcagacgaacauucgucgacagggggugggggaauggauguggauuauucggaaaaggcagcuugauaacgugugcaaaauucaaaugcguaaccaaauuagaaggaaaaaucguacaguaugaaaauuugaaauauucagucauaguuacgguacacaccggagaccaacaucaagugggaaaugaaaguacagaacacggaacaacagcgacuaucaccccucaggcacccacgaccgaaauacagcuuacagacuacggagcauuaacuuuagauugcucaccgagaacgggucucgauuuuaaugagauggucuuacugacaaugaaagaaaaaucguggcucguucacaaacaaugguucuuagauuugccacuaccuuggacaucuggugcgucaacaagccaagaaacguggaacagacaggaccucuuagucacauucaaaacagcccaugcuaagaaacaagaagucguuguccuagguagucaagaaggagcuaugcauacggcguuaacaggagcaacagaaauacagacgucagguacaacgacaauauuugcaggacacuuaaaauguagacuaaaaauggauaaauuaacacuuagaggaaugaguuaugucauguguacaggcagcuucaaauuggaaaaagaaguggccgaaacccaacauggaaccguacucguucagaucaaauaugagggaacugaugcacccuguaaaauuccguucucuacacaggaugaaaaaggaguaacucaaaacggccgccucaucacagcgaacccaaucguaacugauaaggaaaaaccagucaauaucgaagcugaaccaccguucggggaaucguauauagugauuggagccggagaaaaggcacuaaaauugucgugguuuaagaaaggaaguagcauugguaaaauguucgaagcaacagcaagaggugcgagacggauggcgauuuuaggcgauacagcuugggacuucggaucaauuggagguguguucaccuccguagguaaguuaguucaucaaauuuucggcacugccuacggaguauuauuuucaggcgugucauggaccaugaaaauuggaauaggcguauuacuaaccugguuaggacuaaacuccaggaguacuagcuuauccaugaccuguaucgcaguuggccuagugacccuauaucuuggaguuaugguucaagcagauucuggaugugucauuaauuggaaaggccgugaacuaaaguguggcucaggaaucuucguuacaaacgaaguacauacuuggacggaacaauacaaauuucaagcugauagccccaaacgccuaucagcagcaauagguaaagccugggaagaagggguuugcggaauaagaucagccacaagauuagaaaacauuauguggaagcaaaucagcaacgaauuaaaucacauacuucuggagaaugauaugaaauucaccguaguggucggagaugucgcagguauccuagcucaaggcaagaaaaugauucggccacaaccuauggagcauaaguauucauggaaaaguuggggaaaagcuaaaauuauuggugcagacgugcaaaauacuacuuuuauuauugacggaccaaacacccccgaguguccggacgaccagcgcgcguggaacauaugggaaguggaagacuacggcuuuggcauauuuacaacaaauauauggcuuaaacugagagauaguuacacacagguuugcgaucauagguugaugagcgcugcgaucaaagacucgaaagcuguacacgcugacaugggauacuggauugagagugagaaaaaugaaacauggaaauuggcacgggcuucguucauagaaguuaagacgugcauauggccaaaaucccauacccuuuggucuaauggcgugcucgaaucagaaaugauuauaccgaaaauauacggagguccgauuagccaacauaacuaucgaccuggauacuuuacacaaacugccggcccuuggcauuuaggcaaacuagaauuagacuuugauuugugugaaggcacaacgguuguaguagaugagcacuguggaaaccgcggccccucucuucgaacuacuacaguaacugguaaaauaauccacgaauggugcugcagaucguguacauuaccaccucuaagguuucgcggcgaagauggaugcugguacgguauggaaauucgaccaguaaaagaaaaggaagaaaauuuagugaaaagcaugguuucagccggaagcggagaaguugacucuuucaguuuaggacuuuuauguaucucaauaaugauugaagagguaaugagguccagauggaguagaaaaauguuaaugacggguacauuggcaguuuucuuucuacuaauaaugggacaacuaacuuggaaugaccuuauccgacucuguauuaugguaggagccaaugcuucggaucguauggguaugggaacaacauaucuugcguugauggcaacauuuaaaaugagaccaauguuugcuguuggcuuacuauuuaggcggcugaccagcagagagguuuuauuacuaacuaucggauuaucccuugucgcgucagucgaacucccaaauucuuuagaagaacugggagacggucuagccaugggaauaaugauacucaaacugcuuacugacuuucagucucaccaauugugggcaacucuauuaucuuuaacauuuauaaaaacaacauuuagucuccauuaugcguggaaaacuauggcaaugguccuuucaaucguuucacuauucccccuuugucucucaacaacgucccagaaaacgacauggcuaccuguauugcuugggucccugggauguaaaccauuaacuauguuucugauugcagaaaauaagauuuggggucgacgaucuuggccacuaaacgaaggaauaauggcuguugggauuguauccauccuucucuccagcuugcuaaagaaugauguuccguuagcuggaccgcuuaucgcuggcggaauguugaucgcuuguuauguaaucagcgguucuagugcugacuugagucuugagaaagcagcugaaguaaguugggaagaagaagcggaacacaguggagcaucacacaauauauuaguagaaguccaagacgacggaaccaugaaaauaaaagacgaagaacgugacgacacucugacuauccuacuaaaagcuacuuuauuagccguaucgggagucuaccccuuaaguauuccggccacacuguucguaugguauuuuuggcaaaagaagaaacagcguagcgguguuuuaugggauacuccaucaccaccggaaguggaacgagcgguuuuggaugauggaaucuauaggaucaugcaacguggucuccuaggacgcucacaagucggcguagggguauuucaggagaaugucuuucacaccauguggcacguaacgagaggcgcaguccuaauguaucaagggaaaagauuagaaccaucaugggccaguguuaagaaagaucuaaucaguuacggcggaggcuggcgauugcaaggauccuggaacacgggggaggaaguucaagucauagcaguagaaccggggaaaaacccuaaaaacguacaaacugcaccagguacguuuaaaacuccagaaggugaaguuggagcuauugcccuugacuuuaaaccaggcaccucuggaucuccgaucguaaauagagaaggaaaaaucgucggauuauauggaaauggcgucguaacaaccucuggcacauauguuucagcaaucgcgcaagcaaaagcuagccaagaaggaccucuaccugaaauagaggaugaaguguucaggaaacguaaucuuacaauaauggaucuucauccagguagcgggaaaaccagaagguacuugccggccauuguacgcgaagcaaucaaacgaaagcuccguacuuugauucucgcaccaacuagaguggucgcguccgaaauggccgaagcgcucaaaggcaugccuauacgauaucagacaacagcaguuaaaagcgaacauacugguaaggaaauuguagacuuaaugugccacgccacguucacaaugagacuccucagcccagugcgaguaccaaauuauaacaugauuauaauggacgaagcucauuucacggauccaucaucaauagcagcaagaggguauauaucuacgaggguaggcaugggagaggcagcagcaaucuucaugaccgccacaccacccggaaguguugaagccuucccucaaucaaaugccguuauacaagaugaagaaagagacaucccagaaagaagcuggaacucaggauaugaauggaucacagauuucccuggaaagaccgucugguucguaccuagcauaaaaagcgggaaugacauugcaaauugucuacgaaagaaugguaaacgaguaauacaacuaucacgcaaaacuuucgauacagaguaccagaagacgaagaauaaugauugggacuauguaguaacaaccgacauuucagagaugggagcaaacuuccgagcggauagaguaaucgauccaagacguugccuaaaaccggucauauuaaaggaugguccggaacguguuauauuagcagggccuaugccaguuacaguagcuucugcggcgcaacggcgcggucgaauuggacguaaucauaauaaagagggugaccaauauauuuauaugggacaaccgcuuaauaacgacgaagaccaugcccacuggacugaagccaagaugcuauuagauaacauaaacacuccggaaggaaucauacccgcucuuuucgaaccggaacgcgaaaagagugcggcaauagauggugaguacagacuccguggggaagcaagaaaaacauucguugaacuaaugcguagaggggauuuaccuguuugguugagcuauaagguggccagugaagguuuucaauacagugauagaagguggugcuuugauggggaaagaaauaaccaaguucuagaagaaaauauggaugucgagaucuggaccaaggaaggagaacguaaaaaguuaagaccacguuggcuagacgcaagaacuuauuccgauccuuuagcucucagagaguucaaggaauuugcagccgguagaagaucuguaagcggcgauuuaauacuugaaauaggcaaacuuccacaacaucuuacgcaaagagcacagaaugcauuagacaaccucgucauguuacauaauucggagcaagggggacgcgcauaucgacaugcaauggaggaauuaccggauacaauagaaaccuuaaugcuacucgcccucauagcaguuuugacaggaggagucacacuauucuuucuaucuggcagaggcuugggcaaaacaaguaucgggcugcuauguguaauggcaucuagcguguugcucuggauggcuagugucgaaccgcauuggauagcugcgucaaucauauuagaguucuuucuaaugguacucuuaauacccgagccugacagacagcggacaccacaagacaaucaauuagccuacguaguaauugguuuguuguucaugauccuaacuguugcagcgaaugaaaugggacuacucgaaacaaccaagaaagaucuugguauaggacacguugcggucgaaaaucaccaccaugcagcaaugcuagauguggaccuccauccagcaucggccuggacauuguaugcaguagccacaacuauaaucacuccuaugaugcggcacacgauagagaacacaaccgcaaauauaucgcuaacagccaucgcaaaucaggccgcaauccugauggguuuggauaagggguggccgauaaguaaaauggauauuggcguuccccucuuagcauuggguuguuauucucaaguaaauccauugacacuaacugcggcaguucuaaugcugguugcacacuaugcaauuaucgguccaggucuucaagcuaaggccacaagggaagcccaaaaacgaacggcugcaggaaucaugaaaaacccuacaguugauggcauagucgccauagaccuggauccaguuguauaugacgcaaaauucgagaaacaauuaggucaaaucauguuauuaauacugugcacgucgcaaauacuacuuaugcgaaccacaugggcucuaugugagucaauaacguuagccacagguccauuaaccacucuaugggaaggaucaccaggaaaguucuggaauacuacgauagcaguuucuauggcaaacauauuccgaggaaguuaccuggcaggcgcuggucuugccuucagucuuaugaagaguuuagguggaggaaggagaggcaccggagcgcaaggagagacccuaggcgaaaaauggaaacggcaacuaaaucaacuaagcaaaagcgaguucaauacguacaaaagaucaggcauaauggaaguugacaggagugaagcaaaagaaggacuuaaaagaggagaaacuacuaagcacgcaguuuccagaggcacggcaaaguugcggugguuuguagaacgaaaccuugucaagccugaggggaaaguuauugaucucggauguggacguggcgguuggucuuauuauugcgcaggucuaaagaaagucaccgaagucaaaggcuauaccaaagguggaccaggacacgaagaaccaauuccaauggcuacuuacggauggaauuugguuaaauuacacuccggaaaagauguauucuuuauaccaccagaaaaaugcgauaccuugcuaugcgauauaggggaaagcucaccuaauccuacuauagaagaaggucgaacucuaagaguucugaagaugguugaaccuugguugagagggaaccaauuuuguauaaaaauacuaaauccauauaugcccuccguaguagaaacauuagagcaaaugcagcgaaaacacggagguaugcuaguucgcaacccuuugucgcgcaauucuacacaugaaauguacuggguaaguugcgguaccggaaacaucguuucagccguaaauaugaccagucguaugcuuuuaaaccgauucacgauggcucaccgcaaaccuacguaugaacgggaugucgaucuaggagcugguacaaggcauguagccguagaaccagagguagcaaacuuagauauaauaggacaaagaauugaaaacauaaaacaugagcacaagucaacuuggcacuacgacgaagacaauccuuauaaaacgugggccuaucauggauccuaugaaguaaaacccucaggcagcgcauccagcaugguuaaugggguugucaaauugcuaacaaagccaugggacguaauacccaugguuacacaaauagcaaugaccgauacgacgccauuuggacagcagagaguauuuaaggaaaaaguugacacccgcacaccuaaagcaaagagagggacagcucaaauaauggaaguuacagcuaaauggcuuuggggguuucuaucuaggaauaagaaaccaagaauuuguacucgugaagaauuuacgagaaaaguuagaucaaacgcagccauaggagccguauuuguagacgaaaaucaauggaacucugccaaagaggcagucgaagacgaaagauuuugggaucuggugcauagagagcgagaacuccauaaacaaggcaaaugcgcaacaugcguuuauaauaugaugggcaaacgugagaagaaauugggagaauuuggaaaagcaaaaggauccagggcaauuugguauauguggcuuggagcgcgauuucuggaauuugaggcauuagguuucaugaaugaagaucauugguuuaguagagaaaacaguuuaagcggagucgaaggcgagggauugcacaaacucggcuauaucuuaagagauauuucuaaaauuccaggugguaacauguacgcggaugauacggccggaugggauacucguauuacugaagaugaucuacaaaacgaagcucggauuacagacauuauggagccugagcaugcauugcuugcaaaguccauauuuaaauuaacauaucaaaacaaagugguucgaguucagagaccagccaaaaacgguacaguaauggaugucaucaguagaagggaucagagaggcucgggacagguaggcacguaugguuuaaacacauucacaaauauggaagcacaacucauaaggcaaauggaaagcgaaggcauauucaguccaucggagcuagaaaccccaaaccuagcugaacgugugcuugacuggcuagaaaaauacggcgucgaaagacuaaaacgcauggcaaucaguggugaugauugugugguaaagccgauagaugacagauuugcaacugcccuuacugcccuaaaugauauggggaaaguuaggaaagacauaccacaaugggagccgaguaaggguuggaaugacuggcaacagguaccauucuguagucaccacuuucaucaauuaauaaugaaggauggccgcgaaaucguaguuccuugccgcaaccaagacgaacugguuggccgugcacgaguaucucaaggagcagguuggucucuacgggaaacggcgugucuuggaaaauccuaugcccagauguggcaguuaauguacuuucacagaagagauuuaaggcuagccgcgaacgcaauauguagcgccguaccgguggauuggauaccaacgagcagaaccacuuggucaauucaugcacaucaccaauggaugacaacugaggauauguuaaguguauggaauagaguuuggauagaagagaacccauggauggaggauaaaacacacauaucaagcuggggagaugucccauaccuaggaaaaagagaagaucaauggugcggaucccuaauaggacucacggcaagagcaacaugggcuacaaauauccaaguggccauaaaccaagugcgaagauuaauuggcaaugaaaauuaucuugauuacaugacuucuaugaaaagguucaagaacgaaucggauccugaaggagcccuaugguaa

SEQ ID NO: 21508 - RNA, 9879 nt, Artificial Sequence
  derived and/or modified CDS sequence (opt6) from DENV-1__FJ024449__SS-prME
agcguaacaaugcuguuaaugcuaaugccaaccgccuuagcauuccaucucacgacaaggggcggggaaccccauaugauaguaucuaaacaagagcgagguaaaucccugcuuuuuaaaacaucagcaggagugaacaugugcacuuuaaucgcaauggaucuuggggaacugugugaagacacaaugacuuacaaaugucccagaauaacagaaacggaacccgaugacguugauuguugguguaaugcuaccgauaccuggguuacauauggcacauguagucaaacuggugaacaccgaagagacaaaaggaguguugcccuggcuccacacgucggauuagguuuggaaaccagaacugaaacuuggaugucauccgagggggcauggaaacaaauccagcguguagaaacaugggcccuuagacacccaggcuucacugugauagcauuguucuuagcacaugcuaucggaaccucuauuacacaaaaagggauuauuuucauacuuuuaaugcuagucacgccuucaauggcgaugagauguguuggaauuggcucaagagacuuugucgagggguugaguggagcgacaugggucgacguuguauuagagcauggaagcuguguaacaacaauggcuaaagacaaaccgacgcuugauaucgaauuguuaaaaacagaaguaacaaacccagcaguacuuagaaaacuuuguauugaagcaaaaauaagcaacacaacgacugauucuagguguccgacucaaggagaagcaacucuaguugaagaacaagaugccaauuucguauguagaaggacauucguugauagagggugggguaacggaugcgguuuauuugguaaaggaucacuaauaacaugugcaaaauuuaaauguguuacuaaauuagaaggaaaaauaguucaauaugaaaaccuaaaauacucagucaucgugacaguacauacuggagaucagcaucaaguagguaaugaaucaacagagcaugguacaacagcaaccauaacaccucaggcaccaaccacagaaauacaacuuaccgacuacggagcacuuacucuggacuguaguccaaggacagguuuagauuuuaaugaaaugguauuacuaacaaugaaagagaaaaguuggcugguccauaaacaaugguucuuggauuuaccgcucccuuggacuucuggagcuagcacgucucaagagaccuggaacagacaagaucuuuuaguuaccuucaaaacugcacacgccaagaaacaagaaguaguuguucugggaucucaagaaggugcaaugcacacggcucucacgggugcuacagaaauucaaacgucgggcacuacgacaauauuugcuggucacuuaaaaugccguuugaaaauggauaaacuaacauuaaaaggaaugucuuacgucaugugcacuggaaguuucaaauuagaaaaagaaguugccgagacucaacacggaacuguuuuaguacaaauaaaauaugaaggaacugaugcaccuuguaaaauaccuuuuucuacacaggaugaaaaaggcguaacacaaaauggucgacucauaacugcaaauccaauaguuacugauaaagaaaagccugucaauaucgaagcagaaccgccuuuuggggagagcuacaucauaauaggagcuggugaaaaagccuuaaaauugagcugguuuaaaaagggcucaagcauagguaaaauguuugaagcaacagcgagaggggcccggcgcauggcaauacuaggagauacggcuugggauuucgguaguauuggugggguauuuacgucugucgguaagcugguacaccaaauauuugguacggccuauggaguacuauuuuccgguguaucauggacaaugaaaauaggaauaggaguguuguuaacguggcuagggcuaaauucucgaagcaccucauuaucuaugacuuguaucgccguagguuuaguuacacuauauuuaggggucaugguacaagcagauuccggauguguuauaaauuggaaagguagggaacugaaauguggcaguggaauuuucguaacaaaugagguacauacuuggacugaacaauauaaauuucaggcggacucaccaaaacgucuuucagcugccauaggaaaagccugggaagaagguguauguggaauaaggucggcuacccgacuugaaaacauuauguggaaacaaauuuccaaugaauuaaaucauauccuccuagaaaacgauaugaaguuuacaguuguuguaggcgauguggcaggcauacucgcccaaggcaagaaaaugauaagaccgcagccuauggaauacaaauacagcuggaaguccuggggaaaagcuaaaaucauuggugcagacguacaaaacacaacuuuuauaauagacgggccaaauacuccagagugcccagaugaccagcgagcauggaacauaugggaaguugaagacuauggauucgguauuuuuacgacgaacauaugguuaaaacuucgagauagccacacacaagugugugaucauagacuuaugucagcagccaucaaagacucuaaggcaguacaugcggacaugggguacuggauugaaagcgagaaaaaugaaaccuggaaacuagcaagagccuccuuuauagaagugaaaacuugcauauggccaaagucgcacacgcuguggucaaacggaguccuagaaucagagaugaucauaccaaaaauauaugguggcccaauuagccaacacaacuauaggcccggguauuuuacacaaacugcaggaccguggcauuuagguaaacuugaguuggacuuugauuuaugugaagguacaacaguaguaguggacgaacauugugggaauaggggacccagcuugcguacgacaacuguuaccggaaaaauaauccaugaauggugcugcagaaguugcacuuuaccuccccuacgauuuagaggagaagauggauguugguauggaauggaaauccgaccaguaaaagaaaaggaagagaauuuaguaaaaucuauggucagcgcaggcucuggcgagguugacagcuucucccucggucuccuguguaucagcauaaugauugaggagguaaugagaucgcgauggaguagaaagaugcuaaugacaggcacacucgcaguauucuuuuugcugauaaugggucagcuuacguggaacgaucuaauucggcuaugcauaauggucggagcgaaugcaucugacaggaugggcauggguacuacauaucuggcacuaauggcgacguuuaaaaugcgaccaauguucgcagugggauuacuauuucgaagacuuaccuccagagaaguucuacuacugacuauaggacuaagucucguagcaucaguugaacuuccuaacagccuggaagaguugggagauggcuuagcuaugggaauaaugauacucaaauugcuuaccgauuuucaaucacaccagcugugggcgacuuuacuuucuuugacauuuauaaaaacaacguuuagucuucauuacgcuuggaaaacaauggcuaugguguuaagcauagugaguuuauuuccacuuugcuuaucaaccacgucacagaaaaccacaugguuaccgguucuucugggauccuugggauguaagccacucacaauguucuuaauagcagaaaacaaaauauggggucgaaggucuuggccacucaaugaaggaauuauggcagucggaauuguaagcauccuauugucaucauuauugaaaaaugauguaccauuagcagguccuuugaucgcugggggaaugcuaaucgcgugcuauguuauuagcggcucauccgcggacuuaagucuagaaaaagcagcugagguaaguugggaggaggaagcggaacauaguggggcgucucauaauauacugguagaaguucaagacgacggaaccaugaaaauaaaagaugaagaaagggacgacacucuaacuauucuucuaaaagcgacccuguuagcaguuaguggaguauacccucugucaauuccagccacccuuuucguaugguauuuuuggcagaaaaagaaacaaagaagcggaguguugugggacacgccuucgccgccugaaguggaaagagcagucuuagaugauggcauuuacagaauaaugcaacggggacuuuuaggaagaucccaaguaggaguuggaguauuucaagaaaauguuuuucauacuauguggcauguuaccagaggagccguucuuauguaucagggaaaaagacuagaacccuccugggccucugucaagaaagauuuaauaagcuauggaggcggauggcggcugcaaggaucauggaauacaggggaagaaguacaaguuaucgcgguugagcccgggaaaaauccuaaaaacguucagacugcgccaggcaccuucaagacuccggaaggugaaguuggggcaauagcacuagauuuuaaacccggaacaucgggcucuccgauagugaacagagaggguaagaucguaggacucuaugguaacgguguaguaaccacaaguggaacuuacguaucggcaauagcacaagccaaggcuucccaagaaggaccauuaccggaaauugaagacgaaguguuucgaaaaaggaacuugacuaucauggauuuacacccagguucuggaaaaacgcgacguuaccugccugccauaguuagggaggcgauaaaaagaaagcucagaacacuaauauuggccccuaccaggguugucgcaucagaaauggcugaagcauuaaaggguaugccuauuagauaccaaaccacagcagugaagucagaacauacgggaaaagagauaguagaccucaugugccaugcaacauucacaaugagacuccugagcccagugcgaguaccaaauuauaauaugauaauaauggacgaagcucacuuuacagacccaucuagcaucgcagcuagaggguacauaucuacuagaguggggaugggugaagcagcagcaauuuuuaugaccgcaacaccaccagggucaguagaagcauuuccacaaucuaaugccgucauucaggacgaagaacgggauaucccagaacgcucguggaauaguggauaugaauggaucaccgacuuuccggguaaaaccguaugguucguuccuaguauaaagucugguaaugauaucgcuaauugucuccgcaaaaauggaaaaagaguuauucaacuaucacgcaaaacuuuugauacagaauaucagaaaaccaaaaacaaugauugggacuacguagucaccacagacauaucugagaugggugcuaauuuucgggcggaccgagucauagaucccaggcguugucuaaagccagucauacugaaagacggaccagaacgaguuaucuuagcaggaccgaugccugucacaguagcaagcgcagcacaaagaaggggaagaauaggucgaaaccauaacaaagaaggugaucaauauaucuauaugggccaaccauuaaauaacgacgaagaucaugcacauuggacugaagcaaaaaugcuccuagauaacauaaauacuccagaaggaauaaucccugccuuauucgaaccggaacgcgaaaaaucagcugccaucgauggcgaauaccgucuacgaggggaggcucggaaaaccuuugucgaguuaaugcguagaggcgauuuacccguaugguuaagcuacaaaguagcgucugaagguuuucaguacagcgauaggagauggugcuucgacggagaaagaaauaaccagguacuagaagaaaacauggaugucgaaauauggacaaaggagggagagaggaagaaacuccgcccacgauggcuugacgcuaggacguauagugacccauuagcauugcgcgaauuuaaagaguuugccgcugggagaaggagcguuucaggcgauuuaauauuggaaauugguaaacuuccacagcauuugacacaacgagcacagaacgcauuagacaaccuaguuaugcuucauaacucagaacagggaggacgugcauaucgucacgcuauggaggaacuaccagacacaauugagacccuaaugcuacuugcucuuauagcgguacuaacaggugggguaacauuguucuuuuuaucuggaaggggccucggcaaaaccaguaucggcuuacuauguguaauggccaguaguguacugcuuuggauggcaaguguagaaccacacuggauagccgcaaguauaauucuggaauuuuuccuaaugguguuacucaucccagaaccagaucgacaacguacgccgcaagacaaccaacuggcuuacgucgucauuggucuuuuauuuaugauccucacaguugcugcuaaugagaugggauuacucgaaacuacaaagaaagauuuagggauaggacacguagcaguagaaaaccaucaucacgcagcuauguuagauguggaucugcacccugcuagugcuuggacccuguaugcagucgcuacgacaaucauaacuccgaugaugaggcauacgaucgagaacacgacagcaaauaucagccuaacagcaauugcaaaccaggcagcaauucugauggggcucgacaaggguuggccaauuaguaagauggauauaggaguaccgcugcuggcacuaggauguuacagccaaguaaauccucuaacucugacagcugcaguacugaugcuaguggcacacuacgcuauuauaggacccgguuugcaagcuaaggcaacaagggaagcucagaaaagaacugcagcuggcauuaugaaaaauccuaccguagauggaauaguagccauugaccuagauccgguaguauaugacgcgaaguucgaaaagcaauuaggccaaauuaugcugcuuauuuuaugcacuucgcaaauucuacuuaugcgaacaacuugggcauuaugugaaagcauaacacuugcuacuggaccauuaacuacacuaugggaagguagcccaggaaaguuuuggaacacgacgauagcgguuagcauggccaacauauuucgaggaucauaucuagcuggggccgguuuggcauucaguuuaaugaaauccuuaggaggugggaggagggggacuggagcacaaggugaaacucugggugaaaaauggaaaagacaauuaaaucaacuaucaaaauccgaauuuaauacauauaaacguucagguauaauggaaguagaccgaucggaagcuaaagaaggacuuaaaaggggcgaaacgacaaagcaugcuguaucucgcggcaccgcgaaacuucgcugguucguugaaagaaaucucgucaaaccggaaggaaaggucauugauuugggaugugggcguggaggauggagcuacuacugugcuggacucaagaaaguaacggagguaaaaggauauacgaaaggcgggccgggccacgaagaaccaauaccaauggcgacuuacggauggaauuuagugaagcugcauucgggcaaagacguauucuuuauacccccagagaaaugugacacauuguuaugugacauaggggagucgaguccgaauccaacuauagaggaaggaagaacgcuccgcgugcugaaaaugguggagccauggcuacgagggaaucaauuuuguauaaaaaucuugaacccauauaugccuaguguaguugaaacauuagaacaaaugcaaaggaagcauggaggcaugcuaguacguaacccguuaaguagaaauaguacucaugaaauguauuggguaaguuguggaacuggaaauaucguaucagcagucaauaugacguccagaaugcuauuaaacagauuuacaauggcucaucguaaaccaacuuaugaaagggauguggacuugggugcggggacacgucacguagcaguagaaccagaaguggcaaaccucgacauuauaggucaacguauugaaaauauaaagcaugaacauaagagcacuuggcauuaugacgaggacaacccguauaaaacaugggccuaucauggaucauaugaugugaaaccaagugguucagcaucuagcaugguuaacgguguaguaaaauugcugacaaaaccaugggauguuauaccuaugguuacgcaaauugcaaugacagauacuacuccauuuggacaacagcguguguuuaaagaaaaaguggacacaagaacaccaaaagcaaaaaggggaacagcccagauuauggaaguaacugcuaaauggcuauggggauuuuuaagcagaaacaagaaaccccgaauuuguacgagagaagaauuuacgaggaaagugagaucuaacgcagcgauuggggcaguauucgucgaugagaaucaguggaacagugcgaaagaagcagucgaagacgagagauuuugggaccuaguacauagagaaagggaauuacauaagcaagguaaaugugcuacaugcguuuauaacaugaugggaaaacgugagaagaaacuuggugaguuugguaaagcaaaaggaucaagagccauuugguauauguggcugggugcgagauuucuugaauuugaagcacuuggauuuaugaaugaggaccacugguuuagucgugagaauagucuaucugguguagaaggagaaggacuacauaagcugggguauauccucagggacauaucuaaaauaccaggaggaaacauguaugcagaugauacagcuggaugggacacaagaaucaccgaagaugaccuccagaaugaagcuaggauaacugacauaauggaaccagaacacgcacuucuggcgaaaucuauauucaaacuaacauaucaaaauaaagucguuagaguacaaagaccggcgaagaacggaacaguaauggacguaauuucccgacgcgaucagagagguagcgggcaggucggaacguacggauuaaauaccuucacuaacauggaggcccaauugaucagacaaauggaaucagaaggaaucuucucuccaucagaacuggagacaccgaaccuagcggaaagaguuuuggauuggcuaaagaaauauggagucgaaagacucaaaaggauggccauuucgggagacgauugugugguuaaaccaaucgaugacagguucgcuaccgcucuaacugcauuaaacgauaugggaaaagucagaaaggauauaccgcaaugggaacccagcaagggcuggaacgacuggcagcagguuccguuuugcucccaucacuuucaucaacuaauaaugaaagacggucgugaaauuguuguaccuugcagaaaccaagacgagcugguuggucgggcaagagugucacagggagccggauggucauuacgagaaacugcuugccucggaaaguccuacgcucaaauguggcaauugauguacuuucacagaagggaccuacgacuugcugcaaacgcuauuuguagugccguaccuguagauuggauacccaccagucgcacaacguggucaauccaugcacaccaucaauggaugacgacugaagauaugcuaucgguguggaauagaguauggauagaagaaaauccauggauggaagauaagacucauauuaguaguuggggagauguaccuuaucugggaaaaagagaggaucaauggugcggcagucucauugggcuaacagcccgugcuacaugggcaacuaacauccaaguggcuauuaaucaaguacgaagacugauugguaaugagaacuauuuagauuacaugacaucaaugaaacgguucaagaaugaaggugauccagaaggugcucuuugguaa

SEQ ID NO: 21509 - RNA, 9879 nt, Artificial Sequence
  derived and/or modified CDS sequence (opt6) from DENV-1__FJ390383__SS-prME
ucaguuaccauguuguuaaugcucaugccuacggcacuagcauuucaucuaacuacaagggguggggaaccacauaugauagugucaaaacaagaacggggaaaaucucuauuauuuaaaacuucagcuggugugaacaugugcacguuaauagcaauggaucuuggagaauuaugugaggauaccaugaccuauaaaugccccaggauuacagaaacagagccugaugacgucgacugcugguguaacgcaacagauacgugggugacauauggcacauguucccaaacuggagaacaucgacgagacaaaaggucaguugcucuagcaccgcauguuggauuagggcuggagacucguaccgaaacauggaugaguucagaaggagcguggaaacaaauccaaaggguggagacgugggcacuccgacauccuggauuuacuguaauagcacuauuccuggcucacgcaauaggaacuucaauuacccaaaaagguaucauuuucaucuuacugaugcuaguaacaccgaguauggcaaugagauguguuggaauuggaucucgugauuucguugagggacuaucaggagcgacguggguugauguuguauuggaacacggcucguguguaaccacaauggccaaagacaaaccuacauuagacauagaacuuuuaaaaaccgaagucacaaauccggcaguccugcguaaacuaugcauagaggcuaaaauuagcaacacaacuacagauagcagauguccaacacaaggcgaggcgacccugguagaagaacaagaugccaacuuuguuugucgaagaacauuugucgaucgcgguuggggaaaugguuguggccuauucggaaaaggcagcuuaauaacuugugcgaaauuuaaaugcguuacgaaacuggagggaaagauuguacaguaugaaaaucuaaaauacuccguaaucguaaccguacauacaggagaccaacaucaaguaggcaaugaaucgacggagcaugguacgacugccacuauuacuccccaggccccaacaacagaaauacaacuuacagauuauggggcccucacauuagauuguaguccuagaacaggacucgauuucaacgagaugguacuacuaaccaugaaagagaaaucauggcuaguucauaaacagugguucuuagacuuaccacuccccuggacgagcggagcaaguacuucacaagaaacauggaacaggcaggaucuuuuaguuacguucaaaaccgcacaugccaagaaacaagaaguuguaguccuggggucgcaagagggcgcuaugcauaccgcuuuaacuggagcaacagagauucaaacuucuggaacgacuaccaucuuugcuggucauuuaaaaugcagacuaaaaauggacaaacuaacgcuuaaaggaaugaguuacguuaugugcacagguuccuuuaaauuagaaaaagaagucgcugaaacgcaacauggaacaguuuuaguacaaauaaaauaugaaggaacugaugcaccaugcaagauaccauuucuuacgcaagacgaaaaaggaguaacucagaacggcagguugauaaccgcaaauccaaucguuacggauaaagaaaaaccggugaauauagaagccgagccgcccuuuggcgaaucauauaucauaauaggcgcaggagaaaaggcguuaaaguuaaguugguuuaagaaagguaguuccauaggcaaaauguucgaagcaacagccagaggggcuagaagaauggcgauacuuggugauacggcuugggacuuuggaucuauagguggagucuucacaaguguaggaaaguugguccaccagauauuuggaacagcauacgguguauuguuuucgggcguuaguuggacaaugaaaauagguauugguguacucuuaaccuggcugggucuaaacagucguucaacaucacugucuaugacguguauugccguaggucuaguaacauuguaucucggagugaugguucaagccgacuccggguguguuauaaauuggaaaggucgagaacuuaaaugugguucgggaaucuuuguaacaaacgaaguacacaccuggacagagcaguauaaauuccaagcagauucuccgaagcguuuaucugccgcuaucggaaaagcgugggaagagggcguuugugguaucagaucugcaacacgacuugagaauauuauguggaagcagaucagcaaugaacuaaaucacauacuauuagaaaacgacaugaaauuuacaguuguaguuggugauguagcugguauauuggcucagggcaagaaaaugaucagaccgcaaccuauggaguacaaguauaguuggaaauccugggguaaagcaaaaauuauuggugcugauguacaaaauacgacuuucauaaucgauggaccaaauacuccagaauguccagaugaucaacgcgcauggaacauaugggaaguagaagauuauggauuuggcauauucaccaccaacauuugguuaaaacugagagauagcuauacacaagugugcgaccauagacuuaugucagcugcuauuaaagacucuaaagcuguacaugccgauauggguuauuggauugaaagugagaagaaugaaacuuggaaauuagcgcgcgccagcuuuaucgaagugaagacuugcaucuggccaaaaucccauacguuauggucuaauggagucuuggaaucagagaugauuauuccuaaaauauauggcggucccauuucacaacauaauuauagaccaggauauuuuacucaaacagcaggcccuuggcaccuagguaaauuagaacuagacuucgaccuaugcgagggaaccacaguagucgucgacgaacauugcggaaauagagguccuagccuucgaacgaccaccgucacuggaaaaaucauucaugaguggugcugcagaucuuguacauugccgccuuuacgauucagaggggaggauggauguugguacgggauggaaauaagaccaguaaaagaaaaggaagaaaaucugguaaaaucuaugguaucagcuggcucgggagaaguagacucguuuagccuugggcuauugugcauuucuauuauaaucgaggaaguaaugaggagucgauggagucgcaagaugcuaaugacuggcacuuuggcuguauucuuuuuauuaauaaugggucagcuuacuuggaaugacuuaauucgacuauguauuauggucggagcgaaugcuagugaccguaugggaaugggcaccacauaucuagcgcuaauggcgacauuuaaaaugcguccaauguuugcuguggguuuauuauuuaggagauuaacaagucgggagguuuuguugcuuacuaucggauuaaguuuagucgcuaguguagagcuuccgaacagccuugaggagcucggugaugggcuugcaauggguauaaugauacuaaaauuacugacugauuuccaaucacaccaauugugggcgacacugcuuaguuuaacuuuuauaaaaacuacauucaguuugcauuaugcuuggaaaacaauggcuauggucuuaaguauuguaaguuuauuuccuuugugcuuaucaaccacaagucagaaaaccacauggcuccccguuuugcuuggaucccuaggaugcaagcccuuaacaauguuuuugauagcagaaaauaaaauauggggucgaagaucauggccucuaaaugaagggauuauggccguaggaaucgucucaauuuuauuaucaucccuauugaagaaugaugagccauuagcagggccuuuaaucgcaggcgguauguuaaucgcgugcuaugugaucagcgguagcagcgcagaucuaucuuuggaaaaggccgcagaaguaucaugggaagaggaagcagaacacucaggagcgucacacaauauccuaguagaaguccaagacgaugguacuaugaaaauuaaagaugaggaacgcgacgauacgcuuacgauuuuauuaaaagcaacccuacuagccguuuccggcguuuacccgcuaucaauuccagcuacucuauucguaugguauuuuuggcagaaaaagaaacagagaagcgguguacuuugggauacuccaucaccaccagaaguagaaagagcaguuuuagacgaugguauauaucgaauuaugcaaagaggacuucucgggagaagccaaguaggaguuggaguauuccaagaaaauguauuccauacaauguggcacgucaccagaggagccguuuugauguaucaagguaaacgacuggagccuaguugggcuaguguaaagaaagaucuaaucaguuacgggggaggcuggcguuuacaagggucuuggaacacuggagaggaggugcaagugauugcaguugagccaggcaaaaauccuaaaaauguacaaacugcuccaggaacauucaaaacaccugagggugaaguaggagcaauugcccucgauuucaaaccuggaacauccggcucuccaaucgucaaucgcgaaggaaaaaucguagguuuguaugguaauggaguugugacgacauccgguacuuacguaucagccauugcucaagcuaaagcaagucaagaggggccauugccagaaauagaagaugagguauuccgcaaaaggaaucucacaauuauggaucuccauccaggcagcggaaaaacgagacgauauuuaccugcaauaguaagagaagcaauaaaaagaaagcuacgaacacuuauucuugcuccgacuagaguaguagcuagcgagauggcagaggcuuugaaaggaaugccuaucagauaucagacaacugccgucaaguccgaacacacaggaaaagaaauaguagaccuuaugugucacgcuacuuucacuaugcguuuauuaucuccaguaagaguucccaacuacaauaugauuauaauggacgaagcucacuuuacagacccaaguucgauagcggcaagaggauauauuaguacgagaguggguaugggagaagcugcggcuauauuuaugacggcaacuccuccagggucaguggaggcauucccacaaaguaaugccguaauacaagacgaagaacgagauauaccggagaggucuuggaacagcggauacgaguggauaacagauuuuccaggaaagacagucugguucgugccaucgaucaaaaguggcaaugacauagcaaacuguuugaggaaaaacggaaaaaggguuauucaacugucucgaaaaacuuuugauacagaauaucaaaagaccaaaaauaacgacugggauuaugugguaaccaccgacauaucugaaaugggagcaaauuuucgagcugaucgagugauagacccucgcagaugcuuaaaaccaguuaucuuaaaagauggcccagaaaggguaauauuggcaggaccgaugccaguuacuguagcgucugcagcccaacggagggggagaaucggaaggaaccauaacaaagagggagaccaguacauuuauaugggucaacccuuaaauaacgaugaagaucacgcacacuggacagaggcaaaaaugcuguuagauaauauuaacacgccggagggaaucauaccugcguuauuugagccagaacgugaaaaaucugcugcaauugauggugaauacagauugagaggagaagcuagaaaaacauuuguugaacugaugaggagaggggauuuaccaguuugguugucguauaaaguagcauccgagggauuucaguauucggacagaagaugguguuuugauggagaaaggaauaaccagguacuagaagagaacauggacgucgaaauauggacaaaggagggagaacgaaagaaacugcgaccucguugguuagacgcacguacuuacucugacccguuagcucuuagagaauuuaaagaauuugcagcgggacgccguuccguuaguggagauuuaauucuugaaaucggaaaauugccacaacacuuaacgcaacgcgcccagaaugcuuuagauaauuuaguaaugcuacauaacucagaacaaggagggagggcuuauagacaugcaauggaagaauuaccugacacgauugaaaccuuaauguuacuagccuuaauagcgguuuuaacaggaggaguaacuuuguucuuuuuaaguggacguggauuaggaaagacaaguaucggucugcucuguguaauggcaaguaguguucuguuauggauggccagcguugagccucacuggauugcggcgucaauaauacuugaguucuuccugaugguuuuacuuauuccugaaccagacaggcaacgaaccccacaagacaaucaacuugcauauguaguaauaggccuacuauucaugauauuaaccgucgcagcuaacgaaaugggguuauuagaaaccacaaagaaagaucuaggcauuggccauguugcgguggaaaaucaucaucacgcagcuauguuggauguagauuuacacccagcaagcgcguggacuuuauacgcaguggcgacaaccauuauuacuccaaugaugagacacacgauagagaauacaacagcuaacauaaguuuaacagccauagcuaaucaggccgcuauauugauggggcuagauaaaggcuggccaaucucaaaaauggacaucggugucccuuuacuagcguuaggauguuauucucaggugaauccauuaacucuuacagcagcugugcuaaugcucguagcgcauuacgcuauaauugguccgggauuacaagcuaaagcgaccagagaagcucaaaaacgcaccgcagcagggaucaugaaaaauccgacugucgauggaauaguggcaauagacuuagacccaguaguguacgaugcaaaauuugaaaaacagcuagggcagauuauguuauuaaucuuaugcacgagucaaauauuguuaaugagaacuacuugggcgcuaugugaaucuauaacacuagccacaggcccguuaaccacuuugugggaagggucaccgggaaaauuuuggaauacgacaauagcuguuucaauggccaauauauuucggggaagcuacuuagccggggcaggacucgcauuuagccuaaugaaaucauuaggcgguggucguagaggaacaggcgcucagggugagacauuaggugaaaaguggaaaagacaauuaaaucaauuaucaaaaucagaguucaauacguauaaacgcagugggauuauggaaguggaccgaucugaagcaaaagaaggguugaagagaggugaaacuacaaaacaugcuguuagcaggggcacugcgaaauuacgaugguuugucgaaagaaaucuagucaaaccagaagguaaagucaucgacuuggguugcggcagaggaggauggaguuauuacugugcaggacugaagaaagucacggaaguuaaagguuauacaaaagggggcccgggacaugaagaaccaauuccaauggcuaccuacggauggaauuuagugaaacuucauuccgggaaagaugucuucuuuauacccccagaaaaaugcgacaccuuauuaugugauauaggugaauccagcccaaacccaacgauagaagaaggacgaacgcuacguguucuuaaaaugguggaaccgugguuaagaggcaaucaauuuugcauaaaaauauugaacccauauaugccaucuguaguggaaacgcuugagcaaaugcaaagaaagcauggaggaaugcuuguacgcaacccauuaucacguaacucgacucaugagauguauuggguaucguguggaaccggaaauaucguaucggcugucaacaugaccaguagaauguuacuuaauagauuuaccauggcacauagaaaaccgacuuaugaaagggacgucgacuuaggagcuggaacgagacauguagcaguagaaccugaaguagcgaacuuagacauaauaggacaacgaaucgaaaacauuaaacacgaacauaaauccacauggcauuaugaugaggacaauccguauaagacaugggcauaucacgggaguuacgaaguaaaaccuagcggcuccgcuucaucuauggugaacggaguaguuaaauuguuaacuaaacccugggacgucaucccaaugguaacccaaauagcgaugacagauaccacgcccuucggacaacaaagaguuuucaaagaaaaaguggauacucgaaccccaaaggccaaacguggcacagcucaaaucauggaaguaacagcaaaguggcuauggggauuuuugucccgcaauaagaaaccaagaaucuguacccgugaggaauuuacaagaaaaguacgcucuaaugccgcuauaggagcuguuuucguugaugaaaaucaauggaauagcgcaaaggaggcugucgaagaugaaagauucugggaucuuguucauagagagcgggaacuacauaagcaggguaagugugcaacuuguguauacaauaugauggguaaaagagagaagaaauugggagaguucggcaaagcaaaagggagcagagcaauaugguacaugugguuaggugcaagauuccuugaguucgaagcauuaggcuuuaugaacgaagaucacugguucaguagagaaaauucucugaguggaguggaaggugaaggucuucacaaauugggauauauccuaagagauauaaguaagauucccgggggaaacauguacgccgaugacaccgcgggaugggauacucgaauuacagaagacgauuugcagaacgaggcaagaauaaccgauauuauggaaccggagcacgccuuacuugcaaaaagcauauuuaaacuaacuuaucagaacaaaguaguuagggugcaaagaccagccaagaacgggacgguaauggacgugauaucacgacgagaccaaagaggaucaggacagguaggaacauacggauuaaauacuuuuacgaauauggaagcccaauuaauacgucaaauggaaucagaagggaucuucucgccuagugaauuagaaauaccaaacuuagcugaaagagugcuagauuggcucgaaaaauauggggucgagcgcuuaaaacguauggcaauuucgggggaugauugcguagucaaaccuauagaugauagauucgcaacugcucuaacggcucuaaaugauauggguaagguuagaaaagacauuccgcagugggaaccgagcaaaggauggaaugauuggcaacaagugccguucugcucacaccauuuucaccaauugaucaugaaagacgggagggagauugugguaccaugccgcaaucaagaugaauugguaggacgcgcuagagucucucaaggugcuggcuggagcuugcgggaaacggcaugucucggcaaguccuaugcucaaauguggcagcucauguauuuucauagacgagaucugcgacuagcggcgaacgccaucuguagugcgguuccaguagauuggauaccaacaucccgaaccacauggagcauacaugcccaucaucaauggaugacuacagaagacauguugucugucuggaacaggguauggauagaggagaacccuuggauggaagauaaaacgcauauuucaucauggggcgacguuccauaucuuggaaagcgggaagaccaaugguguggaaguuugauuggauuaacggcucgggccacgugggcaaccaacauacaggucgcaauaaaucaagugaggcgauuaauugguaacgaaaacuaucucgauuauaugacuucuaugaaaagguucaaaaaugaaggugacccugaaggagcauuaugguaa

SEQ ID NO: 21510 - RNA, 9879 nt, Artificial Sequence
  derived and/or modified CDS sequence (opt6) from DENV-1__FJ182033__SS-prME
aguguaaccaugcuauuaauguugaugccaaccgccuuggcuuuccacuuaacgacuagagggggugaaccccauaugauaguaagcaaacaagaacgagguaaaucauuacuuuuuaaaacuagcgcagggguaaauaugugcaccuuaauagcuauggauuuaggagaacugugugaggauacaaugacuuauaaauguccaaggauaacugaaguugaaccagaugauguagauuguugguguaacacuacggauaccuggguuacguauggcacauguucucaaacaggggaacaccgccgagacaaacguaguguagcauuagcuccccauguaggguugggauuggaaacucgagcagaaacuuggauguccucagaaggggccuggaaacaaauucaaaaaguggaaacaugggcauuacgacaccccggcuucacaguaauagcacuauucuuagcgcacgcgauugggacgaguaucacacaaaaaggcauaauuuucauauuguuaaugcuagugaccccaucgauggcuaugagguguguagggauuggcagccgagauuuuguggaggggcucucgggugcuaccuggguagauguggucuuggagcacgguaguuguguuacaacuauggcgaaagacaaaccuacucuugauaucgaauuacuaaaaacagaaguaacaaauccugcagugcuacguaaacuaugcauugaagccaaaauauccaauacaacaaccgacagcagaugcccuacucaaggagaggccacauuaguggaggagcaagaugcuaacuuuguaugccgaaggacuuucguagaucgaggaugggggaacggauguggucuuuucggaaaagggagucugauaacgugugccaaauuuaaauguguaacgaaacuagaagggaaaauaguccaauacgaaaacuuaaaauacucuguaauaguuacagugcauacaggcgaucaacaucaaguugggaaugagucaacggaacaugggacaaccgcaacaaucacaccgcaagcuccaacaagcgaaauucaacugaccgacuacggagcacuaacguuagauugcucgccaaggacgggcuuagauuucaaugaaaugguucugcuaacaaugaaagagaaaaguugguuaguccacaaacagugguuuuuagaccugccuuuaccauggacaagcggugcaagcacaucacaagaaaccuggaauaggcaagaccuauugguaacguucaaaacugcucaugccaagaaacaagaaguugucguauuaggcucgcaagaaggugccaugcauacagcacuuacgggggcuaccgagauacaaacaagugggacaaccacaauauuugcuggucaccugaaaugcagacugaaaauggacaagcuaacucuaaagggaaugucauaugucauguguacaggcuccuuuaaacuagaaaaagaaguagcagaaacacagcauggaacuguucuaguccagaucaaauaugaggguacagacgcuccaugcaagauuccauuuucgacgcaagaugagaaaggaguuacucaaaacggaagauuaauaacggcuaaucccauuguaacugauaaagaaaaaccuguaaacauugaggcugaaccacccuuuggagaaucauauauuguaauaggugcaggcgaaaaggcuuugaaauuauccugguuuaagaaagguaguucaaucgguaaaauguuugaagcuacggcaaggggcgcacgucgcauggcgauucuaggugauaccgcaugggacuuugguucgaucggagggguauuuacaaguauaggaaaauugguccaucaaauuuuugguacagcuuaugguguuuuguuuagcgguguuagcuggacgaugaaaauuggaauagguguacuccuaacaugguuagggcuaaacagccggagcacaagucugaguaugacuugcauagccgugggauuagucacacuguaccuuggagugaugguacaggccgacagcggguguguaauuaauuggaaaggcagagaguugaaauguggaucagggaucuuuguaacaaaugaagugcacacauggacagagcaauauaaauuccaagcugauuccccaaaaaggcugucggcugcaauaggaaaagcaugggaagaaggcguuuguggcauucguucagcgacgcguuuagaaaacauaauguggagacaaauuagcaacgaacucaaucauauauuacuagagaaugauaugaaauuuaccgucguuguuggagauguagugggaauacuagcucaagguaagaagaugauucgaccgcaaccuauggagcauaaauauucguggaagucaugggguaaggcgaaaauuauaggagcggauguucagaauacaacuuuuauaauagaugguccaaauacaccagaauguccagaugaccaaagagcguggaauauaugggaaguggaggauuauggcuuuggaauauucaccacgaauaucuggcuuaaauuacgugauaguuacacacaaguaugugaccacagauugauguccgcagcaauaaaggacaguaaggccguacaugcugacauggguuacuggauagaaagugaaaagaacgaaacauggaaauuagcgcgcgcuucguuuauagaaguuaaaacuuguauuuggccaaagagccauacacuauggucaaaugggguuuuagaaucagaaaugauuauuccgaaaauauacgguggaccaauuucacaacauaacuaccgcccagguuauuuuacacaaacugcagggccauggcauuuaggaaaauuagaauuagacuuugauuuaugcgaagggacaacugucgucguagacgagcauuguggaaaccgaggaccaucauugcggacuacuacaguaacaggcaaaauaauacaugaauggugcugucgcaguuguaccuuaccaccauuaagguuuaaaggugaggauggcuguugguauggaauggaaauuagaccaguuaaagagaaggaggaaaaucuggugaagucuauggucucugcuggaucaggugaaguugauucguuuucauuggguuuguuauguauaucaauaaugauagaagaagugaugagaucuagauggagccguaagaugcuuaugacuggaacuuuggccguauuuuuccuacuuauaaugggucaguuaaccuggaaugauuugauacggucauguauuauggucggcgcaaacgcaagugacagaauggguauggggacgaccuauuuagcuuugauggcaacuuucaaaaugaggcccauguucgcagucggucuacuauucaggcgucuaacaagucgagaaguuuuauuacuaacaaucggacuaucacucguagcguccguggaacuaccuaauucacuagaggaauuaggcgacggucuagcgauggguauaaugauauuaaaacuauuaacggauuuucagagcuaucaauuaugggcaacccuauuaucguuaacauuuauaaaaacaacauucagcuuacauuacgcguggaagacgauggcaaugguauuaucgauaguaucgcuucuaccgcugugccucucaacgacaagucagaaaacgacauggcuaccugucuuacuuggaaguuuaggguguaagccauuaacuauguuucuuauagccgaaaauaaaaucuggggaagaaaaucauggccuuugaacgaaggcaucauggcagucggaauagucaguaucuuauugucuaguuuguugaaaaacgacgugccucuagcuggaccuuugauagccggugggaugcugauagcaugcuauguuauaaguggcaguagugcggaucugucacuugaaaaagcugccgagguuucuugggaagaagaagcagaacauaguggcgcaucgcauaauaucuuaguggagguucaagacgaugguacgaugaagauuaaggaugaggagagagaugauacacuuacaauauuguuaaaagcaacgcuauuagcugucucaggugucuauccacugucaauaccugcgacccucuucgugugguacuuuuggcagaagaagaaacaaagauccgguguccuaugggauaccccaagcccaccggagguugaaagagcgguacuugacgacggaauauaucgaauaaugcagaggggcuugcuaggccgaagucaagucgggguaggcguauuccaagagaauguauuccauacuauguggcacgugacgcguggagcaguacuaauguaccaagguaaacguuuagagcccucuugggcauccgucaagaaggauuuaaucaguuacggugggggauggcgucuacaaggcucguggaacaccggagaagaaguacagguaauagcuguugaaccaggcaagaacccuaagaauguacaaacugcuccugguaccuuuaaaaccccagaaggugaaguuggugccauagcauuggauuuuaaaccggguacaucgggaagcccaaucguaaauagagaggguaaaauaguaggacucuauggaaauggagucgucacgacuucugguacguauguuagcgccauugcacaagcuaaagcgucacaagaagguccauuacccgaaauagaagaugaaguauuucgaaagaggaaccugaccauaauggacuugcacccaggaagcggaaaaacgagaagauaucuaccagccauaguacgagaagcaauaaaaagaaaauuacgcacgcuaauucucgcaccuacucgaguaguagccagcgaaauggcugaagcucucaaagguaugccuauuagauaccagacaacagcaguuaaaucagaacauacagguagggaaaucguagaccucaugugccaugcaacuuuuacgaugaggcuacuuaguccuguaaggguacccaauuauaacaugauuauaauggacgaagcccauuuuacggauccuagcucgauagcagcucgcggguacauuucuacgcgcgugggcaugggcgaagcagcggcaauuuuuaugaccgcuacucccccaggaucugucgaagcauucccucaaagcaaugcgguaauucaagaugaggaacgagacaucccggaacguucguggaauagcggauaugaauggauaacagauuucccaggcaagacugucugguucgugccgucgauaaaaucaggaaaugauauagcaaauugccuaaggaaaaaugguaaaagaguuauccaauugucgagaaagacuuuugauacagaauaucagaaaacuaaaaauaaugauugggauuacgugguuacaacugacauaagugagaugggagcaaauuuucgcgcagacagaguaauagacccaagaaggugucuaaaaccuguaaucuuaaaggaugggccugaaagaguaauacucgcagggccgaugccuguaacaguugcaagugcagcccaacguagaggaagaauaggaagaaaccacaacaaagaaggagaccaauacauauacaugggccaaccacugaacaacgaugaagaucacgcucauuggacugaagcgaaaauguuauuagauaauauuaacacacccgagggaaucaucccagcacuguuugaaccugaacgggaaaaaucugcugcuauugauggagaauaucgacuuagaggggaagcuaggaagaccuuugucgagcuaaugagaagaggugaucugccuguuugguuaaguuacaaagucgcauccgaaggauuccaauauagcgauagacgauggugcuucgacggagaaagaaacaaccagguacuagaagaaaauauggauguugaaaucuggaccaaagagggugagaggaagaaacugaggccaagauggcuagaugcccgcacguauucggacccucuagcacuacgagaauuuaaggaauuugcagcaggaagacggagugucucaggcgaccuuauucuggagauuggaaaacugccacagcauuuaacucaaagagcacaaaaugcccuggauaaucuaguaauguuacacaauagugaacaaggaggcagagcguauaggcacgcaauggaggaauuaccugauacaauagaaaccuugauguuguuagcccuuauagcaguguuaacgggugggguaacacuuuucuuucuaagcgguagaggucuagguaaaacaucaauuggguugcuuugcguaauggcuucaagcgcccugcuauggauggccucuguagaaccacauuggauagcagcaaguauaaucuuagaguucuuccuaaugguccuuuuaaucccagagccagacaggcaacgaacaccccaggacaaucaacuugcauauguggugauagguuuguuauuuaugaucuuaacugucgcugcaaacgaaaugggacuucuagaaacuacuaagaaagauuuagguauagggcauguggcagucgaaaaccaucaucacgcaacaauguuagacgucgacuugcauccagcaucugcguggacauuauaugcaguugcgacaacaauaauuacaccuaugaugcgacauacaauugaaaauacaacagccaauauuagccuaacagcgauagcaaaucaggcagcgauccucaugggucuugacaaaggguggcccauaaguaaaauggacauuggugucccacuauuggcacuaggcugcuacagucaaguuaacccacugacuuuaacagcagcgguucugaugcucguagcgcauuaugcaauuauaggucccggucuacaagcaaaagcuacucgagaagcacaaaagagaacagcggcaggaauuaugaaaaauccuacaguugaugguauuguugcaauugacuuggauccgguaguguaugaugcuaaauucgaaaagcaauuaggacaaauuaugcuauuaauuuuaugcacaagccagauacuauuaaugcgaacgaccugggcuuuaugcgagaguauaacgcuggcuacaggcccucuaaccacucucugggaaggcuccccggggaaauucuggaauacuaccauugcaguaaguauggcaaauaucuuccgaggaaguuauuuggcuggagcgggauuggcauucaguuuaaugaaaaguuugggaggagguagacgaggaaccggagcccagggagagacccucggcgaaaaauggaaacgucaguuaaaccaauuaaguaaauccgaguucaauacuuauaaacgaucaggaauaauggaaguagaucggagugaagcaaaagaaggcuuacgucgcggagaaacaacaaaacacgcuguuucgaggggaacagccaaacuuaggugguuuguagaacgaaauuuaguaaagccugaagguaaaguuauugaccuugguugcggaagagguggcuggucguacuauugcgcaggccucaagaaaguaacggaagucaaaggguacacaaaaggagguuuaggucaugaagaaccaauuccaauggcuacauacggauggaaucuagucaaacuucacagugguaaggacgucuucuuuauuccuccagaaaaaugcgauaccuuauuaugugauauaggagaaucaucuccaaaccccacuauagaagaagguaggacgcuuagaguacuaaagaugguagaaccaugguugcgugguaaccaauucuguaucaaaauacucaauccauauaugccuucaguaguagaaacguuagaacaaaugcaaaggaaacaugggggaaugcugguucguaaucccuuaagccgcaauuccacacacgaaauguauuggguaaguuguggaacagguaacauuguaagugcaguaaacaugacuuccagaauguuacugaauagguuuacuauggcucaccguaaaccuacauaugaaagagauguggaucuaggugcagguacgaggcaugucgccguugagcccgaaguugccaaucuagauauaaucggacaaagaaucgaaaauauuaaacaugagcauaaaagcaccuggcauuaugaugaggacaauccauacaaaacuugggcguaucaugggaguuacgaagucaaaccaagugguuccgcauccagcaugguaaauggggucguuaaacuacuuacaaagccuugggauguuauuccaaugguuacucagauagcaaugacugauacgacaccuuucggacaacaacgaguauuuaaagaaaaaguugacaccaggacgccuaaggcaaaaagagggacagcucaaauaauggaaguaaccgcaagguggcucuggggauucuuaucgcggaacaagaaacccaggaucugcaccagggaagaguucacacgaaaagugagaucuaaugcagcuaucggagcgguauuugucgaugaaaaccaauggaauagcgcgaaagaggcugucgaagaugagagauuuugggaucuaguucaucgagaacgcgagcuucauaaacaaggaaagugugcgacuuguguuuacaacaugauggguaaacgugagaagaaauuaggcgaguuuggaaaagcaaaggguucgcgugcaauuugguauauguggcucggugcgcgauucuuggaguucgaagcauuaggauuuaugaacgaagaucauugguuuucccgugaaaauaguuuaucagggguggaaggcgagggccuucacaaacucggauauaucuugcgagauauuucuaaaauuccuggcggaaacauguaugccgaugacaccgcugguugggacacgcguauaacugaagacgaucuacaaaaugaagcaaaaaucacggacaucauggagcccgaacaugcauuacuagcgacauccaucuucaaacugacguaccaaaacaaaguagugaggguacaaagaccugcgcgaaauggaacaguaauggaugugauaucgagaagagaucaaagagguaguggucaaguagguacauauggcuugaauaccuuuacaaauauggaggcucaauuaauuagacaaauggaaucagaagggauauuuuuaccuucagaauuagagacgccgaaucuagcagaaaggguauuagacuggcucgagaaacauggagucgaacgacugaaacguauggcuaucaguggagaugauugcguaguaaagccaaucgaugaucgguuugcuaccgcguuaacagcacuaaacgauaugggaaaagucagaaaggauauuccucaaugggaaccguccaaagguuggaaugacuggcaacaagugccauucuguagccaccauuuucaucaauuaauaaugaaggaugguagagaaaucguagugccaugucgaaaucaggaugagcuaguuggcagggcccggguuagucaaggugccggauggucccugagggaaacagcuuguuugggcaaaucguaugcucaaauguggcagcuuauguauuuccacagaagggaucuacgauuagcagcuaaugcuauuugcucagcagugccaguagauuggguuccgacaaguagaacgaccugguccauucaugcucaucaccaauggaugacuacagaagacaugcuuucaguauggaaccggguguggauagaggaaaacccauggauggaagauaaaacacacauuucaaguuggggugacgugccuuaccugggaaaaagagaagaucaauggugugguucauugauaggucuaaccgcacgagcgacaugggcaaccaacauacagguugcuauaaaccaagugcggagacucauaggcaacgaaaacuaccucgauuauaugacuucaaugaagcgauucaagaaugagucggauccugaaggugcacuuugguaa

SEQ ID NO: 21511 - RNA, 9879 nt, Artificial Sequence
  derived and/or modified CDS sequence (opt6) from DENV-1__FJ182034__SS-prME
uccguaacaauguuacuuaugcuaaugccaacggcacuagcauuccauuuaacaacucgcgggggagaaccccauaugaucguaaguaaacaagaaagaggaaaaucauuacuuuuuaaaacuagcgcgggugugaacauguguacauuaauugcaauggaccuaggugaauuaugcgaagauacaaugacauauaaaugcccaaggauuacugaagcugaaccggacgacguagauuguugguguaaugcuacagauacuuggguaaccuaugguacuuguagccaaacuggagaacaccgacgagacaaacguaguguugcauuagcgccacauguaggacuaggucuugaaacuagaacggaaacauggauguccagugagggagcauggaaacaaauacagagaguagaaacaugggcacuucgucauccuggguucacagucauagcucuuuuccucgcacaugcgauugguaccucgaucacacagaaaggaauaauuuuuauucucuuaaugcucguaacgccgaguauggcgaugcggugcgucggaauugguagccgugauuucguggagggccuaucuggcgccacauggguagacguuguguuagaacaugguucgugcguaacaacaauggccaaagacaaaccgacacuugacauugaauuacuaaaaaccgaaguuacgaauccugcaguguuacguaaacuuugcauugaagcuaaaauuucaaacacgacaacagauaguagaugcccaacucagggugaagcuacgcuuguagaagaacaagaugcaaauuucguaugccgucguacauucguugacagggguugggguaauggcugugguuuguuuggaaaaggaucauuaauaacaugcgcuaaauucaaauguguaaccaaauuagaaggcaaaauaguucaauaugaaaaccucaaauauucgguaauaguaacagugcauacuggagaucagcaucaagugggaaaugagucaacggaacacggaacgacagcaacuauaacaccacaagcaccuucgacggaaauucaauugaccgauuauggcgcgcugacauuagacugcucuccacggacugggcuagacuuuaacgaaauggucuuacuuaccaugaaagagaaauccuggcuaguccauaaacagugguuucuagaucuuccucuaccuuggaccaguggggcgaguaccagucaggaaacauggaacagacaagaccucuuaguaacuuuuaaaacagcgcaugcuaagaaacaagaagugguuguauugggcagucaagagggcgccaugcauacggcguuaacuggggcaacggaaauccaaacauccgguacuacgacaauauuugccggacaucuuaaauguagacuaaaaauggacaaacugacauuaaaagggaugagcuauguaaugugcacagguucauuuaaacuagaaaaagaagucgcugaaacacaacacggcacuguucuuguacaaauaaaguaugaaggaaccgaugcgccauguaaaauaccguucucgacucaggacgagaaaggaguaacccagaauggacggcuaaucacugcaaacccuauugucacugauaaagaaaagccagucaacaucgaagcggaacccccauucggugaaagcuauaucguaaucggcgcuggggagaaagcauuaaaacuuaguugguuuaaaaagggcaguucuauugguaaaauguuugaagcuacagcucgaggggcuaggcgaauggccauacugggugauaccgcgugggauuuuggaucaauaggcggggucuuuacaucuguuggaaaauuaguucaucaaaucuucggaacugccuauggggugcuuuuuagcggagucucguggacaaugaaaauaggcauaggcgucuuauugaccugguugggccuuaacucaaggagcacuucacugucaaugaccugcauugcaguagguuugguuacguuguauuuaggcgucaugguccaagcugauaguggcugugugaucaauuggaaaggacgugaauugaaaugugguucaggaauauuuguaaccaaugagguucacacuuggacugaacaauauaaauuucaagcggauucgcccaaaagacuuucugccgcuauuggcaaagcaugggaagaagggguaugugguauuagaucagcaaccagguuggaaaauaucauguggaaacaaauaagcaaugaacugaaucacauuuuauuagaaaacgacaugaaguuuacaguuguaguaggugaugucgcaggaauauuagcucaggguaagaaaaugauaagaccgcagcccauggaauauaaguauucauggaagaguugggggaaggcgaagaucauaggcgcagauguacagaacacaacauuuauuauugacggaccaaauacaccagaauguccugaugaucaaagagcauggaauaucugggagguagaggauuauggcuuuggaauauuuacaacaaauauuuggcuuaaacugagagauaguuacacacaaguaugugaucauagguugaugagugccgcaauuaaagauucaaaagcaguacacgcugacaugggguauuggauugaguccgagaaaaacgaaacguggaagcucgcucgagcuaguuuuauugagguaaagacuugcauauggccaaaaagccauacacucuggucuaacggcguauuagaauccgaaaugauaaucccuaaaauauauggaggcccuauaucucagcacaauuaucgaccugguuacuuuacacagacagcaggcccauggcacuuaggaaaacucgaauuggauuucaauuuaugcgaagguacuaccguggugguugaugaacauugcggaaaccguggaccaucauugaggacaacgacugucaccggaaagauaauccaugaguggugcugccgaucaugcacacucccuccgcuaagauuuaaaggcgaagaugguugcugguauggcauggaaauacggccuguaaaagagaaagaagaaaaucuaguuaaaaguauggucagcgcuggcucuggagaaguugauuccuucucacuuggucuacuauguauuaguauaaugauugaagaaguaaugagaucacguuggucuagaaaaaugcuaaugacaggcacccuagcggucuucuuucuacuuauaauggggcaauuaacauggaacgaucucauucgucuauguauaaugguuggugcuaaugcuagugaccgaaugggaauggguaugacauaucucgccuuaauggcaacguuuaaaaugcgaccuaugcuagcaguaggcuuacuauucaggcguuuaacuagccgagaaguuuuacuucuaacaauaggacuaagccuaguggcguccguagaacucccgaauagcuuagaggaauuaggugacgggcucgcaaugggcauaaugauucuaaaacugcuuacagacuuccaaucacaucaacuaugggcaacuuuguuaucccuaaccuuuauaaagacaacuuauucuuugcauuaugccuggaagacaauggcaauggugcuuucuauagucucuuuauuucccuuaugucucuccacaaccagucagaaaacgacuugguuaccaguuuuauuaggaucauuaggauguaaaccauuaacaauguuucugauagcagaaaacaaaauauggggacguaagucauggccccuaaacgaagggauaauggcagugggaaucguaaguauccuguuguccagccuucucaaaaaugacguuccacuagcaggcccauuaauugcugguggaauguuaauagcauguuauguaauuucugguuccucggcagauuuaucucuugagaaagcugcugagguaucuugggaagaggaagcugaacacaguggcgcaucgcauaacauauugguagaaguacaagaugacgguacgaugaaaauaaaagaugaagaacgugacgacacccuaacaauuuuacuaaaagcgacauuacuagcugugucgggggucuauccccuuagcauaccagcuacguuauuuguuugguacuuuuggcagaagaagaaacaaaggagugguguacugugggauaccccaagcccgccggaaguugaacgugcagugcuggacgauggaauuuauagaauaaugcagagaggucucuugggccgaagccaaguaggaguugguguauuucaggaaaauguuuuucacacgauguggcacguaacacgaggugcuguguuaauguaccaagggaaaaggcuugaaccaucuugggccucggucaagaaagacuuaauuucuuacgggggugguuggagacuacaagguucauggaauacaggagaggagguacagguaauagcaguagagccaggcaaaaaucccaaaaauguacagacggcgccgggaacuuucaaaaccagcgaaggcgaaguuggagccaucgcacuagauuuuaagccaggaaccuccgggucccccauuguaaauagggaaggaaaaauaguuggacucuaugguaauggcgucguuacuacuucagguacauauguuagugcuauugcacaagcuaaggcuucucaagaagggccucuuccugaaauagaaaaugaaguuuuuaggaaacgcaaccuaacuauaauggauuugcauccugguaguggaaaaacuaggagauaccuccccgcaauagugcgagaagccauaaagcguaaauuacggacucuuauucucgcaccaacaagaguaguugccagcgaaauggcggaggcauuaaaagguaugccgauuagauaucagacuaccgcagucaaaagugaacacacuggcaaggaaauaguggaucuaaugugucaugcuacuuuuacaaugcggcuucuuaguccugugcgugugccaaauuacaauaugauaauaauggacgaggcacacuuuacagacccgucuucgauagcggcccggggauacauuagcacaagaguuggcaugggggaggcggcagcuauauuuaugacggccacucccccgggaucuguugaagccuuuccacaaagcaacgcuguuauucaagaugaggagcgagacaucccagaacgguccuggaauaguggcuaugaauggaucacugauuuucccgguaagacuguaugguuuguuccaucaaucaaaucugggaaugauaucgcuaauugucuaagaaagaaugguaaacgaguaauacaacuaucacgcaagacuuucgacacagaauaccagaaaaccaaaaacaacgauugggacuacguagugaccacugauaucagcgaaaugggagcuaauuucagggcggaucgcgucauagacccccggagaugccuuaaacccguuauacuaaaggauggaccggaacgcguaauacuagcuggaccaaugcccgucacagucgccucggcugcacaacgaagggguagaauaggaagaaaccacaauaaagagggcgaucaauacauauauaugggccagccacuuaauaacgacgaagaucaugcacacuggacugaagcuaaaaugcugcuggacaacauaaauacacccgagggaauaauccccgcucuguuugaaccugagagggaaaaaucagccgcaaucgauggugaauaucgauugcguggagaagccagaaaaacauucguugaauuaaugcgacgcggugauuuaccggugugguuaucuuauaaaguugcaucagaagguuuccaauauucggacagacguugguguuucgauggcgaaagaaacaaucaaguacuugaggaaaacauggacguagagauuuggacaaaggaaggagaacguaagaaacuacgaccacggugguuagacgcaagaacguacucugauccauuagcuuuaagagaauuuaaggaauuugcagccggaagacgcucaguaucgggggauuuaauauuagaaauuggcaaauugccucaacauuugacacagagagcacagaaugcguuggauaacuugguaauguuacauaacucagagcaaggugggcgagcuuaucgucacgccauggaagaacuaccggauacuauugaaacccugauguuauuagcgcuaaucgcagucuugacaggagggguaacacuguuuuucuuaucaggaagaggcuuaggcaaaacuucuauuggacuuuuauguguaauggcaagcagcguacuguuguggauggcgaguguugaaccacauuggaucgccgcuucaauuauauuagaguucuuucugaugguacuauuaauuccugagccagacagacagcguacgccgcaggauaaccaacucgcuuauguuguaauaggccuacuauucaugauacuaacagucgcugcgaacgagaugggucugcuagaaacaacuaagaaagauuuaggaauaggucacguugcuguagaaaaccaucaucacgcugcaaugcuagaugucgacuugcauccugcaucugccuggacacuuuaugcuguagccacuacaauaauaacaccaaugaugagacacacaauugaaaauacaacugcuaacaucagucuaacugcaaucgcgaaucaagccgcaauauuaauggguuuggauaaaggcuggccgauaucuaaaauggacauagguguuccauugcuggcgcuaggauguuauucacagguuaacccguugacacucacagcagcugucuuaauguuaguggcucacuaugcaauaaucggcccaggacuucaagcaaaagcuacucgggaggcucagaaaaggacagcugccggcauaaugaaaaauccaacgguugacgguauaguagcaauagauuuagaucccguaguuuacgacgcaaaauuugaaaaacaauuaggacaaauuauguuacugauacuaugcacaucccagauacuacuaaugcgaaccacaugggcacuuugugaauccauuacauuagccaccgguccacuuacaacucugugggaagguaguccggguaaauuuuggaauacuacaauugcuguaagcauggcuaauauauucagagguuccuacuuagcaggagcagguuuggcauuuucccuaaugaaaucacuuggugguggacgacguggaacaggagcgcaaggagagacccugggagaaaaauggaaaaggcaacugaaccaauuaaguaaaagugaguucaacaccuauaagagaucaggaauaauggaaguagauagaucggaagcuaaagaaggauuaaagagaggggaaacgaccaagcaugcugucaguagagguacugcaaagcuccgaugguuuguagagcgcaacuuagucaagcccgagggaaaaguaauagaucuugguugcggcagaggaggguggucauauuacugugcuggcuugaagaaagucacagaaguaaagggauauacuaaaggaggucccggacaugaagaaccgauacccauggccacuuauggauggaacuuagucaaauuacauucaggaaaagauguuuucuuuauaccaccagaaaaaugugacacacuucuuugugauauaggggagagcucuccgaacccaaccauagaggaaggaaggacauuacguguuuuaaagauggucgaaccaugguuaagaggaaaccaauuuuguauaaaaauuuugaaucccuacaugccaaguguuguagagacauuggaacagaugcaacgaaaacacggcggaaugcuaguaaggaacccauuguccaggaacucaacucaugaaauguacuggguaaguuguggaaccgguaauauagucucggcaguaaacaugacgucaagaaugcuucuuaaccgcuuuacgauggcacaccgcaaaccaacuuaugaaagggauguagauuuaggcgcugguacucgucauguagcggucgagccagaaguagcuaaccuggacauaauuggccagcguauagaaaacauaaaacacgaacauaaaucaaccuggcauuacgaugaggacaaucccuacaaaacaugggcuuaccaugguucuuaugaggugaagcccuccgguagugccucaucgauggugaacgguguuguaaaauuacuaacaaagccuugggauguaauaccaaugguaacucaaauagccaugacggacacaacaccguuuggacagcaaagaguauucaaagaaaaaguugauacaaggaccccgaaagcuaaaagaggaacagcucagauaauggaagugacagcaaagugguuauggggauucuuaagucggaacaagaagccgagaauuugcacaagagaagaauuuaccaggaaaguaaggucaaacgccgcgauuggcgcagucuuuguugacgaaaaccaauggaacagugcgaaagaagcuguugaggaugaaagauuuugggaucuuguacaucgagaaagagaauuacauaaacagggaaaaugcgcuacgugcguauacaauaugaugggaaaaagggagaagaaauuaggagaguucggaaaagcuaaaggaucuagggcgauaugguacaugugguuaggggcacgguuuuuagaguucgaggcgcuuggguuuaugaacgaagaccauugguucucucgugaaaauucacucucaggaguggaaggagaaggucuucacaagcuaggauacauccuaagagacauuucaaaaauaccaggcggaaacauguaugccgaugauacagcugggugggacaccagaauaaccgaggacgauuuacaaaaugaagcaaaaauuaccgauauaauggaaccagaacaugcgcuccuagcuaaaagcauuuuuaaauuaacauaucaaaauaaaguaguuagaguucagagacccgcuaaaaacggaaccgugauggaugucaucucccgccgcgaucaacgggguagcggucagguugggacuuauggauugaacacuuuuacuaauauggaagcccaacuaauaagacaaauggaaagugaggguauauucagcccuagugaauuggaaacuccaaaccuagcggguagaguucuagacugguuggagaagcauggggucgaaagguuaaaacgaauggcuauuaguggugaugacugugugguaaaaccgaucgacgacagauuugccacagcuuugacagcauugaaugacaugggaaaaguacgcaaagauauaccucaaugggaaccuucaaaaggauggaaugauuggcagcaagugccguuuuguucacaccacuuucaccaguuaaucaugaaagacggaagagagauaguuguuccaugucgcaaucaagacgaacuuguagggagagcacggguuucacagggcgccgguuggagccuuagggaaacagcuugucuaggaaaaagcuaugcucaaauguggcaacuaauguauuuccauaggagggacuugcgauuagcggcuaaugcaauuugcucggcaguuccaguugacuggguuccaacaagucgaacgacaugguccauccaugcgcaucaccaauggaugacaacggaggauaugcucucaguuuggaauaggguuuggauagaagaaaaccccuggauggaagauaaaacacacauaaguagcuggggagauguaccauacuugggaaaacgcgaagaccaguggugcggaucauuaaucggacugaccgcaagagcaacgugggcuacaaacauacaaguugcaauaaaucaagugagacgucuaauugguaacgaaaacuauuuagacuauaugacaucuaugaaaagauuuaaaaaugagucugauccggaaggggcucuaugguga

SEQ ID NO: 21512 - RNA, 9879 nt, Artificial Sequence
  derived and/or modified CDS sequence (opt6) from DENV-1__FJ182036__SS-prME
ucuguaacuauguuacuuauguuaaugccaaccgcacuagcauuccauuuaacuacuagaggaggggaaccucacaugauaguaaguaaacaagaaagagguaaaucacuacuauuuaaaacuuccgcggguguaaauauguguacuuuaauagcaauggaucucggagaauuaugugaagauacuaugacauauaaaugcccuagaauaacagaaacugaaccggaugauguugauuguuggugcaacgcaacagauaccuggguuaccuacgggacguguagccaaacuggugaacauagaagagacaaacguucaguugcauuggcuccacauguaggauuaggucucgaaacacgaacugaaacuuggaugucgucagaaggagcauggaaacaaauacaaagaguugaaacaugggcccuucgacauccaggguuuacuguaaucgcccucuuuuuggcgcaugcaauagguacaucaauaacacagaaagggaucauauucauucuauuaaugcuagccacaccaucaauggccaugagaugcgucggcauuggcucaagggacuuuguagaaggacugucuggugcuacuuggguagacgucguauuggaacaugggucuuguguaacgacgauggcuaaagauaaaccaacgcucgacauugaacuauugaaaacagaagugaccaacccggcgguucuucgaaaauuaugcauagaagcgaaaauaaguaauacaacgaccgacagucguuguccaacccaaggugaagcuacguugguagaagaacaagaugcaaacuucguuuguaggagaacauuuguagacagggggugggguaacgguugcggauuauucgguaaagggagcuuaauaacuugcgcuaaauucaaaugcguuaccaaacuagaaggaaagaucguccaauacgagaaccucaaauauucagucauuguaacuguacacacuggugaccaacaucaaguaggaaacgaaucuacagagcauggaacaacagcaaccauaacaccacaagcuccuacgacagagauacaauugacagauuauggagcacuaacacuagauugcucgccacguacugguuuagauuuuaacgagaugguacuauugacaaugaaagagaaaaguugguuagugcacaaacaaugguuucuugauuuaccauuaccauggaccucuggagcaaguacgucgcaagaaacauggaauaggcaagaccuguuagucacuuuuaaaacugcgcaugccaagaaacaagaagucguuguacucgggucacaagaaggggcuaugcauacagcgcucaccggagcaacugagauacaaacgagugguacaacuacuaucuucgcuggucaucuuaaauguagacuuaaaauggacaaacuaaccuuaaaaggaaugagcuacguuauguguacuggaucguuuaaacuugaaaaagaauuagcugaaacgcaacacggaacaguucuuguacaaaucaaauaugaagggacggacgccccaugcaaaaucccauuuaguacccaggacgagaaaggcguuacacaaaauggacgucugauuacugcaaacccuauaguaacagacaaagaaaaacccgugaauaucgaagcagaaccacccuuuggggaguccuacauagugauaggagcgggggagaaggcucugaaauuaagcugguuuaaaaaggggucaucaauugggaaaauguuugaagcaacggcacgaggagcacgacgaauggcgaucuuaggagacacagcgugggacuuugguucaaucggaggcguuuuuacgucgguggguaagcuagugcaucagauauuugggaccgcuuacggcgugcuauucucaggagucaguuggacuaugaagauuggaauaggaguccucuuaacaugguugggucuaaauaguagauccacauccuuaagcaugacaugcauagcgguugguuuaguaacguuauaccuaggagugaugguccaagcagauagugguugcgugaucaacuggaaagggcgugagcucaaguguggaucgggcauuuuuguaaccaacgagguacacacguggacugagcaauacaaauuccaagcugauaguccaaaaagauuaagugccgcuauuggaaaggcuugggaggaaggagucugugguauacgaagcgcgacgagauuagaaaauauuauguggaaacaaauaucaaacgaacuaaaucauaucuugcuagaaaaugacaugaaauuuacuguggucguaggcgacguagcagguauccuagcacaaggcaagaaaaugauacguccgcaaccuauggaauauaaauacucuuggaaaaguuggggaaaagcgaagaucauuggugcagaugugcagaauacaacauuuauaauagauggcccaaauacgccagaguguccugaugaucaacgagcauggaacauaugggaaguagaagauuauggauucggaauuuucacuacaaacauauggcuuaaauuacgggacuccuauacacagguuugugaucauagacuaaugagcgcugcaauaaaagacucaaaagcaguacacgcugauaugggauacuggauagaaagcgagaaaaacgaaacguggaaguuggcgcgggcgaguuuuauagaaguaaaaacauguauuuggccaaagucacacaccuuauggucgaauggcguacuggaauccgaaaugauuauaccuaaaauuuauggagguccaaugucccagcauaauuacagaccagguuauuuuacacaaacagcuggaccauggcaucuaggaaaauuggaacuagauuuugacuuaugugaaggcacgacgguuguaguugaugaacauuguggaaauagagguccuaguuuaagaaccacuacggucacgggaaaaauuauccacgaaugguguuguaggagcugcacgcuuccuccucuaagguuccgcggcgaggacgguuguugguacggaauggagauuagaccuguaaaagaaaaggaggaaaaucuaguaaagagcaugguuucugcaggguccggagaaguagauucguuuucgcuugggcucuuauguauaagcauaaugauugaagaggucaugaggucuagguggagucgaaaaaugcuaaugacaggaacguuggcggucuucuuucuauuaauaaugggucagcuaacuuggaacgaucuaauacgauuguguauaaugguaggggcgaaugcguccgauagaaugggaauggguacuacguacuuagcuuuaauggcaaccuuuaaaaugagaccaauguucgcuguuggucuacuguuucgacgcuuaacgaguagggaaguacuguuacuuacaaucggauuaucccuaguggcuucaguggagcuaccaaauagucucgaagaauugggagauggacuagcuaugggaaucaugauauugaaauugcuaacggacuuucaaucacaucaacuaugggcaaccuuauuaucuuuaacauuuauuaaaaccaccuuuucacuucauuaugcuuggaaaacaauggccauggucuuauccauuguaagccuuuucccacuuugcuuaucuacaaccucacagaagacuacuuggcuuccaguccuacuagggucauuagguuguaaaccccucacuauguuccucauugcagaaaacaagauauggggacgacgaucuuggccgcucaacgaaggaauaauggcagugggaaucguaagcauacuacuaucuucguuauugaaaaaugacguaccauuggcuggaccauugauagcuggagggaugcugauugcauguuauguaauuucaggcucaagcgcugauuuaucuuuggagaaagcagcugagguaaguugggaagaagaagccgaacacucuggagcgucucauaauaucuuaguugagguucaagaugaugguacuaugaaaaucaaagacgaagaaagagaugauacauuaacaauacuacuuaaagccacgcucuuggcaguuaguggcguauaucccuuaagcauuccugcaacauuauuuguaugguacuucuggcagaaaaagaaacaaagaucaggaguauugugggacacuccgucuccaccugaaguugaacgggcuguauuagacgacggaaucuauagaauaaugcaacgcggacuauuaggaagaucacaaguaggaguggguguauuucaagagaauguuuuccauaccauguggcauguaacaagaggcgcaguuuuaauguaucaagguaaacgccucgaaccuucaugggcaucugucaagaaagacuuaauaaguuacggaggcgguuggagacuccaagguuccuggaacacaggagaagagguacagguaauagcgguggagccggggaaaaacccuaaaaaugugcagacagcaccaggaacauuuaagacuccagaaggagaaguuggagccauagcccuggacuuuaaaccgggaacuucugguucaccaaucguaaacagagaagggaaaauuguaggcuuauauggaaauggcguagugacgacuucagguacuuacgucuccgcuaucgcacaagccaaagccucucaagaaggaccacuaccugaaauugaagaugaaguauuuaggaaacguaaucuuacaauaauggaccuacacccagggucaggcaaaacgagacgauaucuacccgcaauaguacgugaagcaauaaaaaggaaacuuagaacauuaauauuagcaccaacccggguaguagcuagugaaauggcagaagcgcuuaaagguaugcccauuagauaccagacuacagcagucaaaagugaacauacugggaaggaaauagucgaucuuaugugucacgcuacuuucacaaugaggcuacugucgcccguaagaguaccaaacuacaacaugauuauaauggacgaagcacauuucacagacccaucgucaauugcagcacgcggcuauauuaguacaagaguggguaugggcgaagcggcggcaauauuuaugacugcgacaccaccuggguccgucgaagcauuuccucaaucuaaugcaguuauacaagaugaagaacgggacauaccagaaaggagcuggaacagugguuaugaauggauuacagacuuuccuggcaagacagugugguuugucccgucaauuaaaucaggaaacgauauagccaauugucuuaggaaaaauggaaaacgaguaauacaauuaucaagaaaaaccuucgauacugaguaucagaagacuaaaaacaaugauugggauuacguaguaacaacagauauuucggaaaugggcgcuaacuuuagggcugauagaguaaucgauccgcggagaugucuuaaaccagucauccuaaaggauggucccgagcgcguaauauuagcagguccuaugccagucacaguugcgagugcagcgcaaagacgaggcaggauaggcagaaaucauaacaaggaaggggaucaauauaucuauauggggcaaccacucaauaaugaugaagaucacgcgcacuggacagaagcaaaaaugcuauuggauaauauuaauacgccugaagggaucauuccggcauuauuugagccagagagggaaaaaucugcagcuauagacggggaguacaggcuacgaggugaggcacggaagaccuuuguagagcuuaugagaaggggcgaucuaccugucuggcuaucauauaaaguggcuagcgaaggauuucaauacagugacagaagauggugcuucgauggcgagcggaauaaucaaguauuagaagaaaauauggauguagagauauggacuaaagaaggugaaagaaagaagcuaagaccaagauggcuagaugcgcgaacuuauucugauccuuuggcguuaagagaauuuaaagaguucgccgcgggaagaagaagugucucaggagaccucauucucgagauagggaaacuuccccaacaccuuacccaaagagcacaaaacgcacuagauaaccucguuaugcugcacaacuccgaacaaggcgguagagcguauagacaugcuauggaagaacuaccagauacuauugagacccuaauguuauuagcacuuauagcaguucugacgggagguguaacucuauuuuuccuaucugguagaggucucgguaagacgucgauagguuuacuguguguaauggcgucaucaguuuuacuauggauggccagcgucgaaccacauuggauagcagcaaguaucauucuagaauuuuuccuuaugguuuuauuaaucccagaaccagaucgccaaagaacuccgcaagacaaccaacuagcauauguaguaaucggccuucuuuuuaugauccuaacaguugcagcuaaugaaauggggcuuuuagagacaaccaagaaagauuuagguauagggcacgucgcaguagagaaucaucaccaugcugcuaugcucgauguggaccugcacccagcaagcgcauggacauuauaugcggucgccaccacuauaauaacaccaaugaugaggcauaccauagagaauacaacggcgaauauauccuuaacagcaauagcaaaccaagcagcuauuuuaaugggacuagacaagggauggccuauauccaaaauggauauaggugugccacuucucgccuuaggguguuauagccaaguaaauccccuuacuuuaaccgcagcgguucuaaugcuagucgcacacuacgcuauaauaggaccgggacuccaagcuaaggcaacaagagaggcacagaagagaacagcugcagguauaaugaaaaauccaaccgucgauggcauaguggccauugaccuagauccuguaguguacgaugcgaaguuugaaaaacaauugggacaaauaaugcuucuuauauuauguacaucccaaauucuauuaaugcgcacuacgugggcauuaugcgaaucaauaaccuuagcuacggggccucuaacaacacuuugggaaggaaguccggguaaguucuggaacaccacuauugcaguuucuauggcgaauaucuuccgcggaagcuaucuugccggugcaggucuagcauuuucacuuaugaaaagccuaggaggcggacgccgagguacuggagcccaaggagaaacacucggcgaaaaguggaagagacaacucaaucaguugaguaagagugaauuuaauacuuacaagcggagcggaauaauggagguagauagaucagaagcuaaagaagggcuuaaacgaggagaaacaacaaaacaugcuguuucccguggcaccgcgaaacuuagaugguucguggaacgaaacuugguaaaaccggagggcaaaguaauugacuuagggugugguaggggcggcuggucuuauuacugcgcaggucuaaagaaagugacagagguuaaaggauacacaaaaggaggcccgggacacgaggaaccaauucccauggcaacauacgguuggaauuuaguaaaauuacacucagguaaggacguguucuuuaucccuccugagaagugugauacgcuacucugcgacauaggcgagucauccccuaauccuacuauagaagaagggcguaccuuaagaguacuaaaaaugguagaaccguggcugaggggaaaucaauuuugcaucaaaaucuuaaauccauacaugcccagcguugucgaaacguuggaacaaaugcaaagaaaacaugggggaaugcuggucagaaauccauuaucaagaaacucgacgcaugaaauguacugggucaguuguggaacaggaaacauaguuagugccguuaacaugacgagucguauguuacuuaauagauucacuauggcacaccgaaaaccaacauacgaacgagacguugaucuaggggcaggaacacgacauguagcaguugaaccagaaguagccaaucucgacauaauugggcaaagaauugaaaauaucaaacaugaacacaagucuacauggcacuaugacgaagacaacccguacaaaacuugggcuuaucacggcagcuaugaaguaaaaccaucugguuccgccucaagcauggugaaugggguuguuaaacuacugacuaagcccugggacguaauuccgaugguaacccaaauugccaugacagacaccacacccuuuggucaacaacgcguauucaaggagaaaguggacacacgcacaccaaaagccaagagggguacggcucagaucauggaggugaccgcaaaauggcuauggggauuuuuaucgaggaauaagaaaccacguaucugcacccgggaggaguucacgaggaagguucgauccaaugcagcaauaggcgcaguuuucguagacgaaaaucaauggaauagugcaaaggaggcgguugaagaugaaagauucugggaccuaguacacagggagagagaacugcauaaacaagguaagugugcgacuuguguuuacaauaugaugggaaaacgagagaagaaacugggagaguucgguaaagcgaaggggucaagggcuauuugguauauguggcuuggugccagauuuuuggaauuugaggcuuuagguuuuaugaaugaggaucauugguucuccagagaaaacucuuugucagguguugaaggugaagguuuacauaaauuaggauauauacuccgggacaucaguaaaauaccgggaggaaacauguacgcggacgacacugcaggaugggacacaagaauaacagaagaugauuugcagaaugaagcaagaauuacagauauaauggagccggaacaugcccuacuggcgaaaucuauauucaaacuuaccuaccagaauaagguagugagaguacaaagaccggccaaaaacggcacuguaauggacguuauaucgagaagggaucagagaggcaguggacagguaggaacguacgguuuaaauacauucacuaauauggaagcgcaauuaauccggcaaauggaaucugaaggaauauucaguccguccgaacuagagaccccaaaucucgcuaaaagaguauuagauuggcuggaaaaauacggaguagaacgacucaaacgaauggcaauuaguggugaugauuguguaguaaaacccaucgaugaucgauucgcuacagcucuaacagcccuuaaugacaugggcaaaguucgcaaagauauuccucaaugggaaccaaguaaaggauggaacgacuggcaacaggucccauuuuguagucaucauuuucaucagcuaauaaugaaagauggaagagagauuguaguaccuugucgcaaccaagaugaacucguugguagagcucguguaucucaaggugccgguuggucguugagagaaacggccugucuaggcaaaucguaugcgcaaauguggcaguuaauguauuuccauagacgagaucuucgacuagcagcuaaugcaauuuguagcgcggucccaguagacuggauuccgacgucaagaaccacauggucaauacaugcccaucaccaguggaugacaaccgaagauaugcuaaguguauggaacagagucuggauugaagaaaaucccuggauggaagauaagacacauauuucuaguuggggagaugugccguaucuaggaaaaagggaggaccaauggugugguucauuaauuggccuaaccgcccgugcuacaugggcaacgaauauucaaguagcgauaaaccagguaagaagauuaauaggaaacgaaaacuaucuugauuauaugacaucuaugaagagguucaaaaaugaaucugacccagaaggcgcauuaugguaa

SEQ ID NO: 21513 - RNA, 9879 nt, Artificial Sequence
  derived and/or modified CDS sequence (opt6) from DENV-1__FJ205876__SS-prME
ucaguaacuaugcuacuuaugcugaugccuacagcacuugcauuccauuuaacaacacgagggggugaaccacauaugaucguuucaaaacaagaacguggaaaaucacuacuguucaaaacuuccgcuggagugaacauguguacguuaauagcgauggacuuaggugaauuaugugaagacacaaugacuuacaaaugcccaagaauuacggaaacugaaccugacgacguggauuguugguguaaugcaacagauacaugggucacauacggaacaugcucgcaaacgggcgaacacagaagggauaaacgaagcguugcucuagcaccacacguuggauuaggacucgaaaccagaacugaaacuuggaugucgagcgaaggugcuuggaaacaaauacagcgaguugaaacaugggcacuaagacauccugguuuuacaguaauugcauuguuucuagcccaugccauaggaacaucaauaacucaaaaaggaaucauauucauacuacuaaugcugguaacuccaaguauggcuaugagaugugucgggauaggaagucgggauuuuguugaagguuuguccggcgcaacuuggguagauguuguucuagaacacgggagcugcguaacaacaauggcuaaagauaaaccaacguuagauauagagcuccuaaaaacagaagucacaaacccagcuguuuuaaggaaacuauguaucgaagcuaaaauaaguaacacuacuacggauagcagauguccuacgcagggagaagcuacacuuguagaagaacaagaugcaaacuuuguuuguagaagaacguuugucgacaggggaugggguaaugguugcggucuguuuggaaaaggaagucucauuacgugugcuaaauucaaaugcguaacaaaauuagaagguaaaaucgugcaauacgagaauuugaaauauucgguuauugucacgguucacacaggugaucaacaucaggucgguaaugagaguaccgagcaugguaccaccgcgacaauaacaccgcaagcaccuaccacagaaauccaguuaacagacuauggcgcuuuaacgcuugauuguucacccaggaccgggcucgauuuuaaugaaauggugcuacucacaaugaaagaaaaaucaugguuaguucauaaacagugguuuuuggacuugccacuaccauggacaucaggcgcaucaacaagccaggaaacuuggaacaggcaagaucucuuagugaccuuuaaaacggcacacgcaaagaaacaagagguaguuguacucggaagccaggaaggagcgaugcacacugcacugacaggggcuaccgaaauacagacuucaggcacaacaacaauauuugcgggucaccucaaaugucgucuuaaaauggacaaacuuaccuuaaaagguaugaguuacguaauguguacggggagcuuuaaacuggaaaaagaaguagcugaaacacaacacggaacagucuuaguacaaauaaaauacgaaggaacugaugcucccugcaaaauaccguucaguacacaagaugagaaaggggugacgcaaaacgguagguuaauaaccgcaaacccuaucgucaccgauaaagagaagccuguuaauauagaagcggaaccaccauucggggaaagcuauauuguaaucggcgcuggggagaaagcgcuaaaacuguccugguucaagaaaggaagcuccauagguaaaauguuugaggcuaccgcacgcggugcuagaagaauggcaauauugggugauacagcgugggauuuuggaucaauaggcggugucuuuacaaguguaggaaaauuaguucaccaaauauucggcacagcauaugguguuuuauuuaguggcguuucguggacgaugaagaucgggauaggcguauuauuaacaugguugggauuaaauaguagaucaaccagcuuaucaaugacguguauugcgguaggguugguaacucuuuacuuaggagugaugguccaagcugauagcgguugcguaauaaauuggaaaggaagggaacuaaaaugcgguuccgggauauucgugacgaaugaaguacacacauggaccgaacaguauaaguuccaagcagauucuccaaaacgguuaagugcugcuauaggcaaggcuugggaggaaggcguuuguggcauaagaucagcaacacgacuagaaaacauaauguggaaacaaauaaguaaugagcugaaucacauacuguuagaaaaugauaugaaguuuacuguaguggucggagauguagcgggaauauuagcacaaggcaagaaaaugauuagaccacaaccaauggaauauaaguauaguuggaaaaguuggggaaaagcuaaaauaauaggagcggauguccaaaauacaacguucauaauagacgggcccaauacuccagaaugcccagaugaccaaagagcauggaacaucugggaaguagaagacuauggauucggcauauuuacuacuaacauuuggcuaaagcucagagacucuuauacacagguaugcgaccacagauuaaugucagcugcgauaaaagacucaaaagcaguacaugcagauaugggauauuggauugaaucugagaaaaaugaaaccuggaaauuagcuagagcuucauucauugaggucaaaacauguauuuggcccaaaucacauacgcuauggucaaacggugucuuggaaagcgagaugauaauacccaaaaucuacggcggcccuaucucacagcacaacuauaggccgggauacuuuacucaaacggcaggcccauggcauuuaggaaaacucgaauuagauuuugacuugugugagggcacuaccgucguugucgaugagcacuguggaaaccguggccccucuuuaagaacaacgacaguaacuggcaaaauaauccaugagugguguuguagaucuugcaccuuaccuccacuuagauuucgcggagaagauggcugcugguacgggauggaaauaaggccuguaaaagaaaaagaggagaaccuugugaaaucgaugguaucggcgggauccggcgaaguugacuccuuuucucucggauuauuauguauuuccauuaugauagaagagguaaugcgcucgagauggucaaggaaaaugcuaaugacaggaacauuagcagucuucuuccuccuaauaaugggccagcucacguggaacgacuuaauacgcuuauguauaaugguuggggcuaaugcuucugaucgcauggguaugggaacuacauaccuagcuuuaauggccacguuuaaaaugcgacccauguuugcaguaggccuucucuuucgccgacuaacgagcagagagguccuacucuuaacgauaggauuaucuuugguugcuucaguagaguuaccaaacucacuagaagaauuaggcgauggccuagcuaugggaauaaugauucuaaaacuguuaacugauuuucaaucacaucaauuaugggcuacuuuacuaucucucacauuuauaaaaacaacauuuucauugcacuaugcuuggaaaacaauggcgaugguucuaagcauuguaucucuauucccucuaugccuauccacgacaucgcagaaaacgacguggcuaccagucuuacuagggagccucggguguaaaccacucacaauguuccucauugccgaaaacaaaauuugggggagaagaaguuggcccuuaaaugaaggaauaauggcaguagggauugucaguauauuauuaucgucucuucucaaaaaugacguccccuuagcagggccauuaauagcuggaggaaugcucauagcuuguuauguuauuaguggaaguagugcggaccuaucccuagaaaaagcggccgaggucucuugggaggaggaagcagaacacuccggugccagucacaacauauugguagagguucaagacgacgguacuaugaaaauaaaagaugaagaacgugacgacacucuuacaauucuuuugaaggcuacacuacuagcuguaaguggaguauauccacugaguauaccagcaaccuuauuuguaugguauuuuuggcagaaaaagaagcaacgauccggaguccugugggauaccccaucacccccggaggucgaaagggcgguccuagacgaugggauauauagaaucaugcagcguggacuacuaggcagaucacaagucgggguugguguauuucaagaaaauguauuccauacaauguggcauguuacucggggcgccguacuaauguaccaagguaagcggcuggaaccaaguugggcuucagugaaaaaggaucugauaucauauggaggaggcuggagacugcaaggaucuuggaauacgggcgaagaaguacaaguaauugcaguagaaccagggaaaaaccccaaaaauguacagacagccccugguaccuuuaaaaccccggaaggagaggugggugcaauugcacuagacuuuaaaccugggaccucagggucaccaauaguaaaucgagaaggcaaaauugugggucuuuacgggaauggaguaguaacgacaaguggaacuuacguuucagcgauagcccaagccaaagcaucacaggaagggccguuaccagagaucgaagaugaaguauuuaggaaacgaaacuuaacaaucauggauuugcacccagggucaggaaaaacgagaagauaucuuccugccauugucagagaagcaauaaagagaaaacuucgcacauugauccucgcaccuacacguguggucgcauccgaaauggcagaagcgcuaaaggguaugccuauacgauaucaaacaacggcuguuaagagugagcauacugguaaggagauuguagaccuuaugugucaugcaacauuuacuaugcgacucuuauccccggucagaguuccaaauuauaauaugauaauaauggaugaagcucauuucacugacccgucgucgauugcggcaagaggauacauaucaacaagaguaggaaugggagaagcagcagcaauauucaugacugcaaccccaccaggcaguguagaagcauuuccccaaaguaaugcaguuauacaggacgaagaaagagacaucccggaacgaucauggaauagcggauacgaguggaucacggauuucccugggaaaacaguuugguuugucccaaguauaaaaagcggaaacgauauagcgaauugccuaaggaaaaacggaaaacgggucauucaacugagccguaagaccuuugauacagaauaucaaaagacaaagaauaacgacugggacuauguaguuacgacagacauauccgaaaugggagcgaauuuccgagccgacagaguuauugauccccgaagguguuuaaaaccagugauauuaaaggauggacccgaaagaguaauauuagcaggaccuaugcccguuacuguggccucugcugcacagagacgcggacgaauaggcaggaaccacaauaaagagggagaccaauauauuuauauggggcaaccauuaaauaaugaugaagaucaugcucauuggacagaagcgaagauguuguuagacaauauuaauacaccagaaggaaucauaccugcuuuauuugaacccgaaagagaaaaguccgcagcuauugacggugaguaccgauuaagaggagaggccaggaagacuuucguugaauuaaugaggaggggcgaucuaccuguguggcuuaguuacaaaguagccucggaaggauuccaauacucugauaggcguugguguuuugauggggaacgcaauaaucaaguacuugaggaaaauauggauguagaaauuuggacuaaagaaggagaacgcaaaaaguuaagaccacguuggcuugaugcucgaaccuauucugauccucuagccuuaagagaauuuaaagaauuugcugccggacgcaggucaguaucuggcgaucuuauucuugagauugggaaauuaccacaacaucugacccaacgugcacaaaaugcuuuggacaauuuggugaugcuucauaauucggaacaagguggacgagcauaucgacaugcuauggaagaacuacccgacaccaucgaaacacuuaugcuccuagcacuaauugcuguucuuacugggggaguaacauuguuuuuccuuucuggaagagggcuugguaagacuucaaucggacucuuauguguaauggcuucaucagugcuguuauggauggcuaguguugaaccucacuggauagcggcaagcauuauauuagaguucuuucuaaugguccuucuaauaccugaaccggauaggcaaaggacaccacaggauaaucaacucgcauauguagugauaggccuacuguuuaugauacuuacaguagcagccaacgaaaugggccuccucgaaaccacuaagaaagaucucggaauagggcacguugcaguugaaaaucaucaccacgcagcuaugcucgauguugauuugcauccugcgucugcauggacguuauaugccguggcaacgacaauaauaacaccgaugaugcgucauaccaucgagaauaccacagcgaauauuucacugacagcuauagcaaaucaagcugcaauuuuaaugggacuagauaaaggcuggccaauaucuaaaauggacauaggaguaccuuuauuagcauugggaugcuauucacaaguaaauccauuaacccugacagcugcgguacuaaugcucguagcacauuaugcaauuauaggcccagguuuacaggcuaaagcaaccagggaagcacagaaaagaacugcagcgggcauaaugaagaacccaacggucgaugguauaguugcgaucgaccuugacccuguuguauacgaugccaaguuugagaaacaauugggucaaauuaugcuucuaauacuauguacgagccaaauucuucuuaugcgcacgacuugggcauuaugugaaucgauaacauuagccacgggcccccuuacaacucucugggagggauccccaggaaaauucuggaauacuacuauugcaguauccauggccaauauuuuccguggcucuuauuuagccggugcagguuuggcauuuagcuuaaugaaaucauuaggcggagguaggagagggacgggggcccaaggugaaacacucggugagaaauggaaacgacaacuaaaucaauuaucuaagagugaguuuaauaccuauaaaagaucugggauuauggaaguagauagaagcgaagcuaaggaagggcuaaaacguggggaaacaaccaaacacgccguuagucgggguacagcaaaacuuagaugguucguagaaagaaaccuaguaaaaccugaaggcaaagucaucgacuuaggaugcggucgcggaggguggucuuacuauugugccggccuaaagaaagucaccgagguaaaagguuauacgaagggugguccaggacacgaagaacccauccccauggcaacauacggauggaacuuaguaaaacuacauucagggaaagacguauucuuuauaccgcccgagaagugcgauacccugcuaugugauauaggagaguccucgcccaauccuacaaucgaagaaggccggacuuuacgaguacuuaagauggucgagccuuggcuccgaggaaaucaauuuugcaucaagauacucaauccauacaugccuagcguaguugagacauuagaacaaaugcaacggaaacaugguggaauguuagugagaaauccguuaucuaggaacucuacccaugaaauguauuggguuaguugcggaacuggcaauauagucucggcaguaaauaugacuucucgaauguuacuaaacagauucacaauggcacauaggaagccaacguaugagcgggauguagacuuaggagcgggaacgcggcacgucgcuguagaaccagaaguggcgaacuuagacauaauaggacaacggaucgagaacauaaaacaugaacauaaaucgacuuggcacuaugaugaagacaauccauauaaaacaugggcuuaccacggcucauaugagguaaagccuucuggaucagcaagcucuauggucaaugggguggugaaauuacuaacgaaaccuugggaugugauaccaaugguaacacaaauugcuaugacagauacuacuccguuuggucaacaacgaguauuuaaagaaaaagucgacacuagaacaccaaaagcaaaacgagguaccgcccaaauaauggagguaaccgcaaaaugguuguggggguuuuugucgcgaaacaagaagccaagaauaugcaccagagaagaguucacccgaaaaguuagaucuaaugccgcuauaggagcaguauuuguggacgaaaaucaauggaacucagcaaaagaagcaguugaagaugaaagauucugggaucuagugcauagagagcgugaauugcacaagcagggaaaaugcgcgacaugugucuauaacaugauggguaagcgugagaagaaauuaggagaauuuggcaaagcaaaaggaagccgagcuaucugguacauguggcuaggcgccagauuucuggaguucgaagcucuaggauuuaugaaugaggaccauugguucaauagagaaaacuccuuaaguggaguagaaggagaagguuuacacaaauuggguuacauauuaagagacauauccaaaauaccaggagggaacauguacgcggaugauacagccgguugggacaccagaauaacugaagaugaucuacaaaaugaggcaaggaucaccgauauuauggagccugaacaugcguuauuggcaagaucaaucuucaaacucacuuaucaaaauaaaguagugcguguccagaggccagcuaaaaaugggaccguuauggacguaauaucccggcgugaucaaagaggaucagggcagguaggaacuuauggcuuaaauacuuucacgaacauggaagcacaacugauaagacaaauggaaucagagggaauauucucaccuagugaauuagaaaccccaaaucuagcggaaagaguacuagauugguuagaaaaauacgggguagaaagacucaaacguauggcgaucucuggagaugauuguguugugaaaccuauagaugaccgauuugcaacagcacuaacagcauuaaacgauauggguaagguacgaaaagacauuccgcagugggaaccaucgaagggauggaaugauuggcaacaaguaccauuuugcucacaccacuuccaucaguuaauuaugaaagauggacgggaaauagucguaccuugcaggaaucaggacgaauuaguagggcgagcacgaguaagccaaggagcagguuggaguuugagagaaaccgcaugucuaggcaaaucuuacgcacaaauguggcaacucauguacuuucaccguagagauuugcgcuuagcugcgaacgccauaugcucagcaguuccaguagacuggauaccaacaucccgcacaacuuggucaauacaugcgcaucaucaauggaugacaacugaagacaugcuuaguguauggaaccgcguguggaucgaggaaaauccauggauggaggacaaaacccacaucucgucuuggggagauguuccauacuuaggaaaacgugaagaucaauggugcggaucccuuauagguuuaaccgcaagggcgacaugggcuacaaacauccaaguugccauuaaccagguaaggagguuaaucggcaaugagaacuaucuagauuauaugacgaguaugaaacgauucaaaaacgaaagugaccccgaaggagcucucugguag

SEQ ID NO: 21514 - RNA, 9879 nt, Artificial Sequence
  derived and/or modified CDS sequence (opt6) from DENV-1__FJ024455__SS-prME
aguguuacuauguuacuaaugcuaaugccaaccgccuuagcguuccauuuaacuacaagaggaggagaaccucacaugauugugucuaaacaagaacgggggaaaagucugcuguucaaaacuucuguaggugugaauauguguacgcuuaucgcaauggaccuuggugagcucugugaagacaccaugacauacaaauguccucgcauuacagaaaccgaaccugaugacguugauugcugguguaaugcuacagauacuuggguaacguaugggacaugcucccaaacaggagaacauagacgagacaaaagaucgguagcgcuagccccucaugucggacugggacuggaaacuagaacagagacauggaugucaagugaaggagcguggaaacaaauccaaagggucgaaaccugggcgcuacgacauccgggguucacagugauugcacuguuucuggcgcaugcuaucggaacgucaauaacacaaaaagggauaauauuuauacuguuaauguuaguuacuccgucaauggcuaugcgauguguaggaaucggaaguagagacuucguugaaggauuaaguggagccaccuggguagauguaguucuggaacauggaucuuguguuacgacaauggccaaagacaaaccuacuuuggacaucgaacuuuuaaaaacagaaguaaccaacccugcaguucucagaaaacuaugcauagaagcaaaaaucagcaauacaaccacggauucacgaugcccaacacaaggggaagcgacuuuaguagaagaacaggaugcuaacuuugugugccgacggaccuucguugauagaggcuggggaaauggaugcgguuuauuuggaaaaggaagccugauaacaugcgccaaauucaaauguguaacgaaacuugaaggcaaaauaguucaauacgaaaaccugaaauauuccguaauugucacuguucauacaggagaucaacaccaaguuggaaacgagagcacugaacacgguacaacagcuacaaucacaccacaagccccaacaaccgaaauucaauuaacagauuauggcgcucuaacccuugacugcaguccaaggacugggcucgauuuuaacgagaugguauugcucacaaugaaagaaaaaucaugguuagugcacaaacaaugguuuuuagacuuaccucuaccauggacauccggggcuucaacgagccaggagaccuggaaucgacaagauuuacucgugaccuucaaaacagcccaugccaagaaacaggaggucgucguacuggggagccaggaaggggccaugcauaccgcauuaacgggagcgacagaaauacaaacuagcgguacaacuacaaucuucgcuggacaucuaaaaugcagacucaaaauggauaaacuaacccugaaaggaaugagcuauguuaugugcacaggauccuucaaauuagaaaaagaauuggcagaaacgcaacacgggacuguauuaguacaaaucaaguaugaaggaacagaugcaccaugcaaaauucccuuuucaacucaagacgaaaaaggagugacgcaaaauggccgacuuauaacggcuaacccaauugugacagacaaagagaaacccguaaauauagaagccgagcccccauuuggugaaucuuacauaguuauaggagccggagaaaaagcguuaaaacucucaugguuuaagaaagguagcagcauaggcaagauguucgaggcaacagccagaggggcucgucggauggccauacuaggcgauacugcaugggauuuugguucuauaggaggaguguuuacaucaguaggcaaauuaguucaccaaaucuuuggaacagcguaugguguauuguuuucaggugucucauggacuaugaagauagggauagguguauuauuaacaugguuaggucuuaacucaaggaguacgagccuauccaugacuuguauagccgucggccuaguaacacuuuaucuaggggugaugguucaggcagacagugggugugugaucaacuggaaaggaagagaauugaagugugguucggggauauucguaaccaaugagguccauacauggacagaacaguacaaauuucaggcagauaguccuaaacggcuaagcgcagcaaucggcaaggcuugggaagaggguguuuguggcaucagaucagcaaccaggcuagaaaauauuauguggaaacaaauaaguaaugaauuaaaucacauuuugcuagaaaacgauaugaaauucaccguaguugucggagauguagcugguauacuugcacaaggcaagaaaaugaucaggccacaaccaauggaauacaaauauucauggaaauccuggggaaaggccaagauaauuggagcagauguacaaaacacuacauuuauaauugauggcccgaauacaccggaauguccugacgaucaacgcgcuuggaauauuugggaaguagaagauuacgguuuuggcaucuucacuacgaauauaugguuaaaguugagagauucuuacacccaaguaugcgaccaucgacuaaugucugcugcaaucaaagauuccaaagcaguacaugcagauauggguuauuggauugaaagcgagaaaaaugaaacauggaaguuagcacgcgcuagcuuuauagaaguaaaaacuugcauauggccaaaaucccacacauuaugguccaauggagugcuagaaucagaaaugauuauuccuaagauuuacggcgguccaauaagccaacauaauuaccgaccaggcuacuuuacacaaacugcugggccuuggcacuuaggaaaguuagagcuagacuucgauuuaugcgaaggaacaacaguuguggucgaugaacauugcggaaaccgagguccaucuuuaagaaccacaaccguaacaggaaaaauaauacaugaauggugcuguagaucuugcacacugccaccucucagauuucgcggggaagaugguugcugguaugguauggaaauacguccaguaaaggagaaagaagaaaauuuaguaaaaucuaugguaagugccggaaguggcgaagucgauucauuuagucugggauugcuaugcauuucgauuaugauugaagaggucaugcggucaagguggagcagaaaaaugcugaugacuggaacacucgcuguauucuuccuauuaauaauggggcagcuaaccuggaacgauuugauaaggcucuguauaaugguuggugcuaacgccagugacagaauggggaugggaacuacguauuuagcauugauggccacauuuaaaaugagaccaauguucgcagucggucuguuauuucgccgacucacaucacgagaaguacuacuucuuaccaucggucugaguuuaguugcuucgguugaauugccaaauucacuagaagaauugggggacggauuagccaugggaauaaugauccuuaaacuauuaacagauuuccaaagucaccaacugugggcuacacuucucucgcuuacauucauaaagacaacguuuucacuccacuaugcuuggaaaacuauggcgaugguacuuagcauugugaguuuauuuccacuaugucuaagcacuacaucacagaaaacaacguggcuuccaguauuauuagguucgcuagggugcaaaccacuaacgauguucuugauagcagaaaauaagauauggggccgccgauccuggccauuaaaugaaggaauuauggcggucggcauaguuucaauacuucugagcucacuucugaaaaaugaugucccauuagcaggaccacuuauagcaggggguauguuaauagcaugcuacgucauaaguggcuccuccgcggacuugagucucgagaaagcagcugaaguuaguugggaggaggaagcggaacauuccggcgcuucucauaauauucugguggaaguccaggaugauggcaccaugaagauuaaagacgaagaaagggaugacacauugaccauacuucuaaaagcaacauuacuagcaguuagugguguuuacccauuaucaauaccagcaacccuguuuguuugguauuuuuggcagaagaagaaacaaagaucuggagugcucugggauacgccuaguccaccagaggucgaaagggcaguauuagaugacggaauuuauagaaucaugcagagggggcuacuggggagaucacaaguaggaguagguguauuccaggaaaacguauuccauacaauguggcacguaacaagaggggcaguucuaauguaucaaggcaagcgacuagagcccucaugggcgucagucaagaaagacuuaauaagcuacggagguggcuggcgucuacaaggaaguuggaauacaggagaggaaguucaagucauagcaguagagccuggcaaaaaucccaaaaauguacaaacugccccgggaacguuuaaaacaccagaaggggagguuggagcgaucgcuuuggauuuuaaacccgguaccucugggucaccaauaguaaauagagaaggcaaaauaguugguuuauauggcaaugguguuguaaccacaaguggaacauaugugucggcgauugcccaggcgaaggcuucgcaagagggacccccaccagaaauagaggaugagguuuuucgaaagagaaauuuaacuaucauggaccuacacccugggucaggaaaaacuagacgcuaucuuccagcaaucguucgcgaagcuauaaaaaggaaacuucgcacguuaauucuugccccaacuagaguaguggcaucagaaauggcagaagccuuaaaagguaugcccauucgauaucaaacaacagcgguaaaaucugaacauaccgggaaagagauaguagauuuaaugugccaugcgacguucacgaugcgucuacuauccccaguuaggguaccaaauuauaauaugauaauaauggaugaagcacacuucacagauccgaguuccauugcugcaagggguuauauaucaacacguguaggaaugggagaagcggcugccaucuuuaugacagcgaccccuccagggucugucgaggcauucccucaaucaaaugcuguaauucaagaugaagaaagggauauacccgagcggaguuggaauaguggguaugaauggauuaccgauuuuccgggcaagacgguaugguuuguaccaagcauaaaaagcggcaacgauauagcuaacugccuaaggaaaaauggaaaacggguaauccaauuaucccgcaaaaccuuugacaccgaguaucaaaagaccaaaaacaacgacugggacuauguaguuacaacagauaucucugaaaugggggcaaauuuucgcgcagaucguguuaucgacccuagacgguguuuaaaaccagugauuuuaaaagacggaccagagcgugugaucuuggcgggaccaaugccaguuacaguagcuucagcagcucaacgucgcggcaggauugggagaaaucauaacaaagaaggagaccaauauauuuacaugggacaaccauuaaacaacgaugaagaccaugcccauuggacagaagccaagauguuauuagacaauauaaacacaccagaagggauuauuccagcuuuauucgaaccagagagagaaaaaucagcagcaauagacggagaguauagguuacgaggagaagcaagaaagacauuugucgagcuaaugcgaagaggcgaccuaccagucuggcuaagcuacaaagucgcauccgaagguuuccaauauagcgauagaagaugguguuucgauggggagcgcaauaaucaaguacuagaagaaaacauggauguagaaauuuggacuaaagaaggugagaggaagaaauuacguccucgcuggcuugacgcaagaacauacucggauccauuagcucucagagaauuuaaagaauuugcugcaggaaggaggagcguaucuggggaucugauucuagaaaucgggaaacuuccgcaacaucuaacacaaagagcucaaaacgcguuggacaaccuggucaugcuacacaacagcgaacaagguggucgggcauauagacaugcuauggaagaguugccagauacaauagaaacccuaaugcuacuagcguuaauugcaguacucacgggcggagucacuuuguucuuucuaucaggaagaggccucggaaaaacaucuauaggacuuuuaugugucauggcaucuucuguacuacuauggauggccagcguggaaccucauuggaucgccgcuucuauuauauuggaauuuuucuuaauggucuuacuuauaccagagccggaccggcagcgaacaccucaagauaaccaguuagccuauguagucauuggacuauuauuuaugauauuaacgguugcugcaaaugaaaugggauuauuggaaaccacaaagaaagacuuaggaauuggacauguugcagucgagaaccaccaccaugcagcgaugcuagauguagauuuacacccggcguccgcuuggacguuauacgcaguugccacgacuauaauuacuccuaugaugagacacacgauagagaauaccacugcaaacauaucacuaacagcaauugccaaucaggcugccauauuaaugggucuagauaaaggcuggccaaucaguaaaauggauauaggaguuccguuacuggcacuagggugcuauucucagguuaacccuuuaaccuuaacugcagccguacuaaugcucguagcccauuaugccaucaucgggccagggcuacaagcaaaagcgacccgugaagcucaaaagagaacggccgcgggaauaaugaaaaauccuacaguugaugguauaguagccauagaucucgauccugugguuuaugacgcaaaguuugaaaaacaguuagggcaaaucaugcuuuuaaucuuauguacuucccaaauccuauuaaugcgcacuacuugggcgcuaugcgagucaauaacacucgcaacagggccuuugacaacguugugggaggguucgccgggaaaauuuuggaauacaacgauagccgucucaauggcaaauaucuuuagagggagcuacuuagccggugcaggacuugcauuuucgcugaugaaaucauuggguggugggcgaagagggacaggggcgcaaggcgagacuuuaggugagaaauggaaaagacaauuaaaucaauuaucaaaguccgaauuuaauacuuacaaacggucugguauaauggagguagaccgaucagaggcuaaggaaggucuaaagagaggugaaacaacaaagcaugcaguaaguagaggcacagcaaaauuaagaugguuuguugaaagaaauuugguaaaaccagagggaaagguaauagaucuaggaugcggaagaggcgggugguccuauuauugugcuggcuuaaagaagguaacagaggucaaagguuauacaaagggagggccuggacacgaagaaccgauuccaauggcaacuuaugguuggaacuuagugaaauuacacagugguaaagacguguucuuuauuccacccgaaaaaugcgauaccuuguuaugcgacauaggagaaaguucgccgaauccaacaauugaagaaggaaggaccuugagaguuuugaaaaugguggagccaugguuaagaggaaaucaauucuguaucaaaauacugaacccauacaugccuagugucguagagacuuuggagcaaaugcaaagaaaacacgggggaaugcuugucaggaauccacucagccgaaacucaacccaugaaauguauuggguauccugcgguacgggaaauauuguaagcgcuguaaauaugaccucucggaugcuauugaauagguucacaauggcacaccguaaaccgaccuaugaacgcgacguugaucuaggcgcaggcacgagacacguugcugucgaaccagaaguagcgaauuuagacauaaucggccagcgaaucgagaauauaaaacaugaacauaaaucaaccuggcauuaugacgaggauaauccuuacaagacaugggcauaucaugggagcuacgaaguaaaaccaaguggcucggcaucaaguaugguaaaugggguugugaaacuucugacgaaaccgugggauguuauacccauggucacucaaauugcaaugacugauacuacaccauucggacagcaaagaguauuuaaagaaaagguagauacacggacgccaaaggcaaaacggggaacggcacaaaucauggaggugacagcgaaauggcuuuggggauucuuauccaggaacaagaagccaaggauuuguacccgcgaagaauuuacucgaaaaguaagaaguaaugccgcaaucggugcaguuuucguggaugagaaucaauggaauagugcaaaagaagcuguugaagacgaaagauucugggaucuagugcauagagaacgggaacuccacaagcagggaaagugugcgaccugcguuuacaacaugaugggaaagagagagaagaaacuaggugaguucggaaaagcuaaaggaucaagagcaauaugguacauguggcuaggagcaagauucuuagaguuugaggcacugggguuuaugaacgaagaucacugguuuucucgagaaaauucguugucugguguagaaggagaaggguuacauaaacuaggcuauauacuuagagacaucucaaaaauaccagguggcaacauguaugcugacgauaccgcugguugggauacccgcauuacagaagaugaucugcaaaacgaagcacguauaacagauaucauggagcccgagcaugcacuguuagcgaaaagcauauuuaaguuaacguaccagaauaaagucguaagaguacaaaggccagcaaagaaugguaccgucauggacgucauuucaagacgcgaucaaagaggaagcggucagguuggaacguauggacuaaacacauucacuaauauggaagcucaacuaauucgacagauggaguccgaggguauauucucacccucugaacucgaaacaccuaaucuggccgaacgaguucuggauugguuggagaaauaugguguugaacgccuaaaacgaauggcaauaaguggagaugauuguguagucaaaccuaucgaugaucgauuugcaacugcacuaacggccuuaaaugauauggggaaagugaggaaagauauaccccagugggaaccaaguaaaggcuggaaugauuggcaacaagucccuuucuguucccaucauuuucaucaacugaucaugaaagacggacgagaaauaguaguaccguguaggaaccaagaugaacuugucggaagggcacgcguuagucaaggagcaggauggucucuacgugagacggcgugucuaggaaaaucauacgcucaaauguggcaauuaauguauuuucauaggcgugauuuacgauuagcugcaaaugccauaugcuccgcagugccuguagauuggauaccuacuucgcggacaacuuggaguauacacgcccaccaccaauggaugacuacagaagauauguuaaguguuuggaauagagucuggauagaagaaaaucccuggauggaagacaaaacgcacauaucuaguuggggugacguuccauaccugggaaaacgagaagaucaauggugugguucauuaauuggauuaacugcgcgugcuaccugggcgacaaauauucaaguagcgauuaaucaaguaagaaggcuuauugggaacgaaaacuaccuggauuacaugacaucgaugaagagauucaaaaaugaaagcgaucccgaaggagccuugugguag

SEQ ID NO: 21515 - RNA, 9879 nt, Artificial Sequence
  derived and/or modified CDS sequence (opt6) from DENV-1__FJ024456__SS-prME
ucaguaacaauguugcugauguugaugccuacggcucuugcauuucauuuaacuacucgggguggggaaccccauaugaucguuacaaaacaagaacgcgguaaaucacuuuuauuuaaaacuucggcugguguuaauaugugcauauuaauagccauggaccuaggagaacuuugcgaagacacuaugacguauaaaugucccaggaucaccgaagcggaaccugaugacguagacugcugguguaaugcuacagauacauggguuacauauggaacaugcagucaaacuggugaacaucgaagagauaaacgaucaguagccuuggcuccacacgucggcuuagggcuugaaaccaggacggaaacauggaugucaagugaaggggccuggaaacaaauacaacguguugaaacaugggcauuaagacaccccgguuucacugugauagcuuuauuuuuagcacaugcgauuggaacuucuaucacccaaaaaggaauuauauucauauuacuaaugcuaguuaccccaagcauggccaugagaugcguaggaauaggaaguagggacuuuguagaaggacucucaggcgcgacguggguugacguaguccuagaacacggcaguugcguuacaacaauggcuaaagauaaaccgacauuggacauagaacuucuuaaaaccgaagugacgaacccagcagugcucaggaaacucugcauagaagcuaaaauuaguaacacaacuaccgauucacgaugcccaacgcaaggugaagcuacacuaauggaagaacaagaugccaauuuuguaugccgcagaaccuuugucgacaggggcugggguaaugguugcgguuuauucgguaaaggaucacuaauaacaugugccaaauuuaaaugugugaccaaacuagaaggaaaaaucguacaauacgaaaacuuaaaguacucuguaaucguaacuguccauacgggugaucaacaucaaguaggaaaugagagcaccgaacaugggaccaccgccacaauuacaccacaagcaccuacuagcgagauccaacuuacagacuacggagcguugacgcuagauuguucgccuagaacaggccuugauuucaaugaaaugguauuauugacgaugaaagagaaaaguuggcugguacacaaacaaugguuucuugaucugcccuugccauggacuucuggcgcaucaacuagccaagaaacguggaauagacaagaccucuuaguuacauuuaaaacagcacacgcgaagaaacaagagguagugguucucggaucacaagaaggugcaaugcacacugccuuaacaggugcaacagaaauacaaaccagcgggaccacuacuauauuugcaggacaucucaaaugcagacuaaaaauggauaaacugacauuaaagggaauguccuacgugauguguaccggcuccuuuaaauuagaaaaagaaguagcggaaacgcaacauggaacugugcucgugcagauuaaauaugaaggaacugacgcgccaugcaagaucccauucucgacccaagaugaaaaaggaguaauucaaaauggacgucugauuacugcaaaccccauagugacagauaaggaaaagccuguuaauauagaagcggaaccaccuuucggagaaaguuacauaguuauuggaguaggagagaaggcuuuaaaguuaaguugguuuaagaaaggaaguaguauaggaaagauguuugaagccacagcgagaggggcuaggcgaauggcaauuuuaggugauacugcuugggacuuuggcaguaucgguggaguuuucacaucgguaggcaaacuuguacaccaaauauucgggacggcauauggagucuuauuuucaggugucaguuggacuaugaaaauaggaauugguguucuuuuaacguggcuuggacucaauagucgaucuaccucucuaucuaugacauguauugcagucggacuugucaccuuauaccuuggggugauggugcaggcggauucugggugcguaauaaauuggaaaggucgugaacuaaaguguggcucugggauuuuuguaacgaaugaggugcacacauggaccgaacaauauaaauuucaggcugauuccccaaaacggcuaucagcagcgaucgguaaggcaugggaagaggguguaugcgguauacguuccgcaacccguuuagaaaauauuauguggaaacaaauaucaaacgaacuuaaccacauacuguuagaaaaugauaugaaauuuaccgugguugugggugauguuguagguauuuuagcucaagguaagaaaaugauucguccucagccaauggagcacaaauauucguggaaaucuugggggaaagcuaaaauuauaggugcagaugugcaaaacacgaccuucauaaucgauggaccaaacaccccagaaugcccggaugaucaaagagcauggaauauaugggaaguagaagacuaugguuuugguauauuuacuacgaauaucuggcuuaaauuacgugacagcuauacccaggcgugugaucaucgacuaaugagcgcagcaaucaaagacagcaaagcaguucacgcugauaugggguacuggauagaauccgagaaaaacgagacauggaaauuggcaagagcuucauuuauagaaguuaaaacauguauauggccgaaaagucacacgcucuggucaaacggaguacuagaaucugaaaugguaauaccuaaaauuuauggaggaccaauaucacaacauaauuauaggccagguuacuuuacccaaacagcaggcccauggcaucuagguaaguuagaauuagacuucgacuuaugcgagggcacaaccguaguugucgacgaacacuguggcaacagagggccgagcuuacguacaaccacaguaaccgguaaaauaauccaugaauggugcugcagaaguugcacuuuaccgccauuaagauucaaaggcgaagauggauguugguaugggauggagauacgcccaguuaaagaaaaagaagaaaaccuugucaaaagcauggucuccgcagguucuggugaaguagacucuuucagucuagggcuucuauguaucagcauuaugauagaggaggucaugcggucacguuggagcagaaaaaugcuaaugaccggaacacuugcuguauuucuacuacuaauaaugggccaauuaacuuggaaugauuuaauaagacucuguaucauggugggcgcuaaugcaagcgacaggaugggcaugggaacuaccuaucuugcguugauggcaaccuuuaaaaugcguccaauguuugcaguuggccuacuguuuagaagacuaacguccagagaaguauuacuauuaaccaucggccuaaguuuaguagcuucaguagaacuuccaaauucuuuagaggaguuaggugauggacuagcaaugggaauaaugauacugaaacuauuaacggacuuucaaucucaucaauugugggcaacccuauuaucgcuuacguucauuaagacaacuuugagccuacacuacgcauggaaaacuauggcgaugguuuuaaguauagugucuuuguuuccguuguguuugagcacaacgucacagaaaacaaccuggcuaccgguuuuacucgguucucuaggauguaaaccguuaacuauguuucuaauugcugagaauaagauaugggggcgaaaaucuuggccgcuuaacgaagguauaauggcaguaggcguaguuuccauccuucugagcucucuucucaaaaaugaugugccacuugcgggaccacuuauagccggagggauguuaaucgcuuguuacguaauaagcgguucaagcgcggaucuuucauuagaaaaggccgcagaagugaguugggaagaggaagcagagcauaguggagcgucgcauaauauacuggucgaaguccaagaugacggaacuaugaaaaucaaggaugaagaaagagacgauacauuaacaauuuuacuaaaagcaacauugcuggcuguuucuggagucuauccuuuaucaauacccgcaacauuauuuguuugguacuucuggcagaagaagaaacaaagaucagguguccuuugggauacaccuucgccuccagagguagaaagagcaguucuggacgauggaaucuacagaauuaugcaacgcggccuauuggggaggagccagguagguguaggaguauuucaggagaacguguuccauacgauguggcauguaacaaggggugccguccucauguaucaagguaaacgccuggaaccuagcugggcaagugucaagaaagauuuaaucagcuacggcggcgguuggagacuacaggguagcuggaacaccggagaagagguucaaguaauagccguugaaccgggcaaaaauccgaaaaacgugcagacagccccggggacauuuaaaacaccggaaggagaagugggggcaaucgcucuagauuuuaaaccagguaccucuggcucacccauugucaauagagaaggaaaaaucguaggacuuuauggcaauggcguaguaacuacaagcggaacuuaugugucugcaauagcucaagcuaaagccucccaagaaggcccgcugcccgaaauagaagacgaaguauuucguaagagaaacuuaacaaucauggaucuacacccagguagcggcaaaacgaggagauaccuacccgcuauagugagagaagcgauaaaaagaaaacuaagaacguuaauucuagcaccaacuagaguagucgcaagcgaaauggcagaagcacugaaagggaugccuauaagauaucaaaccacagcugucaaaagcgaacacaccggaaaagaaauugucgaucugaugugccaugcaacauuuacaaugcgucuuuugucaccuguuaggguaccuaacuauaauaugauaauuauggaugaggcgcacuucacagauccuucuucgauugccgcacgaggauauauaaguacaaggguuggaaugggggaagcugcggcaaucuuuaugacagcaaccccuccaggaucgguagaagcguuuccucagucgaacgcaguaauacaggaugaggagagagacauuccggaacgaaguuggaacagugguuacgaauggauuacagacuuuccaggaaaaacgguaugguucguuccaagcauuaaaagugggaaugauauagccaauugucuuaggaaaaaugguaaaagagugauccaauuaagcagaaagacauucgacacagaauaccagaaaaccaaaaauaacgacugggauuauguagugacgaccgacauuagcgaaaugggggccaacuuuagagcugauagaguaauagacccaagaagaugucuaaagcccguaaucuuaaaagaugggccagaaagggucauauuagcaggcccgaugccugucacaguggcuagugcagcccaaagacgugguagaaucggacgcaaccauaacaaggagggagaucaauauauauacaugggccagccuuuaaauaacgaugaagaccaugcacacuggacagaggcaaaaaugcuguuagacaauauuaauacaccugaagguauaauuccugcauuauucgagccagaaagagagaaaucagcggcaauagauggugaguaucgacuacguggugaagccagaaaaacuuuugucgaauuaaugcgaagaggagaccucccugucuggcuuagcuauaagguagcaagcgaaggguuccaauacagugauagaagauggugcuucgacggugaacguaacaaccaagugcuagaagaaaauauggauguagagauuuggacaaaggaaggugaaagaaagaaacuuaggccacgcugguuagacgcuaggacguauagcgauccgcucgcacuucgagaguucaaagaguucgcagcagggagaagaucugugagcggcgaccuaauucuagaaaucggaaaacuuccacaacaucuaacacagcgggcucaaaaugcccucgauaaucuaguuaugcuucacaacagugaacaaggaggcagagcauacaggcaugcuauggaagaacucccggauacaauugaaacauugaugcuauuggcauugauugcgguuuuaacugggggcguaacauuauucuuuuugaguggacgcggacuggguaaaacauccaucggauuauugugcguaauggcuuccucugucuugcuuuggauggcaagcguugaaccucacuggauagccgccucuauuauacuugaauuuuuccucaugguccuuuuaauucccgagcccgaccgucaaaggacuccacaagauaaccaguuagcuuacguagugauaggguuauuauuuaugauccuuacaguggcagccaaugagaugggacuucuagaaacaaccaagaaagaucucggaauaggacaugucgccgucgaaaaccaccaucaugcaaccauguuagauguugaucuacauccagcaucggcauggacuuuauaugcaguagcaacuacgauaauaaccccaaugaugaggcacacaaucgaaaauaccacggcaaauauaucgcuaaccgcaauagcaaaccaagcagcuauuuuaaugggcuuagauaagggauggccgauaaguaaaauggauaucggagucccucuauuagcguuaggaugcuacagccaaguaaauccacuuaccuuaacagcugcaguacugauguuagucgcacacuaugcuauaauagguccugguuuacaagcgaaagcuaccagggaggcgcagaaacggaccgcggcagggauaaugaagaaucccaccguugaugguauuguugcaauagaucuagacccaguaguauaugaugcaaaauucgagaaacaacuaggacaaauaauguuauuaauauuauguacaucacaaauucuuuuaaugaggacgaccugggcacucugugaauccauuacucuugcuacagggccucuaacuacuuugugggaaggaucucccggcaaauuuuggaacacaacuauagcagucaguauggcaaauauuuuccgaggaucauaucuugcgggugcugguuuagcauucucgcuaaugaaauccuuagggggcggaagacggggaacgggcgcccaaggagagacccuaggcgagaaauggaaacgacaacugaaccagcuaagcaagagcgaauuuaacaucuauaagagaucagguauuauggaaguagauagaucggaagcgaaagaaggccuaaagagaggcgaaacgacccgucaugccguuucucgcgguacagcaaaacucaggugguucgucgaacgaaaucuagucaaaccagagggcaagguaauugaccuagggugcggaagagggggcuggucauacuauugugcuggucucaagaaaguaacagaagucaagggauauacuaaagguggcccugggauggaagaaccuauccccauggcgacaaacggcuggaaucucguaaaauuacauuccggaaaggauguuuucuucacuccaccugagaaaugcgauacucucuugugcgauauaggagaaaguagcccaaaccccacaauagaagaagguaggacuuugcgaguguuaaaaaugguggagcccuggcuacguggcaaucaauuuuguauuaagauacugaacccauauaugccauccgucguagaaacgcuugagcaaaugcaaagaaaacauggagguauguuagugagaaauccacugucuagaaacucaacacacgagauguauuggguaucaugcgggaccgggaacauagugagugccgugaauaugacuucucgaaugcuacuuaaucgauuuacuauggcgcacaggaaaccgacuuacgaacgagauguagauuuaggagcuggaacgcgacacguugccgucgagccagaaguagcaaaccuagauaucaucggacagcgcauugagaauaucaaacaugaacacaagucgacauggcacuaugaugaagauaacccuuacaagacaugggcauaccauggaagcuaugagguaaagcccucggguagugcgucuucaaugguuaacggugucguaaaacuucuaacaaaacccugggauguaauuccgaugguaacacagaucgcaaugaccgacaccacgccauuuggacaacagcguguuuuuaaagaaaaaguagacacacgaacaccaaaagcaaaacgcggcacagcacagauaauggaaguaaccgcuagaugguuauggggauuuuuguccagaaacaaaaagcccagaauauguaccagagaagaauuuacgcggaagguaagauccaaugccgccauaggggcaguguuuguagaugagaaucaauggaacagcgcuaaagaagccguugaggacgaaagauuuugggaucuuguacagaaagaacgagaacuucacaaacaggguaagugcgcuacauguguguacaacaugauggguaaaagagagaagaaauuaggugaguucggcaaagcuaaagguagcagggcaauuugguauaugugguuaggugcgcguuucuuagaguuugaggcuuuaggauucaugaaugaagaccauugguuuucucgugagaacucacuaaguggcguggaaggagaaggauuacauaaauugggauauauacuacgagauauaaguaaaauaccaggaggaaacauguaugcggacgacacugcgggcugggacacacggaucacugaagaugaccuacaaaaugaagcuaaaauuacugauauaauggagccugaacaugcauuacuagcaacgucaauuuucaaacuuacauaucagaauaaggucguccguguucaacgaccagcaaagaaugggacggucauggacguaaucucgcgacgggaccaacgagguucaggacagguaggcacuuauggacucaauacuuuuacuaauauggaagcccagcuuauaaggcaaauggaguccgagggcauauuuuuaccaucagaacuggaaacgcccaauuuagcggaacggguucucgacuggcuagagaaacacggagucgagaggcugaaaagaauggcaauaucgggagacgauuguguagucaagccuauagacgaucgauuugcaacagcucugacagcccugaaugacaugggcaaggucaggaaagauauaccucaaugggaaccaucaaaaggguggaaugacuggcaacaaguaccuuuuuguucucaccauuuucaccaguugauaaugaaagauggccgugagauuguaguaccgugcaggaaccaagacgaacucguagggagggcgcgcgucucucaaggagcgggguggucgcuccgagagacugcuuguuuggggaaaagcuaugcacaaauguggcaacucauguacuuccauaggcgagaccuaaggcuugccgcaaaugcuauuuguucggcgguaccaguggauuggguaccaaccucaagaacaaccuggucuauacacgcacaucaccaauggaugacaacggaagauauguugucaguauggaaucgagucuggauugaagagaaccccuggauggaagauaaaacccacgugucgucguggggugacguaccuuacuuagguaagagagaagaucaaugguguggcucuuuaauaggacuaacugcacgggcuaccugggccaguaauauucaggucgcaauaaaucagguaaggagacuuauaggaaaugagaacuauuuagauuacaugacaucaaugaaacguuuuaaaaaugaaggagauccggaaggagcauugugguga

SEQ ID NO: 21516 - RNA, 9879 nt, Artificial Sequence
  derived and/or modified CDS sequence (opt6) from DENV-1__FJ024457__SS-prME
ucgguaacuauguuauugaugcuuaugccgacagcacuagccuuccaucugacaacgagaggaggggaaccacauaugauuguaaguaaacaagaaaggggcaaaaguuuauuauuuaaaacuuccgcgggggucaauaugugcaccuuaauagccauggacuuaggagaacuaugugaagauacuaugacuuauaaauguccccggaucacugaaacggaaccagaugauguugauugcugguguaaugcaacagauaccuggguaaccuauggaacuugcucucaaacaggagaacauaggcgggauaaacgaagcguagcucuagccccacaugucggcuuaggguuggaaacaagaacagaaacguggaugaguucggaaggagcauggaaacaaauacaaaggguagaaacaugggcccuaaggcaucccggauuuaccguuauugcuuuguuuuuggcucaugcaauagguacuucaauaacacaaaaagguauuaucuuuauauuacuaauguuagucacacccagcauggcaaugcgguguguagguauugguucacgagacuuuguagaaggcuuaucaggggcaacauggguugauguagugcuugaacauggcagcugcgugacaaccauggcaaaagauaaaccgacucuggacauugaacuuuuaaaaacggaggucacgaauccagccguacuuagaaaauuauguauugaagcaaaaauaaguaacacuacaacagacucucgauguccgacacaaggcgaagcuacucuaguagaagaacaagaugcaaacuuuguuugcagaagaaccuuuguugacagagguuggggaaacggauguggacuguuugggaaaggcagcuuaauuacaugcgcgaaauuuaaauguguaaccaaacuggaaggaaaaauugugcaauacgaaaacuuaaaauacagcguaaucgucacgguacauacuggugaucaacaccaaguagggaaugagagcaccgagcacggaacuacugccacaauuacaccacaagccccaacaaccgagauucaauuaacagauuacggagcuuuaacgcuagauugcaguccacguacgggucuagauuuuaaugagaugguauugcucacaaugaaagaaaaaucauggcucgugcacaaacaaugguuucuugacuuacccuugccuuggaccuccggagcuaguacaagucaagaaaccuggaauagacaagauuuguuaguuacauucaaaaccgcacacgcuaagaaacaagaaguuguuguccuaggcagccaagaaggagcaaugcauacagcauugacgggcgccacagaaauucaaacuucagguaccacuacaauauucgcaggccaccuuaaaugucgauugaaaauggauaaguugacucuaaaggggaugagcuacgugaugugcacaggaucauuuaaacuugagaaggaaguagcagagacccaacacgggacaguccugguacaaauuaaauacgaaggcacggaugcuccaugcaaaauuccguucagcacacaagacgagaaaggagucacccaaaauggacgguuaauaacugccaacccaauuguuacggacaaagaaaaacccguuaauauagaagcggaaccgcccuucggagaaagcuauauuguaaucggcgcuggugagaaggcuuuaaaacuaucaugguuuaagaagggaagcagcauagguaagauguuugaagccacggccagaggcgccagacgaauggccauacuuggggauaccgcuugggauuuuggguccauaggaggcgucuucacaaguguggguaaacugguacaccaaaucuuuggaacggcguauggaguacuguucucagggguaaguuggacuaugaaaauagguauuggagucuuauuaacaugguugggauuaaacaguagaucuacgucccucucaaugacguguaucgcaguuggauuagucacacuauaucucgguguuaugguccaggcagacucugguugugucauaaacuggaaagggagagaauugaaauguggaucugguaucuuuguuacuaaugagguacauacuuggacggaacaauacaaauuucaggcggauucuccaaaaagauuaagugcggccauugggaaagcaugggaagaaggugugugcgguauuagaucagcuacacgacuugaaaauauaauguggaaacaaauuucaaaugaguuaaaccauauccugcuugaaaaugauaugaaauuuacggucgugguuggggaugucgcggggauccuugcucaagggaagaaaaugauacgaccccaaccuauggaguacaaguacaguuggaaaagcugggguaaggcuaaaauuauaggcgcagacguacaaaacacaacuuuuauuauagaugguccuaauacuccagaaugccccgaugaucaacgagcuuggaauauaugggagguggaagauuacggauuuggaauauucacaaccaauauaugguuaaaauuacgugauucauauacacaagucugugaccaucgauuaaugagcgcugcgauaaaagacaguaaggcagugcaugcggacaugggcuacuggauugaaagcgaaaagaacgaaaccuggaaacuugcacgcgcauccuuuauugaaguuaaaacauguauauggcccaagucacacacucuauggaguaacggaguuuuagaaucagaaaugaucauaccgaaaauauacggggguccaauuucucagcacaauuacagaccggguuauuuuacacaaacugccgggcccuggcaucucggaaaacuagaacuugauuuugacuuaugcgagggaacuacuguaguaguugacgaacauuguggaaaccgaggaccaagccuacgaaccacuacaguaaccggcaaaauaauucacgaaugguguuguagaaguuguacguuaccgccacuaagauuucguggagaagaugguugcugguauggcauggaaauaaggccuguaaaagaaaaagaagaaaaucuaguaaaaagcaugguuucugcaggaucgggugagguagauaguuucucuuugggccuucuauguauaucaauaaugaucgaggaaguaaugaggucaagauggucuaggaaaauguuaaugacaggaacuuuagcaguauuuuuccuacuaauaaugggucaacugacguggaacgauuuaauaagacucuguauuauggucggugcgaacgccucagaccgcaugggaauggguacaacuuaccuagcacuaauggcaacuuuuaaaaugagaccaauguucgcagugggauuacuuuucaggcgauugacaucacgugagguacuauuacuaacgauaggguuaucuuugguugcuaguguggaguuaccgaacaguuuagaagaacuuggggacggccuugccauggggauaaugauacucaaauuauuaaccgauuuccaaucccaucagcuaugggcaacacuauugucguuaacuuucauaaagacuacuuuuaguuuacacuacgcguggaaaacgauggcuaugguuuuauccauaguaucacuauuccccuuaugucuauccacaaccucgcaaaagacaacguggcucccuguccuacuugguagucucgguugcaaaccuuuaacaauguucuuaauagcagagaacaagaucuggggucgacgaagcuggccccuaaaugaagguauaauggccguagguauuguaucaauauuauugaguucccuuuuaaagaaugacguaccacuagcaggaccacuaaucgcgggugguauguuaauagccugcuacgucauauccggaucgucagcugaccucucacuugaaaaagcagcagaagugucaugggaggaggaggcggagcauucaggugcuucacacaacauucuagucgagguacaagaugacggaaccaugaaaauuaaggaugaagaaagagaugauaccuuaacuauacuauuaaaagccacccuucuagcuguauccgguguauacccguuaucuauacccgcaaccuuauuugugugguauuucuggcagaaaaagaaacaaagaucaggaguacuuugggacacacccaguccgccagagguugagagagcaguucuagacgacggaauuuaccguaucaugcagagaggcuuacucggucgaagccaaguaggaguugguguauuccaagaaaauguauuccauacuauguggcauguuacaagaggggcaguauuaauguaucaagggaaacgacuugaaccauccugggcgucagugaagaaagauuuaauaucauaugguggaggguggagauuacaggggucuuggaauacuggggaagaaguccaagucauagcuguagagccaggcaaaaauccaaagaauguacaaacugcaccaggcacauuuaagacacccgaaggggaagucggugcuauugcuuuagauuuuaaaccaggaacaucaggaucaccuauagugaauagagaagggaaaauaguagggcuguauggaaacggagugguaacuaccucagggacuuacgugagugcaaucgcgcaagcgaaagcaagucaagaggguccuuugccugaaaucgaggaugaaguuuuuagaaaaagaaaucucacaauaauggacuuacauccggguucuggcaaaacccgcagauaccucccagcuauaguacgcgaagcaauuaaacggaagcucaggaccuuaauauuggcaccgacccgaguaguggcgucugaaauggcugaagcucuuaaaggaaugccuaucagauaccaaacuacugcgguuaaaucagagcacacaggaaaagaaauaguagaucuaaugugucacgcaacguucacaaugaggcuauugagcccaguuaggguaccuaacuauaauaugauaauuauggacgaggcucacuucacugaucccucuagcauagcagcgcgcggauauaucucuacccguguggggaugggugaagcggcugcuauuuuuaugacagcuacaccaccagguuccguugaggcuuuuccccaaaguaaugcagugauacaagaugaagaaagagauauuccugagcgcucuuggaacagugguuacgaauggauaacagauuucccaggaaaaacgguaugguuuguuccuagcauuaagucaggcaaugacauugcgaacuguuuaaggaaaaauggaaaacgggucauacaauuaaguaggaaaacauuugacacagaauaccagaaaacaaagaauaaugauugggacuauguuguaacgaccgacaucucagagaugggagccaauuuuagagcugauagggucaucgauccaagaagaugucuuaagccaguaauuuugaaagacggaccagaacgcguuauuuuggccggcccuaugccggucacaguagccucagcggcucagcggagagggagaauaggacguaaucacaauaaagaaggugaucaauacauauauaugggccagccuuugaauaaugaugaagaucacgcacauuggaccgaagcaaaaaugcugcuagacaacauaaauaccccugaaggaauuaucccagcauuauuugaaccugaaagggaaaaaucagcagcuauugauggugaauauaggcuaagaggugaagcacguaagacauuuguugaauuaaugagaagaggagauuuaccggucuggcuuaguuacaaaguugcaucagaagguuuccaauauagugauaggcggugguguuuugauggagagaggaauaaucaaguguuagaagagaauauggaugucgagauuuggacuaaggaaggagaaaggaagaaauuacguccaagguggcucgacgcacgaacuuauagugauccauuagcccuucgagaauuuaaagaguuugcggcaggucgacgaaguguaucaggagaucuaauacucgagauaggaaagcugccacaacacuugacgcagagggcacaaaaugcucuugacaauuugguaaugcugcacaauucugaacaggguggucgagcuuacaggcaugcaauggaagaauuaccagauacaauugaaacgcuuaugcuucucgcccuuauugcaguauugacggguggagucacuuuauucuuuuuaagcggaagagguuuaggcaaaaccucgaucggccuauugugcguaauggcgucuucgguacugcuuuggauggcuagcguagaaccucauuggauagcagcuucaauuauuuuggaguucuuccuuauggucuuauuaauaccugaaccagauagacagcguacgccucaagacaaucagcucgcauacguaguaauaggucuguuguuuaugauucuaaccguagcggcaaaugaaaugggauuacucgaaaccaccaagaaagaccuugguauuggacacguugccguugaaaaucaucaccaugcggcaauguuagacguagauuuacacccggcuagugcauggacgcuauaugccgucgcaacgacuauaauaacaccaaugaugcgacacacaauugaaaauacaaccgcaaauauaagccuaaccgcaauugccaaucaagcugcaauacuaaugggucuagauaagggauggccaauaucgaagauggacaucggaguaccacuucuagcacugggauguuacagccaaguaaauccacuaacacuuacagcagccguuuuaauguuaguggcccauuacgcuauaauugguccgggacuucaagcuaaggcaacaagagaagcucagaaaagaacugcagcugguauaaugaaaaaccccaccgucgacggaauaguugcuaucgacuuagacccaguaguauaugacgcaaaguuugaaaaacaauuaggucagauaauguuacucauauugugcacaagccaaauccuuuuaaugagaacuacaugggcauugugugaaagcaucacacuugcuacgggaccccuuacuacccugugggaaggaucgccaggaaaauuuuggaacacaacaauagcagugucaauggcgaauauuuucagagguucuuaucuagcaggagccgggcuugccuuuucacuaaugaaaucacuaggugggggaaggcguggcacgggcgcccaaggagaaacccuaggugagaaguggaaaagacaacugaaccaauuaucgaaaucagaguuuaacacauauaaacgaagcgguauuauggagguagaucgauccgaagcaaaggaaggucuaaagcgaggagagacaacaaagcaugcagucagccgaggaacugcgaaacugcggugguuugucgagcgaaauuuaguaaaaccagaaggaaaaguuauugaccucgguuguggacgaggcggcuggagcuauuacugugcaggcuugaaaaagguaaccgaaguaaaaggauacacuaaaggcgguccagggcaugaagaaccgauaccuauggcuacuuacgguuggaacuuaguuaaacuacauucuggaaaagauguauucuuuauaccuccugagaaaugugauacgcugcuaugugauauaggggagucaagcccuaauccaacuauagaagaaggcaggacccuuaggguacuuaaaaugguagaaccgugguuaagagggaaucaauucugcaucaaaauauuaaaucccuacaugccuaguguaguugagacccuugaacaaaugcaacggaagcacggcggcaugcuagugcguaacccuuugagcagaaacaguacacaugaaauguauuggguaaguugcgguacagguaacaucguaucagcagugaacaugaccaguagaauguuacuuaauagauuuaccauggcgcaccgaaagccaaccuacgagcgcgauguggaucuaggagcaggcacacgacauguugcggucgaaccggagguagcaaauuuagauauaauuggacaacguauugagaacauuaaacacgaacacaaaaguaccuggcauuacgaugaagauaacccauacaaaacaugggccuaccaugguucauaugaagugaaaccaucagggagcgcauccucuaugguaaacgggguagugaaacuauugacgaagccaugggacgugauaccuaugguuacccaaauagccaugaccgauacuacuccuuucgggcaacaaagaguuuuuaaagaaaaagucgauacucggaccccaaaagccaaaagagggaccgcccaaauaauggagguuacugcuaaauggcuaugggguuuucuuucucgaaauaagaaaccuagaauauguacccgugaggaguucacacgaaaaguucgcaguaaugcugcuauuggagcaguguucguagaugaaaaucaauggaacucagcaaaagaagcaguggaagaugaaagguuuugggaucuaguccauagggagagagaacuucauaaacaggguaagugugcaaccugcguauauaauaugaugggaaaacgcgagaagaaauuaggggaauuuggcaaggcaaaaggaagcagggccauuugguauauguggcugggugcccgguuccuagaguucgaagcgcuaggcuuuaugaaugaagaccauugguucucccgagaaaauucucucucgggcguagaaggugagggcuugcauaagcuggguuacauucuuagagacauaucaaaaauacccggcgguaacauguaugcugaugauaccgcuggaugggacacgcgaaucacagaggacgacuugcaaaacgaagccaggauuaccgauauuauggaacccgaacacgcguuacuagcucgaucgauauucaaguuaaccuaucagaauaaaguagugagaguucagcggccugccaaaaacggaacgguaauggacguuaucagucgaagagaucaacgggguucaggucaagucggaacuuauggucuuaauacauucacuaauauggaggcacaauuaauacgucagauggagagugaaggcauauuuagcccuucagaacuagaaacgccgauauuagccgaacgaguacuugauugguuagaaaaguaugggguggaaagauuaaaacgaauggcuauaucuggugaugacugcgucguaaagccgauagaugacagauucgcaacagcguuaaccgcuuuaaaugacauggguaagguacggaaagauauaccucaaugggaaccaaguaagggguggaaugauuggcaacagguaccguucugcagccaucacuuucaucaacucauaaugaaagacggaagagaaauaguagucccgugucgaaaucaagaugaguuaguuggucgagccagaguaucucaaggagcaggauggagucucagggagacagcuugucuaggcaagucuuaugcucaaauguggcaacuuauguauuuucacagacgagauuugcgauuagcagccaacgcuauauguuccgcaguacccguugacuggauuccaacaucgagaacgacguggucuauucacgcacaccaucaauggaugacaacagaggacaugcucaguguauggaacagaguuuggauugaagaaaauccguggauggaagacaaaacacacauuaguuccuggggcgauguaccuuacuuagguaaacgcgaagaucaaugguguggcucauuaaucggauuaacggcccgagcaacuugggcaacaaauauccaaguggcgaucaaucagguuagaagguuaauuggaaacgagaauuauuuagauuauaugacaaguaugaaacguuucaaaaaugagagcgauccugaaggagcauuaugguag

SEQ ID NO: 21517 - RNA, 9879 nt, Artificial Sequence
  derived and/or modified CDS sequence (opt6) from DENV-1__FJ205881__SS-prME
ucagugacgauguuacuacuauuaaugcccaccgcauuagcauuucaucugacuacgagagggggugaaccccauaugauaguuucaaaacaagaacgcgguaaaagucuccuuuucaaaacuucagcgggugugaauaugugcacacucauagcaauggauuuaggagaacuaugcgaagauacuaugaccuacaaaugcccaagaauaacugaaaccgaaccagaugauguagauugcugguguaaugcuacagauacaugggucacauacgguacaugcagucaaacgggagaacaccgcagagauaaaagguccguagcccucgccccucacguuggcuuggguuuggaaacaagaacugaaacuuggaugagcucagagggggcuuggaaacaaauacaaagaguagaaacuugggcucuccggcauccugguuuuacaguaaucgcccuauuuuuagcucaugcaauagguacaaguaucacucaaaaaggaaucauuuuuauauuacuaaugcucguaacaccuucaauggcgaugagaugcguaggcauaggaaguagagauuuugucgaaggacuuucuggagccacguggguagauguagucuuggaacauggcucuuguguaacaacuauggcuaaagauaaaccaacguuagauauagagcuacucaaaacugaaguuaccaauccugcuguucucagaaaacuuugcauagaagcaaaaaucaguaauacaacuacugacucgaggugcccuacucaaggagaggccacccuaguagaggaacaagacgccaacuucguuugcagacgcacauuuguugauagagguugggguaacggaugcggacuauuuggaaaaggaucucuaaucacuugugcaaaauuuaaauguguaacaaaauuagaaggcaaaauagugcaauacgagaauuuaaaauauucgguaauagucacaguacacacaggagaccaacaccaagugggaaacgaaaguacagagcauggaacaacagcaacaauuacaccgcaggcuccaacgacagaaauacaauugacagacuauggugcacucacauuagauugcaguccccguacaggucucgauuuuaacgaaaugguauuauuaacgaugaaagagaaaucaugguuaguacacaaacaaugguuucuagaccuuccauuaccauggacuagcggugcgucuacuucccaagaaaccuggaauagacaggaccuuuugguaacguuuaaaacggcacacgccaagaaacaggaaguuguuguucuaggaagucaagagggcgcuaugcauaccgcauuaacuggggccaccgaaauccaaacaaguggaaccacaacuauuuucgcgggacacuuaaaaugcagauugaaaauggacaaacucacguuaaaagggauguccuacguuauguguacuggaucuuuuaaauuagaaaaagaauuagcugaaacacaacauggaacggugcuuguucagauuaaauacgaaggaaccgacgcaccguguaaaauaccauucaguacccaagacgaaaaaggagugacucaaaauggacgcuuaaucacugcuaacccgaucguuacggauaaagaaaagccugugaacaucgaagcugagccaccguucggugaaaguuauaucguaauuggggcgggcgaaaaagcguugaaauugucaugguucaagaaagggucaagcauaggaaagauguuugaagcaacugcaaggggugcuagaagaauggcaauuuuaggggacacagcuugggauuucgguuccaucggaggaguauuuaccucuguagguaaacuuguucaccagauauuuggaaccgcuuacggaguacuuuuuagugguguaucauggacgaugaaaauuggcauagguguguuacuaacaugguuaggccugaacucuagaucuacaagucuuucaaugacaugcauugcaguagggcuugucacguuguaccuaggaguaaugguucaagcagauucgggcugcguaauaaacuggaaaggucgggaacuuaaauguggaaguggaauauuugugacaaaugaaguccauaccuggacugaacaguacaaauuucaagcggacucgccaaaaagauuaagcgccgcuauagggaaagcaugggaagaagggguaugugggaucagaagcgcaacaaggcucgaaaacaucauguggaagcaaauuucaaacgagcuuaaucauauacuucuggaaaacgauaugaaauucaccgucgucguaggagacguugcgggaauauuagcccaaggcaagaaaaugauacgcccacagccgauggaauauaaguacagcuggaaaagcugggggaaagcgaaaauuaucggggcagauguacaaaacacuaccuuuauaauugauggaccuaacacgcccgaaugcccugaugaccagcgagccuggaacauuugggaagucgaggacuaugguuuugguauauuuacuacuaacauuugguuaaaauuaagagacuccuauacacaagugugcgaucaucguuuaaugagcgcggcuauaaaagacucaaaagccguacacgcugauauggguuauuggauugaaucugagaaaaaugaaacguggaaacuugcgagagcgagcuuuauagagguaaaaaccugcauauggccaaagagucauacauuauggaguaacgguguccuugaaucagaaaugaucauucccaagauauauggcggucccauuucacaacauaacuaucguccaggauauuucacacaaacugcgggaccuuggcacuuagggaaauuagaacuagacuuugaccuaugugaaggaaccacuguaguaguugaugaacauugcgggaaucguggucccagcuuaagaacaacaacggucacaggaaaaaucauacacgaauggugcugccguagcuguacauuacccccacuuagguuucguggugaagacgguugcugguaugggauggaaaucaggcccguuaaagagaaagaagagaaucugguaaaaagcauggucuccgcuggcagcggggaaguggauucauucagcuugggguugcuuuguauuagcauuaugauagaagaggucaugcguucccgcuggucaagaaaaaugcucaugacagguacucuugcaguguucuuuuuauuaauuaugggccaacucacguggaacgacuugauuaggcucugcauuaugguuggggcaaaugcuagcgaccgaauggguaugggaacaacauauuuagcuuugauggcaacguuuaaaaugcgaccaauguucgcgguagguuuauuguuccguagacugacgaguagagaaguguuguugcugacaauaggauuaagccuagucgcgucaguugagcuaccuaacagccuugaggaauuaggcgacggucuagcaaugggaaucaugauccuaaaauuauuaacagauuuccagucccaccagcuaugggcaacauuauuaagccuaacauuuauaaaaacaacguucucuuuacauuaugcuuggaaaaccauggccauggucuugagcauagucagccuauuuccauuaugcuuaaguaccaccagccagaaaacgacguggcuucccgugcuccuaggaagucuaggaugcaaaccguugacuauguuuuuaauugcugaaaacaaaauuuggggcagacgcucauggccucugaacgaggggauaauggcugugggaauuguaucgauucuccucaguucacuuuugaaaaacgauguccccuuggccggaccuuuaauagcuggaggcauguugaucgcauguuacguaauuuccgggagcagugcagaucugucuuuagaaaaagcagcagagguaaguugggaggaagaggccgaacacucuggugcuucccauaauauauuagucgagguacaagaugauggcacaaugaaaauuaaagacgaagaaagagaugacacacucacuauucuacucaaagcaaccuuauuagcaguaaguggugucuauccauuauccauaccagcaacccuguuuguaugguacuucuggcagaagaagaaacaaagaucaggaguacuuugggauaccccuagcccuccagaaguggaacgcgcuguccuagaugacggaauuuacagaaucaugcaaagaggacuauuagggcgaagucaaguuggaguaggaguuuuucaagaaaacguauuccauacuauguggcacguuacacguggagcaguucugauguaucaagggaagagacuugaaccaucuugggcaucagugaagaaagaccuaauaucguacggaggaggauggagacuacaagggucguggaacacuggagaggagguucaaguaauagcuguggaacccgguaaaaauccgaaaaauguucaaacagcaccggggacguuuaagacaccggaaggagaaguaggugcgauagcguuagauuuuaaaccuggaacaagcggcucgccaauugucaacagagaggggaagauaguagggcuauauggaaaugggguaguaacaacaucgggcaccuauguaucagccauagcacaagcuaaaacaagucaagaaggaccauugccagagaucgaagaugagguguuucgcaaaagaaaccuaacaauaauggaucuacauccgggaagugguaagacuaggagauauuuaccggcaauaguacgggaggcaaucaaaagaaaauuacgaacuuuaaucuuagcuccuacgcgaguaguagcaagcgagauggcagaggcuuuaaaaggaaugccaauuagauaccagacuaccgcggucaaaucugaacauacaggaaaagaaauaguggaccucaugugucacgcaacguucacuaugcgauuauuaucuccaguucgugucccuaacuauaauaugauaauuauggacgaagcacauuuuaccgauccaucaucaaucgcagcaagaggauacauaucuacuaggguagguaugggcgaggcugcagcgaucuuuaugacggcaacaccaccaggaucaguagaggcauucccacaaagcaaugcuguaauucaagacgaagagagagacauaccagagagaaguuggaauagugguuaugaauggauaacugacuuuccuggaaagacaguaugguuugucccuagcauaaaauccggaaaugacauugcaaauuguuuacgcaaaaacgguaaaaggguaauucaacuuagcagaaaaacguucgacacugaauaccaaaagaccaaaaacaacgauugggauuauguaguuacaaccgauauaucggaaaugggugccaacuucagagcugauagaguaauugauccucgccggugucuaaagcccguaauucuuaaggaugggccugaaagaguaauauuagccggaccaaugcccgucacuguagccagcgcagcacaaagaagaggaagaauugggcguaaccauaauaaagagggugaucaauauauuuacaugggacaaccauugaauaacgacgaggaccaugcgcauuggacggaagcuaaaaugcuauuggacaauaucaauacuccugaggguauuauaccggcauuguucgaacccgaacgagaaaagucagcagcgaucgacggugaauauagacucaggggugaagcaaggaagacguucguugagcuuaugagacggggugaccuuccaguuuggcucucauacaaaguagcgucugaaggguuucaguauucugacagaagaugguguuucgacggggaaagaaauaaucagguuuuagaagaaaacauggauguugaaauuuggacgaaagagggugagcgaaagaaauugagaccgagauggcuugacgcgcgcacauacuccgaucccuuagcacuacgcgaauuuaaggaauuugcugcaggacggagaucgguaucgggagaccuaauucuagagauaggaaaauugccccagcauuuaacgcaaagagcacaaaaugcacuggauaaccuggucaugcuacacaauagugaacaagggggucgggcauacagacacgcuauggaagaacuaccugacaccauugaaacacuaaugcuucuagcuuuaauagcugugcucaccggaggugucacauuauuuuuccuaaguggaagaggucucgguaaaacaaguauagguuuacuaugcgucauggcuucuucagugcuauuauggauggccucaguagaaccgcauuggauugcagccucgauuauacucgaauuuuucuuaaugguguuauugaucccagaaccggauaggcaaagaaccccucaggauaaccagcuagcauacgucguuauuggcuugcuguuuaugaucuuaacgguagcugcuaaugaaaugggguuacuagagacaacuaagaaagauuuggguauaggacaugucgccgucgaaaaucaccaucacgcagcaauguuagauguugaucugcauccugcuucagcauggacccuguacgcuguagcaacuacaauuauuacaccuaugaugcgucacacaauugagaauacaaccgcaaauauaucacuuaccgcgauugcuaaucaagcagcaauacuaaugggacuagauaaagguuggccuauaucaaaaauggacauaggagucccccuacuagcauuagggugcuacagccaagucaacccacuaacacuaaccgcagcuguuuuaaugcuaguugcucauuacgcaauaauagguccggggcugcaagcuaaggcuacuagggaagcacaaaaacguacagcagccggaaucaugaaaaacccgaccguagaugguaucguggccauugaucuagauccagugguuuaugaugcaaaauuugagaaacaauuagggcaaauaaugcuauugauucugugcacaagucaaauauugcucaugcgaacuacuugggcauuaugugaauccaucacucuugcaacagggccgcuuacaacguugugggagggaucaccagguaaauucuggaauacaacgauugcaguuaguauggcaaauauuuucaggggcagcuaucuugcuggugcgggcuuagcauuuagcuugaugaaaagucuuggaggaggacguagagggacaggggcgcaaggggaaacucuaggagaaaaauggaaaaggcaguuaaaccagcuauccaaaucagaguuuaauacauauaaaagaucaggaauaauggagguagacaggucagaggccaaagaaggucugaaacggggcgaaacaacaaagcacgcggugucuagaggaaccgcuaaauuaagaugguuuguugaaagaaacuuagucaagccagaaggaaaagugauagauuugggauguggacggggugguuggucguauuacugcgcuggacucaaaaagguaaccgaaguuaagggauacacuaaaggggguccuggacaugaggagccaauaccuauggcaacauauggauggaaccuaguuaaacugcauucggguaaagaugucuucuuuauaccaccagaaaaaugcgauacuuuauugugugacauaggagaaucauccccaaacccgacuauagaggagggacgaacgcuacgcguguuaaaaaugguagaaccuuggcuaaggggaaaucaguuuugcauaaagauucugaauccguauaugcccucaguuguggagacuuuagagcagaugcaacgaaagcacggugguauguuaguuagaaauccacugucccgaaauaguacucacgaaauguacuggguaucaugcgguacagggaacauuguaucagcaguaaacaugacaaguagaaugcuucugaaccgauucacuauggcccauaggaagccuacuuacgagagagauguagacuuaggagcuggcacacgacacguggcgguggagccugaagucgcgaauuuagauauuauuggacaaagaauugagaauauaaaacacgagcauaaaagcacguggcauuaugaugaagauaacccauauaaaacuugggcguaccaugguucauacgagguuaaaccuagcggaucugcaucaaguauggucaacggagucguaaaauugcuaacaaaacccugggauguaaucccuaugguaacgcaaaucgccaugacagauacuacgccguuuggacagcaacgaguauucaaagaaaaaguugacacuaggaccccaaaagcuaagagagggacagcgcaaaucauggaggucacugcuaaauggcuuuggggauuuuuaucuagaaacaagaaacccagaauuuguacccgagaggaguuuacucgaaagguccggagcaaugcugcaaucggugcaguauuugucgaugaaaaucaauggaacuccgccaaagaggcgguagaagacgaacgauuuugggaucuuguccauagagaaagggaguuacauaagcaggggaagugugcuacuugcguauauaauaugaugggaaagagagagaagaaauuaggugaauuuggaaaagccaaaggcagcagggcaaucugguauaugugguugggggcaagauuccuagaauuugaggcccuuggauuuaugaacgaagaccauugguucaguagagaaaauucacuuagcggcguagaaggggaaggguugcauaaacuaggcuauauccugcgagauauaucaaagauacccggugguaacauguaugcugacgacaccgcgggaugggauacaagaauaacagaagaugauuuacaaaaugaagccaggauaaccgauauuauggaaccagaacacgcucuuuuagcaaaaaguauuuuuaaguuaacauaucaaaauaaagucguacgaguacaaaggccagcuaagaaugguacagugauggaugucauuagcagaagagaucaaagaggaucaggccaaguaggaacuuauggcuuaaauacauuuaccaacauggaagcgcaauuaauccgucaaauggaaucagagggaauauucaguccauccgaacuggagaccccaaacuuggcagaacgaguucucgauuggcucgaaaaguauggugucgaacgucuuaaaaggauggcaauaucaggagacgauuguguggugaaaccuaucgaugaccguuuugcuacggcacuaacugccuugaaugauaugggaaagguuagaaaggacauaccccagugggaaccuuccaaggguuggaaugauuggcaacaagugccauuuuguucccaucauuuccaucaacuaauaaugaaagauggacgagaaaucguuguaccauguagaaaucaagaugaauuaguaggucgagcgcgagugucacaaggggcaggauggucucugagagagacagcuugcuuggggaagucuuaugcacaaauguggcaauuaauguauuuccaccgaagggaccugcgacuugcagcaaacgcgauaugcucggcuguaccgguagacuggauaccuacauccagaacaacaugguccauacaugcacaccaucaauggaugacuacggaagacauguuaucaguauggaaccgagucuggauagaagaaaacccuuggauggaagauaaaacucauauaucaaguuggggagauguaccauaucuaggcaagagagaggaccaaugguguggcucacuaauagggcucacugcaagagcgacuugggcaaccaacauacaaguggcaauaaaucaggucagacggcugauugguaacgaaaacuaccuagauuacaugacgaguaugaaaagauucaaaaacgagagugaucccgagggagcucuaugguga

SEQ ID NO: 21518 - RNA, 9879 nt, Artificial Sequence
  derived and/or modified CDS sequence (opt6) from DENV-1__FJ205882__SS-prME
aguguaacuaugcuucuaaugcuuaugccaacagcgcuggcauuucaucuaacaacaaggggaggugaaccccacaugauaguuucuaagcaagaacgagguaaaucgcuucuuuuuaaaacuagugcagguguaaacauguguaccuuaauagcaauggaccuaggagaauugugugaggauacaaugacauauaaaugcccgagaauaacagaagcagaaccugaugauguggacugcugguguaaugcaacagauacuuggguuacguauggaacaugcucgcaaacaggugagcaccgaagggauaaacgcaguguggcacuugcgccucacguuggucuggguuuagagacgagaacugagacauggaugucaucugaaggagcuuggaagcaaauacagagaguagaaacuugggcccugagacaucccggauucacagugauagcacuauucuuggcccaugcuauuggaacuucaauaacucaaaaaggaaucauauuuauauuguugauguuaguuacaccuucaauggcaaugagaugcgucgggauaggcaguagagacuuuguggagggccuaucaggggccacauggguugauguuguuuuggaacacggcaguuguguaacuacuauggcuaaagacaaaccgacgcuugauauagaauuacuuaagacggaggugacuaacccagcuguacuucggaaacuaugcauugaagcuaaaauuucgaauacuacuaccgauucgcgguguccaacccaaggugaggcaacccugguagaagagcaggaugcuaauuuuguaugcaggcggacuuuuguugaccgagguugggguaauggauguggccuguucggaaaaggaucuuuaauuacuugcgcgaaauucaaaugcguaacuaaacuggaaggaaaaauaguacaauaugaaaaccuaaaauauaguguaauaguaacaguucacacaggagaucaacaucagguaggaaaugagucaaccgaacacggaacuacagcuacaauuacaccgcaagcaccgucuacagaaauccaauuaacagauuacggagcccucacguuggauuguucaccaaggacuggacucgauuucaaugaaaugguacuuuugacuaugaaagagaagucauggcugguacacaaacaaugguucuuagaucuaccacuuccguggaccucaggcgcuucgacuucacaagaaacauggaaccgacaagacuuacuaguaacuuucaaaacagcacaugcuaagaaacaggaaguagucguacuaggcucucaagagggagcgaugcacacugcuuuaacgggugcuaccgagauacaaacaucggggacaaccaccauauuugccggucaucuaaaaugucgucugaagauggauaaauuaacauugaaaggaaugaguuauguuaugugcacugguaguuucaaguuggagaaagaaguugcagaaacgcagcaugggacgguauugguccagauuaaauaugaaggaacagaugcaccgugcaagauuccuuuuaguacgcaagaugaaaaggggguuacacaaaacggacgucucaucacagcaaaucccauuguaacugauaaagaaaaaccaguuaauaucgaagcggagccaccuuuuggagaaucuuacaucgugauaggcgcaggugaaaaagcccuaaaauuaagcugguuuaagaaagggucaucgauuggaaaaauguucgaggcuacugcacgaggagcacgcagaauggcaauacuuggggacaccgccugggauuucgguucaauaggaggaguauuuaccucuguaggaaaacuuguacaccaaaucuucggaacugcuuauggugugcuuuuuagcgggguuucuuggacgaugaaaauuggaauagguguacuacuaacuugguuaggacuaaauagccguuccacaagcuuaaguaugacgugcauagcaguaggucucgugacguuauaucucggaguuaugguucaagcagacucuggguguguuauuaauuggaagggacgagaauuaaagugcggaucggguaucuucguuacaaaugagguccauacguggacagaacaauacaaauuccaagccgacagcccaaaaagacugagugcugcgauaggaaaagcuugggacgaagguguaugugguauacgaucugcuacaaggcuagagaauauuauguggaagcaaauuucuaacgagcuuaaucacauauugcuagagaaugauaugaaauuuacuguaguuguaggcgauguagcaggcauucuugcgcaaggcaaaaagaugauucguccacaaccuauggaauauaaguauucauggaagucguggggaaaagcuaaaauaauaggugccgacguccagaauacaacguuuauaauagacggaccaaacacuccugaaugcccggacgaccaaagggcuuggaauauauggaaaguggaagaccauggauuuggaauuuucccgacaaauauaugguugaagcuaagagauucauauacacaagucugcgaucaccgacucaugucagcggcaauuaaggacucaaaggccguacacgcagauaugggauacuggauugagagugaaaaaaacgaaacauggaaacucgccagagccaguuuuauugaaguuaaaacauguauuuggccaaaaagucauaccuuauggagcaacggaguucuugaaucagaaaugaucaucccaaaaauuuauggaggcccaauaagucaacauaacuaccgacccggcuauuucacucagacugccgguccauggcaucucggaaaauuagagcuagacuuuaaccucugugagggaacaacgguaguaguagacgaacauugcggcaauagaggcccgucuuuacgaacgacuacuguaacaggaaaaaucauacaugaaugguguuguaggucgugcacuuugccaccuuugagguucaaaggagaagauggauguugguacgguauggagauucgacccguaaaagaaaaggaggagaaccuaguaaaaucaauggugagugcgggcucuggcgaagucgacucguuuagucugggauuauuaugcauaaguauaaugauagaggaggugaugagaucuagauggucgcgaaagaugcuaaugacggguacacuugcaguauucuuuuugcuaauaauggggcaauuaacauggaaugacuugauucgauuaugcaucaugguaggcgccaaugcaucugaucgaaugggaaugggcacgaccuaucuagcacugauggcaaccuuuaaaaugcgaccaaugcuagccgucggauuauuauuuagacgauuaaccucgcgugaaguuuuauuauuaaccauaggacucucuuuaguagcgucaguagaauuaccaaacagucuggaagaacuaggagauggacuagcaauggggauaaugauacuaaaauuacugaccgauuuccaaagucaucaacuaugggcaacacuauuauccuugacuuuuauuaaaacuaccuauucuuugcauuaugcuuggaaaaccauggcuauggucuuaucaaucguaagucuauuuccuuugugucuaucaacuacaucacaaaagaccacauggcuuccuguucuauugggaucuuugggcugcaagccauuaaccauguucuugauagcagaaaacaaaaucugggggaggaaaucguggccacuaaaugaaggaauaauggcaguuggaauagucuccauacuauuaucuucgcuauuaaaaaacgaugucccauuggcuggaccguuaauagccggugguauguuaauugcgugcuacguaauaucaggaucaucggccgacuuaagcuuagagaaagcugcggaaguuucaugggaagaagaagcggaacacagcggugcaucacacaauaucuuaguugagguacaagaugacgguaccaugaagauaaaagaugaagaacgugacgauacgcuuacaauacuguugaaagcuacacuguuagccguaagcggaguauaucccuuaucuauuccugcuacgcucuuugucugguacuuuuggcagaaaaaaaaacagcgaucggguguucucugggauacaccaagucccccagagguugagagggcgguauuagaugauggaaucuaccggauaaugcaaagagggcuacuagguagaucacagguaggaguuggaguuuuucaagaaaauguauuucacacuauguggcacgugacacgcggagccguauugauguaccaaggaaaaagauuagaaccuagcugggcuucaguaaaaaaagacuuaauuagcuauggaggaggguggagauuacagggaaguuggaacacaggugaagaggugcaagucauagcaguagaaccagggaagaacccaaaaaaugugcaaacggcuccagggacauucaagaccagcgaaggggaaguaggagcuauagcacucgacuucaagccugguacuucgggaucgcccauaguaaauagagaaggaaagauaguggguuuauaugguaauggaguaguaacuaccucaggaacauauguaagugcaaucgcucaagcaaaggcaucacaagagggaccacuaccagaaauagaaaacgaaguauuuagaaaaaggaauuuaacuauaauggaucuacauccugguagugguaagacuagacgauaucucccagcgauagugcgugaagcaauaaagaggaaauuaagaacauuaaucuuggcuccaacacgaguaguggccucagagauggcugaagcguugaagggcaugccgauacgcuaucaaaccaccgcaguaaaaagcgaacacacagguaaagaaauuguugaccucaugugucacgcuacuuuuacaaugaggcuauuaaguccugugcgcguuccaaacuacaacaugauuauuauggacgaggcacauuucacagauccaucaucaauugcagcgagagguuauauaaguacucgaguugggaugggagaagcugcagcaauauuuaugacagcuacucccccagggucaguugaagcuuuuccacaaucgaacgcaguaauacaagaugaagaacgugauaucccugaacgaucguggaacuccggguaugaauggauaacggacuuucccggaaagacaguaugguucguacccaguauuaaaagcggaaaugacauugcgaauugcuuacgaaaaaaugguaaacgaguuauacaacugucaagaaaaacuuucgauaccgaauaccaaaagacaaaaaacaaugauugggacuauguuguaacaacggauaucagugaaaugggugcaaacuuuagagcggaccguguaaucgauccucguagauguuuaaaaccaguaauauuaaaagauggaccagaaagaguuauauuagcggguccaaugccugucacgguagcaagugcugcacaaaggcgaggaagaauagguagaaaucauaacaaggaaggggaucaauacaucuauaugggacagccacuuaacaaugaugaggaucaugcccauuggacugaagccaaaauguuauuagauaauaucaacaccccagaaggaaucauaccagcucuguuugaaccggaaagggagaaauccgcggcgauugauggagaguaucgucuuagaggcgaagcgagaaaaacuuucguagaauuaaugcgacgcggagacuuaccgguaugguuauccuauaagguugcuuccgaagguuuucaauauuccgaucgcaggugguguuuugauggagaaaggaauaaucagguauuggaagaaaauauggauguugaaaucuggacgaaagaaggugagaggaaaaaacuuagaccacgcugguuagaugcacguacuuauucagauccucuggcccucagagaguucaaagaguuugcagcaggucggaaaagcguaagcggugauuuaauacucgaaauaggaaaauuaccucagcaucuaacacaaagagcacaaaaugcauuagacaaccucguuauguuacacaacagcgagcaagguggaagagccuauaggcaugcgauggaagaauuaccagauacaauagaaacauuaaugcuuuuggcucuaauagcaguuuugaccgguggggugacccuauucuuuuuaucgggaagggguuuggguaagacguccauaggucuacugugugucauggcgucuucggugcuucuauggauggcaaguguagaaccacauuggauagcagcgagcauuauauuagaauucuuuuuaaugguucugcugauaccagaaccggauagacaaagaacuccgcaagacaaucaacucgcguauguggucauuggguugcuguuuaugauucuuacuguggcagccaaugaaaugggauuauuagaaacuacgaagaaagacuuagggauagggcauguagcaguggaaaaccaucaucaugcugcaaugcuagacguagauuuacauccugcgucugcauggacccuguaugccguugcaaccaccauaauaacaccaaugaugagacauaccauagaaaacacaacagcaaauauaucuuuaacugcaauagcaaaucaggcagccaucuuaauggggcuugauaaaggauggccgauaagcaaaauggauauagguguaccuuuauuggcacugggauguuauagccaaguuaacccucucacguuaacugccgcggucuuaaugcuaguagcccauuaugcuauaaucggacccggacuucaagcuaaagcaacacgugaggcacaaaagcgcaccgcugcagguauaaugaaaaacccuacuguggauggaauuguagcgauagauuuagauccagucguuuaugacgcaaaauuugagaaacagcugggacaaauaauguuauuaauacucugcacuagucagauuuuguuaaugaggacaacgugggcacuuugugagaguauuacgcuggccacgggaccguuaaccacacuaugggaaggaucuccagggaaauuuuggaauacgacaauagcaguuucgauggcgaacauauucaggggaagcuaucucgcgggagcuggguuagcuuuuucuuugaugaaaagcuugggaggggguaggcgagguacuggagcgcaaggagaaacauugggugaaaaguggaagcgucagcuaaaucaauugagcaaaagugaauuuaacacguauaaacgaagcggaaucauggaagucgaccgaucagaagcaaaagaagguuugaaaagaggcgaaacuacgaaacaugcugucucaagaggaacagcuaagcucaggugguucguagaaagaaaccuaguuaaacccgaaggcaaaguuauagaccucggauguggacgaggcggauggucuuacuauugugcaggccugaaaaaaguaacagaagucaaagguuauacgaaaggugguccgggacacgaagaaccuauuccgauggccacauaugguuggaauuuggugaaauuacacucaggaaaagauguauuuuuuauaccuccagaaaaaugcgacacacuucuaugcgacauuggcgaaucuagcccgaacccuacuauugaagaaggucgaacacugaggguccuaaagaugguugaaccuuggcuuagagguaaccaauucuguauuaaaaucuuaaaccccuacaugccuucugugguagaaacgcuagaacaaaugcaacguaagcauggggguaugcucguaagaaauccauuaucccguaacuccacacaugaaauguacugggucucuugcggaaccgggaauauugucucagcaguaaauaugacgagcagaaugcuuuuaaaucgguucacuauggcacauaggaagccaacuuaugaacgcgauguugaccuaggcgcggggacacgucauguagcaguugagccagaaguagcaaaccucgauauuauaggucaaagaaucgaaaacauuaagcaugaacacaaaucuacauggcacuacgacgaagacaaucccuacaagacgugggcuuaucacggaagcuacgaggucaaaccaaguggaagcgcaucgucgauggucaaugguguugucaaauuacucacaaaaccuugggacguaauaccaaugguuacgcaaauagcuaugacagauacuacaccuuuuggacaacagcggguauuuaaagaaaagguugacacgaggacacccaaggcaaaacggggaacugcacagauaauggaaguaacugcuaagugguuauggggauuucuuagcagaaauaagaaaccucggauuugcacaagagaagaauuuacaagaaaagucagaucaaacgcugcuauaggugcaguauuuguugacgaaaaucaguggaauucugcaaaagaagcgguagaagacgaaagguucugggaccuaguacauagggaaagggaacugcauaaacaagguaaaugugcaaccuguguuuacaauaugauggguaagcgagaaaagaagcuaggggaauucggaaaagccaaggguagucgggcgauaugguauauguggcugggugccagauuccuagaauucgaggcacuaggcuucaugaacgaagaucauugguuuucuagagaaaacucgcucaguggaguggagggugaaggguugcacaaauuaggauacauucucagagauaucucuaaaauaccgggagggaauauguaugcugacgacaccgcuggaugggacacucguauaacagaagacgaucuccagaacgaggcaaagaucacugacauaauggaaccugaacacgcccuucuggcuaagaguauauucaaacuaaccuaucaaaacaaagucguacgaguacaaagaccggcuaagaaugguaccgugauggauguaauauccagaagagaccaaagagggucgggucagguggguacguaugggcugaauacauucaccaauauggaagcucaacucauaaggcaaauggagucagaagguauuuucucaccaagcgaauuagagacuccuaauuuggcuggaagaguauuagauugguuagagaaacauggaguagagagguuaaaaagaauggccauaaguggagacgauugugucguaaaacccauagaugacagauucgcaaccgcacuaacugcauuaaaugacaugggcaagguuagaaaagauaucccucaaugggaaccuucgaaagguuggaaugauuggcaacaaguuccuuucugcagccaccacuuccaucaauugauaaugaaagacggacgggaaauaguaguaccuugccggaaucaggaugaacuuguaggacgcgcacgaguuucgcaaggcgcaggcuggaguuuaagggagacggcaugucucgguaaaaguuacgcucaaauguggcaauuaauguauuuucaccguagggauuuacgucuugcagcaaaugcaaucugcucggcuguuccaguagacuggguaccgacaucaagaacgacauggaguauacaugcgcaucaucaauggaugaccacugaagauauguugucgguuuggaaucggguuuggauugaagaaaauccguggauggaagauaaaacucacauaucaaguuggggagacgucccauaccuagguaaacgcgaagaucaaugguguggaucccuuauaggccuaacagcacgagcaacaugggcuacuaauauacaaguagcuauaaaccaaguaagacgauugauuggaaacgagaauuauuuagacuacaugaccaguaugaaaagauuuaagaacgaaagugaucccgagggcgcgcugugguga

SEQ ID NO: 21519 - RNA, 9879 nt, Artificial Sequence
  derived and/or modified CDS sequence (opt6) from DENV-1__FJ390388__SS-prME
ucuguuacaaugcuccuuauguuaaugccgaccgcucuugcauuucacuuaacgaccaggggaggugaaccacauaugaucguaucaaaacaagaacgugguaaaucuuuauuauucaaaacaucagcaggaguuaacauguguacacucauugcgauggaccuaggugaauuaugugaagacaccaugacguauaaauguccucgaauaacagaaaccgaaccagacgauguagacugcuggugcaacgcaacagauacuugggucacauaugguacgugcucacaaacgggagaacauaggcgagacaaacguagcguagcacucgcuccacacguaggccuuggucuugaaacaagaaccgaaacauggaugagcucagaaggugcauggaaacaaauacaaaggguugaaacaugggcccuaagacauccaggauucacagucauagcuuuauuccucgcacacgcaauuggcacaucuauuacacaaaagggaauuauauucauacuccucauguuggucacacccucuauggcaaugaggugcguagguauaggauccagggacuucguagaaggacuuucgggcgcuaccugggucgauguaguucuagaacacggauccugcguaacaacaauggcuaaagacaagccuacccuugauauugaauugcuaaaaacagaaguaacaaauccugcuguauuaagaaaacuauguauagaagcuaagauaagcaauacaacuacggacaguagguguccaacacaaggcgaagcuacgcuggucgaagaacaagaugcuaacuuuguauguaggcgaacuuuuguggauagaggaugggguaaugguugcggauuauuugguaaaggaucccucauuacaugugcuaaauuuaaaugcguaacaaaauuagaagggaagauaguucaauaugaaaacuugaaauauucggucauuguuacuguacauacgggggaccaacaccaaguggggaaugaaucaaccgaacauggcacaacugcaacaauaacuccucaagcgcccacaaccgagauacaauuaacagacuacggggcccugacucucgauuguuccccacgaacgggcuuagacuuuaacgaaauggucuuacuaacgaugaaagagaaaaguugguugguucacaagcaaugguuccuugauuuaccacuacccuggacaucuggggcuucaacgagucaagaaaccuggaaucgccaagacuuauuagucaccuucaaaaccgcacaugcaaagaagcaggaggugguagugcuuggcagccaagaaggagccaugcacacugcccucacaggugcaacugagauacaaacuagcgggacaacaacuauuuucgcaggccaucuaaaaugcagauugaagauggacaaacuuacuuuaaaaggcaugucauacguuauguguacaggaaguuuuaaguuagaaaaagaauuggcugaaacucagcacggaacuguauuaguacagauaaaguaugaaggaaccgacgcaccaugcaaaauucccuuuaguacacaagacgaaaaagguguaacacaaaacggacgacuaauuaccgcgaaucccauaguaacugauaaggaaaaaccaguuaauauagaagccgaacccccguuuggugaauccuauauaguaauuggagcaggcgaaaaggcacucaaacuaucaugguuuaagaaaggcuccucgauagguaaaauguucgaggcuacggcaaggggagcgcgacgaauggcgauacuaggggauacugcuugggacuuugggaguauaggcggaguauuuacuagcguagguaaacuuguucaccaaaucuuugggacugcuuaugggguauuguuuucagguguaaguuggaccaugaagauaggaauagguguucuaaugacguggcuagggcucaacucuaggucuacgucccuuucgaugacguguauagcgguugggcuaguaacuuuguaucuugggguaaugguccaagcugacucaggcugcguaauaaacuggaagggaagagaacuaaaaugcgggucagggauuuucguaacgaacgaaguacauacuuggacagagcaguauaaauuccaagcggauucaccuaagcgcuugucagcagcaauaggaaaagcgugggaagaaggaguaugcggaauuagaucugcaacucgacuugaaaauauuauguggaaacaaauaucaaaugaguuaaaucauauauuauuagaaaaugauaugaaauucacagucguuguuggagacgucgcugguauucucgcacaaggcaagaaaaugauacgaccacaaccaauggagcauaaauacucuuggaaaucaugggggaaagcuaaaauaauaggagcagauguccaaaauaccacguucauaauagauggcccgaacacgcccgaauguccagaugaucaaagagcauggaacauaugggaaguugaggacuauggauuugguauuuucacaacaaacauauggcuaaaacuucgagacucauacacacaaguaugugaucacagacuaaugucugcugcaauaaaagacucuaaagcgguacacgcugacaugggauacuggauagagagugagaaaaacgaaacauggaaauuagccagggcuucauucauugaaguaaaaacuuguauuuggcccaaaucgcacacguuauggaguaauggaguguuagagagcgaaaugauuauuccaaaaauauacggcggaccgaucagucagcacaacuaucgucccgguuauuucacccaaacagccgguccauggcaucuuggcaaacuagagcucgauuuugacuuaugcgaaggcacaacuguaguaguagaugaacacuguggaaaucgaggcccgagucuccggacgaccacaguuaccggaaaaaucauacaugaguggugcugcagaucgugcacauuaccaccuuugagauuuagaggggaagacggcuguugguaugggauggaaauccgcccaguaaaggaaaaggaagagaauuuaguuaaauccauggucucagccggcaguggcgaaguagauucuuuuucauuaggucuacuuuguauuucgauuaugaucgaagagguaaugcgaucaagauggucacgcaaaauguuaaugacagggacucuagcgguauucuuucuucucauaguaggacaacuaacuuggaacgacuugauacgcuuguguaucaugguaggugccaacgccagugaucgcauggguauggguaccacauacuuggcucucauggcgacauucaagaugcggccaauguucgcaguaggacugcucuuuagaagacuaacaagcagagaagucuuacugcuaacuauaggcuuaagucuaguagcaaguguugaauugccaaacucccuagaagaauuaggagaugguuuagccaugggcauaaugauuuugaagcuauuaacugacuuucaaucccaccaacugugggccacucugcuauccuugaccuuuauuaaaacaacguuuaguuuacauuacgcauggaagacuauggcgaugguacuuagugucgucagccuauucccgcuaugcuugucaacaaccucgcaaaagacgacgugguuaccaguuuugcuaggaagucuuggauguaaaccuuuaacuauguuucuaauugcagaaaauaagauauggggccggcggucauggccacuaaacgaagguauaauggccguuggaauuguaaguauacuccuaaguucucugcucaaaaaugauguuccucuagcaggaccauuaauagcuggagggauguuaaucgcauguuaugugauaucuggaagcucagcagacuuaucauuggagaaagccgcugaagugucgugggaagaagaagcugaacacucaggugcaagccacaauauacucguugaaguucaagaugacgguacaaugaagauuaaagaugaggagagagaugauacacucaccauacuccuaaaggcaacccuucuagcaguuaguggaguauauccgcucuccauaccagcgacacuauucguuugguacuuuuggcagaagaagaaacaacgaucugguguacuaugggauacccccuccccuccagaaguggagagggcaguacuagaugauggaauauaucggaucaugcaaagagggcuauuggggcguagucaaguaggagucggaguauuccaagagaacguguuucacacuauguggcacguuacaagaggggcuguguuaauguaucaggguaaaagacuugaaccgagcugggcuucagucaaaaaggaucuaauaucguauggcgguggguggcgccuacagggaucauggaauaccggcgaagaaguccaaguaauagccguagaaccagguaagaauccuaaaaacguccaaaccgcccccgguacauucaagacaccagagggugagguaggggcaauagcccuagauuucaaaccaggaacuucagggagcccaauagucaaccgagaaagaaaaauugucggccuguaugguaauggcguagucacgacuagcggaaccuacguuucagcuauagcgcaagccaaagcuagucaagaagggcccuuaccugaaauagaagaugagguauuuaggaaaaggaauuuaacuauaauggauuuacaccccgggucaggaaaaacgagaagauaucucccagcgauuguacgugaagccauaaaaagaaaacuuagaacuuuaauauuagccccaacucgagugguagcaucagagauggcagaagcccugaaaggaaugcccauccgauaucaaaccacagcugucaaaagcgaacauacugggaaagagauagucgauuuaaugugucacgcuacauucacgaugcgucuacuuaguccaguucggguaccaaacuacaacaugauaauaauggaugaagcacacuucacugacccgucgagcauagcggcacggggguauauaagcacaagaguagguaugggcgaggcagcggcaauauuuaugacugccacaccuccaggaaguguugaggcuuuuccccaauccaacgcgguaauacaggaugaagagagagauauaccugaacgaucauggaacucaggcuaugaauggauaacugacuucccagguaagacaguaugguucguccccaguaucaagucggggaaugacauugccaauugucuacguaagaacgggaaaagaguaauacagcuaagucgaaaaaccuuugauacagaauaccagaaaaccaaaaauaaugacugggauuacguagucacuacagauauuucugaaaugggugccaacuucagagccgaccggguuauagacccacgcagaugcuuaaaaccgguuauucuuaaggauggucccgaaagagugauacuagcuggcccaaugcccguuaccguugcuucggcggcgcaaagacgaggaaggaucggacgaaaucauaacaaagaaggagaccaauacauauauauggggcaaccauuaaauaacgaugaagaccacgcucauuggacugaagcaaaaaugcuauuagacaauauuaauacgccagaggggauuauaccagcuuuauucgaaccagagagagaaaaaucagccgcuauagacggcgaauaucgccucagaggugaagcaagaaaaacauucguagaacuaaugagaagaggagauuugccuguuuggcucucauacaaggucgccucagaagguuuccaguacucagaccggcggugguguuuugauggagaaaggaauaaccaagucuuagaagaaaauauggacguugaaauauggacuaaggaaggagaacguaaaaagcuccguccgagauggcuugaugcuagaaccuauagugauccgcuugcccuaagggaauuuaaggaguucgccgccgggagacgauccguuaguggagacuugauccuugagauaggcaagcuaccacagcaucuuacucaaagggcucaaaaugcucuugacaaccugguuauguuacauaacucggaacaaggagggagggcauacagacaugcaauggaggagcuuccugauacaauagagacgcuuaugcuuuuagccuuaauugcaguucuuacgggaggcguaacguuauucuuccuaaguggacgaggauuagguaaaaccaguauuggacuacucugcgugauggccucaaguguucuccucuggauggcgucugucgaaccacacuggauagcugccucuauuauauuagaguucuuucucauggucuuacuuauuccagaaccagacagacaacgaacaccucaagauaaccaacuggcuuauguuguuaucggucuauuguuuaugaucuuaacuguagcggcaaaugaaaugggauuauuagagacuacaaagaaagaucucggaaucggacauguugcuguggagaaucaccaucacgcugcaauguuggacguugaucuacacccggcuucugccuggacucucuaugcaguagcaacaacaauaauaacaccaaugaugaggcauacaauugagaauacaacagcgaacauauccuuaacagccauugcgaaccaagcagcgaucuuaaugggacuagauaaaggauggccuauaaguaaaauggacaucgguguuccucuacuggcacuagguugcuacucacaaguaaauccucuuacucuuaccgcggcgguuuuaauguuaguggcgcacuacgcuauaaucggcccaggauuacaagcaaaggcaacccgugaagcacagaaaagaacagcggcagguauaaugaaaaaccccacggucgaugguauuguagcuaucgaucuagauccugucguauaugacgcaaaguucgaaaaacaauugggucaaaucaugcucuugauuuuguguacaagccaaauccuauuaaugagaacuaccugggcguugugcgaaucuauaacauuagcaacaggcccuuuaacaacacuuugggaggguaguccaggcaaguucuggaauacaacgaucgcaguaucaauggcaaauauuuuuagggguaguuacuuagcaggagcuggauuagcguuuuccuuaaugaagucuuuaggcggcggacgucgaggaacuggggcacaaggcgaaacguuaggagaaaaguggaagagacagcuuaaucagcuaucaaaaagugaauuuaacacauacaagagaagcggaaucauggaaguagaucgaucagaagcuaaagaaggauugaagagaggggaaacuaccaagcaugccguaaguagaggcacggccaaacucaggugguuuguagaaaggaacuuagucaagccagaaggaaaaguaauagacuuaggaugugggcgugguggauggucauauuauugugccggucuaaagaaaguaacugaagucaaggguuacaccaaagggggaccaggucaugaagaacccauaccuauggcgacuuacgguuggaaucuaguaaaacuccauaguggaaaagacguguucuuuauacccccagagaaaugugauacgcuacuuugugacauuggugaaaguucaccgaauccuacaaucgaagaagggaggacucuaagaguacuaaagaugguagagccguggcucaggggaaaucaauucuguauuaagauauuaaacccauauaugccuucaguaguagagacacuugagcaaaugcagcguaaacauggagguaugcuugugcguaacccuuugucucguaauucaacacacgaaauguauugggucucaugcgguacagggaacauugucucugcuguaaauaugacaucuagaauguuauuaaacagauuuacuauggcgcaccgaaaaccgacguaugaaagggauguugaccucggugcaggcacaagacauguggccguggaaccugaaguugcuaauuuagacauuauaggacaaagaauugaaaacauuaagcaugagcauaaaucuaccuggcacuaugacgaggauaacccguacaaaacgugggcguaucacggaucguacgaggugaagcccuccggaucugcaucaagcaugguaaacgguguaguaaaacuuuuaacaaaaccaugggauguuauccccaugguaacccaaaucgccaugaccgauaccacaccuuucggucaacaaagaguauuuaaagaaaagguagacacgaggacuccaaaggcaaaacgaggcacagcccagauuauggagguaacugcgaaaugguuauggggauuccuaucacgaaauaagaagccaagaauauguacccgagaagaauuuacuagaaagguccguuccaacgcugcaaucggggcaguauucguugaugaaaaccaauggaauagugccaaggaagcuguagaagaugaaagauuuugggacuuaguucauagggaaagggaacuucauaaacaaggaaagugcgcgacaugcguauauaacaugaugggaaagcgugaaaagaaauuaggagaguucgguaaggcuaaaggaucacgagcuauaugguacauguggcucggagcaagauuccuagaguucgaagcucuagguuuuaugaacgaagaccacugguucucucgagaaaauucguugucgggaguggaaggggaaggauuacauaaauuaggguauauacugcgagauauuuccaaaauaccuggggguaauauguaugcagaugacacagcagguugggauacacgaauaaccgaagaugaccuacaaaaugaggcgcgcauaacugacauaauggaaccagaacacgccuugcuagcaaaaagcauauucaaacuaacauaucaaaauaaggucguacguguucaacgacccgcgaaaaaugguacggugauggauguuauaucaaggcgagaccaacgugguucaggacaaguuggcaccuauggguuaaauacguucacuaacauggaagcucaauuaaucagacagauggaaucugaaggcauauuuucaccaucugagcuugagacgccaaaccucgcggagcguguauuggauugguuagaaaaauauggcguagagagauuaaaacggauggcaauuucuggugaugauugcgucgugaaaccaaucgacgaucgauuugcaacagcauugacagcguuaaacgacauggguaaaguaagaaaggacauuccacaaugggaacccagcaaaggcuggaaugacuggcaacaggucccuuucuguucacaccacuuccaccagcuuauaaugaaagauggaagagaaaucguaguacccuguaggaaucaagaugaauugguagggagagcccguguaagucaaggagcuggguggucauuacgugagacagcuugucuagggaaaucauacgcacagauguggcaauuaauguacuuucauagaagagacuuacgacucgcugccaaugcgauauguucggccguaccaguagauuggaucccuacguccagaacgaccuggucaauacaugcucaucaucaauggaugacaaccgaggauaugcuuucuguauggaauaggguguggauugaagaaaaucccuggauggaagacaaaacacauauuaguaguuggggagacguaccauacuuagggaaaagagaggaucaauggugugguagccuuauaggucuuacugcgcgggcgaccugggcaaccaauauacaaguugcaauuaaccaaguaagaagauuaauagguaacgaaaauuauuuggacuacaugacaucaaugaaacgauucaaaaaugaaagcgacccagaaggagcgcuuugguaa

SEQ ID NO: 21520 - RNA, 9879 nt, Artificial Sequence
  derived and/or modified CDS sequence (opt6) from DENV-1__FJ024464__SS-prME
agcgugacuauguuguuaauguuaaugccaacagcgcuagccuuccaucuuacgacacgggguggugaaccccacaugauugugagcaaacaagaacgaggaaaaucuuuacucuuuaaaacaucagcaggaguuaauauguguacuuuaauagcgauggaucuaggagaacucugcgaggauacaaugacauacaaauguccgagaauuacggagacagaaccugacgacguggacugcuggugcaaugcaacagauacaugggucacuuauggaacuuguucccaaacaggcgagcauagaagggacaaacggaguguagcacuugccccacacgucggacuagggcuugagacgagaaccgaaacauggaugagcagugaaggugcuuggaaacaaauucaaaggguugaaacaugggcuuuaaggcacccuggauuuaccguaaucgcucucuuucuugcgcaugccauaggaacuucaauaacacaaaaaggcauaauauucauacuauuaauguuaguuacaccguccauggcaaugagaugcgucggaauaggaaguagagacuuuguagagggacuaaguggggcaacaugggucgaugucgugcuagaacauggaucauguguuacaacuauggccaaagacaaacccacauuggauauugaguugcucaaaacagaaguaacaaaucccgcaguacuuaggaaacuaugcauagaagcgaaaauaucuaacaccacgaccgacucaagguguccuacgcaaggagaagccacuuuaguagaagaacaagaugcaaauuuuguguguagaagaacuuuugucgacagaggauggggaaacggguguggauuauuuggaaaaggaaguuuaauuaccugcgcaaaauuuaaaugugugacaaaauuagaagguaaaauaguacaauacgagaacuuaaaauauaguguuauaguaacaguacauacuggugaucaacaccaaguugggaacgaaucuacugaacacggaaccacagcaacuauaacuccacaagcaccaacaacagagauacaauugaccgauuauggagccuuaaccuuagacugcuccccuagaacaggacuagacuuuaaugaaaugguucuauuaaccaugaaagagaaaaguuggcuaguucacaaacaaugguuuuuagauuuaccucuaccauggacaucaggugcaucaacaagucaagagacuuggaauagacaagacuuacugguaaccuuuaaaacggcgcaugccaagaaacaagaaguaguagugcugggaagucaagaaggcgccaugcauacggcacuuacaggugcaaccgaaauacaaaccucgggcaccacaacaauauuugcuggccaccuaaaaugcagacuuaaaauggauaaacucacccuuaaagguaugucguacgugauguguacaggaucauuuaaacuagaaaaagaauuagcagaaacucaacacggaacuguauuaguacaaauuaaauacgaggguacagaugcaccuugcaaaauaccuuucucgacccaagacgaaaaaggagucacgcaaaauggaagacugauuacugcaaauccuauagugacggacaaagaaaaaccugucaacauugaagcugaaccaccguuuggagaaucuuauauaguuauaggugccggugaaaaagcauugaaauuaucuugguucaagaaagggucuagcauagggaaaauguucgaagcuacggcaagagguguuagaagaauggcaauacugggagauacagcuugggacuuuggaucaaucggcggaguauuuacaucuguaggaaaauuaguucaccaaaucuucggaacagccuaugggguauuauuuucaggcguuuccuggacaaugaaaauagggauaggggugcuuuuaaccugguugggacuaaauaguaggaguacaucucuaagcaugacauguauagcgguagggcuuguaacacuauaucuaggcgugaugguacaagcagauagcgguugcgucaucaauuggaaagggagagaacuaaaaugcggaaguggaauauucgucaccaaugaaguccauacuuggacagaacaauacaaauuucaagccgacaguccgaaaaggcuuucggcagccauagggaaggcuugggaggaggggguauguggcauccguuccgccacgcgcuuagagaauauuauguggaaacaaauuaguaaugaauugaaucacaucuuguuagagaaugauaugaaauuuacuguaguuguaggugauguagccggaauacucgcacaagguaagaaaaugauacgcccacaaccaauggaauacaaauauagcuggaagucauggggcaaggcgaaaauuauuggagcggauguucaaaauacuacguucauuaucgacgguccaaauaccccugaauguccagaugaccaaagggcauggaacauaugggaagucgaagacuaugguuuugggauuuuuacaacaaauauuugguuaaaauuacgagauuccuauacgcaaguaugugaucaucgacuaaugagugccgcuauuaaagacucgaaggcuguccaugcugauaugggauacuggaucgaaagugagaaaaaugagacuuggaaacuagcgcgagcuucuuucauugagguuaaaaccugcauuuggcccaaaagccauacccuauggagcaaugguguccuagaaagugaaaugauaauaccuaaaauauacgguggaccuaugucgcagcacaauuauagacccgguuacuuuacacaaacagcgggaccguggcauuuaggcaaacucgaacucgauuuugaccuuugugaaggaacuaccgucguaguagaugaacacuguggcaaucgugggcccucucuaaggacaacuacugucacaggaaaaauuauucaugaaugguguugucgauccuguacccucccaccguuaagguuuagaggagaagauggcugcugguacggcauggaaauacgacccguuaaggaaaaagaagaaaaccugguaaagucaaugguauccgcgggcucaggggagguagauucguuuucauuaggacuauuguguauaucuauaaugauagaagagguaaugcgauccagauggaguaggaaaaugcuaaugacugggacacuugcuguauucuuucuguuaauaaugggacaacuaacguggaaugauuuaaucagauuauguaucaugguaggagcaaacgcaucugauagaaugggcaugggaacuacguaucucgcccugauggcuacuuucaagaugcggcccauguucgcaguugggcuacuauuuaggcgacugacaagucgcgaaguacuuuuauugacaauuggacuaucucuagucgcuuccguggaacuacccaauucuuuagaagaauugggagauggguuagcuaugggaauaaugauacuaaaguuauuaacugauuuucaaagucaccaguugugggccacguuguugucacucacauuuauuaaaaccacuuuuucacuacauuaugcguggaaaacuauggcaaugguauuaagcauagugagcuuauuccccuuaugucuuaguacaacaucacagaaaacgacaugguuaccaguucuauuaggaucccucggauguaaacccuuaacaauguucuuaauugcugaaaauaaaaucuggggucguagaagcuggcccuugaaugaaggaauaauggcuguagguaucguaucaaucuuacugaguucucuccugaaaaacgaugugccgcuggcgggaccauugauagcgggaggaaugcuuauagcauguuauguaaucagugguucaagugcagacuuaucacuugaaaaagcugccgaaguuaguugggaggaagaagcagaacauucaggugcaucacauaacauucuuguagaaguucaagaugaugguaccaugaagauuaaagaugaggaacgugaugacacucuuaccauacuuuugaaagccacauuacuagcuguuagugguguuuacccucuaucgauuccggccacuuuauucguaugguacuuuuggcagaagaagaaacaacgaagugggguucugugggacacacccagucccccagaggucgaaagagcagugcuugacgacgguauuuacagaauaaugcaacgggguuuguugggacggucacagguagggguagggguauuucaagaaaauguauuucacacaauguggcacgugacgcguggagccguacucauguaccaagggaaaagguuggaaccaaguugggcuuccgucaagaaagauuuaauaaguuauggaggcggauggcgauugcagggaaguuggaauacuggagaagaaguucagguuauagcgguagaaccuggcaagaaccccaaaaacguucaaaccgcgccagguacauuuaagacgcccgaaggagaaguuggagccauugcuuuagauuuuaagccagguacuucggguucaccuaucguaaacagggaagggaaaaucguaggacuuuacggcaaugguguugucacaacgucagguacuuauguaucagcuauagcacaagccaaagcaucacaagaaggaccuuuaccugaaauugaagacgaaguuuuuagaaaaaggaacuuaacaauaauggauuugcacccaggaagugggaagaccaggagguaucuuccugcaauaguaagagaagcgaucaaaagaaagcuccgaaccuuaauauuggcuccaacgcguguaguagcuagugagauggcagaggcucuuaaagguaugccgauucgguaucaaacgacagccgucaagucugagcacacuggaaaggaaauaguggacuuaaugugccaugccacauuuacaaugcgacuucuaaguccagucagagucccaaauuauaacaugaucauuauggacgaagcgcauuucacugacccgagcucaauagcggcaagaggguauauaucgacaagagucggaaugggugaagcugcggccauuuucaugacagcaacaccuccaggcagcguggaagcauuuccacaaucgaaugcugucauucaagaugaagaacgugauauuccugaaagauccuggaacucgggcuaugaauggauuaccgacuuuccugguaaaacggugugguuuguuccaagcaucaaaucagguaacgauauagcaaauugucugagaaagaauggaaaaagagugauucagcuuucacgaaagacuuuugacaccgaauaucagaaaaccaaaaauaacgauugggacuacguaguuacaacagauauaagugaaaugggugcuaauuuucgugccgaucgagugauagacccaaggagaugucuuaagcccguuauauuaaaagaugguccugagagaguuauucuggccgggccuaugccagugacuguagcaagcgcugcccaaaggagaggucguauagguagaaaucauaacaaagagggagaccaguacaucuacauggggcaacccuuaaauaaugacgaagaucaugcucacuggaccgaagccaagaugcuacuagauaauaucaauacaccggaaggaauaauuccggccuuauuugagccagagcgggaaaagucagcugcaauagacggggaguaccgguuacgcggggaggcuagaaaaaccuucguagaguuaaugcggaggggagaucuaccaguauggcucaguuauaagguugcguccgaaggcuuccaguauucagaucgaagaugguguuuugacggagaacguaauaaccaaguauuagaagaaaauauggauguagagauauggacuaaagaaggagagaggaagaaacuacggccaagaugguuagaugcacguaccuacucugaccccuuagcacugagggaauuuaaagaguuugcagcaggacgacgaagcgugaguggugaucuaauccuugaaaucgggaaacuaccgcaacauuuaacucagcgggcacaaaacgcacuugauaacuuagucauguuacauaauuccgaacaaggaggccgagccuacagacacgcaauggaagaacucccagauaccauugaaacgcugaugcuucuugcguuaauugccguguuaacuggaggagucacucuguuuuuccugagcgguaggggauuaggaaaaaccucaaucggauuauuaugugugauggcaucaucuguucugcuuuggauggcaucaguugaaccacauuggaucgcagcguccaucauucucgaguucuuuuugaugguccuucuuauaccagaaccagauagacaacggacuccucaggauaaccaacuagcuuacguuguaaucggauuacuguuuaugauacuaacaguugcugcgaaugaaauggguuugcuugaaacaaccaagaaagaccuagguauagggcaugucgcaguugagaaucaucaccaugcagcgaugcuugauguugauuugcauccagccagcgcuuggacuuuguaugcuguugccacuacaauaauuaccccaaugaugagacauacgaucgagaauacaacagccaacauaucauugacugcaauagcaaaccaagcugcaauccugaugggccuugauaaaggauggccuauaagcaaaauggauauagguguaccucuauuagcgcuggguugcuauucgcaaguaaauccauuaacacuuacggcugcaguucuaauguugguagcacacuacgcaauaauaggacccgggcugcaggcaaaagcaacaagggaggcccagaaacguacugcagccggcaucaugaaaaacccaacaguagauggcauagucgccauagaccuugaccccguuguauaugaugcgaaauuugagaaacaguuaggacagauuaugcuuuuaauucuauguaccagucagauacuacuaaugagaacgacaugggcauuaugugaaagcaucacacuugcuacagggccauuaacaacucugugggaaggaucgccaggaaaauucuggaacacuacgauugcaguaucaauggcaaauaucuuuagaggcucuuaucuagcaggcgccggacuugcauuuagccugaugaaaucucuagggggcggacguagggggacaggagcucagggcgaaacacuaggcgaaaaauggaaaagacaauuaaaccaacuuucaaaaucggaguucaauacuuacaaacguaguggcauaauggaagucgaccgaagugaagcgaaggaagguuugaagagaggugaaacuacuaaacacgcagugaguagaggaaccgcaaaauuaagaugguuuguagaaagaaaucuagugaaacccgaagggaaagucauagacuuaggauguggaaggggaggauggucauauuauugugcuggucuuaagaaaguaacagaaguuaaaggauacacaaaggguggaccuggacacgaagaaccgauaccuauggcaacguauggguggaaccucgugaaacugcauucggguaaggauguauuuuucauuccaccugaaaagugugauacauugcuaugcgacaucggagaaaguucuccuaacccaacuaucgaagaggggagaacacuccgaguguuaaaaaugguggaaccguggcuacgagggaaccaauuuugcauaaaaaucuuaaaucccuauaugccaagcguaguagagacacuggaacagaugcaaagaaagcauggaggaauguuaguuagaaauccucuuucucguaauucaacacaugagauguauuggguaucuugcggaacuggaaauaucguuucggcaguuaauaugacuucuagaaugcuuuuaaauagauuuacgauggcccauaggaagccgaccuacgaaagagauguugauuugggcgcugguacuaggcauguagcaguagaaccagaaguugccaaccuagacauaauaggccaaagaauagagaacauuaagcaugaacacaaaagcacauggcauuaugaugaagauaaccccuacaagacaugggcuuaccacggaucauacgaaguuaaaccaaguggcucugcuucuaguaugguaaauggcguuguuaaacuauuaacgaaaccuugggaugucauaccuauggucacccaaaucgccaugacggacaccacuccauucgggcagcagagagucuucaaagaaaaggucgauacacggaccccuaaagcaaaaagagggacagcgcaaauaauggagguuacagcgaaauggcuuuggggauuucuaucccguaacaagaaaccacgaauuuguacacgggaagaguucacacgaaaagugagaucaaacgcagccauaggcgcaguguucguggacgagaaucaauggaacagugcaaaagaagcaguagaagaugaaagguucugggauuuaguacauagagaacgcgagcuccacaaacaggguaaaugugcaaccugcgucuacaauaugauggggaaacgagagaagaaauuaggagaauuugggaaggcaaaagguucucgagcaauuugguauauguggcucggagcuagauuuuuagaauuugaagcauugggauuuaugaaugaggaccacugguuuucacgagaaaauucauuaucaggugucgaaggugaaggcuuacacaaauuaggauacauacuaagggauauuaguaaaauaccaggcgguaacauguaugcugacgauacagcuggaugggauacucgcauaacagaggacgaucugcaaaacgaagcucggauaaccgacaucauggaaccagaacaugccuuacuagcuaaaucgauauuuaaacuaacauaucaaaacaagguaguaagaguacagcgucccgcuaagaauggcacuguaauggacgugauaucacgcagggaccagcgaggcaguggacaaguuggaacuuauggacugaauacuuucacuaauauggaagcccaacucauucggcagauggaauccgaagggauauuuucuccgucagaacuagaaacaccaaaucucgccaaacggguacuugauugguuagaaaaauaugguguugaaagauuaaaaagaauggcaauaucuggugacgauugcguaguaaaacccauagaugauagauuugcaacagcauuaacugccuuaaaugauaugggcaaaguaagaaaagauaucccccagugggaaccuucaaagggcuggaacgauuggcaacaaguuccauuuuguagccaccacuuucaucaacugauaaugaaagaugggcgcgaaauuguaguaccuuguaggaaucaagacgaauuaguuggcagagccagagugagccaaggugcgggauggagcuugagagaaacagcuugccuaggaaaaucauacgcgcaaauguggcaacugauguacuuucacagaagggaccuucgauuagcggcuaacgcaauauguucggcugucccugucgauuggauaccaacaucaagaacaaccuggagcauucaugcacaucaccaauggaugacaaccgaagacaugcugagugucuggaaucgcguguggaucgaagaaaaucccuggauggaagauaaaacgcacauuaguuccuggggugauguuccuuauuuaggaaagcgugaggaucaauggugugguuccuuaauaggucuuacagcuagagcaaccugggcgacaaacauucaaguggcgauaaaucaagugcgucgacuaauuggaaaugaaaauuacuuagauuauaugacaagcaugaaacguuuuaaaaaugaaucggaccccgaaggcgcccuaugguga

SEQ ID NO: 21521 - RNA, 9879 nt, Artificial Sequence
  derived and/or modified CDS sequence (opt6) from DENV-1__FJ410191__SS-prME
aguguaacuauguuauuaauguugaugccaacugcccuugccuuucaucuaacgacgagaggaggggaaccccauaugauugucucuaaacaggaaagagggaaaucacuacuauucaaaacuucugcaggaguuaauaugugcacuuuaauagcaauggaccuaggagaguucugcgaagauaccaugaccuauaaauguccaagaaucaccgaagcagaaccagacgauguagauugcuggugcaacgccacagacaccuggguaacauauggaacauguucgcagacaggugaacaccguagagacaaaagaaguguugcucuagcuccacacguuggauugggacuagaaacccguacugaaacauggaugaguucagaaggugcauggaaacagauccagaaagucgaaacaugggccuuacggcauccaggauucacgguaauugcguuauuucuugcacacgcaaucgguacuagcauaacccagaaggggauaauuuucauacuccuuauguugguuacuccaaguauggcaaugagaugcguggguaucggaagucgugacuucguagaagguuugagcggugcgaccuggguggauguugugcuagaacauggaaguugugucacuacuauggcaaaagauaaaccgacuuuagauauagaauuacuuaaaacugaaguaacaaauccagcgguacuccggaaacuaugcauugaagcaaaaaucagcaacaccacgaccgacucucgaugcccuacucaaggggaagcgacucuaguagaagaacaagaugcuaauuuugugugucgucgcaccuucguugauagaggguggggaaaugguuguggacuauucggaaaaggaucgcuuauaacaugugccaaauucaaauguguaaccaaauuggaaggaaaaacaguucaacaugaaaaucuaaaauauucuguaauaguuacggugcauaccggagaucaacaucaagucggcaaugagucaacugaacacggaacuacagcaacgauaacaccccaggcaccauccacggaaauacaacugacggacuacggagcccuaacucuggacugcaguccccggacaggauuagauuuuaaugaaaugguacuauuaacaaugaaagagaaaaguugguuaguacauaaacaaugguucuuagauuuaccacucccauggaccucuggagcgucgacaagucaggaaaccuggaauagaaaagauuugcuaguaacauuuaaaacugcacaugcuaagaaacaggaaguagucgucuuaggcagccaagaaggugcaaugcauacugcauuaacuggagcaacagagauucagacaaguggcacaacgacaauauuugcaggucauuuaaaaugucggcugaaaauggauaaauuaacccucaaaggaacgucauauguuauguguacuggaaguuucaaauuagaaaaagaaguggccgagacucaacaugggacuguauuaguacaaauuaaauaugagggaacggacgcaccaugcaaaauuccuuucucaacucaggaugaaaaagguguaacucaaaacggucgucugauuacagcaaaccccauaguaacugauaaagaaaaacccguuaauaucgaagcagaaccgccuuuuggagaaucauacauuguaauaggagccggcgaaaaggcuuuaaaacuauccugguuuaagaaaggaaguucgauaggaaaaauguucgaagcaacggcuagaggugcacgucgcauggcgauccuaggugauacugcuugggauuuuggaucaauaggcggaguuuuuaccucaguaggaaagcuaguucaucaaauuuuugggaccgcuuacgguguguuguucaguggaguuucuuggaccaugaaaaucgguauugggguuuuauuaacuuggcuaggacuaaauucaagaucaacgucccugucgaugacguguauagcagugggacucguaacauuguaucuaggaguaauggugcaagcugauagcgguuguguuauaaacuggaaagggagagaacuuaaaugcgggagcggaauuuucgucaccaaugaaguacauacauggacggaacaguauaaauuccaggcagacagcccuaagcgguugagugcagcaauagguaaggcuugggaagaaggagugugcggcauucgaucugcuaccagacuugaaaacauaauguggaaacagauaucuaacgaacugaaccauauauuauuggaaaacgacaugaaauuuacaguagucguaggggacgucgccggcauccuugcgcaaggcaagaaaaugauuaggccucaaccuauggaauauaaauauagcuggaaaaguugggggaaggcaaaaaucaucggagccgacgugcaaaauacaacguuuauuauugacggaccaaauacuccggaaugcccugaugaccaaagagccuggaacaucugggagguagaggauuauggauucgguaucuuuaccacaaauauaugguuaaagcuaagagacucauauacccaggugugugaucaucgccuaaugucagcugcaauaaaggacaguaaggcaguucaugcagacaugggauacuggaucgaguccgagaaaaaugaaacauggaagcuagcuagagccucguuuauagaaguuaaaacauguauuuggccuaaaucacauacguuauggagcaacgguguauuagaaucugaaaugauaauuccaaaaauauauggagggccaaccucucaacacaauuauaggccaggguacuuuacgcagacugcagguccuuggcaucucgguaaacuugaacuugauuucgauuuaugugaaggcacaacaguuguuguugacgaacauuguggaaauagagggccgucguuacguacaaccacaguuacagguaaaauaauacacgaaugguguugcagaucguguacauuaccuccguuaagguucaaaggcgaagauggauguugguacggaauggaaauaaggccuguuaaagaaaaagaggaaaauuuaguaaagucaaugguaagugcagguagcggugaagucgacaguuuuucacucggauuacuuuguauaagcauaaugauugaagaagugaugcgaucaagguggaguaggaaaauguuaaugacggguacgcuagcugucuucuuucuacuuaucauggggcaauuaacguggaaugaccuaauacgucuauguaucaugguuggagcuaaugcaagugauagaaugggaauggguacgaccuaucuagcucuaauggccacguuuaaaaugagaccaauguuugcaguuggauuauuauuccgucgauuaacuagcagagaaguucuauuauuaacaauuggacuaucacuuguagcaucaguggagcuucccaauucguuggaggaacuaggggauggucuagcaauggggauuaugauccuuaaauuguuaacagacuuucaaucgcaucaacuaugggcaacguuguuaucacugacguuuauaaagacgacuuucaguuuacauuaugcguggaagacaauggcuaugguacuuagcauagugucacucuuucccuugugccuaucaacgacgagucaaaagacgaccugguuaccgguauuauuagguagucucggguguaaaccacuaacaauguuuuugaucgcugaaaauaagaucugggggcgaaaaucauggccuuugaacgaagggauaauggcuguugguauugucucaauacuccuuagcaguuuauugaagaaugauguaccacuggccggaccuuugauagcggguggaauguuaauagcauguuacguaauuucuggaucgucugcagauuuaagucuggaaaaagcugcggagguaagcugggaagaagaagcugaacauucaggugccucucauaauauacuggucgaggugcaagacgauggcacuaugaagauuaaagaugaggaaagagaugauacauugacuauacucuugaaagcuacauuauuagccgucagcggaguauacccauuaaguaucccagcaacauuguucguuugguauuucuggcaaaagaaaaagcaacgaucagguguuuuaugggacaccccuucuccgccugaaguugaaagagcaguccuagacgacggcauuuaucggaucaugcaacguggccuccuuggaagaucucaaguuggcguaggagucuuccaagagaaugucuuucauacuauguggcacguaacuagaggagcaguauuaauguaucaagguaaacgguuggagccaucuugggcuagcguuaagaaagaucucaucucguacgguggaggauggagauuacaaggaagcuggaauacgggagaagaagugcaagugauagccguugaaccagguaaaaauccuaaaaaugugcaaacggcuccuggaacauuuaaaaccucugagggggaagucggggcaauagcauuggacuuuaaaccugguaccuccgggucgccuauuguuaacagagaaggcaaaauaguaggauuauacggaaauggaguaguaacuacaucggguacuuauguauccgcaauagcacaagcaaaggcuucccaagaagguccucuacccgaaaucgaagacgaaguauucagaaaaaggaauuuaaccauuauggaucuucauccagguagcggaaaaacaaggcguuacuuaccagcaauaguuagagaagcgauuaaacgaaaacuccgaacacucauuuuggcaccuacgcgugucguagcaucugaaauggcagaagcacuuaagggaaugccgauuagauaucaaacaaccgccgugaaaggugaacacaccggaaaagaaaucguugauuuaaugugccaugccacguucacaaugagacuuuuaaguccgguaagaguaccgaacuauaacaugauaaucauggaugaggcacacuucacagauccuucuucuauagcagcacgugguuacauaaguacacguguagguaugggcgaagcagcagcaauauucaugacugcgacacccccaggaucaguugaagcauuuccacaaucaaaugcaguuauacaagaugaagagagggacauuccugaacgaucauggaacucaggauacgaguggauaaccgacuucccgggaaaaacaguaugguuuguacccucaauaaagagugggaacgacauagcaaacugcuugaggaaaaacggcaaacguguuauacaacuaucacgaaaaacguuugauacagaauaucagaaaacuaaaaauaaugauugggauuauguaguaacgacugacauaagcgaaaugggugcaaacuuuagagcggaccgggucauugauccacgucgaugucuaaaaccggucaucuuaaaagaugguccagaaagaguaauauuagcugggccuaugccuguuacuguagccagcgccgcacaacguaggggaagaauagguagaaaccacaauaaggagggugaccaauauauauauaugggacaaccauuaaacaacgaugaggaccaugcccacuggaccgaagcuaaaauguuguuagauaacauuaacacgccagaaggaauaaucccagcucuauuugaaccagaaagggagaaaagcgcagcuaucgauggcgaguauagauuaagaggagaggccaggaaaacuuucguagaacuaaugagacgaggagaccuaccggucuggcuaucuuauaaaguugcaagcgaaggauuccaauacucugaccgucgcuggugcuuugacggcgaacgaaacaaucaaguuuuagaagaaaacauggacguugagauuuggacuaaagagggggaaagaaagaaacuaagacccagguggcuggaugcaagaacuuauagcgacccguuggcacucagggaguucaaggaauuugcggcaggaagaaggucaguuagcggugacuuaauccucgagaucgggaaguugccucaacaucuaacccaaagagcucaaaaugcauuggacaaccuuguaaugcuucauaacucagaacaggguggucgagcuuauagacaugcuauggaagaguuaccggauacaauagaaacucucaugcucuuagccuuaaucgcugucuuaaccggagguguaacuuuauuuuuccuaaguggccgcgggcuaggaaaaacaaguauuggauuauuaugugucauggcuucuucagcacuguuauggauggcuucgguugaaccucacuggauagcugcgucuaucaucuuggaguucuuucuaaugguccuucuaauaccagaaccagauaggcaaagaaccccacaagacaaucaacuggcuuacguuguuauuggacugcuguucaugauucuuaccgucgcggcgaaugaaaugggucucuuagaaacaacaaaaagagaucuuggcauaggccauguugcggucgagaaccaccaccaugcagcgaugcuagaugucgauuugcacccagcaucugcauggacuuuauacgcugucgcuacuacuaucauaaccccuaugaugcgacacacuauagaaaauacgacagccaauauuucguugacagccauagcuaaccaagcugcaauacucaugggacuugauaaaggauggccaaucagcaaaauggauaucggcguuccguuacuagcguuagguugcuauucgcaagucaacccacuuacauuaaccgcagcaguuuugaugcuagucgcucauuaugcuaucauuggaccugguuugcaggcaaaggcaacuagagaagcucaaaaacggacugcagcaggaauaaugaagaacccaacaguagacggcauuguagcuauagauuuggacccaguaguuuaugaugcuaaauucgaaaagcaauuaggacaaauaaugcuauugguauuauguacgucgcaaauauuacugaugcgcacuacaugggcgcuaugcgaaucaauuacacuagcaacaggaccgcuuacgacuuuaugggagggaucaccuggaaaauuuuggaauacaacaauagcuguaucuauggcgaauauuuuucggggaaguuauuuagcuggcgcggggcucgcguuuuccuuaaugaagucauugggcgguggacgaaggggcacuggugcucaaggagaaacauuaggggaaaaauggaaacgacaacuuaaccaacugucaaagucagaguucaauacauauaaaaggaguggaaucauggaggucgauagaagcgaggccaaagaggguuuaaaaagaggggaaacuacgaagcaugcuguuaguagagggacggcaaaauuaagaugguucguugaacgaaaucucgucaaaccagagggcaaaguuauagaucuaggcuguggcaggggagguuggucguacuauugcgccggacucaagaaagugacugaagugaaaggauauacaaaaggugguccaggacaugaggaaccaaucccaauggcuacauauggcuggaaucuagucaaacuacacuccgguaaagacgucuuuuucauaccgcccgaaaagugugauacgcuguugugugauauuggugaaucaucuccaaacccaacuauagaagagggacgaacucugcgcguauuaaaaaugguagaaccauggcuaagggguaaucaauucugcaucaagauacuaaauccauauaugccuagcguaguugaaacacucgaacagaugcaaagaaagcauggagggaugcuugucagaaaccccuuaucccgcaauucgacucacgaaauguacuggguaagcuguggaaccgggaauauaguuucggcgguaaauaugacaagucgaauguuacuaaaucgauuuaccauggcgcacagaaaaccaacuuacgagagggaugucgacuuaggugcugguacuagacacguggcuguagaaccugaaguugcuaaccuggauauaauuggccaacgaauagagaacauaaaacacgaacacaaaagcacauggcauuaugaugaagauaauccauauaaaaccugggccuaccauggcuccuacgaagugaaaccgucagggucggcaagcaguaugguaaauggagucguaaagcuacugacuaagcccugggaugucaucccgaugguaacacagauagcgaugacagacacaacaccauuugggcagcagagaguguuuaaggaaaagguagacacgcgaaccccaaaagcuaagcgaggaacggcgcaaauaauggaagugaccgcgaagugguuauggggauuccuuucuagaaacaaaaagccucgaaucugcacuagagaagaauuuaccaggaagguuagaucaaaugcagcuauaggggcaguauuuguagacgaaaaccaauggaacucugcaaaggaagcuguagaagaugagagauucugggaccuuguccacagagaacgagaauuacauaagcaagggaaaugcgccaccuguguauacaauaugauggggaaacgugaaaagaaacucggggaguucggaaaggcaaaaggcucaagggcaaucugguacauguggcuaggagcucgauuucuugaguucgaggcauuaggcuuuaugaaugaggaucauugguuuuccagagagaacucgcuuaguggaguagaaggagagggauuacacaaauuaggauauauacuaagagacauaaguaaaauaccugggggaaauauguaugccgacgacacagcuggaugggauacucguaucacugaagacgaccuacaaaaugaagcgaaaauaacagauauuauggaaccugaacaugcacuuuuagcaaaauccaucuucaaauugacauaucaaaauaaaguuguucgaguacaaagaccagcuaagaacgguacagugauggaugucauauccaggagagaccaacgcggaagcggccagguaggcacguauggucucaacacauuuacaaauauagaagcacaacuaauaagacaaauggagagugaggagaucuuuaguccgucagaguuagaaacaccaaacuuagcgggaaggguucuagacugguuagagaagcauggaguggagagacucaagagaauggcuauaucaggcgacgacuguguggugaaaccaauagacgaccguuucgcaaccgcacugaccgcccuaaacgauauggggaaagucagaaaagacauuccgcaaugggagccaaguaaaggguggaaugauuggcaacaaguacccuuuugcagucaucacuuucaccaauuaauaaugaaagaugggagagaaauaguaguaccuuguaggaaucaggaugaauuaguuggacgagcgcgggucucacaaggggcuggguggucauuacgggagacagccugccucgguaaaucguacgcgcaaauguggcaauugauguauuuucacaggagagaucucagauuagccgcuaaugcgauaugcucugcaguacccguggauugggucccuacaucgcguacaacuuggucaauucaugcucaccaucaguggaugacaacugaggauaugcuaucuguauggaacagagucuggaucgaggaaaauccauggauggaagacaaaacgcauaucucaucauggggugaugugccuuaucuagggaaacgcgaagaucaauggugcggaucucuuaucggacuuaccgcaagagcaacuugggcaacuaacauacaaguagcaauaaaucaaguucggagauuaauuggaaacgaaaacuaucuggacuacaugacuucuaugaaaagauucaaaaaugaaucagaucccgaaggagcucucugguag

SEQ ID NO: 21522 - RNA, 9879 nt, Artificial Sequence
  derived and/or modified CDS sequence (opt6) from DENV-1__FJ432723__SS-prME
ucaguuacuaugcuacuaauguuaaugcccacugcccuagcuuuccauuuaacuacgagaggaggugaaccacacaugauaguaacgaaacaagaaagggguaaaucucuauuauuuaaaacuucagcuggcguaaacauguguacacuuauagcaauggaucuaggagaacuaugugaagacacaaugacauauaaauguccacgcauaacugaagcagaacccgacgaugucgauuguuggugcaaugcuacggauaccugggugaccuacggaacaugcucacaaacaggggaacauagacgugauaagagaucgguugcucuagcaccacauguagggcuuggccucgaaacaagaacagaaacuuggaugucuucugaaggagcuuggaaacaaauacaacguguugaaacgugggcauuacgccaucccggauuuacggucauagcacuauucuuagcacaugcaauaggaaccuccaucacgcaaaaaggaauaauauuuaucuuauuaaugcuaguaacuccaucaauggcaaugcgauguguagggauagguuccagggauuuuguugaaggguuguccggcgccacuuggguagacgucguccuagaacaugggaguugugucacaacaauggcgaaagacaaacccacacuugauauugaauuacuuaaaacagaagugacuaauccagcagugcugcgaaaguuaugcauagaagcgaaaauauccaauacuacaacagacagucgauguccuacgcaaggugaagcaacauuaauggaagaacaggaugcuaacuuuguuugucgacgaacauuuguggaucgcggaugggguaauggaugcggauuauuugggaaaggaucucuaauuacaugcgcaaaauucaagugcguaaccaagcucgaaggaaagaucguacaauaugagaaccuaaaauauucaguuauaguaacaguacacacaggagaucaacaccagguagggaaugaaaguacagaacacggaacaacagcaaccauaacgccgcaggcuccuacuucugaaauucaacuuacagacuacggagcauugacacuggacuguucaccccgcacgggucuggauuuuaacgaaaugguucuauugaccaugaaagagaaauccuggcucguacacaagcagugguuucucgaccugccacuaccauggacuucaggagccucaacaucacaggaaacuuggaaucgucaggaucuccuagucacguuuaagacugcucacgcuaagaaacaagaaguuguuguuuuggguucacaagaaggugcaaugcauacggcauugacaggagcuacugaaauacaaaccagcggcacgaccacgaucuucgcuggacauuuaaaaugcagacucaaaauggacaaauuaacccuuaaaggaaugucauauguaaugugcacuggcucauuuaagcuagaaaaagaaguagcagaaacgcaacauggcacaguuuuggugcaaaucaaauacgaaggaacugaugcuccaugcaaaauaccauuuagcacacaagaugagaaaggggucacucaaaauggacgccucauaacggcuaauccaauuguuaccgauaaggaaaagcccguuaauauugaggcggaaccuccauuuggugaaagcuacauaguuauaggggcgggugaaaaagcacuaaaauuaaguugguucaaaaaggguucuagcauagguaagauguucgaagcuacagcucgaggugcacgucgaauggcaauccuuggagauacugcgugggacuucgggaguaucggggguguauuuacuucaguaggaaagcugguacaccaaauauucggaacagcauaugguguguuauuuucgggugugagcuggacaaugaaaauaggaauuggugucuuguuaacuuggcucggauuaaacuccagaaguacaaguuugaguaugacuuguauugcugucggccuaguaacccuauauuuaggagucaugguccaagcagacagugguugugucauuaacuggaaaggucgcgaacuaaaaugcggaucaggaauuuuuguuacgaacgagguccauacuuggacagaacaauauaaauuucaagcugacucaccaaagcgacuaagcgcagcgaucggcaaagcgugggaagaggggguauguggcauucggucagcaacgcguuuggaaaauauaauguggaaacaaauaucuaacgaguuaaaccauauuuuacuagaaaaugauaugaaguucaccgucgucguuggggaugucguugggauauuagcccaggggaaaaagaugauccguccacaaccaauggaacacaaauauagcuggaagucuugggguaaagcgaaaauuauaggagcagacguacaaaacacgacauucauaauagauggcccaaacacuccagaauguccugaugaucaaagagcuuggaacauaugggagguggaggacuauggauuuggcauuuucacgaccaauauaugguugaaauuaagagacucauacacgcagguuugcgaccaucgacucaugagcgcagcuaucaaagacagcaaagcaguacacgccgauaugggauauuggaucgaaucugaaaagaaugaaacauggaaauuggcucgagcaucauuuaucgaagugaaaacuugcauuuggccuaaaagucauacauuauggucaaauggcguacuggaaucugagaugauuauaccuaaaauauauggcgguccgauaucgcagcauaacuaccgcccuggguacuuuacccaaacagcuggucccuggcaucucggcaaauuagaacuugauuucgaccuuugcgaggguacaacaguagugguagacgaacacugcgggaacagaggaccaaguuuacgcacgacaacagugacagggaaaauaauacacgaguggugcuguagaucguguacacuaccgccauuaagguucaaaggggaggauggauguugguauggaauggaaauaagaccagucaaagaaaaagaagaaaaccuagugaaauccauggucucagcagggucaggugaaguagauaguuuuucauuaggacuuuuaugcauaaguauaaugaucgaagaaguaaugagaaguagauggagcagaaaaauguugaugacagggacauuggcuguauucuuguugcuaauaaugggucaacuaaccuggaaugaucuaauucgguuauguaucauggucggugcaaacgcaagcgaucguaugggaaugggaacaacuuaucuugcuuugauugcaaccuucaaaaugcguccaauguuugcgguaggcuuacuauuccgacgucuuacaaguagagaagugcuauuauuaaccauaggauuaucucuuguggcuagcguugaacuuccuaauaguuuggaagaauuaggcgauggucuagcuauggguauuaugauacugaagcucuuaacugauuuccaaucucaucaacugugggcaacacuacucucguucacguucauaaaaaccacacugucuuuacauuaugcauggaaaacaauggcgaugguuuuaagcaucguaaguuuauucccauugugucuaucgacaaccucacagaaaacgacguggcugccuguccuucuaggaagccuagguuguaaaccauugaccauguuucuaaucgcggaaaauaaaaucugggggcggaagaguuggccccucaacgagggaauaauggcaguagggguaguauccauauugcucaguucgcuucucaaaaaugacguaccauuggcaggaccccucauugccgggggaaugcuaaucgcgugcuacguaauaucaggaucuucugcagauuugucauuagaaaaagcggcggaagucucaugggaagaagaagccgagcauaguggugccucacauaauauccuaguggaaguacaggaugacggcacaaugaagauuaaagacgaagaacgagacgacacgcucacaauccucuuaaaggcaacauugcuugccguaucugggguguacccccucagcauuccugccacacuauucguuugguauuucuggcagaaaaagaaacaaagaagcgguguccucugggauaccccaucaccacccgaaguugaacgcgcaguccuugacgauggaauuuauagaauuaugcaaagaggacuacuugggagaucacagguagguguuggaguauuucaagaaaacguauuccauacuauguggcacguuacucggggcgcuguauuaauguaccaaggaaaacgauuagaacccucaugggcaagcguaaagaaagauuuaauauccuacggaggaggauggagguuacaaggaucuuggaauaccggcgaagaaguucaagugauagccgucgaaccggguaaaaacccuaaaaauguccaaacagcaccaggaacauucaagacuccagaaggagaagugggggcaauagcuuuggacuuuaaaccugggacaucaggaucaccuauuguuaauagagagggaaaaauuguaggguuauaugguaauggaguagugacuacaucuggaacauacgucagugcaauugcgcaagccaaagcaagccaggaaggcccucuucccgaaauagaggaugaaguauuucguaagagaaaucuuacaauaauggaucuacauccuggaucugguaaaacucgaagauaccuacccgcaaucguucgugaagcaaucaagcgcaagcugagaacucuaauacuagcuccuacacguguaguagcgagcgaaauggcggaggccuuaaagggcaugccgauucguuaccaaacaacagcuguuaaaagugaacauacaggaaaagaaauuguagaccuuaugugccacgcgaccuuuaccaugcgcuuauuaucaccuguacgaguuccaaauuauaauaugauuauaauggaugaagcacacuuuacugauccaucaucuauugcagcaagaggauacauuaguacccggguuggcaugggagaagcagcagcgauuuucaugacagccaccccuccugguagcguagaggcuuucccucaaucuaaugccgugauacaagaugaggaacgagauauaccggaaagguccuggaacuccgguuacgaauggauuacggauuucccagguaaaacugugugguuuguacccucgauuaaguccgggaacgauauagcaaauugcuugcguaagaauggaaaacgcgugauacaauuaucuagaaaaacuuucgauacagaguaucaaaagacuaagaacaaugauugggacuacguaguaacuacggacauuucugaaaugggagcgaacuuccgagccgauagagugauugauccucguagaugcuuaaaaccaguuauccuuaaggacgguccagagagagucauucuugcaggaccaaugccagucacuguagcuucagcagcccaaaggcggggacguauugguagaaaccauaacaaagaaggagaccaguauauauauaugggccagcccuugaauaacgaugaagaucaugcacauuggacggaagcaaaaauguuacuagacaauauuaauacuccggaaggaauaauaccagcauuguuugagccagaacgugaaaagucugccgccauagacggggaauaccgacucagaggugaagcuagaaaaacguucguugaacuaaugagaagaggcgauuuaccuguauggcucuccuauaaaguagcaagugaagguuuucaauacucagaccggcgcuggugcuuugacggugagcgaaacaaccaaguccuagaggaaaacauggauguggaaauauggacgaaagaaggugaaagaaagaaauuaaggccacguuggcuugaugcaagaacauauucggauccacuagcacuaagagaauuuaaagaauuugcagcaggcaggaggaguguaaguggagaccuuauuuuagaaaucggcaagcugccucaacaucuuacgcagcgagcucaaaaugcuuuggacaaucuagugauguuacacaauagugaacagggcggacgugcuuauagacaugcgauggaggaacuuccugacacaauagagacacuaauguugcuugcauuaauagcaguucucacaggaggaguaacacuuuucuuccuaagugggagaggacuaggaaagacaaguaucggauuguuauguguaauggcaucaucaguucuuuuauggauggcaucuguagagccgcauuggauagcugcgaguauuauccucgaguucuuucuaaugguccuacuuauaccggagccagaucgacaacgaacuccacaagacaaccaacucgcguacguuguaaucgggcuucuauuuaugaucuuaacaguugcagccaacgaaaugggguuauuggaaacaaccaaaaaggacuuggguaucggucauguggcugucgaaaaucaccaucacgcgacgaugcuagacgucgaucuucauccggcuucagcuuggacucuauacgcuguggcaacuacaauaauuacaccaaugaugagacauacaauagaaaacacaacggccaauauuucacugaccgcgauugccaaccaagcugcaauauuaaugggacuggacaaaggcuggccaaucaguaaaauggacauaggaguuccuuuacuugcauugggaugcuauucccaagucaacccacuaacuuugacugcugcaguacuuauguuaguggcgcacuaugcuauuauagguccaggacuacaagcaaaagcuacuagagaagcacagaaaagaacggcagcagguauaaugaaaaauccuacaguugauggaauaguggcaauagaccuugacccuguaguuuaugacgcaaaauucgagaagcagcuuggacagaucauguuauuaauauuguguacuucucagauacuauuaaugaggacgacuugggcauuaugcgaguccauaacacucgccacaggaccacucacaaccuuaugggagggaucacccgguaaauucuggaacacuacuauagcuguuagcauggcaaacauuuuccgaggaaguuaucuugcgggggcaggacuugccuucucauuaaugaagucacugggagggggaaggagagguacuggagcgcagggagaaaccuuaggagagaaauggaaacgccaacucaaucaauugagcaaauccgaguucaacaccuacaaaagaaguggaauaauggaaguugaucguuccgaagccaaagaaggacuuaagagaggcgagaccacccgacacgcaguuuccagaggaacugcaaaguugaggugguuuguggaaagaaauuuagucaagcccgaagguaaagucauugaccuuggguguggucgaggaggcuggagcuauuauugugcaggacucaagaaaguuaccgaaguuaaagguuacacaaaagguggccccggacaugaagaaccaauuccaauggcaacguacggguggaacuuagugaaacuacacucggguaaagacgucuucuuuacaccuccugaaaaaugcgauacacuacuaugugacauuggagaaaguaguccuaauccuacgauagaagaaggaagaacauuaagggucuuaaaaaugguugaacccugguugcgggguaaccaauuuuguauaaagauacucaauccuuauaugccaucagugguagaaacccuggagcagaugcagagaaaacacggcgggauguuaguaagaaauccgcuuucacgaaauucaacucacgaaauguacugggucagcuguggaacaggcaauauuguaagugccgugaauaugacuuccagaauguuacuaaauagauucacaauggcacacaggaaaccaacauacgagagagauguagauuugggggccgggacacgacacguugcggucgaaccagaggucgcaaacuuagacaucauugggcaaaggauagagaauaucaaacaugaacacaaaucuacauggcauuaugacgaggacaauccauauaaaacuugggcauaccacggcaguuacgaaguaaaaccgucuggaucagcaagcucaaugguuaacggcgugguaaaguuauuaaccaaaccgugggacgucauaccaaugguaacucaaauagcaaugacagauacuacgcccuucggacaacagagaguauucaaggaaaaaguugacaccagaacaccaaaagcgaagagaggaacagcccaaaucauggaaguaacugccaaauggcuuuggggauuucuuucacgcaauaagaagcccagaauuugcacaagagaagaauuuacaaggaagguucgaagcaaugcagcuaucggggcgguuuucguagaugaaaaucaauggaacucugccaaagaggcuguagaagaugaacguuuuugggauuuaguccaaaaagaaagagaacuucauaaacaaggaaaaugugcaacuugcguauacaauaugaugggcaaaagggagaagaaacuaggcgaauuuggaaaggcuaaagggagcagagcuaucugguacaugugguuaggcgcaagauuuuuggaguuugaagcguuaggguuuaugaacgaagaccauugguucucgcgagaaaacaguuugucagguguugaaggcgagggacuacauaaacuggguuauauacuccgcgauauaagcaagauuccagggggaaacauguacgcagacgauacugcgggaugggauacuagaauuaccgaagaugauuuacaaaaugaagcuaaaauaacagauauaauggagcccgaacaugcacuacuagcaacgaguauauuuaagcuaacauaucaaaauaaagugguuagaguacaaagaccagcuaaaaauggaacuguuauggauguaauuucaaggcgagaccagcggggaagcggucaaguuggaacuuauggccuuaauaccuucacaaauauggaagcacaacugauacgucaaauggaaagcgaaggaauauuccuccccggagaacuugaaacacccaacuuagcagaacguguuuuagauuggcuagagaaauauggcguugaacgucuaaaacguauggcuaucucaggggacgacugcguaguuaaacccauagacgaccguuucgcaacagcucuaacagccuuaaaugacauggggaagguaagaaaagauauaccacaaugggaacccaguaaaggguggaacgacuggcaacaaguuccuuuuugcucucaccauuuccaucaguuaaucaugaaggauggacgugaaauaguagugccgugucgaaaucaagaugagcuaguuggaagggccagaguuucacagggagcaggauggucacuaagggaaacggcaugcuugggcaagagcuaugcucaaauguggcaguuaauguacuuucaucggcgugacuuacgcuuagcugcuaaugcuauuuguucugccguacccguugauuggguuccuacgucgagaacuacauggucuauccacgcgcaucaucaauggaugacuacagaggauauguugaguguuuggaaucguguauggauagaggaaaauccuuggauggaggauaaaacccacguuuccucauggggugauguaccauacuuaggaaaaagagaagaccagugguguggaucgcuaaucggccucacugcacgagcaacaugggccucaaauauucaagucgcaaucaaucaaguuagaagacucaucggaaaugagaacuaucucgauuauaugacuucgaugaaaagguuuaaaaaugagggugauccagagggggcccugugguga

SEQ ID NO: 21523 - RNA, 9879 nt, Artificial Sequence
  derived and/or modified CDS sequence (opt6) from DENV-1__FJ410192__SS-prME
ucggucaccaugcuauuaaugcuaaugccaacagcauuggcuuuucauuuaaccacucgcggaggggaaccccauaugaucguuaguaaacaagaaagagguaaaagccuguuauucaaaacaucagcagggguuaauaugugcacacuaauugcaauggauuuaggagagcugugcgaagauacgaugacauauaaauguccucgaaucacugaaacagaaccagaugauguagauuguugguguaaugcuacggacacaugggugacauauggaacaugcucgcaaacaggugaacauagaagagauaaaagaaguguggcacucgccccacauguaggucucgguuuagaaacucggacggaaacuuggaugagcagcgaaggggcauggaaacagauucaaagaguggaaacaugggcacuuagacaccccggcuuuacuguuauugcguuguuuuuggcacacgcgaucggaacaaguauaacacaaaaagggauuauauucauccuauuaaugcucguaaccccaagcauggcgaugcgguguguaggaauuggaucgcgagauuucguugaaggucuaucaggcgcaacauggguugauguaguauuagagcacggaucguguguuaccacuauggcgaaagauaaaccaacuuuagauauagaauuacuaaaaaccgagguuacaaauccagcaguccucagaaaacuaugcauugaggcuaaaauaaguaauacgacuacagacucuagaugcccaacccaaggugaagcgacuuuaguugaagaacaagaugcuaauuuuguaugcagaagaaccuucguggauagagguuggggcaauggcugcggccuauucggcaaaggcaguuuaauuaccugugcaaaauuuaaaugugugacaaaacuugagggaaaaauaguacaauaugagaaucuaaaauacucuguuauugugacaguccauacuggcgaucaacaucagguuggaaacgaaucaacagaacacggcacuacugcuacaauaaccccacaagcaccgacuacugaaauucaacuaacagauuauggugcgcugacccuagauugcaguccccguacgggucuagauuuuaaugaaauggucuuauuaacaaugaaagagaaaucuuggcuuguacauaagcagugguuuuuggauuuaccgcucccauggacaucaggagccucgacgucccaagagacauggaaccgacaagauuuauuagucacauucaaaaccgcacacgccaagaaacaggaaguagugguacuggguagccaagagggagcgaugcauacugcacuuacaggugcgacagaaauacagacaucaggaacuaccacuauauuugcaggacaucuuaaauguagacuaaaaauggacaaacugacguugaagggcaugaguuauguaaugugcacaggcagcuuuaaauuggagaaagaguuagcagaaacccaacacggaaccguucugguucaaauuaaguaugaagguacagaugcgccuuguaagauaccuuuuucaacacaggaugagaaggggguuacacaaaacggacgauugauuacagcgaaccccauaguaacagacaaagaaaaaccagucaacauugaagcagaaccgccauuuggagagucauacauugucaucggagcuggagaaaaagcacuaaaguugucgugguuuaagaaaggaagcucaauagguaaaauguuugaagcaaccgcucggggagcaagacgaauggcaauauugggugauaccgcuugggauuuugggucaaucggaggaguuuuuacuucuguggguaagcuaguacaucaaauuuuuggaacagcauacgggguccuuuucagcggagugaguuggacaaugaaaauaggaauagggguauuauuaacauggcucggccuaaacagucguuccacgucuuuaaguaugacauguauagcugugggcuuggugacauuauacuuaggaguaauggugcaagcugacagcggaugugucaucaauuggaagggaagggaacucaaaugugggucaggcauauucguaacaaaugaaguacacacauggacagaacaauauaaauuucaggcugauucucccaaacgcuuaagcgcagcuauaggaaaagcgugggaagaaggaguguguggaauacguucagcaacaagacuggaaaacaucauguggaaacaaauuaguaacgagcuuaaccacauacuauuggaaaaugacaugaaguucacaguaguggugggagauguagcagggauucucgcacaagggaaaaagaugauccguccacagccaauggaauauaaauauucuuggaaaucuuggggaaaagccaaaauaauuggugcugauguacaaaauacgacguuuauuauagaugggccuaauacgccugaaugccccgaugaucagcgugccuggaauauuugggagguagaggacuacggauuuggaauuuuuacuacuaauaucuggcuuaaauuaagagacagcuauacacaagucugcgaccaucggcuuaugagugcugcaauaaaagacaguaaggcuguucacgcagacaugggauauuggaucgaaucagagaagaacgaaacauggaaauuagcccgugcuucauuuauagaaguuaaaacauguauauggccuaaaucgcauacauuauggucuaacggaguacuugaaagugaaaugauaaucccaaagauauauggggguccaauaucgcaacacaauuaccgcccuggcuacuuuacucaaaccgccggacccuggcaccuaggaaaacuagaacuugacuucgaucuaugcgaaggcacgacggugguaguugacgaacauugcgguaaucgugggccuaguuuaaggaccacaacgguaacaggaaagauuauccacgaauggugcugcagaucuugcacauuaccgccucuacgauuuaggggagaggauggguguugguaugguauggaaauccgaccagugaaagagaaagaagagaaucugguaaaaagcauggucucagcaggcucuggggaaguugauucuuucuccuuaggauuacuaugcauauccauaaugauagaggaaguuaugcgcucccgcuggucgaggaagauguuaaugacuggcacacuggcaguauucuuucucuuaauaauggggcagcugaccuggaaugacuuaaucagauuauguauuauggugggagccaacgcaucugaucgaaugggaaugggcacuaccuaccuagcguuaauggcaacguuuaagaugagaccgauguucgccguuggccuacuuuuuaggagauuaacaucgagagaaguucuguuacugacuaucggauuguccuuaguagcuagcguagagcuaccuaauaguuuagaagaauugggugaugggcuggcgaugggcauuaugauccuaaaacuacuaacagacuuccaaagccaccaauugugggcaacccuucuaagccuaacauuuauaaaaacgacuuuuucucuacauuacgcguggaaaacuauggcgaugauccucucuaucgugucuuuauuuccacuaugcuuaucaacuacuucacagaaaacaacuuggcuccccguacucuugggaagccuggguuguaaaccauuaacaauguuucuaauagcugaaaacaaaaucuggggccgacgaagcuggccgcugaacgaaggcauaauggcuguaggcauuguaucgauacuacucucuaguuuguugaaaaaugaugugccacuugcaggaccguuaauugcuggugggaugcuuauugcuuguuacguaauuucugggucaagugccgaucuaagucuagaaaaagcagcugaagugaguugggaagaagaagcggaacacagcggcgcgucacauaauauauuggucgaaguacaagacgacgguacgaugaaaauuaaggaugaggaaagagacgauacauugacaauacuacugaaagcaacacuuuuggcuguaaguggaguauacccacuaucaauacccgcaacauuauuuguaugguauuucuggcagaagaagaaacaacgaucugggguccucugggauacuccgaguccuccggaaguagaaagagccguauuggacgauggcauuuauaggauuaugcaaagaggacuauuagguagaagucaagugggaguugguguuuuccaagagaacguuuuucauacaauguggcaugucaccaggggugcaguccugauguaccaagggaaacgcuuggaaccaucaugggcaagcgucaaaaaggacuugauaucguacggcggagguuggagauuacaaggaucauggaauacgggagaggagguucagguaauugcuguggagccaggcaaaaauccuaagaauguacaaacagcaccaggaacguuuaaaacaccagaaggugaagugggcgcaauagcacucgauuucaaaccuggaacuucaggcucaccaauaguuaauagagaaggcaagauaguaggacuauauggcaauggagucguaacuacuuccggaacauauguguccgcgauagcacaggccaaggccucgcaagaagggccuuugccagaaaucgaagaugaaguuuuucguaaaaggaaucuaaccauaauggaucuccauccaggauccgguaaaacucguagauauuuaccugcaauuguccgagaggcuauaaaaagaaaacugcgaacacuaauucuagccccaacccgaguaguagcuuccgaaauggcagaggcuuuaaaaggaaugccgauacgcuaucaaacuacagcaguaaaaucagaacacacgggaaaagaaauuguagaccucaugugccacgcuacuuuuacuaugcgauuauuaucgccgguacgagugccuaauuacaauaugaucauaauggacgaagcacacuuuacagacccuagcucgauugcggcacgugguuacauaagcacucguguuggaaugggugaagcagcugcgauuuuuaugacagcuacucccccuggcuccguugaagcguucccgcaguccaaugcgguaauccaggaugaagaaagagauauuccagagcgguccuggaacucgggauacgaguggaucacggauuucccggguaaaacaguaugguuuguuccaucgauaaaaaguggcaacgauauagcaaacugucuaagaaagaauggaaaaaggguaauucaauuaucacgaaaaacguuugauacugaauaucagaagaccaagaauaaugauugggacuacguaguaaccacugacauaucagaaaugggugcuaauuuccgggcagaucgggucauagacccccgcagaugcuuaaaaccuguaauacuaaaagauggaccagaacgagucauucuagcugggccgaugccagucaccguagcaucagcagcucaaagacgaggccgaauaggacgaaaccacaauaaggagggagaucaauacauauauaugggucaaccgcuaaauaacgaugaggaucaugcucacuggacagaagcuaaaauguuacuugacaauaucaacacaccagaaggaaucauacccgcccuguucgaaccagaaagagaaaagucagcagcaauagacggggaauauagauugaggggagaagccaggaaaacauuuguagagcuuaugcggagaggcgaccuaccugucuggcuaucuuauaaaguagcaucagaaggguuucaauacagugauagaaggugguguuucgacggcgaacgaaauaaucagguacuggaggaaaauauggacguugaaaucuggacgaaagagggagaaaggaagaaacuuagaccacgauggcuggacgcacgaacauauagugacccguuagcacuuagagaauuuaaggaauuugcggccggacgucgcaguguaagcggcgauuuaauacuggaaauagguaaauuaccucaacauuuaacgcaaagagcucaaaacgcauuagauaaucuaguaaugcuacauaauucugagcaagguggcagagcguaccgucacgcgauggaggaacuaccagauacaauagaaacccuuaugcuacuagcauuaauugccguccuaacggguggaguaacacuauucuuucuuagcggucggggucucggcaaaaccucaaucgguuuauuauguguaauggcgaguucaguauuacuuuggauggcuuccguagaaccacauuggauagcugccaguauuauacuggaguucuuccugaugguuuuguuaauaccugaacccgaucgacagcggaccccacaagauaaucaauuagcauauguagucaucggacuacuauucaugauauugacaguggcggcaaaugaaauggggcuucuagaaacgacaaagaaggauuuggggauaggccacguagcuguugaaaaucaucaucacgcugcgaugcuugacguagauuuacacccagcuucugcauggacacuauacgcgguagcgacuacaaucauaaccccgaugaugcgacauacgaucgaaaacacaacggcgaauauaucuuuaacagcaaucgcaaaccaagccgcaaucuugaugggauuagauaaagguuggccaaucuccaaaauggauauuggaguuccacuucuagcuuuggguuguuacucucaagucaacccacuaacauuaacagcagcaguccugauguuaguagcacauuaugcaauuaucggccccggccuacaggcuaaagcuacucgugaagcacaaaaacgcaccgcugccggcaucaugaaaaauccgaccgucgauggcauaguggcgauagacuuggauccaguagucuacgaugcaaaauuugaaaaacaacuaggccaaauaaugcugcuuauauuaugcacgucacaaaucuuauuaaugaggacuacuugggcuuuaugcgagucaauaacucucgcaacugggccacuaaccacauugugggaggggagcccuggaaaauuuuggaauaccacaauugcaguaucaauggcaaauauuuuucggggaucauaccuugcuggugcagguuuggcguuuucguuaaugaaaaguuuagggggaggcaggaggggcacaggcgcccaaggcgaaaccuuaggggagaaauggaaaaggcaauuaaaucaguugucaaagagcgaauuuaauacguauaaaagaucgggcaucauggaaguggaucgaucagaggcuaaagaagggcuuaaacgaggggagacgacgaaacaugcggucucacgagggacagcuaaacuaagaugguuuguagagagaaacuuaguaaaaccugaaggcaaagugauagacuuggguugcgggagaggaggguggucauauuauugcgcugggcuaaagaaagucacggaaguaaaaggcuacacgaaaggaggucccggccacgaggaaccaauaccuauggccacuuacggauggaacuuaguaaagcugcacucgggaaaagauguauucuuuaucccuccggaaaagugcgacacucuuuuaugcgauauaggagaauccaguccaaauccuacuauagaagaaggacguacgcuucguguacuaaaaaugguagaaccauggcuccgggguaaucaauuuuguaucaaaauacucaauccuuauaugccaucugugguagaaacacuugaacaaaugcaaagaaaacauggaggaaugcuugugagaaauccacuaagcagaaauaguacccaugagauguauuggguaucaugugggacaggaaauauaguuucggccguaaauaugacuagcagaauguuacuuaauagauuuacaauggcacaucguaaaccuacuuaugaaagagauguggaccucggagcugguacuagacauguggcaguagaacccgaggucgcgaacuuagauauaauaggccagaggauugaaaacauaaagcacgaacauaaaucuacguggcauuacgaugaggauaauccuuauaagacuugggcauaucacgggaguuaugaaguaaaacccucugggucagcaaguucuauggucaacggaguagugaaacuccuaaccaaaccaugggaugugauaccuaugguaacacagauagcaaugacagacacuacaccuuuuggacagcaaagaguguucaaggaaaaaguagacacuagaaccccgaaagcuaagagagggacagcucagauuauggaaguuacugcuaaaugguuauggggauuccugucuagaaauaagaaaccaagaauuuguacaagagaggaauuuacgcgaaagguacgaaguaacgcggcaauaggagcggucuucgucgaugaaaaucaguggaacucagccaaagaagcaguggaagacgaacgauucugggaccuugugcacagagaaagggaacuccauaaacagggaaaaugcgcaaccugcguauacaauaugaugggaaaacgugaaaagaaacuuggcgaauuuggcaaagccaaagggucgagagcuauaugguauaugugguuaggggcaagauuccucgaauuugaagcgcucggcuuuaugaaugaagaucacugguuuagucgagaaaauucguuaagugguguagaaggagagggcuuacauaaacuaggauauauauuacgagacauauccaaaauuccaggagguaauauguacgcagaugacaccgccggaugggauacacgaauaaccgaagaugacuugcaaaaugaagcuagaauaacugacaucauggaaccagaacaugcuuuguuagcuaagucuauuuucaaauuaacguaccaaaauaaaguaguccgaguacaaucuccugccaaaaaugggacaguaauggauguuaucaguagacgggaucaacgagguucgggacaagucgggacauauggauuaaacacuuuuacaaauauggaagcccagcucauacgucaaauggagagcgaaggaauauucucuccaucugagcuagaaacacccaacuuagccgagagaguucuagauuggcuugagaaguauggggucgaacgacuaaagagaauggcaauuucaggcgaugacuguguuguuaaaccgauugacgauagauuugcuacugcuuuaacugcuuuaaaugacauggggaaagugagaaaagauauaccucaaugggaaccaucgaaggguuggaacgauuggcaacaaguccccuucugcagucaucacuuucaucaacuaaucaugaaggaugggagagagaucguuguaccaugccguaaccaagacgaauuaguagggcgagcgaggguaagccagggagcuggcuggaguuuacgcgagacagcaugcuuaggcaaaucuuaugcacaaauguggcaguuaauguauuuccauagacgcgauuuaagacuggcugcaaaugcaaucugcucagcuguaccggucgauuggauuccuacuucaagaacuaccuggaguauccaugcccaccaucaauggaugacuacggaagacauguugucuguauggaacagaguauggauugaagaaaacccuuggauggaagacaagacucauauaucaaguuggggugacguaccuuauuuagguaaacgagaagaccaauggugcgguucgcuuaucggccugacagccagagcaacaugggcaacaaauauucagguggcaauuaaccaaguucgaagguuaauaggaaaugagaauuaucuugauuacaugacaucaaugaagcgcuucaaaaaugaaucugauccagagggugcauugugguag

SEQ ID NO: 21524 - RNA, 9879 nt, Artificial Sequence
  derived and/or modified CDS sequence (opt6) from DENV-1__FJ410194__SS-prME
ucgguaacuauguuauuaaugcucaugccuacggcgcuagccuuccaucuaacgacucguggaggggaaccacacaugauaguuagcaaacaagaacgaggaaaaucacuguuauuuaaaacuucugcuggugucaauauguguacauuaauugcaauggaucucggagaauugugugaagacacgaugacauauaaauguccaagaauaaccgaaacagaacccgaugauguagauugcuggugcaacgcgacagauaccuggguuacuuauggaacauguucccaaacuggggaacauaggcgugacaagcggaguguggcucuagcuccucacgugggauugggguuagagaccaggaccgagacauggaugucaucggaaggugccuggaaacaaauacagagagucgaaacaugggcacuaagacacccgggcuuuacagucauagcccucuuccuggcacacgcgauagggacaucaauaacucaaaaaggaauaauuuuuauacuccuaaugcucguaaccccaaguauggcaaugagauguguuggcaucgggaguagagauuucguagaagguuuaaguggagcaacuugggucgaugucgugcuagaacacggcuccuguguaacuaccauggcuaaggauaaaccaacucuagauauugaacuucucaaaacagaaguaaccaauccagcgguauuaagaaaacuauguauugaagcuaagauaucuaacacaacaacggauucucguuguccaacccaaggugaggcuacacuuguagaagaacaagaugccaacuuuguuuguagacggacauuuguagauaggggauggggcaacggaugcggucuuuucggcaaaggauccuuaauuacaugcgcgaaauuuaaaugcguaacaaagcuagaaggcaaaaucguacaauaugaaaaucucaaauacucgguuauagucacaguccacaccggagaucagcaccaagugggcaaugaaaguacggaacacggaacgacggcuacuauaacuccacaagccccaacaacugaaauacaauuaacagacuauggugcccuaaccuuagauuguagcccuagaacuggucuugacuucaacgaaauggucuuacuuacgaugaaagagaagaguuggcuuguucacaaacaaugguuuuuggaucuaccacugccauggacaaguggagcaaguacaagucaggaaacuuggaaucggcaagaccugcuagugaccuuuaaaacagcccacgcaaagaaacaggaggucguuguucugggcagucaggaaggagcaaugcauacugcccuaacgggugcgacugaaauacaaacgagcggaaccacaacaauauucgcuggacaucuaaagugucgacuuaaaauggauaaauuaacauuaaaaggaaugucuuacguaauguguaccggaucguucaaacuagaaaaagaggucgcugaaacccagcacgggacaguacugguccagauuaaauaugagggaacggaugcaccaugcaaaaucccuuucaguacccaggacgagaaaggaguaacgcagaauggacgguuaaucacugcuaacccgauaguaacugauaaagaaaaaccuguuaauauugaagcagaaccaccauuuggugaaucauauauagugauuggagcgggagaaaaagcacuaaaauuaagcugguuuaagaaaggaagcuccaucggcaaaauguucgaagcuacugcccguggugcaaggagaauggcuaucuugggagauaccgcgugggacuucgguagcaucggggguguauuuacaagcguaggaaagcuaguccaucagauauuuggcacugccuacgguguauuauuuaguggagugagcuggacgaugaaaauuggaauuggaguauuguuaacuugguuaggucuuaacaguagaucaacuucccugucaaugacaugcauagcuguagggcuagucaccuuguaccucggaguuaugguacaagcagacucgggaugcguuauuaauuggaaagggagggaacugaaaugcgggucaggaauuuuuguaaccaaugaggugcacaccuggacagaacaauauaaauuucaagcugacaguccaaaaagauuaucggcggcuauagguaaagccugggaagaagggguuuguggaauuagaagcgccacacgucuugaaaacauuauguggaaacaaauaucgaaugaacugaaucauauacuauuggagaacgauaugaaauucacuguggugguaggagauguugcaggaauccuagcacaggggaagaaaaugauaagaccacagccuauggaauauaaauacaguuggaagucauggggaaaagcaaagauuauaggugcugauguucaaaauaccaccuucaucauugaugggcccaauacaccagaaugcccagacgaucaaagagcuuggaauauaugggagguagaggacuacggauuuggcauuuuuacaaccaacauaugguuaaaguuacgcgacaguuauacccaaguaugcgaccacagacuaaugucagcagcgauaaaggauucgaaagcaguacacgcugauauggguuacuggauugagagcgagaaaaaugaaacauggaaacuagcucgugccagcuuuauagaagucaaaacauguauauggccaaagagccauacgcuauggucaaauggcguccuagaaucugaaaugauuaucccgaagauauauggagggccuauaucacaacauaauuaucggccaggauacuuuacucaagcggcagggccauggcacuugggcaaguuagaacuagauuuugacuuaugcgaaggcacuaccgucgucguugaugagcacuguggaaauaggggaccuagccuacguacuacaacaguaacaggcaagaucauacacgaauggugcuguaggucuugcaccuuaccuccucuucgguuucggggugaagauggauguugguauggcauggaaauaaggccgguaaaagaaaaagaagaaaauuuagucaaaucuauggugagugcagguaguggagaaguugacuccuucagccuaggcuuacucugcauaagcauaaugauagaagaagugaugagaagccgcuggucacgacgaauguugaugacugggacccuggccguauucuucuuauuaauaaugggacaacuuaccuggaacgauuuaauucgccuauguauuaugguaggcgccaaugcaucugaucguauggguaugggcacaacuuauuuagcuuugauggcgacuuucaaaaugcggcccauguucgccgucggauuauuauucaggagacuuaccagccgugagguauuauuguugacaauuggauuaucauuaguugcgaguguagaacucccaaauagcuuagaagaacugggagauggccucgcgauggguaucaugauucuaaaacuuuugacugacuuucagagucaucaauuaugggcuacccuccucagucucaccuucauaaaaacaacguucucgcugcauuacgcauggaagaccauggcuaugguucuaagcauagucucacuuuucccauuauguuuaaguaccacaucucagaagacaacaugguugcccguacuuuuaggcucauuaggauguaagccccuuacuauguuuuuaauagccgagaacaaaaucuggggacgaagaaguuggccuuuaaaugaagguauuauggcgguagguauaguuucaauacuauuauccaguuuacuuaaaaaugauguaccccuagcugguccacuuauagccgggggcaugcuaauagcuuguuauguaauaucagguagcagcgcagauuuaucacuugaaaaagcagcugaaguuuccugggaagaagaggccgaacacaguggagcaucacauaauauucuuguagaaguucaagaugaugguacaaugaaaauaaaggacgaagaacgagacgauacacuaacaaucuuacuaaaggcuacauuauuagcgguaagcggcguuuacccccucaguauaccagcaacccuauucguaugguauuuuuggcaaaagaagaaacagaggaguggagucuugugggauacuccguccccaccagagguagaacgugcuguucucgaugacggaauuuaccguauaaugcaaaggggacugcucggacggagucaaguaggcguaggaguuuuccaggagaaugucuuucauacuauguggcauguuacucgcggugcaguauuaauguaucaaggcaaaagacuagagcccuccugggcgagcguuaaaaaggauuuaauuucguacggaggaggcuggagguuacaaggcucauggaauacaggugaagaaguccaaguaaucgcugucgaaccaggcaagaauccuaagaacguucaaacagcaccaggaacauucaagacaccggaaggggaaguaggugcuauugcuuuggacuuuaaaccaggaacaucgggcucgccaaucguaaacagggaaggaaaaauaguaggacuuuaugggaaugguguuguaacaacuucagguacauauguaagcgcuauagcucaagcuaaagccucccaggaaggaccuuuacccgaaauagaagacgaaguuuuccgaaaaagaaaucuuaccauaauggaccuucauccaggaagcggaaagacuagaagauaucuaccagcaauaguucgagaagccauuaagagaaaacuaagaacauuaauacucgcaccuacaaggguuguagccagugagauggccgaggcauuaaaagggaugcccauacgguaucaaacaacggcuguuaaaucagaacacacaggaaaggaaauuguagauuuaaugugccaugcuacuuucacgaugcguuuacuuucuccuguucguguaccgaacuauaacaugauaaucauggaugaagcacacuuuacagaucccucuucaaucgccgccagggguuauauuagcaccagggucggaaugggugaagcagcugcgauuuuuaugacagcuaccccgccgggcucuguagaagcguuuccacaaucuaacgccguaauacaagaugaagaacgcgacaucccugaaaggucguggaacucuggcuaugaauggauaacugacuuuccuggcaaaaccguaugguuuguaccgaguauaaaguccgggaacgauauagcaaauuguuugaggaaaaauggaaaaagaguaauacagcuaagucguaaaacauuugacacagaauaucagaaaacuaaaaauaacgauugggauuauguugucacuacagauauaucugaaaugggggcaaauuuucgugccgauagggugaucgacccacgaagaugcuuaaaaccggucauccuaaaagacgggccggaacguguaauacucgcgggaccaaugccaguaacgguagcaucagccgcacaacgaagaggcagaaucggucggaaucauaauaaagaaggugaccaauauauauauaugggacaaccucuuaauaacgaugaggaccacgcacauuggacugaggcgaaaaugcuacuggauaacaucaauacaccugagggaauuauuccggcacucuuugagccugaaagggaaaagagugcagcuauugauggugaauacagguuaagaggcgaagcccgaaaaaccuuuguggaauuaaugcgaagaggugaccuaccaguauggcuuaguuacaaaguagccucggaaggauuccaauauuccgacagaagguggugcuuugauggagaacgaaauaaccagguacuugaggagaauauggacguagaaauuuggacaaaagaaggcgaacgcaaaaaguugagaccuaggugguuggacgcuagaaccuauagcgacccauuagcauugagagaauuuaaggaguucgcugcgggccgucgaucaguaucaggagaucuaauauuagaaauagguaaauuaccgcagcauuugacccaaagagcacagaaugcucuagauaacuuaguaauguuacauaacagugagcaagggggcagagccuaucgccacgcuauggaagaacucccugauacuauugaaaccuuaauguuacucgcacuuauugcaguuuuaacgggaggaguaacuuuauucuuuuuaagcgggagaggacuugggaagacgucgaucggauuauuaugugugauggcuuccucaguacuauuauggauggcuucuguugaaccacauuggauagcggcuagcauuaucuuagaauuuuucuuaaugguacuuuugaucccugaacccgauaggcaaaggacaccccaagacaaucaguuagccuaugucgucauaggucuucuauuuaugauucugacagucgcagccaaugaaaugggauuauuagaaacaacuaaaaaggaccuagggaucggacauguagccguggaaaaccaucaucaugcagcuauguuggauguagacuugcacccagcuucagcauggacacuuuacgccguggcaacgacaauaauaacaccgaugaugcgucauacaauagaaaacacaacagcgaauauuucccuaaccgcuauugcaaaucaggcagcaauauugauggggcuggacaaaggauggccaauaucaaaaauggacaucgggguaccccuccuagcgcuaggcugcuauucacaaguaaauccucuaacucuuacggccgcaguucucaugcuaguagcacacuaugcaauuauaggaccaggacuucaagcaaaagcaaccagagaagcgcaaaagagaacagcagcgggcauuaugaaaaauccaacaguugauggcauugucgccaucgauuuagacccugucguuuaugacgccaaauuugaaaaacaauuaggccagauaaugcuucucauucucugcaccucacaaauauuauugaugagaaccaccugggccuuaugugaaucaaucacguuagcaacuggaccauugacaacacuuugggaaggcucucccggcaaauuuuggaacaccacaauagccgugucaauggcaaacauauuccgugguucguacuuagcuggagcaggcuuagcauucucacucaugaaauccuuaggaggcggaagaagaggaaccggugcgcagggcgaaacgcuaggggaaaaauggaaacgccaacucaaucaacugucaaaaagugaauuuaauacauauaagagaucagguauaauggaaguagaccguagcgaagcaaaagaaggcuugaagcguggugaaacuaccaaacaugcuguaucucgggguacugcgaaacuuagaugguucgucgagcgcaauuuggucaaacccgaaggaaagguaauugaucuaggcuguggaaggggaggauggagcuacuauugugcgggucucaagaaaguuaccgaaguaaaaggauacacuaaaggaggacccggccaugaagaacccauaccuauggcuacauaugguuggaaucuaguaaaacuacccucuggaaaagacgucuuuuucauaccaccagaaaaaugugauacacuacuuugugacauaggugaaucaagcccuaacccuacuauagaagaaggaagaacccuaagaguauuaaaaaugguagagccguggcuaagaggaaaucaguuuugcaucaagauauugaauccauacaugccuucuguuguugaaacacuggaacagaugcaacgaaaacacggggguauguugguaagaaauccauuaucucgaaacucuacccacgaaauguacugggucucuugugguacugguaacauuguuucagcagucaacaugacaagcagaaugcuauuaaaccguuuuacgauggcacaucgaaaaccuacuuacgaacgggacgucgaucucggagccgguacgagacacguagcaguugaaccugaaguugcuaauuuagauaucaucggucaaagaauagaaaauaucaaacaugaacacaaaucaacauggcacuaugaugaagacaacccguauaaaacaugggcauaccauggcaguuaugaaguuaaacccagcgggucugcaagcagcauggucaauggcguuguaaaauuacucacaaaacccugggauguaaucccuaugguuacucagaucgcaaugaccgauacgacccccuuuggacagcagcgcguauuuaaggaaaaaguagacaccagaacuccgaaagcaaaaagaggaacagcccaaauaauggaaguuacagccaaaugguuguggggcuucuuaucaagaaauaaaaagccucggauauguacccgcgaggaauuuacccgaaaagugcgcucaaacgcugcuauuggagcaguuuuugucgaugaaaaccaguggaauagugcgaaggaggcaguagaagaugaacguuucugggauuuaguacauagagaaagggaauuacauaaacaaggaaaaugcgcuacgugugucuacaauaugaugggaaaaagagagaagaaguugggagaauuuggaaaagcuaaagguucaagggccauuugguacauguggcuaggugcccgauuuuuggaguucgaggcuuugggauuuaugaacgaagaucacugguuuuccagggaaaauucucuuucaggcguagaaggagaagguuuacacaaacuagguuacauccuccgagauauaucaaaaauaccuggaggaaauauguacgcagaugauacugcagggugggacacuaggaucacugaagaugacuugcaaaacgagccacguauaacagauauaauggaaccagaacaugcacuucuagcaaagagcauauucaaacugacauaccaaaauaaaguuguuagaguacagagccccgcuaaaaaugggacugugauggacguuaucagucgacgcgaucagagggggucgggccagguagguacauauggacugaacacuuuuacgaauauggaagcacaguugauaaggcagauggaaucugaaggaaucuucaguccaagcgaacuagagacuccaaauuuagcggagagaguacucgauugguuagaaaaauauggcguagaaagauuaaaacguauggccauaagcggggaugauugcgucguuaaaccaauagaugauagauuugcaacugcguuaacagcauuaaaugauauggguaaaguucgaaaagauauaccgcagugggaacccucgaagggguggaacgauuggcaacaaguuccauuuuggucacaucauuuccaucaauugaucaugaaagauggaagagaaauaguaguaccgugucgcaaucaagacgaacucguaggaagggcaagggucagccaaggugcagggugguccuuaagagaaaccgcgugucuggcaaaaucuuaugcacagauguggcaguuaauguacuuccaucgaagagaucucagacuagcagcuaacgccauauguucagcaguaccaguagauuggauucccacaucuagaacaacauggucgauucacgcucaucaccaguggaugacgacugaagauaugcuuaguguauggaacaggguuuggauugaagaaaauccuuggauggaggacaaaacacacauauccucauggggagauguaccauaucuaggcaaaagagaggaucaauggugcggaucauuaaucggacucacggcccgagcaacaugggccacaaacauacagguggcaauaaaucaaguaaggcggcuaauuggaaaugagaacuaccuugauuauaugacaaguaugaaacgauucaaaaacgaaucugaucccgagggugcguugugguaa

SEQ ID NO: 21525 - RNA, 9879 nt, Artificial Sequence
  derived and/or modified CDS sequence (opt6) from DENV-1__FJ432725__SS-prME
agcguaacuauguuacuuaugcuuaugccuacagcacucgcauuucaucuuacuacacgaggaggagaaccucauaugauaguuucuaaacaagaacguggaaaaucucuguuguucaaaacaucagcagggguaaauaugugcacacuaauagcgauggaccuuggagaacuuugugaagauacaaugacauacaaauguccaagaauaacugagacugagccugaugacguugauuguugguguaaugcgacugauacaugggucacuuaugggacauguagccaaacaggugaacaucgucgagauaaaagaucugucgccuuagcgccacaugugggauuaggauuggaaacaagaacagagaccuggaugaguuccgaaggugcauggaaacaaauucaaagaguagaaaccugggcacuaaggcauccgggauucaccguaauagccuuauuuuuggcucaugccauaggaaccaguauuacucaaaaaggaauaauuuucauuuuauuaauguuaguaacuccgucaauggcuaugcgaugcguaggcauaggcucacgagauuuuguagaagguuuaucaggggccaccuggguagauguaguacuagagcacggcucuugcguuacaacuauggcuaaagacaaacccacauuagacaucgaguuguugaaaacagaagucacaaaucccgcagucuuacgaaaacuuugcaucgaagcuaaaaucuccaauacaacaacagauucccgcuguccaacucaaggagaagcaacuuuaguagaagaacaagaugcuaacuuuguuugccguagaacuuuuguugaucgugguuggggaaaugguugcggcuuauucggaaaaggaucccuuauaacaugcgcgaaauuuaaauguguuacuaaacuagaaggaaaaauaguacaauacgaaaaucuuaaauacucggugauagucacuguucauaccggugaccaacaucagguaggaaaugaaucaacugaacauggcacuacugcaacgauuacgccacaagcuccgacaacugaaauccagcuaacugacuacggggcauuaacacuugauugcaguccuaggacaggauuagauuuuaacgaaaugguacuuuugacuaugaaagagaaaagcuggcuuguucacaaacagugguuuuuagaucuucccuugccguggacaagcggugcaucaaccucucaagaaacauggaacagacaagaucuauuagugacuuuuaaaacagcacacgcaaagaaacaggagguugugguauuaggcagccaagaaggagcaaugcacaccgcacugaccggagccacugaaauucagacaucaggcacuacuacuauauucgcugggcacuuaaaaugucgccuuaaaauggauaaacuaacguuaaaaggaaugaguuaugucaugugcacaggaucuuucaaacuugaaaaagaaguagcagaaacacagcauggaacgguuuugguccaaauuaaauaugaagguacagacgcucccuguaaaauaccguuuuccacacaagacgagaaaggggucacacaaaacggucgauuaauuacggcuaaucccauuguuacugauaaagagaaacccguuaauauagaagcugaacccccauuuggagaaucauauauaguaauaggggcaggggaaaaagcacugaaacuaucuugguuuaagaaagguucguccauagguaaaauguuugaggccacagcacgaggggcacgaagaauggcaauauuaggggauacagccugggacuuugguaguauuggagguguguucacuuccgucgguaaauugguacaucaaaucuuugggacagcguacgguguauuauucucaggugugucuuggacaaugaaaauaggcaucggcguuuuacugacaugguuagguuuaaauucucguucuacuucccuuucaaugacuugcauagccgugggacuugugacccuauaucucgggguaaugguucaagcggauucuggauguguaauaaauuggaaagguagagaacuaaagugcggauccggaauauuuguuacuaaugaaguacauacguggacugaacaauacaaauuccaagcugauaguccaaaaagguuaucagcagcgauaggcaaagccugggaagaaggagugugcgggaucagaagcgcgacucgacucgaaaacauaauguggaaacaaauaucgaacgaguuaaaccacauuuuauuagaaaacgauaugaaauuuacaguaguagugggggacgucgccggaauauuagcacaaggcaagaaaaugauuagaccacaaccgauggaguauaaauauucauggaaaagcuggggaaaagcaaaaauuauuggcgcagauguacagaacacaaccuucauaauugauggaccuaacacaccugaauguccagacgaucaacgagcuuggaacauaugggaaguugaggacuacggguuuggaauauucacaacaaacauuuggcugaaacuuagggacucauacacacaaguaugcgaucaucgccucaugagugcggccauuaaagacucaaaagcuguacaugcggauauggguuauuggauagaaucagagaaaaaugaaacauggaaacuugcccgagcuagcuucauagaagugaagaccuguauauggccaaagucucauacauuauggucaaaugguguauuggagucagagaugauaauuccaaaaauuuauggaggaccaaucagucaacauaacuauagaccagguuauuucacacaagccgcgggaccuuggcacuuagggaagcucgaacuagauuuugaccuaugcgaagguaccacuguaguaguugaugaacauugugguaaucgcggaccuagccuaagaacaacuacagucacaggcaagauaauacaugagugguguuguaggagcugcacguuaccaccccuuagguuccgcggggaagacggaugcugguacggaauggagaucagaccaguuaaggaaaaagaagaaaaccuaguuaaaagcauggucuccgccgguucaggagagguugacucuuucucauuggguuugcuaugcaucucuauaaugauugaagaaguaaugaggaguagguggagcagaagaaugcugaugacuggaacauuggcaguauucuuuuuauuaauuaugggacaacuuacauggaaugacuuaauacgauuauguaucaugguuggagcaaacgccucggauagaauggggauggguaccacuuaccuggcauuaauggcaacauucaaaaugagacccauguuugccgucggauuacuguuccggagacuaacuagcagggaaguauuacuucuaacaauagguuuauccuuaguagcuucaguugaacucccaaauaguuuagaagaacuaggagacggucuugcuaugggcaucaugauauuaaaacuccugacagauuuucaaagucaucaauuaugggcuacacucuuaagccuuacguuuauuaaaacaaccuucagccuacauuacgcauggaaaacaauggcgaugguucuaucuauaguaagccuauuucccuugugcuugaguacgacgucucagaaaacgaccuggcucccaguacuuuuaggaagucuagggugcaaaccacuuaccauguucuuaauugcagaaaauaaaauuuggggaagaagaucuuggccauuaaaugaagggauaauggccgugggaauaguuucaauacuacuuucaucauuauugaaaaaugacguaccacuugccggaccacugauagcaggcgguaugcuuauagcaugcuauguaauaucugguucuagcgccgauuuauccuuagaaaaagcggccgaaguuaguugggaagaagaggcagaacacucuggagcaucccacaacauacucguggagguccaagaugaugggaccaugaagaucaaggaugaagaacgagaugacacucuaacgauccuacuaaaggcuacgcuacucgcggucaguggcgucuauccucugaguauuccggcaacauuauuuguaugguacuuuuggcagaagaagaaacaaaggucaggaguucucugggauacgccuucuccaccugaaguagaaagagcuguacucgacgauggaauauaccgaauuaugcaacggggacuacuagggcggucacaagucggcguaggcguguuccaagaaaauguguuucauaccauguggcauguuacuagaggagcuguucugauguaccaagguaaacgccuugaaccgagcugggcuuccguaaagaaggaucuaauuagcuacgggggaggauggaggcugcaaggaagcuggaacacaggcgaggagguucaagucauagcaguugaaccaggaaagaaucccaaaaauguucaaacagcaccugguacuuuuaagacaccagagggagaaguaggagcaauugcacuagacuuuaaaccagguacaagcggaucuccgauagugaacagagaaggaaaaaucgucggacucuacgggaacggagucguuacgacuucaggaacauacguaucagcgauagcucaagcaaaggcuucucaggaagguccuuuaccugaaauagaagacgaaguguuccgcaaacgaaauuugacaauuauggaucugcauccaggcucaggaaaaacuagaagguauuuaccugcaauaguaagagaagccauaaaaagaaaauuaagaacucuaauacucgcaccaacucgagugguagcaagcgagauggcugaggcuuugaaaggaaugccuauaagauaucagacaaccgcuguaaaaucggaacauacaggaaaagaaaucguggaucuaaugugccacgccacauuuacuaugcgauuguuaaguccagugagagucccgaacuacaauaugauuauuauggacgaagcacacuuuacagaucccaguucuauagcugcuagaggauacauuucaacccgcguaggaaugggagaggcggcugcaaucuuuaugacagcaacuccaccaggaucaguugaggcuuuuccacaaagcaaugcaguaauucaagacgaagaacgugauauuccagaacgaaguuggaacaguggauaugaguggauaacugacuuuccagguaagaccguaugguucgucccuucuauaaagucuggaaaugacauugccaacuguuugaggaaaaaugguaagcgcguaauucaauuaucacgaaagacauuugacacagaauaucagaagaccaaaaacaacgauugggauuacguugucaccacagauauaucagaaaugggcgcaaauuucagagcugaucgcguaaucgacccccggcgcugccugaaaccagucauauuaaaggacggaccggaacgaguaauacuugcaggucccaugccggugacugucgcaagcgccgcccaaagaagaggacgcauagguagaaaucauaacaaagaaggagaucaauacauuuacaugggucaaccgcuaaacaaugacgaagaccaugcacacuggaccgaggccaaaaugcuacuagauaacauaaauacaccagaaggaauaauaccggcccuauuugaaccugaacgagaaaaaucagcagcaauugacggagaauauaggcuaagaggggaggcaagaaagacuuuuguugaacugaugcgaagaggcgaccuaccaguauggcuaaguuauaagguggcgucagaaggcuuccaauacucugaccgacgcugguguuucgauggagaacgcaauaaucaaguguuagaagaaaauauggauguagaaauuuggacaaaagaaggagaacguaagaaguuacgaccgagguggcucgacgcgcgcaccuacagcgauccacuggcccuucgagaauuuaaagaguuugccgcaggccgucgaucaguuagcggcgauuuaauccucgaaauugggaaguuaccccaacaccuaacacaaagagcucaaaaugcacuagacaauuuaguuauguuacacaauucagaacaaggaggacgcgcuuauaggcaugcuauggaggagcuacccgauaccauagaaacacuuaugcuauuagcguugauagcuggggugacagguggagugacucucguguuucuaagugguaggggauuagguaaaacaaguauagggcuacuaugcgucauggcgaguucagucuuguuauggauggcgaguguugagccacacuggauagcugcaaguauaauauuagaguucuuuuugauggugcuacuaauaccugaaccugaccgccagcgaacuccacaagauaaucaauuggccuacguuguaauaggauuauuauuuaugauacucacuguugccgcuaacgagaugggccuuuuggaaaccaccaagaaagacuuggggauaggacaugucgcaguggaaaaucaucaucacgcagcuaugcuugauguugaucuacauccugcgagugcauggacgcucuacgcuguggcgaccacaauaauaacacccaugaugagacauacaaucgagaauacaacugcuaauauuaguuuaacggcuaucgccaaccaggcagcgauacuaaugggacucgcgaaagguuggccaaucucuaaaauggacauugguguaccacuguuagcacucgguuguuauucacaagucaacccuuuaacgcugaccgcuccaguucuaauguuaguagcucauuacgcaauaauaggucccggguuacaagcaaaggcaacacgagaggcacagaaacgaacggcagcagguaucaugaaaaauccgacuguggauggaauuguagcaauugaccuagauccuguaguauaugacgcgaaauucgaaaaacaacucggccaaauaauguuacuaauauuauguacaucgcaaauacuacuaaugagaacuacuugggccuuaugcgagucuauaacucuugcuacaggaccacuaacgaccuugugggaggguuccccggggaaguucuggaauacgacgauugcugugaguauggcgaacauauucagaggaaguuaucucgcgggagcaggguuagcauucucccucaugaaaagucuagguggagguagacgaggaacaggcgcccaaggugagacccuaggugaaaaauggaagcgacaacuuaaucaacucuccaaauccgaguucaacacuuacaagcgguccgggauaauggaaguagaucgaucugaagccaaggaggggcuaaaacguggugaaacgacaaaacaugcaguaucuagaggcacagcuaaacuccgaugguuugucgaacgaaauuuagucaaacccgaaggaaaaguaaucgauuuaggauguggacgugggggcugguccuauuauugugcgggcuugaagaaaguaacugagguaaaaggauacaccaaaggaggcccgggacaugaggaaccuauuccaauggccacuuacgguuggaauuuaguaaaacuccauucuggaaaagacguuuucuuuauaccaccagaaaaaugcgauacucucuugugcgauauuggagaaagcucaccuaauccaacuauagaagaaggacggacucuacgaguguuaaaaaugguggaaccguggcuaagagguaaucaguucuguauaaaaauuuuaaauccguauaugcccaguguaguggaaacuuuagaacagaugcaacggaaacauggugguaugcuaguacgaaacccgcuaucuagaaauuccacgcaugaaauguauuggguauccugcgguacagggaauauaguaucggcaguaaauaugacaaguagaaugcuucugaacagauuuacaauggcacauagaaagccaaccuacgagagagauguagaccugggagccggaccaagacauguugccguggaaccagaaguagcuaaccuagauaucauuggccaaaggauagaaaauauaaaacaugagcacaaguccacguggcauuacgacgaagauaacccguauaagacgugggcguaccauggaucguacgaaguaaaaccuucaggaucggcuucuuccaugguaaauggaguaguuaaguuacugacgaagccgugggauguuauuccuaugguuacccaaauugccaugacggacaccacaccguucggacaacaacguguauuuaaggagaagguagauacuagaacacccaaagcaaaacgugggacagcacagaucauggaaguuaccgcaaaaugguuauggggguucuuaucccgaaauaagaaaccaagaauaugcacaagagaagaauuuacgaggaaaguuagaucaaaugcagcuauaggagcgguauuugucgaugaaaaucaauggaacucggcgaaagaagccguugaagacgagcgcuuuugggacuuaggccaucgagagcgugaacuccauaaacaaggaaaaugcgcaacgugcgucagcaauaugaugggaaaacgugagaagaaauuaggugaauuuggaaaaccaaaaggaagcagaccaauaugguacauguggcuaggcgcuagguuccucgaauuugaagcgcucggguucaugaacgaagaucacugguuuagucgcgaaaauucauuaucgggcgucgagggcgaggguuugcauaaacuaggauauaucuuacgagauauaaguaaaauaccgggagguaauauguaugccgaugauacagcaggaugggauacaagaauaacggaagaugaucuccagaacgaagcucgaaucaccgauauaauggagccugagcacgccuuauuggcaaaaagcaucuucaaguuaacauaucaaaauaaaguaguacguguacagagaccugccaaaaauggcacagugauggacguaauaucaaguagggaucaaagaggaucgggacaagugggaacauaugggcuaaauacguuuacaaacauggaggcgcagcucauacgucagauggaaagcgaaggaaucuuuucaccaucagaauuagagacaccaaacuuagcggaaaggguucuagacuggcucgaaaaguacggcguggaacgcuuaaaacgaauggcaauuaguggcgaugauuguguaguuaagccgauagaugacagauuugcuacagcucugacugcuuuaaacgauaugggaaaaguacgaaaggacaucccgcaaugggaaccuucaaaaggguggaacgauuggcaacaagugccguucugcucacaucacuuccaucaauuaauuaugaaagacggacgagaaaucgucguccccugucgaaaucaagaugaauuagucggacgagcacgugugucucaaggggcagguuggucccuuagggaaacugcaugucucgguaaaaguuaugcucagauguggcaauuaauguauuuccaccgacgggaucugagauuggccgcaaacgccauauguagugccguaccuguugauuggauacccacaucacguacuacauggaguauccacgcccaccaccaauggaugaccacugaagauauguugucaguuuggaaccgggucuggauagaagaaaaccccuggauggaggauaaaacacacauaaguaguuggggagaugugccauaucuggguaagcgagaggaccaauggugcggaagccuaauuggucucacggcaagagccacaugggccaccaacauccaaguagcaauaaaucaaguuagacguuuaauaggaaaugagaacuaucuagauuauaugacaaguaugaaaagguuuaaaaaugagucagauccggaaggcgcgcuaugguaa

SEQ ID NO: 21526 - RNA, 9879 nt, Artificial Sequence
  derived and/or modified CDS sequence (opt6) from DENV-1__FJ432729__SS-prME
ucuguuaccauguuacuuauguuaaugccaacagcacuggcauuccaucuuacaacuagagggggagaaccacauaugaucguaacuaaacaagaaagaggaaaaucuuuauuauuuaaaacaagcgcaggggugaacauguguacauuaauugcaauggacuuaggugaacugugcgaagauacuaugacguauaaaugucccagaauaacugaagcagaaccugaugauguugacuguuggugcaaugcaacggauaccuggguaaccuauggaacaugcagccagacaggagaacaucgccgcgauaaaaggagcguagcacuagcuccccacgugggacuuggacuagagacaaggacggaaacauggaugucgucagagggagccuggaaacaaauacaacguguugaaaccugggcacuacgucauccaggcuuuacaguaauagcucuauuuuuagcucacguaauagguacaaguauuacucaaaaagguaucaucuuuauucuauuaauguuaguaacaccuagcauggcuaugagaugcguagguauaggcucaagagauuucguagaaggacugucaggugcaacuuggguugauguaguauuagagcacggaucauguguaacaacaauggcgaaagauaaaccaacucucgauauagaguuauugaaaacagagguuacaaacccagcuguuuugaggaaauugugcauagaagccaaaauaucuaauacgacuacagacucucgaugcccaacccagggggaagcaacccugauggaagaacaggacgcgaauuucguuugcagaagaaccuuuguggacagagguuggggaaacggaugcggguuauuuggaaaaggaagucugauaacuugcgcuaaauuuaaauguguuacaaaacuagaaggaaaaauaguacaauaugagaaccuaaaauauucaguaauagucacuguucacacgggagaccaacaccaaguaggaaaugaaucaacugagcauggaacaauugcuaccauuacuccccaagcaccaacaagugaaauucaguuaaccgauuauggugcccuaacucucgauuguucgccaaggacaggacuagauuucaacgaaauggugcuguuaaccaugaaggagaaaaguuggcuuguucacaagcaaugguuucuugaucuaccuuugccuuggacaucaggagcaucaacgagucaagagacguggaacaggcaagauuuguuagucacauucaaaacagcgcacgccaagaaacaagaagucguuguucuaggaucucaagaaggugccaugcacacagcccugacgggugcuacggaaauacaaacaucuggaacaacaaccaucuuugcaggucaccuaaaauguaggcuaaaaauggauaaauugacuuuaaaagguaugagcuacguaauguguacgggaucguuuaaauuagaaaaagaaguugcggaaacgcaacaugguacggugcugguucagauuaaauaugagggaaccgaugcccccuguaagauaccguucucaacgcaagaugagaaaggagugacccaaaacggacgccuuauaacagccaaucccauuguuacagacaaagagaaaccaguuaauaucgaagcagaaccaccauuuggcgaaaguuacauaguaaucggcgcuggugagaaagcauuaaaacucaguugguuuaagaaagggucaucuauugguaagauguucgaagcgacagcaagaggggcacgaagaauggcuauucuuggggacacugcgugggacuuugggaguauuggagguguauuuaccagugucgguaaacuuguucaccaaauuuucggaacggcauauggaguuuuguucaguggggucaguuggacgaugaaaaucggaaucggcgucuuacuuacaugguuagguuuaaacaguagaucaacgucuuuaucuaugacguguauagcagugggacucguuacucuauauuugggcgucaugguucaagcugacucaggcugcguuauaaauuggaaaggacgcgaacuaaaauguggaagcgguauauucguaacgaacgaaguacacacguggacugaacaauauaaauuccaggcagauucgccaaagagacuaucagcugccaucggaaaggcuugggaagaaggcguuugugguauaagaucagcaacuaggcucgaaaauauaauguggaagcaaauaucaaacgaauuaaaucauauauuacuugaaaaugauaugaaguucaccgugguaguaggugacguagugggaauccuagcacaaggcaagaaaaugauuagaccacaaccuauggaacacaaguacagcuggaagucaugggggaaagcuaaaauaauaggagccgacguacaaaauacaacuuuuauaauugaugguccuaauacccccgaguguccagaugaccaaagagcauggaauauaugggaaguugaagacuacggguucgguauuuuuacuaccaauaucuggcuaaaacuucgagacucucauacgcagguuugugaucaccgacucaugucagcggccauaaaggauucaaaagcagugcacgcagauaugggauacuggaucgaaagugagaaaaaugaaaccuggaaauuagccagagcuagcuucauagaagugaaaacguguaucuggccuaaaucucauacccuauggucaaacggaguuuuggaaucagaaaugauuaucccaaaaauauacggaggaccaauaagucaacauaauuauagaccgggcuauuuuacccagacggcugggccguggcacuuaggaaaguuagaauuagauuuugaucuaugugaaggcaccacaguuguggucgacgagcauugcggaaauagggggcccagccuuaggacaacgaccguaaccggaaaaauuauucaugaaugguguugucgaaguuguacgcugccuccgcuuagguuuaaaggagaggauggguguugguacgggauggaaauaagaccagugaaggaaaaggaagagaacuuaguaaaauccauggugucagccgguaguggagaaguggacaguuucagcuuaggucuucuauguauaucuauaaugauugaggaaguaaugagaaguagauggagccguaagauguuaaugacagguacguuagcgguauuucuauuguugauaaugggucagcucacguggaacgauuuaauacgauuaugcauaaugguuggugccaaugcuucagaucgcauggguauggguacgacauaccuagcccucauggcuaccuuuaagaugagaccaauguucgcaguuggauuacuauucagaaggcuuacuucacgugaaguauuacuauuaacaauagguuuaaguuuggucgcgucaguagaacuaccuaacucccuagaagaacuuggugacggacuagcuaugggaaucaugauacuuaaauuacuaaccgauuuccaaucacaucaacuaugggccaccuugcucucucucacauuuauaaaaacgacccuuagucuacauuaugcauggaagacuauggcuaugguucuaucaauagucucauuguuuccuuuaugcuuaucaacaaccucacagaaaacuaccugguuaccaguucuauuaggcagucuaggauguaaaccacuagccaugcuuuuaauagccgaaaauaagauauggggcagaaaaagcuggccacuuaacgaagggaucauggcaguuggaguuguuucaauccuguuguccucucugcuuaaaaaugacguaccacuugcgggaccucugaucgcaggaggaauguuaauagccugcuaugucauauccggaucaucagcugauuugaguuuagagaaagcugcugaagugucaugggaggaagaagcagaacacagcggagccagucauaauauauuaguggagguacaagaugaugguacaaugaagauaaaagacgaagaacgagacgacacuuuaaccauucuccuuaaagcuacacuuuuagccguaaguggugucuacccuuugucuauuccggcgacucuuuuuguaugguauuucuggcaaaagaagaaacaaagaagcggaguauuaugggacacaccuucgccacccgaaguagaaagagcaguauuagacgacgggaucuacagaauuaugcaaagaggucuauuagguagaagucaaguggguguuggcguauuucaagaaaaugucuuccauacaauguggcauguaacaagaggagcaguccucauguaucaagguaagaggcuagagccaagcugggcauccgucaagaaagaccugaucuccuacgggggaggauggagauuacaaggcucguggaacacaggagaagaaguacaaguuaucgcuguggagccuggcaaaaaccccaaaaauguucagaccgcaccagggacauuuaaaacaccagagggggaaguuggcgcuaucgcccuugauuucaaaccaggaacaaguggaaguccgauuguaaacagagaaggcaaaauuguuggacuuuaugggaaugggguaguaacaacgagugguacguacgugagugcuauagcucaggcgaaggcuucgcaggaagguccacucccagagaucgaagaugaaguguuucggaaaagaaaccugacuauaauggauuuacaccccgguucaggaaagaccagaagguaucuuccugccauaguucgagaagccauuaaacggaaauuaagaacguuaauacuggccccaacacggguaguagccuccgaaauggcagaggcuuuaaagggaaugcccauuagauaccagacuacagcaguuaaguccgaacauacgggaaaagaaauuguagaucugaugugccacgcaacuuuuaccaugagguuguugucuccugugaggguuccaaacuauaacaugauaaucauggacgaagcacauuucacugauccaucaucaauagcagcaagaggguauauaucuacucggguagguaugggcgaagcagcugcaauauuuaugacagcuacuccaccuggcaguguggaggcuuuuccgcaaucaaaugccguuauacaagacgaagagagggauaucccagagagaucauggaacucugguuaugaauggauuacagacuuuccgggaaaaacaguuugguuuguuccaagcaucaaauccggaaacgauauagcaaauugucuaaggaaaaaugguaaaagaguaauacaguuaucucguaaaacauucgauacagaauaccagaaaacuaaaaauaaugauugggauuaugugguuacgaccgacauaucagaaaugggagcuaacuuuagggcagauagaguuauagaccccaggcguugcuugaagccagucauucuuaaggauggaccugagcgcgugauacuagcgggaccuaugccgguuacagucgccagcgcggcucagcguaggggaagaaucggacgaaaucauaacaaagaaggggaccaauacauauacaugggacaaccauuaaauaacgacgaagaucaugcacauuggaccgaggcgaaaauguuauuagauaauauaaacacgccggaagguauaauacccgcauuauucgagccagaacgugaaaaaucagcggcgaucgauggggaauaucgauuacguggagaagcaaggaaaaccuucguugaauugaugcguagaggagauuugccaguuuggcuaucuuacaaggucgcgagugagggcuuucaauauagugacagacgauggugcuuugauggagaaagaaauaaucaaguuuuggaggaaaauauggauguggagauauggacaaaagagggugaacgaaagaaguugcguccaagaugguuagaugcuaggaccuacucagacccauuagcacuaagagaauuuaaggaauuugcggcaggccggcguucggucucaggcgauuuaauacuugaaaucgguaagcuaccacagcaucugacucagagggcacaaaacgcucucgauaaccucgugauguuacauaauucggaacaaggaggcagagcauacagacaugcaauggaagaauuaccagacaccauagaaacguuaaugcuguuagcauuaaucgcgguccuuaccgguggcguuacacuguucuuuuugaguggaagagguuuagggaagacgucuauuggccuucugugugucauggcgagcucaguacuacucuggauggccucaguggagccccacuggauugcggcgucuauuaucuuagaauuuuuccuaaugguauuauuaauaccggaaccggaucgucaaaggacuccacaagacaaucagcuagccuauguaguaauaggccuacuauucaugauuuuaacgguagccgccaacgaaauggguuuacuugaaacuacaaagaaggauuuagguauaggccacgucgccguugaaaaucaucaccaugcaacuauguuagauguggauuugcacccggcuucggcuuggaccuuguaugccguugcgacaacaauaauaacacccaugaugaggcacacaauagaaaauacuacagcaaauaucagcuuaacagcaauagcuaaucaagcugcgauauuaauggggcuagacaaaggauggccuauaagcaaaauggauauaggaguccccuuguuagcuuuggguugcuauagucaagucaauccguugacauuaacagcagcaguguugaugcucguggcucauuacgcaaucauaggucccgggcugcaagcaaaagcgacacgagaagcucaaaagcggaccgccgccgggaucaugaaaaacccaacgguggacggaaucgucgcgauagaccuagauccuguugucuacgacgccaaauucgaaaaacaguuaggacaaauaauguuacuuauauugugcacaagccagauauuacuaaugaggaccacaugggcgcuaugcgaguccauaacucuagcgacagguccucucaccacccugugggagggaucuccuggaaaauuuuggaacaccacgaucgcaguaucaauggcuaauauauuuagaggcucauaccuggccggugcuggauuagcuuuuagucugaugaaaucacuaggcggagggcggagaggaacuggggcacagggagaaacgcuuggagagaaguggaaaagacaauuaaaccaauuaaguaaaucugaguucaauauuuauaagagaucgggaauaauggaaguagacagauccgaggcuaaggaagggcugaaaagaggagaaacaaccagacacgcgguaagcaggggcacggcaaaauuaaggugguucguugaaagaaaucucgucaaaccugaaggaaaagugauagaucugggauguggaagagggggauggaguuacuauugugccggacucaagaaaguaacagagguuaaaggauacacaaaagguggcccgggacaugaagaaccgauaccaauggcaacauauggauggaaucuuguaaaacuacauucugguaaagauguauucuuuacaccgccagagaaaugugauacacugcuaugugauaucggagaaucaaguccuaauccuaccauagaggaggggaggacuuuaagaguauuaaaaauggucgaaccauggcugcgaggaaaccaauuuuguauuaaaauauuaaauccuuauaugccaagcgucguugagacacuugagcaaaugcaacguaaacaugguggcaugcuuguaaggaacccacugucaagaaauaguacacaugaaauguauuggguaucuuguggaacaggcaauauaguuagcgcgguuaacaugacuucucggauguuguugaaccgcuuuacuauggcucauagaaaacccacguaugagagagacguagacuuaggggcugggacgaggcacguugcaguugaaccagaaguugcuaacuuagauauaauaggacagagaaucgaaaauauuaaacaugaacauaaaucaacuuggcauuaugaugaggacaacccuuauaaaacaugggcuuaccaugggaguuaugaaguuaaaccaagcggaucugcaucaaguaugguaaacggcguaguuaaacugcucacuaaaccuugggacguaauccccaugguuacucaaauagcaaugacagacacaacgcccuucggacagcaaagagucuuuaaagaaaaggucgauacaagaacaccuaaagccaaaagaggcacagcucaaauaauggaggugacugcgagaugguuaugggguuuucuuucgcggaauaagaaaccuagaauauguacacgugaagaguuuacuagaaaaguucgaucaaaugcagcaauuggggcaguuuuuguugaugagaaucaauggaauagcgcuaaagaagcaguugaggaugaacgguuuugggauuuaguacaaaaagaaagagaauugcacaaacaggggaaaugugcaacauguguuuauaacaugaugggaaaacgugaaaagaaauuaggagaauuuggaaaagcaaaagggaguagagcuaucugguacauguggcuuggagcaagguuccuugaguucgaggccuuaggauucaugaaugaagaucacugguuuucccgggagaacagcuuaaguggaguugaaggagaaggucugcauaaacuaggcuacauacuaagagauauuagcaaaauaccaggugggaacauguaugccgaugauacagcuggaugggacacacguauaacagaagaugaucuccaaaaugaagcaagaauaacugacaucauggagccugagcaugcauugcuagcaacgaguauuuuuaaauuaacauaucaaaauaagguaguacguguacaacgccccgccaaaaacgggacagugauggauguaauaucacgacgugaccagagaggcaguggccaaguuggaaccuacggauuaaacacauuuacuaacauggaggcucaacugauccgacaaauggaaucggaagguauauuuuuaccaucagagcuggagacccaaaauuuagcugagagaguacuagacuggcuagagaaauacggagucgaaaggcucaaaaggauggcgauuuccggggacgacugcguaguaaagcccauagacgacagguuugcaacagcccugacagcguuaaaugacaugggcaaaguaagaaaggauaucccucaaugggagcccucuaagggauggaaugacuggcagcaagugccauuuuguucucaccacuuccaucagcuuaucaugaaggacggaagggaaaucguaguuccaugccguaaccaggaugaauuaguagggagggcaagagucucucaaggagcaggaugguccuuacgagaaacggcauguuuggguaaaucuuacgcucaaauguggcaacuaauguacuuucauagaagagacuuaagguuagcagcaaacgcaauaugcucagcaguaccaguugauuggguaccaaccucuagaacaacuuggaguauacaugcccaccaucaauggaugacuacagaagacauguuguccguauggaaccggguauggaucgaagaaaauccuuggauggaagacaagacucauguaucaagcuggggugacgucccauaucuaggaaaaagagaggaccaaugguguggaucuuuaauaggacuaacagcaagggcuacuugggcuaguaacauacaaguugcaauaaaucaaguccgaagguugauaggcaaugaaaacuaccuagacuacaugacaagcaugaaaagguucaaaaacgaaggugauccagagggagccuuaugguga

SEQ ID NO: 21527 - RNA, 9879 nt, Artificial Sequence
  derived and/or modified CDS sequence (opt6) from DENV-1__FJ432730__SS-prME
ucggucacuauguugcugauguuaaugccuacugcacuagcuuuucauuuaacgacacgaggaggggaaccucauaugauuguaucaaaacaagaaagggguaaaaguuuauuauucaaaacuagcgcaggaguaaauauguguacacugauugcaauggacuugggugaguucugugaagauaccaugacuuauaaauguccgcgaaucacagaggcggaaccagaugacguagacugcuggugcaaugcuacagacacuugggucacuuauggaacgugcagucaaacuggagagcacagacgagacaaacguagcgucgcuuuggcgccgcaugucgggcugggcuuagaaacacguacggagacauggaugagcagcgaaggugcauggaaacaaauacaacguguggaaacuugggcucuuagacauccaggauuuacagugauagcacuauuuuuagcgcacgccauagggacuucuaucacacaaaaagguaucauauucauacuauugauguugguaacacccaguauggcuaugagaugugugggaauagggucccgcgacuucgucgaaggauuaucaggagcgaccuggguagauguuguacuggagcacggaaguugugucacuacaauggcaaaagauaaaccuacuuuagauauagaacuuuugaaaacugaaguuacuaauccagcaguccuacgcaaauuauguauagaagcuaaaauauccaacacaacgacagauucccguugccccacucaaggagaagcgacucuaguagaggaacaagacgcaaacuucgucugucgucgaacauuuguagauaggggaugggggaaugggugcggauuauuuggaaaaggauccuuaauuacaugcgcaaaauuuaaauguguaacuaaacucgaagguaaaacgguucaauaugagaauuuaaaauauucgguaauaguaacgguacacacaggcgaccagcaccaaguaggcaaugaaaguaccgagcacgguacuaccgcgacaauuacgccucaagcacccuccacagaaauccaacuaacggacuacggcgcucuaacucucgauugcuccccaagaacuggauuagacuucaaugaaaugguuuuauuaacaaugaaagaaaaaucguggcuuguacauaaacaaugguuuuuggaccuaccguuaccuuggacaaguggagcuucuacaucacaagaaacguggaaccgaaaggaucugcuugugacguucaaaacugcccaugcgaagaaacaagaagugguaguguuggggucgcaagaaggagcgaugcauacagcacuaacaggagcaaccgaaauacagacaucugguaugacaacuaucuuugcaggucacuuaaaaugucggcuuaaaauggauaaguugacuuuaaaaggaaugucuuacgugaugugcacaggcucuuucaaauuagaaaaggagguagccgaaacgcaacacggcacuguucuugugcaaauaaaguacgagggcaccgacgcaccuuguaaaauccccuuuaguacacaagacgaaaaaggcguuacccaaaauggaagacuaauaaccgcuaacccaauaguaaccgauaaggaaaaacccguaaacauugaagccgaaccuccauuuggagaaagcuacaucgucauaggagcgggagaaaaggcucuuaaauuaucaugguucaagaaaggaaguagcauagguaaaauguuugaggcaacggcaagaggcgcaagaaggauggccauauuaggcgauacagcaugggacuuuggguccauuggcgguguauucacuucaguagguaaacugguacaucagauauuuggaaccgcauacggcguacuguucucgggaguuagcuggacuaugaaaauaggaauaggaguauuauuaacgugguugggucucaauucuagaagcacuucguuaagcaugacguguauugcugucggguuaguuacauuauaucucggcguuauggugcaggcagacuccgguugugugauaaauuggaaaggacgagaauugaaguguggcagcgggauuuuuguaaccaaugaagugcauaccuggacggagcaauauaaauuccaagcagauagcccaaaaagacuaucagcagcaauagggaaggcaugggaagagggaguuugugggauucgcagugcaacaagauuagaaaacauuauguggaagcaaauaucuaacgaacuuaaccacaucuugcuggaaaacgacaugaaauuuacaguugucguaggugauguggcgggaaucuuagcgcaaggcaagaaaaugaucagaccccagccaauggaauauaaauacucauggaaaagcuggggcaaagcuaaaauaauaggugccgauguacaaaacacaacuuuuauaauagauggucccaacacuccggaaugccccgacgaccaaagagcguggaacauaugggaaguugaagacuauggauucgguauuuuuaccacgaauauuugguugaaauuaagagauaguuauacccaagucugcgaucaucgacuaaugucagcagcgauaaaagauucgaaagcaguacaugccgacauggguuauuggauagagucagagaaaaaugaaacguggaaauuagcgagagccagcuuuauagaagugaagaccuguauuuggccaaaaucacauaccuuauggucuaacgggguguuggagucagaaaugauuauaccuaaaauauaugguggcccaauuucacaacauaacuauagaccagguuacuuuacgcaaacagcaggucccuggcaucuagguaaacucgagcuugacuucgauuugugcgaaggaacaacgguugugguagacgagcauugcggaaauagggggccuucguuaagaacaacaacuguaacggggaaaaucauacaugaaugguguugcagaagcuguacucuucccccuuugagguucaagggugaagacggcugcugguauggaauggaaauacguccaguaaaagaaaaagaagaaaaucuugucaagucaauggucagugcugggaguggggagguugauuccuuuucucugggacuucuuuguauuagcauaaugauagaggaaguuaugagaaguagauggucuaggaaaaugcuuaugacagggacccuggccguguucuuucugcuaauaaugggucaauuaaccuggaaugaccuaauaagauuauguauaaugguaggagcaaaugcgagcgauaggaugggaaugggcacaacuuauuuggcguuaauggcaacauuuaagaugagaccuauguucgcuguuggacugcuauuuagacgacuuacaucgcgugaaguucuacucuuaacuauuggauugagucuugucgcguccguagaguuaccaaacucucuagaggaacuuggcgaugguuuagcuaugggaauaaugauuuugaaguuguugacggacuuccaaucacaucaacuuugggcaacuuuauuaaguuuaaccuuuauaaaaacaacguuuagcuuacacuacgcuuggaaaacgauggcuaugguauuaaguauaguaucucuuuuuccgcucuguuuaucaacuaccucacagaagacaacgugguuacccguccuauuagggagucuaggcugcaaaccauugacuauguuuuuaauagcugagaacaagauuuggggucgaaagaguuggccauugaaugagggcauaauggcuguagguauaguuucaauccuacucaguagucugcucaaaaacgacguaccguuggcaggccccuuaauagcuggaggcaugcuaauugccugcuaugucauaucugggucaagcgcagaucuuucuuuagaaaaggcugccgaaguuucaugggaggaagaagcugagcauuccggagcgagccauaauauuuugguugaaguacaggacgauggaaccaugaaaaucaaagacgaagaacgggacgauacacuuacaauuuugcuuaaagcuacucugcucgcugugucaggcguauacccauuauccauaccagcaacacuuuucguuugguauuuuuggcagaagaagaaacaaaggucugguguauuaugggauacuccaucaccaccagaaguugaacgagcugucuuagaugacgguauauauagaauuaugcaaaggggauuauuaggccggagucagguaggagugggagucuuccaggaaaauguguuccauacuauguggcacgugacaaggggcgccguccuaauguaucaaggcaaaaggcuugaacccucgugggcuucaguuaagaaagauuuaaucagcuacggaggggguuggcguuuacagggaaguuggaauacaggcgaagagguacaaguaauagcaguagagccagguaaaaacccgaaaaauguacaaacugccccuggcacuuuuaaaaccucagaaggagaaguuggagcgauagcgcucgauuucaaaccaggaacaucaggaagcccuauugugaaccgugagggcaaaauagucgguuuauauggaaacgguguaguuacaacgagugggacauauguauccgcuaucgcucaagcuaaagcgagccaggaggguccucuaccagaaauagaggaugaagucuuuagaaaacguaauuugacaauaauggaccuucacccaggaucgggaaagaccagacgguacuuaccugcgauaguccgagaagcuauaaaaagaaaacuaaggacauuaauuuuagcgccaaccagaguagucgcaagugaaauggcugaagcacuuaaagguaugcccauaagguaucaaacaaccgcgguaaaaucagagcauacagggaaagagauagucgauuugaugugccaugcaacauucacaaugaggcuacugucaccgguaagagugccaaacuauaacaugauaauuauggaugaagcgcacuuuaccgauccuucauccauagccgcaagaggauacaucaguacuaggguagguaugggcgaagcugcagcaauuuuuaugacagcaacaccaccagguucuguagaggccuuuccacaaucaaaugcuguaauacaagaugaagaacgggacaucccagaacgaucguggaacaguggcuacgaauggauuacggauuucccugguaagaccguuugguucguaccaucuauaaaaaguggaaaugauauagcaaauugucuuaggaaaaacggaaagcgaguuauacaauuaucuaggaaaaccuuugacacagaguaucagaaaacuaaaaauaacgauugggauuauguaguuacgacagauaucagcgaaaugggagcaaauuuuagagcagaucgaguaauugauccacgcagaugccuuaaaccgguuauauuaaaagaugguccagaaagggugauacucgcugggccaaugcccguuacuguugcuagcgccgcacaaagacgagggagaauuggacgcaaccauaacaaagaaggugaucaauacauauacaugggucaaccuuuaaacaaugacgaagaucaugcacauuggacggaagcuaaaaugcuauuggacaacaucaacacuccugaaggaauuauuccagcgcuauucgagccagaaagagagaaaucagcagcgauugacggagaauaucgucucagaggugaggcacguaaaacuuuuguggagcuaaugagaagaggcgauuugcccguguggcuuucauacaaaguugccagcgagggauuccaauauucggaccguagaugguguuuugauggugaacgcaauaaccagguccuagaggagaacauggauguagaaauuuggacgaaagaaggagagcguaagaaauuacgcccucgguggcuagaugcuagaacauacuccgauccacuugcauuaagagaauuuaaggaauuugcagcagguaggcguaguguaucaggagauuuaauauuggaaauaggcaaacuaccacaacauuuaacacaaagggcacaaaaugcguuagauaauuugguaauguuacauaacucugaacaaggcggacgcgcuuaccgacaugcuauggaagaauuaccagauacuauagaaacacugaugcuacuggcacucauagccguauuaacaggugggguaacguuguucuuucugaguggaaggggacucgggaagacaagcauuggucucuuaugcguuauggcauccuccguuuuauuauggauggcaucgguugaaccgcauuggauugcagccagcauuauauuagaauuuuuccucauggucuuacuaaucccggaaccagaucgacagaggacaccgcaagacaaccagcuggcguauguaguaaucggucuccuauuuaugauuuuaacuguggcagcuaaugaaaugggucuacuagaaacaacgaagaaggaucuaggaaucggacauguagcgguugaaaaccaucaccacgcagcaaugcuagacgucgaccuacaucccgccucggcauggacucuauacgcaguggcgacaacaauuauaacaccuaugaugagacacacuauugagaacacgacagcuaauauuagcuuaacagcgaucgcaaaucaagccgcuauacugauggggcucgauaaagguuggccaauaaguaaaauggauaucggugucccuuuguuagcucuaggaugcuacucgcaaguuaauccucuuaccuuaacagcagcuguccuuauguuggucgcacauuaugcgauaauaggacccggauuacaagccaaagcaacacgagaagcacaaaaacggaccgcugcugggauaaugaaaaauccuaccguagacggaauagucgcgauagaccuugacccagucguuuaugaugccaaauucgaaaagcaacuugggcaaaucaugcuauuaauucuauguaccucacaaauauuguuaaugaggacaacaugggccuuaugcgaaucgaucacucucgcaacaggaccacugacaacucuaugggaggguagucccgggaaauuuuggaauacuaccauagcagucucaauggcgaauauauuucgugggaguuaucuggcgggcgcaggauuagcauucucucuaaugaaaucacucgggggcggacggcgggguacaggcgcacaaggggagacccuaggagaaaaauggaaaaggcaauugaaucaacuaagcaaaagugaauuuaauacauacaaaaggaguggaauaauggaaguggacagauccgaagcuaaggaaggucuaaaaaggggugagaccaccaaacacgccguaagucggggaacagcgaaacuaagaugguucguagagaggaaccugguaaaaccagagggcaaagucauagaccuagggugugggagaggaggauggucauacuauugugccggcuuaaagaaaguuacagaagugaaaggauacacuaaaggagggcccggccaugaagaaccgauacccauggcuacuuacggauggaauuuaguaaaacuucauagcggcaaagacgucuucuuuauaccaccugaaaagugugauacacuucugugugauauaggggaauccaguccuaauccaacuauugaagagggaagaacacuaaggguucuuaaaaugguagagccaugguuacgaggaaaucaguucuguauaaaaaucuugaacccguauaugccaucagugguagagacuuuagaacaaaugcaaagaaaacauggagguaugcuugucagaaauccgcuaagucgcaacucaacgcaugaaauguacugggucuccugcggaacugguaauaucguuagugcaguaaauaugacaaguaggaugcuacugaaccgauuuacaauggcccaucguaaaccgaccuacgaacgagacguagauuugggagcugguacaagacacguagcugucgaaccagaaguagccaaucuagacauaauaggucaaagaauagaaaauauaaaacaugagcacaaaucaacuuggcauuacgaugaggauaacccuuauaaaacaugggcguaucauggcucuuacgagguuaagccgucuggaucugcuucgucuaugguaaauggaguugugaaguuauuaaccaagccgugggaugugauaccaauggugacacaaauugcgaugacagacacaaccccguuuggacaacaaagaguuuuuaaagaaaaggucgacacaagaacgccgaaagcgaaaagagguacagcccaaaucauggaaguaacugcuaaauggcuuuggggauuuuuaucgcgcaauaagaaaccaagaauaugcaccagagaggaauuuacuagaaaaguaagaucgaacgcugcaauuggagcaguuuuuguagaugaaaaccaauggaacagugcgaaagaagcgguagaagacgaaagauuuugggauuugguccaucgagagcgcgagcuacacaagcagggaaaaugugccacguguguguacaauaugauggguaaaagagagaaaaaguuaggugaauuuggcaaagcuaaggggagcagagcuauaugguauaugugguugggagcacgguucuuagaguuugaagcacuugguuuuaugaaugaagaucacugguuuucuagggaaaacaguuuaaguggugucgagggcgagggucuacauaaauugggauacauauuaagggacauauccaaaauaccugguggaaacauguaugcugacgacacggccggaugggacacuagaauuacagaggacgacuugcagaaugaagcaaaaaucacagacauaauggaaccugagcacgccuuauuagccaagucuauauucaaacugacauaucaaaauaaggugguacguguacaaagaccagccaaaaauggcacagugauggacguaaucucaagacgugaucaaagaggcagcgggcaaguugguacuuacggacuaaauacauuuacuaauauggaagcucagcuaauuagacagauggaaucagaaggaaucuuuucgcccucugaacuagagacaccuaaucuagcaaggagaguacuggacugguuggaaaagcacggagucgagagacuaaaacgaauggcuauaagcggagacgacuguguaguaaaaccuauagacgauagauuugcaacugcacuaaccgcgcuuaaugauauggguaaagucagaaaggacauuccucaaugggaacccucuaaaggguggaaugacuggcagcagguaccauucuguagccaccauuuucaucaauugauuaugaaagaugguagagaaauaguggucccaugucgcaaucaagacgaauuaguaggucgcgcgagaguaucucaaggugcggguuggagccuaagggaaaccgcaugucucgguaagucuuaugcgcagauguggcaacucauguacuuucaucggagagaucuaagacuugcugcaaacgcaauuugcucagcaguuccaguggauugggugccuacaagucgaacuacauggucaauucacgcacaucaucaauggaugacuacagaagauauguuaucgguauggaauagagucuggauugaagaaaacccuuggauggaagauaaaacccacaucuccucguggggugauguaccauaucuaggcaaaagagaagaccaauggugugggagucugauaggcuuaaccgcacgggcuacuugggcuaccaauauccagguugcuaucaaucagguacgaagacucauuggaaaugagaauuacuuagauuauaugacaucaaugaaaagguucaaaaacgagucagacccagaaggugcuuuaugguaa

SEQ ID NO: 21528 - RNA, 9879 nt, Artificial Sequence
  derived and/or modified CDS sequence (opt6) from DENV-1__FJ432732__SS-prME
ucgguaacgauguuauuaaugcuuaugccgaccgcacuggcuuuucaucuaaccaccagagguggagaaccacacaugauaguaucgaaacaagaaagggguaaaucccuacuuuuuaaaaccucagcaggaguaaacauguguaccuuaauugcaauggauuuaggagaauugugugaagauacuaugacuuacaaaugcccgcgaauuacugaaaccgaaccugaugauguggauugcugguguaaugcgacggacaccuggguaaccuaugguacauguagucaaacaggagaacaccgccgagauaaaagaucuguugcccuggcaccacauguagggcucggauuagaaacaagaacugaaacuuggaugaguuccgaaggugcauggaaacaaauacaacggguagaaaccugggcacuacgacauccagguuucacaguuauagcacucuuuuuagcacacguaauuggaacaaguauuacacaaaaagguauaauuuuuauacuauuaaugcuuguaacucccagcauggcaaugcguuguguugggauaggaucaagggauuucguugaagguuuaaguggggcuacuuggguagaugugguuuuggaacacggcucauguguuacaacuauggcaaaagauaaaccuacgcuggacauugaacucuuaaaaacagaagucacaaauccugcuguauuacguaaguuguguauagaagccaagauuucgaauacaaccacugauagccguuguccuacucaaggggaagccacacuuguagaagaacaagaugcuaacuuuguauguaggcgcacuuuuguagauagagguugggggaaugggugcggauuauucggaaagggaucuuuaauaacaugcgcuaaauuuaaauguguaaccaaacuugaaggcaaaauaguccaauacgaaaaucuaaaauauucagucaucgucaccguccauaccggagaccagcaccaaguggguaaugaguccacagaacauggaacaacagcaacgauuacaccucaggcgccuacaacagaaauccaacucacggauuauggagcuuuaacacucgacuguucaccaagaacgggacuagacuucaaugaaaugguguuauuaacaaugaaagaaaaguccuggcucguccacaagcaaugguuucuagaccuuccauuacccuggaccaguggugcaucaacgucucaagaaacuuggaacagacaagaccucuuaguaaccuuuaaaacggcacacgccaagaaacaagaaguugugguacucggaucacaggaaggagccaugcauacugcucuaaccggggccacagaaauccaaacuuccggaacaacgacuaucuucgcugggcauuuaaaaugcagacucaaaauggauaaacuuacauuaaaaggaaugucauauguaaugugcacaggguccuuuaaacucgaaaaagaaguggcugaaacccaacacgggacaguauuaguacagauaaaauacgaaggaacagaugcuccuuguaaaaucccuuuuucuacacaagaugaaaaaggaguuacccaaaacggaagauugauuacggccaacccaauaguaacugauaaggaaaaaccaguuaacaucgaagcugaaccacccuucggagaaucuuauauaacaauaggcgccggugaaaaggcuuuaaaacuuaguugguucaagaaagguucgucuaucggcaaaauguuugaagccacagccaggggagccagacguauggcaauacucggagacacagccugggacuuuggcucaauaggugguguguucaccaguguagguaaguugguucaucagauauuugguacagcauaugguguucuguuuagugggguuagcuggacaaugaaaauaggcauaggaguccuccuaacgugguugggacuaaauucccggagcacaagucucucaaugacaugcaucgccguuggcuuaguaacgcuuuaucuuggaguaaugguacaagcugauagcgguugugugauuaacuggaagggucgagaacucaaaugugguaguggcauauuuguuacaaacgaaguccauacguggacggaacaauauaaguuucaggcagauaguccaaagcgauugucagcugccaucggcaaggccugggaggaaggaguuugcggaauaaggucagcaaccagacuagaaaauauaauguggaagcaaauuaguaaugaguugaaucacauucuucuggaaaaugacaugaaguuuacugucgucguuggugacgucgcuggcauuuuugcgcaagguaagaaaaugaucagaccgcaaccuauggaguauaaguacucauggaagaguuggggaaaagcuaaaauaauuggugcugacguccaaaacacaacauucauaauugacggaccaaacacccccgagugccccgacgaucagagagcauggaacaucugggagguggaggacuaugguuuuggcauauucacuacaaauauuugguuaaaauuaagagauucauauacgcagguuugugaccacagguuaaugucugcagcaauaaaagauaguaaggcaguccaugcugacaugggcuauuggauugagagugagaaaaaugaaacauggaaguuggcaagggcuaguuuuaucgaaguaaaaacaugcaucuggccaaagucacauacauuauggaguaauggcgucuuagagagugaaaugaucaucccgaagauauacggaggacccaucagccaacacaacuaccgcccuggauauuucacacaaacugcuggaccuuggcauuuaggcaaacucgagcuggauuucgauuuaugugaagggacaacaguaguaguugacgaacauuguggaaacagaggcccaucauugcgcacgaccacaguuacuggaaaaauuauacacgaaugguguugucgauccuguacuuuacccccuuuaagguucagaggugaagacgguuguugguauggaauggagaucagaccgguuaaagaaaaggaagagaaucuuguaaaauccaugguaagugcagguagcggagaaguugacagcuucagucugggcuuauuaugcauuagcauuaugaucgaggaaguaaugcggucgcguuggucacguaaaaugcuaaugacaggaacacucgcuguauucuuuuuauuaauuaugggucaauugacauggaacgacuuaauccgucuuuguaucaugguaggagccaaugcaucagaucggauggggauggguacaacauauuuagcucugauggcaaccuuuaagaugagaccuauguuugcagucggccuguuauuccgucgucucacgaguagagaaguuuugcuuuugaccaucggacuaagccuaguggcgucgguggaauuaccaaauucuuuggaagaacuaggugaugggcuagcaauggggauaaugauacuaaaauuacugaccgauuuccagucacaucaauuaugggcuacauuauuaaguuuaacuuucauuaaaacuacguuuaguuuacauuacgcguggaaaacuauggcuaugguccuuagcaucguaagucucuuuccucuuuguuuaaguacaacaucacagaaaacuacauggcuaccgguacucuuggggucauuagggugcaaaccacuaacgauguuuuuaauagcugagaauaaaauuuggggucggcgauccuggccacugaaugaaggaauuauggcaguuggaauaguaaguauccugcuaucaucauuauugaaaaaugauguaccccuagcugggccauuaauugcugguggaaugcuaauugcguguuaugucauaucugguucuagugcugauuuaucacuagaaaaagccgcagaaguaucgugggaagaagaagcggaacacucaggcgcaagccauaauauucuaguagaaguccaagaugauggaaccaugaaaauuaaagaugaagaacgggacgauacauuaacaauauuacucaaggccacuuuauuggccguauccgggguguaucccuuaaguauuccagcgacauuauucguaugguauuucuggcagaagaaaaagcagcgaaguggaguuuugugggacacgccuucuccuccagaggucgaaagagcaguacuagacgacgggauauauagaauuaugcaaagggguuuacucggucguucccagguuggaguagguguguuucaagaaaauguauuccacacaauguggcacguuacuagaggggccguacugauguaucaaggaaaaaggcuagaaccaagcugggcaucugucaagaaagaccugauaagcuauggcggugguuggcgacuccaggggucauggaacaccggagaggagguccaaguuauugccguagagccuggcaaaaaucccaaaaauguacaaacagcucccgguacauucaaaacgccggagggagaaguuggagccauugcauuagacuuuaaaccagguacaucugguucuccaauaguuaaccgagaaggaaaaauagucgggcuuuauggcaauggaguuguaacaacaucagggacauacgugagcgcaauagcacaagcaaaggcgucacaagaaggaccccuaccagagauagaggaugaaguuuuuagaaagagaaauuuaacaauuauggauuuacauccugguaguggcaaaacacgacgauaucuuccugcaauaguuagagaggcaauaaaacguaaauuaagaacucucauacucgcaccuacaagaguuguagcaucagaaauggcagaggcucuuaaaggaaugccaauccgauaucagaccacagcugugaaaucagagcacacagggaaagaaauagucgacuugaugugccacgcaacauucacaaugagacuuuugucacccguccgaguaccuaacuauaauaugauaauuauggaugaagcacauuuuacagacccgucaagcauugcugcacguggauauauaaguacucggguagggaugggggaagcagcagcaauauuuaugacugcuacacccccagguucaguagaagcguucccacaaucaaaugccgucauacaagaugaagaacgugauauccccgagcggucuuggaacucuggauacgaauggauaacugacuuuccuggaaagaccguuugguuugucccgagcauaaagaguggaaacgacauagcaaauugccuucggaaaaaugguaaaagaguaauacaacucucuaggaaaacuuucgauacagaauaccagaaaaccaaaaauaacgauugggauuacguagucacgacagacauaucggaaaugggggcaaauuuuagagcggauagggugauagauccacguagaugucucaaaccagucaucuuaaaagacggaccugaaagggucauauuggccggcccuaugccagugacgguagcguccgcugcacaaaggagagggcguauaggacgaaaccacaauaaagaaggagaccaauacauuuauaugggacaaccguugaauaacgaugaggaucaugcacauuggacagaggcaaaaaugcucuuagauaauaucaauaccccugaaggaauuauaccugccuuguuugagccagaacgagagaaaagcgccgcgauagacggcgaauauagauuaaggggagaggcccggaagaccuuuguagaacucaugcgaagaggggauuuaccaguuuggcuauccuauaagguugcauccgagggcuuccaauauagcgacagaagaugguguuucgacggagaaagaaacaaccaaguguuagaagaaaauauggauguugagauauggaccaaggaaggggaaagaaagaaacuaaggccucgauggcuagacgcuagaacguacuccgauccauuggcgcuacgagaauuuaaagaguucgcagcgggaagacggagcgugucaggagaucuaauauuagaaaucgguaaacuaccacagcaccucacgcaacgugcccaaaaugcuuuagauaacuuagugauguuacacaacagugagcaggguggccgcgccuauagacaugccauggaagaacuaccagauacaauagagacauuaaugcuacuggcauuaaucgcaguccuuaccggagguguaacuuuauuuuuccuaucuggacgggguuuaggaaaaacaucaauuggcuuacuauguguaauggcaucgucgguacuacuguggauggcaucuguugaaccucauuggauugcugcaucuauaauacuggaguucuuucuuaugguacucuuaauacccgagccagaucgacaaaggacaccccaagauaaccaauuagcauauguagugauuggacuuuuauuuaugauucuaaccguagccgcaaaugaaaugggucuacuagaaacaacuaagaaagacuuaggaauuggccacgucgccguagaaaaucaucaucacgcagccaugcuggacguagaccuacaccccgcgucagcauggacauuguaugcuguagcaacuacuauuauuacacccaugaugcgacauacuaucgagaauaccacagcaaauauaagucuaacagcaauagcuaaccaagcggcgauauuaaugggccucgacaaaggcuggccgaucucaaaaauggacauagggguaccguuacuugccuugggauguuauagccaaguaaauccuuuaacacuaacggcugcaguguuaauguuaguugcccacuaugccaucauagggccuggacuacaagcgaaagcaaccagagaagcacagaaaagaacggcagcaggaauaaugaaaaaucccacaguugaugggauuguagcuaucgauuuggacccugugguuuaugaugccaaguuugaaaaacaauugggacaaauuauguuguuaauauuauguaccagccaaauacuacuuaugagaacgacaugggccuuaugugaaaguauuacauuagccacuggacccuugacuacacugugggaaggcagcccagggaaauuuuggaacacaacaaucgcagucaguauggcaaacauuuuccgaggaucauauuuagcuggugcgggacuugccuucucauuaaugaaaucauuagggggaggaagaagaggcacaggugcgcaaggagagacguugggggaaaaauggaagcgacaauuaaaucaacuaagcaaaagcgaguucaacaccuauaaacgaagcgguaucauggaaguugaucggagugaggcaaaggaaggucugaagagaggugaaacaacuaagcaugcuguaagccgagguacagcuaaacuuagaugguucguugaaagaaauuuagugaagccggagggcaagguaaucgaucucggcugcgggaggggcggaugguccuauuauugugcaggacugaagaaaguaacggaaguuaagggauacacuaagggugggccuggccaugaggaacccauuccuauggcgacauaugguuggaaucucguaaaacuacauucggguaaagacguuuucuucauaccucccgaaaaaugugauacauuacuuugugacauaggcgaaaguaguccuaauccuacuauagaggaaggucggacuuugcguguacucaaaaugguggaaccgugguugagagguaaccaauucugcauuaagauucucaacccauacaugccaucaguuguagaaacccuggaacaaaugcaacguaaacauggcgguaugcuagucagaaauccccuuaguaggaacucaacacacgaaauguauugggugagcuguggcacgggcaacauuguaucugcgguaaauaugacaucucguauguugcuuaauagauuuacgauggcgcaucggaaaccaacuuaugagagggauguugaccuaggagcaggcacuagacauguugcuguagaaccagagguagcgaaucuugauauaauugggcaacgaauagaaaauauaaagcacgagcauaagucaacuuggcacuaugaugaagauaauccuuacaaaacaugggccuaucauggaucuuaugaagugaaacccucugguucagcuucaucgaugguaaauggagucguuaaauuauuaacaaaaccuugggaugucauaccuaugguuacucagauagcaaugaccgauacaacuccauuuggacaacagagaguuuuuaaagaaaaaguagacacgagaacuccgaaggcuaagcgcgguacagcucagaucauggaaguaacggcgaaauggcuuuggggcuuucugucuaggaauaagaaaccaagaaucuguacaagggaagaauuuacccgaaaaguucguagcaacgcggcaauaggcgcaguauuugucgacgaaaaccaauggaauagcgcuaaggaagcuguagaggaugaacgauuuugggacuugguacaucgagaacgagaacuucauaaacaagggaaaugugcuacauguguuuauaauaugaugggaaagcgagagaagaaacuuggagaguucggcaaagcuaaaggcagcagagcgauuugguauauguggcuaggugcuagauuccucgaguuugaagcacuagguuucaugaaugaagaccacugguuuagccgugagaauagucuuagugguguggagggugaaggguuacacaaacuaggauauauauuaagagacaucucgaaaauuccagguggaaauauguaugcagaugauacagcuggcugggauacuagaauuaccgaagaugacuuacaaaacgaagcacgaaucacugauauuauggagccggaacacgcacuucuugcuaaaucaaucuuuaaauugacuuaucaaaauaaaguaguacgaguccagcgccccgccaaaaacggcacuguaauggaugugauauccaggagagaccagcgcggcucggggcaaguagguacauacggauuaaacacguuuacaaacauggaagcucaauuaauaagacagauggaaagcgaaggaauauucucaccuucagaguuggaaaccccaaauuuagcagaaagaguacucgacugguuagaaaaauauggaguagagcgauuaaaacguauggccaucagcggagaugauugugugguaaagcccauagacgacagauuugccacagcacucacugcucuaaaugauaugggaaaagucagaaaagauaucccucaaugggaacccaguaaaggauggaaugacuggcagcagguuccuuuuugcucgcaucacuuccaucaacuuauuaugaaagaugggcgagaaauuguuguaccgugcagaaaucaagacgaguuaguagggagagcaagagucucccaaggcgcaggguggucccugcgggaaacugcaugucucgguaagucuuacgcacaaauguggcaacuuauguacuuucacagacgagaucugaggcuugccgcaaacgccauauguagcgcaguuccgguagauuggauuccgacaagcagaacgaccuggagcauacaugcucaccaucaauggaugaccaccgaagacauguugucaguuuggaacaggguauggauagaagaaaacccauggauggaggacaaaacacauauauccucauggggugacguccccuauuuagguaaaagagaggaucaguggugugggaguuuaauaggucuuacugcuagagcuacaugggcgacuaauauacaaguagcaauuaaucagguacggagguuaauagggaaugaaaacuaucuugauuauaugacaaguaugaaacguuucaaaaacgagucagaccccgagggcgcuuuaugguaa

SEQ ID NO: 21529 - RNA, 9879 nt, Artificial Sequence
  derived and/or modified CDS sequence (opt6) from DENV-1__FJ432733__SS-prME
ucuguaacuaugcugcuaaugcuaaugccgacugcauuagcauuucaucugacgacaagagggggagaaccgcacaugauaguuacgaaacaagaaagaggcaaaagccuacuuuucaaaaccucagcaggcgugaacaugugcacucuaauagcaauggauuuaggagaauuaugcgaagauacaaugacuuacaaaugcccuagaaucacagaaguugaaccugacgauguggacuguugguguaaugcaacggacacguggguaacuuacggaaccuguagccaaacaggagaacaucguagagauaaacgaagcguagcacuagcuccacacgugggauuagggcuggaaacucgaacugaaacguggaugagcuccgaaggagcuuggaaacaaauacaacgcguagaaacaugggcauuaagacaucccgguuuuacaguuauagcucuuuucuuagcccaugucaucgggacaaguauuacacaaaaaggcaucauauucauccuccuuauguuagugacuccuaguauggcuaugcguuguguuggaauaggaucacgugauuuuguagaaggacuauccggagcuacaugggucgacgugguacuagaacauggcuccugugucacaacuauggccaaagacaaaccaacgcuggacaucgaauuacugaaaaccgaaguaaccaauccagcuguauugagaaaacuauguauugaagcgaaaaucaguaauacgacaacugacucuaggugucccacacaaggggaagcuacauuaauggaagaacaagaugcuaacuucguaugucgccgcacauuuguagaucgugguuggggaaacgguugcggucuauuugguaaagggucauuaauuacaugugcuaaauuuaaaugcgugacaaaauuggaagguaaaauuguacaguacgaaaaucuuaaauauagcguuauagugacaguacauaccggagaucagcaucaaguaggaaacgaaagcacggaacauggaaccauugcaacgauaacaccgcaagcgcccacuucggaaauccagcuuacggacuauggagcauugacacucgauuguagcccucgcaccggucuagauuucaaugaaaugguucuauuaacgaugaaagaaaaaucuugguuaguacacaaacaaugguucuuggauuuaccauuaccuuggacaagcggagcgucaacaucucaggagacauggaauaggcaagaccucuuaguuacauuuaagacagcccaugcgaagaaacaagaaguuguuguuuuagguucucaagaaggugccaugcacacugcauuaacgggagccacggaaauccaaacuucaggaacaacgaccaucuucgcuggccaccucaaaugccgucuuaaaauggauaaauugacacuuaagggcaugagcuauguuaugugcaccggaucguuuaaacuagagaaagaaguugcggaaacucagcauggcacaguauugguucagauaaaauacgaagguacagacgccccaugcaagauacccuucaguacacaggaugaaaagggcguaacgcagaacggcagguuaauuacagcaaauccgauagugacggacaaagaaaaaccaguuaauauugaagcagaacccccauuuggcgaaaguuauauagugauaggcgccggugaaaaggcacugaaacuuagcugguuuaaaaaggguucaucgauagggaaaauguucgaggcuacggcacgaggagcacggaggauggcaauacugggggauacagcuugggauuuugguagcaucgggggcguuuucacaagcguagguaaacucguacaucaaauauucggaaccgccuauggaguguuauucuccggugucucauggacaaugaaaauagguauaggcgucuuacugacguggcucggauuaaacucuaggagcacaucgcugaguaugacguguauagcgguaggcuugguuacgcuauaucuuggagugaugguacaagcugauucuggauguguuauuaacuggaaagguagagaauuaaaauguggcagcggaauuuucgugacgaacgaaguacauacauggacugaacaauauaaauuccaagcagauucaccuaaacgucucucugcagcaaucggcaaagcaugggaagaaggcgucugcgguauaagauccgcaaccagauuggaaaauaucauguggaaacaaauaucuaaugaguugaaucauauuuuauuagaaaacgauaugaaguucacaguaguaguuggugaugucgugggcauucuugcccaagggaaaaagaugauaagaccacaaccgauggaacacaaauacuccuggaaaaguugggggaaggcaaaaauuauaggugcugacguucaaaauacaacuuuuaucauagacggacccaauacucccgaaugcccagaugaccaaagagcuuggaacauuugggagguugaagauuauggauucggaauauucacgacgaauaucuggcuuaaauuacgagacagucauacucagguaugcgaucaccguuuaaugucagcugcuauaaaagauucaaaggcaguucaugcugacaugggguauuggauugaaucagagaaaaacgagacauggaaauuagcccgugcaucauucaucgaagugaagaccuguauauggcccaagucccacaccuuguggagcaacgguguauuggaaucugaaaugauuauaccaaagaucuauggaggaccaauaagucaacauaauuaucggccuggauauuucacccaaacagcagguccguggcaucuaggaaaguuagaacuugacuuugacuuaugugaaggcacaacaguaguaguugacgaacauugugguaaucgaggcccaagucuaagaacaaccacugugacaggaaaaauaauacacgaaugguguuguagaaguuguacucuuccaccacugcgauuuaagggagaggacgguuguugguauggcauggaaauaaggccaguaaaagaaaaagaagaaaauuugguaaaaaguaugguuagcgccggaucaggcgaaguugacucuuuuaguuuaggccuccugugcauuaguauuaugauagaggaaguaaugagaucgagauggagcagaaagauguugaugaccggaacucucgcaguauuccucuuauuaauaaugggacaauuaacguggaacgauuuaaucagacuuuguauaaugguuggagcuaaugcaucagacagaauggguauggguacuacguauuuggcacucauggcaacuuucaaaaugaggccaauguuugcugucggccuucuauuucggaggcuaaccaguagggaaguauuguuauugacaauaggacuaagucucgucgcuucuguagaguuaccaaacuccuuagaagaacuaggugaugguuuggcuauggguauuaugauauuaaaguuacugacugauuuucaaucacaccaacuuugggcaacucuacuuucucuuacauucauuaaaacaacauugagccuacacuacgcuuggaaaaccauggcaauggucuuaucaaucgucaguuuguucccucuaugucuuucuacuacaucgcagaaaaccacaugguuaccuguacuacuaggaucucuuggcuguaaaccacuagcgaugcuauuaauagcugaaaacaaaauauggggucgaaagucauggccguuaaaugaaggaauaauggcaguaggaguuguaucaauuuuauuaucaucacugcucaaaaaugauguucccuuggcaggaccccuaauugccggggguauguuaauugcguguuacguuaucucggguaguucagcugacuuaucucucgaaaaggcugcagagguaagcugggaggaagaagccgaacauaguggagcgucucauaacauauuaguagaaguucaggaugaugguacgaugaagauaaaagaugaggaacgagaugauaccuugacuauuuugcucaaagcaacuuuacuugcagucucuggggucuauccuuuaucgauacccgcgacacuauuugugugguacuucuggcagaagaagaaacagagaucaggcguacuuugggauacgccuaguccuccagaaguagaaagagccguucuugacgauggaauauacagaaucaugcaacgugguuugcuagguagaucacaaguagggguugggguauuccaagaaaauguuuuccauacgauguggcaugucacacgcggagccguacuaauguaccaagguaaaaggcuugaaccuucgugggcuuccgucaaaaaggauuuaauuucguauggagguggguggcggcuacaaggaucuuggaauacuggagaggaagugcaagucauugcugucgagccggguaaaaacccuaagaacguccaaacugccccuggaacuuuuaaaacaccagaaggcgaggucggugcaauagcucuagauuucaaaccagggacuucggguuccccaauaguaaaucgugaaggaaaaauuguugggcuuuacgggaauggcguaguaaccacuagcggaacuuacguaucggcaauugcacaagccaaggcuucccaagaagguccucucccggaaauagaagaugagguguuccggaaacgaaaccugacaaucauggauuuacacccaggaaguggaaaaacacgaagguauuugccugccauaguaagagaagccauaaagcgcaaguuacguacguuaaucuuagcacccacuaggguuguugcaagugaaauggcugaagcgcuaaagggcaugccaaucagguaucaaacuacagcugucaagucagaacauacagguaaagaaauuguugaucuaaugugccacgcaacauucacaaugcgacugcuuucgccuguacgaguaccaaauuacaauaugaucaucauggaugaagcgcauuuuacagaucccucaucaauugcagcgcgcgguuacauaucaaccagaguaggaaugggugaagcggcagcaauauuuaugaccgccacgccaccuggcucuguugaagcauuuccucaaaguaaugcugugauucaagaugaagaacgagacauacccgagcgaaguuggaacuccggauacgaguggaucacagacuuuccagguaagacaguuugguucguaccuucaaucaaaagcgguaaugacauagcgaauugucuacgcaaaaaugguaagcggguuauucaacugucacggaagacauucgauacugaauaccagaaaaccaagaacaaugauugggacuauguaguaacgacugacauaucagagaugggggcaaauuuucgugcagacagagucauagacccgcgucgcuguuuaaagccugucauucucaaagacggaccagagcgaguaauccuagccggacccaugccaguuacagucgcaucggcagcucaacgccgagguaggaucggaagaaaccauaauaaagaaggcgaccaauacauauacauggggcaaccccuaaauaacgaugaagaucacgcacacuggacagaggcaaaaaugcuccuagauaauauaaauaccccggaaggaauaaucccggcucuauucgaaccugaaagagagaaaagugcagccauugacggggaauaucgacuacgaggagaagcgcgaaaaaccuucguugaacuuaugaggagaggagaucuaccugucugguuaaguuacaaaguggcguccgagggauuucaguacucagaccgcagaugguguuuugacggagaaagaaauaaucagguauuagaagaaaacauggacguagaaaucuggacaaaagagggagaacggaagaaauugaggccacgauggcuugaugcaagaacauauagcgaccccuuggcguuacgagaauuuaaagaguucgcugcaggaagacguagcgugucgggagaccuaauacuagaaaucgguaaacuaccucaacaucuaacacagagggcacaaaaugcucuagacaaucuuguaaugcuccacaacucugaacaaggugguagggccuaccggcaugcuauggaagaauuaccagauacgauagaaacguuaaugcuguuagcuuuaauagccguacuaacaggcggaguuacucuauucuuccucucaggcaggggguugggcaaaacgaguauuggacuacugugcgugauggcuuccagcguccuacuauggauggccagcguagaaccgcacuggauagcagccuccauaauucuugaguucuucuuaaugguauuguuaaucccggaaccggauaggcaaagaacaccccaagauaaccaacucgccuacguaguuauaggauuauuauucaugauacugacaguagcagcaaacgaaaugggacugcucgaaacuacuaagaaagaccuggguauaggacauguugccguugaaaaucaucaucaugcuacuauguuagacguggaucuucauccagccagugcguggacauuauaugcuguagccaccacaauaauaacacccaugaugcgucauacgauagaaaauacuacagcuaauaucucacuuacagcgauugcuaaccaggcggcgauccugaugggucuugacaaaggauggccaaucucaaagauggauauaggaguuccacuacuggcuuuagguugcuauucucagguaaauccauuaacguuaacggcagccguccucauguuagucgcccacuaugcaauuaucgguccugguuuacaagcuaaggcuacacgggaggcccaaaaacggacggcugcaggaauaaugaagaacccaaccguugacggaauuguagccaucgaucucgauccgguaguauacgacgcaaaauucgaaaagcaacucggacaaauaaugcuucuaauucuuuguacaucacaaauucuuuuaaugagaacgaccugggcauuaugugaaucaauuacauuagcuacagggccuuugaccacacuaugggaggguuccccugggaaauuuuggaauacaacgaucgcagugagcauggcuaauauuuuucguggauccuaucuagccggugccggacuagcauuuaguuugaugaaaagccuagggggcggccgccgaggaacgggugcccaaggagaaacacucggagaaaaguggaaacgucaacuaaaucaacucaguaaaucggaguucaacauauacaaacguagugggauaauggaaguugacagaucugaggcaaaagagggacuaaaaagaggggaaacgacaagacaugcaguaaguagaggcaccgcaaaacuaaggugguucgucgaacguaaccuuguaaagccugagggcaaaguaauagaccuuggcugcgguaggggaggaugguccuacuacugcgcaggucucaagaaaguuacagaagucaaaggauacacaaagggagguccagggcacgaggaaccuauaccaauggccacguauggguggaaucuaguaaaacuccauaguggcaaagauguauuuuucacuccaccugaaaaaugugauacgcuauuaugcgauauaggagagucaaguccuaauccuacuauugaggaaggaagaacauuacggguacuaaaaaugguggaaccaugguuaagaggcaaccaauuuuguauaaagauucuaaauccauauaugccaucuguagucgaaacguuagagcagaugcaaagaaaacacggugguaugcucgucagaaauccucugaguagaaacaguacacaugaaauguacugggucaguugugggacagggaauauagucucggcuguaaauaugacaucgcgaauguuacuaaaccgcuuuacaauggcacauagaaaaccaacauacgaaagggauguggacuuaggagcagguacacggcacguggcagucgagccggaaguagcgaauuuagauaucauaggucaaagaauagagaauaucaaacaugagcacaaaucaacauggcacuaugacgaggauaacccauacaaaacaugggccuaccacggaaguuaugaaguaaagccaucgggauccgcgucuucgaugguuaauggcguaguaaagcuacucaccaaaccaugggacgugauaccaaugguaacccagaucgcaaugacagacacgacaccuuuugggcaacaaaggguguuuaaagaaaaaguagauacaagaacacccaaagcaaaacgagguacggcgcagaucauggaagucacggcccgaugguuauggggauuccuaaguagaaacaagaaaccaagaaucuguacaagagaagaauuuacacgcaaagugaggucaaacgcugcgauuggcgcgguauuuguugacgagaaucaauggaauagcgcuaaagaagcuguggaagaugaacgauuuugggauuuaguucaaaaagaacgagaacuucauaagcaggggaagugugcaacauguguauauaacaugauggguaaaagagaaaagaaauugggcgaguucgggaaagcaaaaggcucuagagcaauuugguauauguggcugggggcucgcuuucucgaauuugaggcuuuagguuuuaugaaugaagaucacugguuuucacgugaaaacucguuaaguggcguugagggagaaggucuccauaaauuaggauacauauuaagagauauaagcaaaauuccaggaggaaauauguaugcagacgauacagcaggaugggauacuaggauaacagaagacgaucuacaaaaugaagcaaggauaacagauauaauggaaccagaacacgcgcuauuggcgacaucaauauuuaaauuaacauaccaaaacaaagucgugagaguucagagaccugccaaaaacggcacuguaauggacgucauaagccggagagaccaacgaggaucaggacaagucggcacauauggccuuaauacguucacgaauauggaagcacaauuaauaagacagauggaaagcgaaggcauauuuuuacccagcgaacuugagacacagaaccuagccgaaagaguucucgauugguuggaaaaguaugguguugagcgucuuaaaagaauggcaauuagcggagaugacuguguagucaaaccaauagaugaccgauuugcuacggcacucacagcacuaaacgauaugggaaagguuaggaaggauauaccccaaugggaaccaaguaaaggauggaacgauuggcagcaaguuccauucuguucgcaccacuuccaucaauuaauaaugaaagauggucgagaaauaguugucccauguagaaaucaggacgagcuaguagggagagcgagagugagucagggcgcuggauggucacugagagaaacugcuuguuuaggaaaaucauacgcucagauguggcaauuaauguacuuccaccgacgcgaccugaggcuagcagcuaaugcaauaugcucggcgguuccugucgacuggguacccacaagccgaaccaccuggaguauucacgcacaccaucaauggaugacuacagaagauauguuaaguguuuggaacagaguuuggauugaagagaaccccuggauggaagauaaaacucacguaucaaguuggggugacgucccauacuuggguaaaagagaagaccagugguguggcagcuugauaggucuaacugcuagagcaaccugggcaagcaauauacaaguugcgauuaaucaaguucguagacuuauugguaaugaaaauuaucucgauuauaugacuucaaugaaacguuuuaaaaaugagggagauccagagggagcguugugguaa

SEQ ID NO: 21530 - RNA, 9879 nt, Artificial Sequence
  derived and/or modified CDS sequence (opt6) from DENV-1__FJ410196__SS-prME
agcgucacgaugcuauuaaugcugaugccuacugcucuugcguuccaucugacuacgcgggguggagaaccccacaugauagugucaaagcaggaaagaggaaaaucacuguuauuuaaaacuagcgcuggcguaaacaugugcacacucauugcaauggauuuaggugaauugugugaagauacaaugacguauaaaugcccgagaaucacggaaacagaaccugaugacgucgauuguugguguaacgcuacagacacguggguuacuuauggaacauguucucaaacuggggaacacagacgcgacaaacgaagcguagcauuggcuccucacguaggauuaggauuggaaacacguacagaaacauggaugucuucagaaggagcauggaagcagauacaacgugucgaaacuugggcauuaaggcauccaggauuuaccguaauugcgcuauuuuuggcacacgcuauaggcacaucaaucacgcagaaaggcauaauauuuauucuuuuaaugcuuguaacgccaagcauggcuaugagaugugucggaauuggaucaagagauuuugucgaaggauuaagcggagcaacuuggguggauguuguccuagaacauggauccugugugaccaccauggcuaaagauaaaccuacgcuagauauugaacuacuaaaaacagaaguaacaaacccagccguacugagaaaacuaugcaucgaagcaaaaaucucaaauacaacgacagauucaagaugcccaacccaaggggaagccacccuaguagaagaacaggaugcaaauuucgucugcagaagaacauucgucgacaggggauggggaaacggauguggucucuucggaaaaggaaguuuaauuacaugugcaaaauuuaagugugucacaaaacuagaggguaaaauuguccaauaugagaaucuuaaguauagcgucauagucaccguacacacuggggaccaacaucaggugggaaacgaaucaacugaacacgguaccacugcuacuaucacgccacaggccccgacaacugagauucagcuuacugauuauggcgcuuuaacacuagauugcagcccaagaacgggucuggauuuuaacgagaugguacucuugacgaugaaagagaaaucaugguugguucauaaacaaugguucuuggauuuaccuuuaccauggacauccggcgcaagcacgucucaagaaacuuggaauagacaagaccuauuagugacguucaaaaccgcgcaugcuaagaaacaagaaguaguuguauugggcucacaggaaggggcgaugcauacugcucuuacaggagcuacagagauucaaacgagcgguacaacaacaaucuuugcaggccacuugaagugccggcuuaaaauggauaaacucaccuuaaaaggaaugaguuauguuaugugcaccggaucuuucaaguuagaaaaggaaguugcugaaacucaacauggaacgguacuuguucaaaucaaauaugaagggacugaugcuccgugcaaaauuccauuuucuacucaagaugaaaaggguguuacucagaaugguagacuuauuacagccaauccuauuguaacugauaaagagaaaccaguuaauauagaagcagagccgccauuuggggaaucauauaucgucauaggugcgggugaaaaagcacuaaaacuuuccugguucaagaaaggaucuuccauagggaagauguuugaagccacugccagaggagcgcgcagaauggcaauauugggugacacugcuugggauuucggcagcaucgguggaguauucacaaguguagggaaauugguacaccaaauuuucgguacggccuaugguguauuauucagcggagugucguggacaaugaagauugggauuggagugcucuugacauggcuuggguuaaauucaaggaguacaagccugaguaugacgugcauugcaguaggauuagucacacucuauuuaggaguuaugguucaggcggauucgggaugugucaucaacuggaaaggaagagaacuaaaauguggaucugggauauucguaacaaaugaaguucacacauggacugaacaguacaaauuucaagcagacucaccaaaacgacuaagcgcggcuauuggaaaggcuugggaagaaggaguuugugguauacggagugcaacacgguuagaaaauauaauguggaagcagauaucaaaugaauuaaaccacauacuccuagaaaacgauaugaaauucaccguuguagucggagauguggcaggaauauuagcgcagggaaagaaaaugauccgaccacaaccaauggaauauaaauacucauggaaaucuugggguaaagcaaaaauuauaggggccgauguccagaacacuacauuuaucauagauggaccuaacaccccagaguguccugaugaucaaagggcguggaauauaugggaggucgaggauuacggauuuggaauuuucacaacaaauauaugguuaaaauugagagacucguauacccaaguaugugaccaccgacucaugagcgcugcaauaaaagauucuaaagcaguucaugcggauaugggcuauuggaucgagucagagaaaaaugaaacuuggaaacuugcucgcgcuucuuucauugaaguaaaaacuuguaucuggccaaagagucauacauuauggaguaacgggguacuggaaucagaaaugauaauaccgaaaauauaugguggacccauuagccaacacaauuacagaccaggauauuucacacaagcagccggaccauggcacuuaggaaaguuggaauuagauuuugauuuaugugagggaacaaccgucgucguagaugaacauugcgggaauaggggacccucauuaagaacuacuacggucacagguaaaaucauacaugaauggugcugccgaagcugcacccuaccuccauuaagauuuaggggagaagacggcugcugguacgguauggaaaucagaccugugaaagaaaaggaagaaaaucuuguaaaaucaaugguaucagcaggaucaggcgaaguagauucguucuccuugggucuacucugcauaaguauuaugauagaagagguuaugcgaagcagauggagcaggcgaaugcuaaugacuggaacccuggccguuuucuuuuuauuaauaaugggccaauugacauggaaugaucuuaucagacuguguauaauggucggagcaaacgcaagcgaccgaaugggaaugggcacaaccuaucuggcauuaauggcaacuuuuaagaugagaccaauguuugcaguugggcuacuauuuagaagacugaccucuagagaaguguuauuauugacaauuggucugucacugguagcuagcgucgaauuacccaauagucuggaagaacucggagauggacuagcaauggggauuaugauuuuaaaacuuuugaccgauuuccaaucacaccaauuaugggcuacuuuauugagccuaaccuucauuaaaacaacauuuagccuccauuaugccuggaagaccauggcaauggugcugagcauuguaucgcuuuuuccgcucugcuuaucgaccacaagucagaaaacaacuugguugcccguuuuauuggggucauuaggauguaaacccuuaaccauguuucuuauugcugaaaacaaaauaugggguaggcgaucguggccccuuaaugaagguauuauggcaguaggaauaguuucaauacuucuaagcucccuuuugaaaaacgauguaccucuagcuggaccacugauugcgggugggaugcuaauagcgugcuauguuauaucaggaucaucagcagaucuuucuuuggaaaaagccgcagaagugagcugggaggaagaagccgagcauucuggcgcaucacacaacauacucguugaaguccaagacgacggcaccaugaaaauaaaagaugaagaaagagacgauacgcuuacaauacuacuuaaagcgacacuguuggcagugucgggcguguauccauuaagcaucccggccacacuuuuuguuugguacuuuuggcagaagaagaaacaaagaagcgggguauugugggacaccccgagcccgccugaaguagaaagagcuguccuagaugacgguauauaucgaauuaugcaacgaggacugcuaggaagaucacaaguaggaguugguguauuccaggaaaacguuuuccacacuauguggcauguaacaagaggcgcgguacuuauguaccaaggaaaaagguuagaacccucaugggcguccguuaagaaagauuuaauaucuuacggaggaggauggagacuucaagguucguggaacaccggagaagaaguucaagucauagccguagaaccagguaaaaacccuaaaaauguccaaacagcgccgggaaccuucaaaacaccagaaggcgaggugggagcaaucgcgcuagauuucaaaccuggcacaaguggaucuccaauaguuaacagagaagguaaaauuguagguuuauaugguaauggggucguuacuaccucgggcacauaugucagugccauugcgcaggcaaaagcaucgcaagaagggccauugccagaaauugaagacgaaguauuuaggaaaagaaauuuaacgauaauggauuugcaucccgguucaggaaaaacgagacgauacuuacccgcaauagucagggaagccauaaaaagaaaguuacgaacacugauucuagcucccacgaggguaguagccucagagauggcagaagccuuaaaggggaugccaauuagauaucaaacaaccgcaguuaaaucagagcacacugguaaggaaauaguagacuugaugugucacgcuacguucacaaugcgucuacucucgccuguacgaguuccuaauuacaauaugauaaucauggaugaagcacauuuuacggauccuuucucaaucgcggcccgcggauauauuaguaccagggugggaaugggugaagccgccgcuauauuuaugacagccaccccaccuggcucaguggaggcauucccacaaaguaaugccgucauacaggaugaagaaagggacauaccggaacgcucauggaacucggguuacgaauggaucacagacuuucccggaaagaccgugugguuuguaccuagcauaaaaucgggaaacgauauagcuaauugccugaggaaaaacgggaaaagagucauucaacucagcagaaaaacuuucgacacagaauaucagaaaaccaaaaauaacgacugggauuauguuguuacuacagacauaagcgaaaugggcgcuaacuuccgagcggaucgagucauugauccgaggcgaugccuuaaaccagucauuuugaaagacggcccggaacguguaauccuggccggcccgaugccaguuacuguagcaagugcggcgcaaaggcgcgggagaauaggaaggaaucauaauaaagagggugaucaauacauuuauauggggcagccauuaaauaaugaugaagaucacgcacauuggacugaagcaaaaaugcuucuugacaacaucaacacaccugaggguauaauaccagcauuauuugaaccagagagggaaaagagcgcugcgauugauggugaguacagacuuaggggagaagcaagaaaaacuuuuguagaacuaaugaggcgaggagaccuuccuguauggcuuucguauaaaguugcuagcgaaggcuuucaauauagugaucgaagauggugcuucgauggugagagaaacaaucagguccuagaggaaaauauggacguagaaauauggacuaaggaaggcgagaggaagaaacugcgaccucgcugguuagacgcucgaacauauuccgacccauuagcucugcgagaauuuaaagaguucgcggcagguagacgauccguaagcucagacuuaauacuagaaauaggcaaguuaccacagcaucugacacagagagcucaaaacgcuuuagacaauuugguuauguugcauaauagugaacaaggugggagagcuuacagacacgcaauggaagaguuacccgauacaauugaaacauuaauguuacucgcgcucauagcaguucuuacugguggaguaacauuauucuuccugucagggcguggucugggaaaaaccuccauuggacuacuuuguguaauggcaaguuccguauuauuauggauggcuuccguagaaccucacuggauugcugcaucuauaauauuagaguucuuuuuaaugguucugcuuauaccugaaccagacagacagcggacaccacaggacaaucagcucgcguacguggucauagguuuauuauucaugauccuaacuguugcugccaacgaaaugggucuacuagaaacgacaaagaaagacuugggcauaggucacguugccguagaaaaucaucaucaugcagccaugcuagauguggauuuacacccugcgucugccuggacccuuuacgcaguggcuacaacuauuauaacgcccaugaugagacauaccauagagaauacaacagcgaauauaucauuaacugcuauugcaaaccaagcagccauccuaauggggcuugacaaaggauggccuaucaguaagauggauauaggcguaccauuauuagccuuagguugcuauagucaaguuaauccuuuaacauugacagcugcuguucucauguuaguggcacauuaugcaaucauagguccggguuugcaggccaaagccacucgcgaggcacagaaacguaccgcagcaggaauuaugaaaaauccuacgguugacgguaucguugcaauugaucuagauccggucguauaugacgcaaaauucgagaaacaauuaggucagauaauguuacuaauucucuguacaucgcagauucuucuaaugagaacgacaugggccuuaugugaaaguaucacacuagcaaccgggccacugacaacacugugggaaggaucuccgggcaaauuuuggaacacaacaauagcuguaagcauggcuaauauauucaggggcuccuaucucgcuggcgcgggucuagcguuuagucuuaugaaaucacugggcggagguagacgugguacgggagcacagggagagaccuuaggcgaaaaauggaagagacaacuaaaucaacuaucgaaaucugaauuuaacacuuacaaacgaagugggauaauggagguagauagaagcgaggcaaaagaaggcuuaaaaagaggagaaaccaccaaacaugcaguaagucgcgggacagccaaauugcguugguucguugagagaaaucuuguuaaaccagaagggaaagucaucgaucucggaugcgggagaggggguuggaguuauuacugcgcuggacucaagaaaguuacagagguaaaaggauacacgaaaggagggccggggcacgaagaaccgauuccaauggcuacguacggauggaauuuggugaaacuucauagugguaaagacgucuucuuuaucccaccugaaaaaugugauacacuacuuugugacauuggagaaucgucaccaaaccccacaauagaggaaggaagaacucuccgaguucucaaaauggucgaaccguggcuaagagguaaucaguuuuguauuaaaaucuuaaacccuuauaugccaucaguuguagaaaccuuggaacaaaugcagcggaaacauggcgggaugcuugucagaaauccacuuucgagaaacuccacucacgaaauguauuggguaucauguggaacagguaauauugucagugcaguaaacaugacaucgaggauguuguugaaccgcuuuacuauggcacacaggaaaccaacauaugagagagauguggacuuaggcgcugguacucgacauguugcagucgagccagagguagcuaaccuagacaucauaggucaaaggauagagaacaucaaacaugagcacaaaucgacuuggcauuaugaugaggauaaucccuauaaaacaugggcauaccacggaagcuacgagguaaaacccagugguagugcaucuaguaugguuaaugguguagucaaguuacuaacgaaaccaugggauguuauaccaaugguuacccaaaucgcuaugacggauacaacaccuuuuggacaacagagaguauucaaagaaaaaguugauacacgaacgccuaaagcgaagaggggcaccgcacagauaauggaaguaacagcuaaaugguuguggggauuuuuaagucgaaauaagaaaccgcgaauaugcaccagggaagaguucacaagaaaaguacgaucaaaugcggccauaggggccguauucguagaugaaaaucaauggaacucugccaaagaagcugucgaggaugaacgcuuuugggaccuuguacacagagaacgagagcuucacaaacaagguaaaugugcuacaugcguuuacaauaugaugggaaaaagggagaagaaauuaggggaguucggaaaagcaaaagguucaagggcuauaugguacauguggcuuggagcucguuucuuggaauuugaagccuuaggcuuuaugaacgaagaccauugguuuucgagagagaauaguuuaucaggaguggaaggcgaaggacuccauaaauuggguuauauccuccgaggaauuucuaaaaucccaggaggaaauauguaugcagaugacacugcaggaugggacaccagaauaacagaagaugauuuacaaaaugaggcaagaauaacagacaucauggaaccugaacaugcuuuacuggcaaaaaguauauucaaauuaacuuaucaaaacaaaguaguaagaguacaaagaccggcuaaaaacgggacuguaauggacguaauaaguaggagagaccaacggggaucgggacaagugggcacuuacggauugaauacguuuacaaauauggaggcccaacuaauaaggcaaauggaaagcgaaggaaucuucagcccgagugaacuugaaaccccaaaucuagccgaaagaguacuugacuggcuagaaaaauaugguguugaacgauuaaaacgaauggccauaucaggugacgauugcguagucaaacccaucgaugaccgcuuugcaacugcguuaacugcuuuaaaugauauggguaagguuaggaaagacauaccacagugggaaccaagcaaaggauggaacgauuggcaacaaguaccauuuuguagccaccauuuucaccagcuuaucaugaaagacggcagagaaauaguuguaccauguaggaaccaagaugagcuugugggcagagcucgaguaucacaaggggccgguuggaguuuaagagaaacagcgugucucggaaaaaguuaugcucaaauguggcaacuaauguauuuucacagaagagaucucagacuugccgcaaacgcuauuuguucagccguuccaguugacuggauuccgacaucuagaacgacguggucaauacacgcccaccaccaguggaugacaacugaagacaugcuaucuguuuggaauagaguauggauagaagaaaauccauggauggaagacaaaacccauauaaguucuuggggugauguaccauacuuaggcaagagagaggaccaaugguguggaagucuuauuggacugacggcuagagcaaccugggccacgaauauacaaguagcaauuaaccaaguaaggcgguugauugguaaugaaaauuaucuugauuacaugaccaguaugaagagguucaaaaacgaaagugauccagaaggagcccugugguga

SEQ ID NO: 21531 - RNA, 9879 nt, Artificial Sequence
  derived and/or modified CDS sequence (opt6) from DENV-1__FJ432734__SS-prME
agugugacaaugcuauuaaugcuuaugccaaccgcucuagcauuucacuuaaccaccagagggggugaaccgcauaugauagucucaaaacaagaacgcgguaaauccuugcucuuuaaaacaagugcugguguuaauauguguacacuaaucgccauggauuuaggagaacuaugcgaagacacuaugacauacaaaugcccccgaauaacagaagccgaaccggaugacguagauuguugguguaacgccacugacacguggguaacuuauggaacuugcucgcaaacaggagagcaccgaagagauaaaaggucagucgcucucgcaccgcauguuggucucggacucgaaacacguacagaaacuuggaugucuucagaaggggcauggaaacaaauucaacguguagaaacguggguuuuaagacauccuggguucacaguaaucgcucucuuucuagcucacgccauugguacaagcaucacacaaaaaggaauaauauuuauccugcuaauguuaguaacaccaaguauggcuaugcgauguguugguauaggcaguagagauuucguggaaggacuauccggugcuaccuggguugacguaguucuggaacauggaucgugcguaaccacaauggccaaggauaaaccaacucuggauauagaacuuuuaaaaacagaaguuacaaauccugccguacuaagaaagcuauguauugaggcuaagauaaguaauacaacuacugacucccgcugucccacccaaggggaagcaacgcugguagaggaacaagaugcaaacuuugucugucgaagaacuuuuguagauagaggaugggggaauggcuguggauuauucggaaaggggagucuuauuacgugugcaaaauucaaguguguaaccaaacuagaaggaaaaauaguacaauaugaaaauuuaaaauacuccgucauaguaacgguucauacaggugaccagcaccaaguagguaaugaaagcacagaacacggaacgaccgccacgaucacaccucaggcuccaacuacagagauucaauuaacagauuauggggcccuaacucuggauuguaguccgcgcacuggcuuagacuucaaugagauggugcuucuuacaaugaaagagaaaaguugguuaguucauaaacagugguuuuuggauuuaccacuuccauggacauccggugcuucaaccagccaagaaacuuggaaccgucaagauuugcuaguuacguucaaaacggcacaugcuaagaaacaagaggucguaguacuaggaucacaagaaggugcaaugcauaccgcguugacgggcgcgacagaaauccaaacguccgguacuacaacgaucuucgcugggcaucucaaauguagguuaaaaauggauaaguuaacauuaaaggguaugucauacgucaugugcacuggcucuuucaaauuagaaaaagaaguagcagagacacaacacggaacuguuuuaguucagauaaaguaugagggaaccgacgcucccuguaagauacccuuuagcacgcaagacgaaaaagguguaacgcagaauggaagauuaaucacagcaaauccuauugugacugauaaagaaaaaccaguuaauauagaagccgagccaccguuuggagaaagcuacauagugaucggcgcaggagagaaagcgcugaaacuuaguugguucaagaaaggaucaaguauaggaaaaauguuugaagcaacagcuaggggugcgagaagaauggcuauucuaggcgacacugcuugggacuuugguuccauuggaggcgucuucacuucgguggguaaauugguacaucaaauuuuuggaaccgcuuauggaguucuauuuucuggcguaagcuggacaaugaaaauuggcauagguguauuauugaccuggcuuggacuaaauagccgaaguacuucucuaaguaugacuuguaucgcaguaggccuuguaacucucuaucuuggaguaaugguacaagcugauucugguuguguaauuaacuggaaaggucgugagcuaaaaugcgguagcggaauauuugugaccaacgaaguacacaccuggaccgagcaauauaaauuccaggccgacucuccaaaaagacuaucagccgcuauugguaaagccugggaagaaggcguaugcgguauaaggucagccacuagacuugagaauaucauguggaagcaaauuucgaaugagcucaaucacauucuacuagaaaaugacaugaaauuaacugugguggucggugaugucgcaggaauauuaggucaggguaagaaaaugauacggccacagccaauggaauauaaguauucguggaaaucauggggaaaagcgaaaauuaucggagccgacgcacaaaauaccacauuuaucauugaugggccaaauacgccagaaugcccagacgaccagagagcuuggaauauuugggaaguagaagauuacggauucggaauguuuacuaccaacauauggcuaaaacuacgggauucauauacgcaagucugugaucaccgucuaaugucagcagccaucaaagauucuaaagccgugcaugcagauaugggauacuggauagagucugagaaaaacgagacauggaaauuagcccgugcuucguuuauagaaguuaaaacaugcaucuggccuaaaagucacacgcuauggagcaacgguguucuggaaucggagaugauuauuccaaagaucuacggaggaccaauaucacaacauaacuaucguccugguuacuuuacccagacagcagguccguggcauuuaggaaaguuagaacuugauuuugacuuaugcgaggggaccaccguggugguugaugaacacugugguaauaggggacccagccuuagaacgacgacagucacggguaagauaauccaugaaugguguuguagaagcugcacacuaccaccucuacgguuccguggagaggacgggugcugguauggaauggaaauuaggccaguaaaagaaaaagaagaaaaucuagucaaaucaaugguaagugcgggaucaggcgaagucgauucguuuagucugggucuacugugcauaucaauaaugauugaagaggugaugaggaguagauggucuagaaagauguuaaugacuggaacacuagccgucuucuuucuacuaaucaugggacaauuaacauggaaugacuuaauccgauuaugcauaaugguaggugcaaaugcuagcgauagaauggguaugggaacaacauaucuagcccuaauggcuacauuuaaaaugcgccccauguucgcugucgggcuccuguuuaggagauuaaccagucgagaaguuuuacuucugacaaucggacuaagccuaguugcaaguguagaacuacccaauucuuuagaggaauugggggacgguuuagcaauggguauuaugauacucaaguuacugacugacuuccaaucacaccaauuaugggcaacucuauuauccuugacuuucaucaagacgacauucucacugcauuaugccuggaaaacgauggcaauggucuugaguauaguuaguuuguuucccuuguguuugucuacuacaucacagaaaacgacaugguuacccguucucuuggguagucuggguuguaaaccuuugacaauguuucuaauagcagaaaauaaaauuugggggaggaagucuuggccauuaaaugagggaauuauggccguuggaauaguauccauauugcuauccaguuuguuaaagaaugaugugccguuggcgggaccccuaauagcgggagguauguuaauagcauguuaugucauaucaggaaguucggcggauuugucuuuagagaaagccgcugaagucucuugggaagaggaagcagagcauucaggagcaagccauaacaucuuaguagaaguacaagaugacgguacgaugaagaucaaagaugaagaacgugacgauacauuaacaauccuacugaaagcuacuuuauuggccguuagcggaguauauccccuuucuauuccugcaacacuauuuguaugguauuuuuggcaaaagaagaaacaacgaucuggaguuuuaugggauaccccaucaccaccugaaguagagagagcaguauuagaugacgggauauauaggauaaugcaacgaggacugcuagggaggucucaaguaggugucggaguauuucaagagaacguauuucacacaauguggcacguuacuaggggagcuguccuuauguaucaaggcaagaggcuagagcccucuugggcuaguguaaagaaagauuuaauuagcuacggcggugguuggcgauuacgagggucauggaauacgggagaggaaguacaaguuauagcaguugaacccggcaaaaaucccaaaaauguucagaccgcuccaggaacguuuaaaaccccagaaggcgaaguaggugcuaucgcuuuagauuucaaacccggaacgucaggguccccaauugucaacagagaaggaaaaauaguaggucuauaugggaacggaguaguuacuacaagcggaacauacgucagugccauagcucaagcaaaagcaagucaggaaggaccauuaccagaaauagaagacgaagucuuccgaaaacguaacuuaacgauaauggaucuucacccggguagcgguaagacaaggcgauaucucccggccauaguucgagaagcuaucaaacgaaaauuacguacauuaauucuugcgccaacccgaguaguugccucagaaauggcagaggcacuaaaagguaugccuauaagauaucaaacuacggccguaaaaucagagcauaccggcaaagaaaucguagaccuaaugugucaugcaacguuuacgaugaggcuuuugucaccgguaagaguuccaaauuauaauaugauaaucauggacgaagcacauuucacugauccaucaucgauagccgcaagaggauacauaagcacgagaguaggaaugggggaggcugcggccaucuucaugacagcaacgccaccagguucuguagaggcauuuccucagaguaaugcaguaauacaggaugaagagagagauauaccugagcgaucguggaauaguggcuacgaauggauaacagauuuccccggcaaaacggugugguucguucccucaaucaaaucaggcaaugauauagcaaauugccuaaggaaaaacggcaaaaggguaauacaauuaucgagaaaaacuuuugauaccgaauaccagaaaaccaaaaacaaugauugggacuaugugguaacaacagacauaagugaaaugggagcaaacuuucgugcagauagaguuauugacccaagaagaugcuuaaaaccugucauauugaaggacggaccagaaagaguaauucuagcagguccuaugccaguaacgguugcgagcgcugcacaaagacgaggucggauuggacgcaaucauaacaaagaaggagaccaguacauauacaugggacaaccuuugaauaacgaugaagaccaugcacauuggaccgaggcaaaaaugcuuuuagauaacauuaauacgccagagggaauaauccccgcauuauucgagccagagcgagaaaaaucagcggcuguagauggagaguaccgacugcguggugaagcaaggaagacuuucguggaacuuaugagaagaggagauuuaccuguaugguuaucauauaaaguugcaucagaaggcuuucaauauucagacagaagaugguguuucgauggcgagaggaacaaccaaguauuagaagaaaauauggacguagagauauggacaaaggagggagaaaggaagaaauuaaggccaagauggcuagaugccagaacauacucagacccgcuagcgcuacgagaauuuaaggaauuugcagcuggaagaagaagugugagcggagacuuaauacucgagauaggaaaauugccucaacauuugacccagagggcgcaaaaugccuuagacaaucuagugaugcuucauaauagugaacaaggagggagagcauauagacaugcaauggaagaacucccggauacaauugagaccuuaaugcugcuagcucucauagcuguuuuaacaggaggcguaacacuauucuuuuuaagugggcggggucuaggaaagacuucaauaggacuccucugcguaauggcaagcucaguucuacuguggauggcaucgguugaaccgcauuggaucgcugcuagcauaauauuagaguucuuuuuaaugguacuauugaucccugaaccugacaggcaaagaacaccacaagauaaccaacucgccuauguaguaauuggccuguuauucaugauuuugacuguagcggcaaaugaaaugggauugcuggaaacaacuaaaaaggaucuaggaauagggcacguagcuguagagaaucaccaucacgcugcaaugcuagacgucgaccuacaucccgcaagugcauggaccuuauacgccguugccacaacaaucaucacaccaaugaugcggcacacaauagagaauacuacugcuaacaucagccugacggcgaucgccaaccaggcagcaauucugaugggacuugacaaaggauggccaauuaguaaaauggauaucggcgucccauuacuagcauuaggcugcuauagccagguuaauccguuaacauuaacggcagcagugcuuaugcuggucgcccacuacgccauaauuggucccggccugcaagcgaaggcaacacgagaagcgcaaaagagaacugcugcuggaauuaugaaaaauccuacuguggaugggauugucgcaaucgauuuagauccaguuguauaugacgcaaaauuugaaaaacaauugggccaaauuaugcuacuaauucuguguacaucgcagauauugcuuaugaggacgaccugggcgcuaugugaaucaauaacccuugcuacuggcccauuaacuaccuuaugggaagguucacccgguaaguuuuggaauacaacaauagcgguuaguauggcgaacauauuucgagggaguuaccuagcuggagcuggauuggcauucuccuugaugaaaucccuuggaggugggagaagaggcacuggugcacaaggggaaaccuuaggggaaaaguggaagcggcaauugaaccaacuaucaaagucugaguucaauaccuacaagagaagcggcauuauggaaguggauaggagugaagccaaagaaggauuaaaaaggggcgagacaacaaagcacgcagugucgcgaggaacagcaaaguugcggugguuuguagaaaggaauuuaguaaaaccagaagggaaagugauagacuuaggcugcgguagagggggcuggaguuauuauugugcuggucucaagaaaguaaccgaggucaaaggauauacaaaaggggguccaggacaugaagaaccgaucccgauggcaacuuacgguuggaacuuagugaaauugcacucaggaaaagacguauucuuuauaccuccagaaaagugcgacacauuacuaugugacauaggagagucaaguccaaauccuacaauugaagagggaaggaccuuaagaguacuaaaaaugguagaaccuuggcugcgaggaaaucaguuuuguauuaaaauucucaacccauauaugccgucgguaguggaaacacuagaacaaaugcaacgaaaacauggcgguaugcucguacgaaacccacuaucacgaaauaguacccaugaaauguacuggguuaguugugguacuggcaauauaguuagugcaguaaacaugacuucaaggauguuacucaauagguuuacaauggcgcaccguaaaccaacauaugaaagagauguggaucuuggaacggguacaagacacgucgcugucgagccggaaguagcuaaucuagauauuaucggucaacgcauugagaauauaaagcacgaacauaaaucaaccuggcauuaugacgaggauaauccauacaaaacaugggcuuaucaugguaguuaugagguaaagccaucagguucagcaucgaguaugguaaauggugugguaaaauuacuuacaaaacccugggauguaauaccaauggugacccaaauugcaaugacugacacaacgccguuuggccagcaacgaguauuuaaagagaaagucgacacucggacaccaaaagcaaaacggggaaccgcccaaauaauggaaguuacugcgagauggcuauggggguuccucaguaggaauaagaaaccacgaaucuguacgcgugaagaguucacucggaagguuaggucaaacgcagcaauuggugcuguuuuuguagaugaaaaucaguggaauagcgccaaggaagcaguugaggaugagcgguuuugggaccuaguacaucgagaaagagaacuucauaaacaagggaaaugugcuaccuguguuuacaauaugauggguaaaagagagaagaaacuaggagaguucgguaaagcgaaggguucacgagcaauaugguacauguggcuaggugcacgguuucuugaguuugaagcacugggcuuuaugaaugaagaccauugguuuagcagggaaaauucucugucgggaguagagggugaaggguuacacaaauuagguuauauauugagggauauuuccaaaauccccggaggcaauauguacgcagacgauacggccgguugggacacucgcaucacagaggacgauuugcagaaugaagcaaaaauaacugacauaauggaaccugaacacgcucuguuggcaaaagcaauauuuaaacuuacauaucaaaauaaagucgugcgcguucaaagaccagccaaaaaugguacaguuauggacguaauuaguagacgugaucaaagaggauccggccaagucgguacauauggauugaauacauuuacuaauauggaggcucaauugauuagacaaauggaaagugaagguauauuuagucccagcgaacuagagaccccaaaccuggcugaacgggcacuugacugguuggagaaauauggaguugaacgauuaaaaagaauggcuauuagcggagacgacuguguagucaaacccauagaugaucgcuucgcaaccgcauugacggcacucaacgacauggguaagguaaggaaagauauuccacaaugggaaccaucuaaaggauggaaugauuggcagcaggucccuuucugcucacaucauuuucaucaacuaaucaugaaggauggaagggaaaucguugugccgugccguaaccaggaugaguuagucggccgagccaggguaucccaaggagccggauggucuuuacgugaaacagcgugccuuggcaaaucguaugcacaaauguggcaauugauguauuuucauaggagagaucuaagauuagcagcgaacgcuauuuguucggcagugccaguggauuggguaccgacuucacguacuacguggucaauacacgcgcaucaucaauggaugacgacggaagauauguuaucgguuuggaaucggguauggaucgaagaaaauccuuggauggaggacaaaacacauauuucauccugggaagacguaccauaucucggaaaaagagaagaucaaugguguggaucacucauaggauuaacagcgcgagcgacuugggcuacuaacauucaaguagccauaaaucaagugagacgacuuaucggcaacgagaauuaccuagacuauaugacaagcaugaaacgauucaaaaaugaaacugaucccgaaggagcauugugguaa

SEQ ID NO: 21532 - RNA, 9879 nt, Artificial Sequence
  derived and/or modified CDS sequence (opt6) from DENV-1__FJ432735__SS-prME
ucaguaacaauguuacugauguuaaugccaacggcacuagcauuccaccucacgacuaggggaggugaaccacacaugauaguaucuaaacaagaaagaggaaaaucacucuuguuuaaaacaagugcuggcguaaauaugugcacauuaauagcgauggaccugggagaauuuugcgaagauacaaugacauacaaaugcccgcgaauaaccgaagcggaaccugacgacgucgauugcuggugcaacgcaaccgauacuuggguaaccuacgggacuuguagccaaaccggugaacaucgcagggauaaacgaagcgucgcccuugcaccucacguuggcuugggguuagaaacaagaaccgaaacauggaugucaucggaaggcgcuuggaaacaaauacaaaggguagaaacaugggcuuuacgucauccgggauuuacaguuauagcccuguuucucgcacaugcaauagggacaaguaucacgcagaaagguauuauuuucauucuauugaugcugguaacaccgucuauggcuaugagaugcgucggaauagguucucgcgauuuugucgaagguuuaaguggggcaacauggguugaugugguacucgaacauggaaguugcguuacuacgauggcuaaagacaaaccuacacuagauauugaauugcuaaagacugaagucaccaauccagccguucuaaggaaacucugcaucgaagcaaaaauaucgaauacaacaacagauagccgauguccuacccaaggcgaagcgacccuaguugaagaacaagaugcaaacuucgucuguaggagaacguucguagaucggggauggggaaaugguuguggcuuauucggcaaaggcagucuuauuacuugugcuaaauuuaaaugcgugacaaaacuagaagguaagacuguccaauacgaaaacuuaaaauacucgguaauaguaacaguucauacuggagaucaacaccagguuggaaaugaaaguacugaacauggaacaacugcgacaauuacgccacaggccccaaguacagaaauacaacuaaccgauuauggagccuugacucucgacuguagcccuaggacaggacuggauuuuaaugaaauggucuuacuuacaaugaaagagaaaagcuggcuaguccacaaacaaugguuccuugauuuaccucuaccuuggacaucaggcgcaagcaccagccaagaaacuuggaaccgaaaagacuuacuuguaacuuucaaaacagcacaugccaagaaacaagaagucgugguacucggaucucaggaaggugcuaugcauacggcuuuaacuggugccacagagauccaaacaagugggaccacgaccaucuucgccggucacuuaaagugucgucuaaagauggacaaacuaacauugaaaggaaugucguacguuauguguacaggcagcuucaaauuagagaaggaagucgcugaaacccaacauggaacagucuuaguacaaauaaaauacgaagggacugaugcaccaugcaagauuccauuuaguacgcaagaugaaaaagggguaacacaaaauggcaggcuuauaacggcgaacccuaucguuacggacaaagaaaaaccaguuaauauagaagcagaaccaccauucggagaaucauauauagugauaggcgcaggcgagaaagcucucaaacuuagcugguucaagaaaggaucaucuauaggcaaaauguuugaagcgacagcaaggggugcaagacguauggccauauugggugacacugcaugggauuuuggaaguaucgggggaguauucaccucaguuggcaaauuaguacaccagaucuuugggacagcauacgguguguuauucaguggaguaucauggacgaugaaaauagggauaggcguguuacucacaugguuaggccuaaauucgcguaguacuucacucucgaugacuuguauagcaguaggguuagucacacuguacuuagggguuauggugcaagcggauucugguugcguuauuaauuggaaaggcagagaauugaaaugcgguucaggaauauucguuacaaacgaaguucacacuuggacagagcaauauaaguuucaagcugauucuccaaagcgauuaagcgccgcaaucggcaaagcaugggaagaagguguaugcggaaucagaucagcaacacgacucgaaaauauaauguggaaacaaauuucuaacgaauuaaaucauaucuuguuagagaaugacaugaaauucacaguuguugucggagaugucgccggaauauuagcacagggcaagaaaaugaucagaccucaaccuauggaguacaaauacagcuggaaaucauggggcaaagcuaaaaucauaggggccgaugugcaaaacacgacuuuuauuaucgauggccccaauacaccagaauguccugaugaccagagagcauggaauauuugggaaguggaagacuacggauuuggcauuuuuaccacuaacauaugguuaaaauuaagggacucauacacccaaguaugcgaucauagauugaugagugccgcuauaaaagauuccaaagcgguacacgcugauaugggguacuggauagaaagcgagaaaaaugaaacauggaagcuggcgcgugcaucauuuauugaagugaaaacuugcauuuggccuaagucacauacccuauggucgaacggcguccuagaauccgaaaugauaauuccgaagaucuaugggggaccuauaagccaacacaauuauagacccgguuauuuuacucaaacagcaggacccuggcaucuagguaaacuggaacuagauuucgaccugugugaaggaaccacuguuguuguagaugaacauuguggaaacagaggaccuagccuacgcaccacaacaguaacugguaaaaucauacaugaaugguguuguaggagcuguaccuuaccaccacucagauuuaaaggcgaagacggcuguugguauggcauggaaauacguccaguuaaggagaaagaagaaaaucuuguuaagagcaugguaucagccggcucuggugagguggauagcuuuaguuugggcuuauuauguauuucaauuaugaucgaggaagugaugaggucucgauggucgagaaaaaugcucaugacaggaacguuagcuguauucuuucucuuaauaaugggacaacuaacuuggaaugacuugauaaggcuuuguauaaugguuggagcuaaugcaucugacagaauggguaugggaaccacuuaucuagcuuuaauggcaacauuuaaaaugagaccaauguuugccguaggucuauuguuccggcgccuaacaaguagggaaguguuauugcuuacaauaggauugagcuuaguagcuaguguugaacuacccaauagucuugaggaacucggcgacggucuggcaaugggcauuaugauuuugaaguuauugaccgacuuccaaucccaucaacuaugggcuacccuguugucguugacguucauuaaaacgaccuucagcuugcauuaugcauggaaaaccauggcgaugguuuuaucaauaguuagcuuauuuccauugugccugaguacgaccucacagaaaacuaccugguuaccaguucuacucggcagcuuaggauguaaaccacugacaauguuucugauagcugagaauaaaauauggggaagaaaaagcuggccacucaacgaggguauaauggcaguaggaauuguuucuauucuuuuaaguucacuuuugaaaaaugacguaccacuagccggaccgcucauugcgggugggauguuaauugcauguuaugucaucagugguuccagugcagauuuaucuuuagaaaaagcagccgagguaaguugggaggaagaagcagaacacagcggagcgagucauaacaucuuaguugaaguccaagaugacggcacaaugaaaauaaaagaugaagaacgugaugacacauugacgauccucuuaaaagcuacacuccucgcgguuagugggguuuauccuuuaaguauaccagcaacgcuauuugucugguauuuuuggcaaaagaagaaacaacgcaguggagugcuaugggauacaccuaguccaccggagguagaaagagcaguauuagaugacggaauauaucguaucaugcaaaggggguugcugggcagaucucaaguagggguaggaguguuucaagaaaacgucuuucauacaauguggcacguaacaaggggcgccguauugauguaccaaggcaaacgauuagaacccagcugggccucagucaagaaggaucuaauaaguuacggcggaggauggagauuacaagguucauggaauacaggcgaagaaguacaggucaucgcgguugaaccuggcaaaaacccuaaaaacguacaaaccgccccgggaaccuucaaaaccagcgaaggcgaaguuggcgcuaucgcauuagacuuuaaacccggaacaagugggucaccuauagugaacagagaggggaaaauaguaggucuuuacggcaauggaguaguaacuacaucugguacauauguuucggcuaucgcucaagcaaaagccagccaagaagggccacuacccgaaauagaggaugagguauuuagaaagcgcaaucugacaauaauggaucuucaccccggcuccggaaaaacuaggcguuacuuaccggcaauaguucgugaagccauuaaacguaaauuaagaaccuugauauuagcuccaacaagaguuguagcaagcgaaauggcagaagcccuuaaaggcaugcccauuagauaccagacaacugccguuaaaagcgagcauacagguaaagaaauuguagauuugaugugucacgcaaccuuuacaaugagacuauuaagcccaguacguguaccaaacuacaauaugauaauaauggacgaagcgcauuuuacugacccuaguucaauagcugccaggggcuauaucaguacaagaguaggaaugggagaagcagcagcuauauuuaugacagcaaccccaccaggcucaguggaggcauucccgcaaucuaaugcagucauccaagacgaagaacgugauauaccagaacggucguggaauagcggguaugaauggauaacugauuuuccaggaaaaacaguaugguuugucccgaguauaaagucugguaacgauauagcuaauugucuuaggaaaaauggcaagagaguaauucaauuaagucguaagacauuugacaccgaauaucaaaagaccaaaaauaaugauugggauuauguagugacaacugauauuagcgaaaugggugcuaauuuuagagcggaucgcguuauugacccgcguagaugucuuaaaccuguaauuuugaaagaugguccugagagaguaauauuagcagguccaaugccagucacaguggcgagugccgcgcaacgaagagggcgcauugguagaaaucacaacaaagaaggagaccaauauauauauaugggccaaccauugaacaacgaugaagaccacgcucauuggacugaagccaaaaugcuauuagauaauaucaauacaccagaaggaauaaucccagcauuauuugaaccugaaagagaaaaaucagcggcaauugauggggaauauagacuaagaggggaagcaaggaaaacauuuguagagcucaugcgcagaggagaucuacccgugugguuaucauauaaggucgcaucggagggguuucaguauagcgauagaagguggugcuucgacggugagagaaacaaccaagucuuggaggaaaacauggauguagagauauggacuaaagaaggagaaaggaagaaacuaagaccacgaugguuggacgccaggacguacagugacccgcuugcuuuacgagaguucaaagaguucgcagcagggagaaggucuguaucgggugacuuaaucuuggaaauaggaaaacugccacaacaucuaacucaaaaagcccaaaacgcgcuagauaaucuagucauguuacacaacuccgaacaagggggucgcgcguacaggcacgcgauggaggaauuacccgauacuauagaaacgcuaaugcugcuagccuugauagcaguuuugaccggaggggugaccuuguucuuucuaucugguagaggguuaggcaaaacuagcauaggucuucuuugugucauggccucaucagucuuauuguggauggccucaguggaaccacacuggauugccgcuagcauaaucuuagaguucuuuuuaauggugcuacugauuccagaaccugaucggcaaaggacaccucaagauaaucaauuggcuuacguuguaauaggcuuacucuucaugauucucacaguugcagcaaacgagaugggacuacuugaaacgacuaagaaagacuuagguauugggcacguagccguugaaaaccaucaucaugcagcgauguuagauguggacuugcacccggcaagcgcuuggacucucuacgccguagccacuaccauaauuacaccgaugaugcgucauaccauagaaaacacaaccgcuaauaucagccucaccgcaauagcgaaucaggcugcuauuuuaaugggccuugauaaagguuggccgauaaguaaaauggacauaggcguaccacuacuagcauuagggugcuauagucaaguaaaccccuuaacccuaacagccgccguacuaauguuaguagcgcauuacgcuauuauagggccgggauuacaggccaaagcgaccagagaggcacaaaagagaaccgcagccggcauuaugaaaaacccaaccguugacggaaucguugcaauagaucuagauccagucgucuaugaugcuaaauuugagaaacaacugggccaaauuauguuacucauacuuuguacaucucaaaucuuguuaaugaggacaacgugggcuuuaugcgaaagcauaacguuggcgacaggcccacuaacgacucucugggaagguucgccuggaaaauuuuggaauaccacaauagcgguaucgauggcaaauauauuuagagguucauaccuggcaggagcaggucuagcauuuucauuaaugaaaucacugggaggcggaagaagagguacaggagcucagggugaaacacuaggagaaaaauggaaaagacaacuaaaucaacuuucaaaaagcgaauuuaauaccuacaaacgaucagguauuauggagguggaucgaagcgaagcgaaagaaggauuaaaacgcggagagaccacuaaacaugcaguuagcagggguacugcuaaauugcguugguuuguugaacgaaaucuuguuaaaccagagggaaaaguuauugaccugggauguggcagaggggguuggaguuauuacugugccggacuaaagaaaguuacagaaguuaaaggauauacuaaagggggccccggacaugaggaaccuauacccauggcaacuuacggcuggaacuuaguaaaacuccacaguggaaaggauguauucuuuauaccaccugaaaaaugugauaccuuauugugcgauauuggugaaagcucgccgaacccuacgauagaagagggacgaacauugagaguccuaaaaaugguagaacccuggcuacggggcaaccaauucuguauaaagauauugaauccguauaugccguccguuguugaaacccuagaacagaugcaaagaaaacacggcggaaugcuagugagaaacccguuaucacguaacucaacccacgaaauguauuggguuagcugugggacagguaacauuguaagcgccguaaauaugaccagccguauguuacugaauagauuuacgauggcacauaggaagccuacauaugaaagagacgucgaucugggagccgggacaaggcacgucgcuguagaacccgagguagcuaacuuggacauuauaggacagaggaucgaaaauauaaaacaugaacauaagucaacauggcauuacgacgaggauaauccauauaagacaugggcauaucauggcaguuacgaggugaagccauccgguucugccucuucaauggucaauggcguaguaaaacuccuaaccaaaccuugggaugugauaccaaugguaacacagauagcaaugacagacacaacaccauucggucaacagagaguauuuaaggaaaaaguggacacucguacaccaaaagcgaagcgaggcaccgcccaaaucauggagguuacagccaaauggcuauggggguuccuaucaaggaauaagaaaccucgaauuuguacgagggaagaauuuacgagaaaagucagaucaaaugcagcaaucggggcagucuuuguagacgaaaaucaauggaacagcgcaaaagaagccguugaagaugaaagauucugggaucuagugcacagagaacgugaacuucauaaacagggaaaaugugccacuugcguuuacaauaugaugggaaaaagagagaagaaacuaggagaguucggaaaagcgaaagggagucgagccauuugguacauguggcucggagcgagauuucuagaguucgaagcgcuuggauuuaugaaugaagaccacugguuuagcagagaaaauucacuaucaggcguggaaggcgaaggacuucacaaauuaggauacauucuucgagacauuagcaagauucccggaggaaauauguaugcagaugacaccgcaggcugggauacacgcaucacugaagacgauuuacaaaaugaagccaaaauuacggacauuauggagcccgaacacgcucugcuagcaaaaucaauauuuaaacuaacauaucaaaauaaaguuguuaggguucaaagacccgccaaaaauggcacaguaauggacgucauuaguagacgagaucaacgggguucugggcaaguagguacguacggauuaaacacuuucacaaauauggaagcacaguugaucagacaaauggaaucagaaggcaucuucucaccaucggaauuagaaaccccuaauuuggccggucgcguuuuagacugguuagagaaacauggaguugaacgucuuaaaaggauggccauaucaggugacgauuguguaguuaagccaauagaugaucgcuuugcgacagcccuaacugcauuaaaugauauggguaaagucagaaaagauaucccacagugggaaccaucgaaaggauggaaugauuggcaacaaguaccguuuuguucacaccauuuucaucaacucaucaugaaagauggaagagaaauaguaguuccauguagaaaccaggaugaacuugucgguagagcccgagugucgcaaggcgccgguuggucauuacgugaaaccgcauguuuaggaaaaaguuacgcacaaauguggcaacuaauguacuuccaccgaagagaucucagauuggcugcuaaugccauaugcucagcggucccuguagauuggguuccaacguccagaacgacguggucuauacacgcccaucaucaauggaugacaacggaagauauguuaagcgucuggaaucgcguuuggauagaagagaacccauggauggaggauaaaacgcacauaagcaguuggggugaugugccguaccuagggaaacgcgaagaucaaugguguggcucucuuauaggcuuaacugcgcgggcaacuugggccacuaauauccaaguagcuauaaaccaaguaagaagauuaauaggcaaugaaaacuaccuggauuacaugacuagcaugaaaagauucaaaaaugagucagacccagaaggagcguuaugguaa

SEQ ID NO: 21533 - RNA, 9879 nt, Artificial Sequence
  derived and/or modified CDS sequence (opt6) from DENV-1__FJ432736__SS-prME
ucuguaacuauguuacuuauguuaaugccaacugcacuugcuuuccaccugacuacgagagggggugaaccgcauaugauuguuucgaaacaagaaaggggcaaaaguuuguuauuuaaaacgagugcuggcguaaacauguguacuuuaauugcaauggaccuaggagagcuaugcgaagacacaaugaccuacaaaugcccgcgaauaaccgaagcugaaccggacgacguagacugcuggugcaacgcaacugauaccuggguaacuuacggcaccuguucacagaccggagaacaccgccgagauaaaaggucgguagcuuuagcaccucauguaggauuaggcuuagaaacacggacggaaacauggaugagcagugaaggggcguggaaacaaauucaaaggguagaaacaugggcccuaaggcaucccggauuuacaguuauagcccuauuucuagcgcacgccauagguacaaguaucacgcagaaagguaucaucuucauauuacuaaugcuagugacaccuucaauggccaugcguuguguuggaaucggaucacgugauuucgucgaagggcuuucaggggcgacuugggucgacguaguacucgaacauggauccugcguaacgacgauggccaaagauaaaccgacccuugauauagaauugcuaaaaacugaagucaccaauccagcaguacugcguaaauuauguauagaagcaaaaauuucaaauacaacaaccgacucuaggugcccgacacagggcgaagcaacucuggucgaagaacaagaugcaaacuuuguaugccgacggacguucguagauagaggaugggggaauggauguggccuauucggaaaagguagcuuaaucacaugugcgaaauuuaaauguguuacgaaauuagaaggaaaaauuguccaauaugagaauuugaaauauucaguaauuguaacuguacauacgggggaucagcaucaaguugguaacgagucuacggaacaugggacuaccgcaacaauuacgccucaagcgccaaccaccgaaauccaauuaaccgauuauggugcacuaacauuggauugcucaccuagaacaggacucgauuucaacgagauggucuuacuaaccaugaaagagaaaaguuggcuaguacauaaacaaugguuucuugaccuaccacuacccuggacaaguggagcauccacgagccaggagacuuggaauagacaggacuuauuaguuacauucaaaacagcacaugccaagaaacaagaagucguugugcuuggcucacaagaaggcgcuaugcacacagcauugacaggagcaacugaaauacaaacaagugguacuacaacaaucuuugccggccauuuaaaauguagacuuaaaauggacaagcugacuuugaaaggaaugucauaugugaugugcacugguucuuucaaacucgaaaaagaaguugccgaaacacaacauggaacaguacuuguacaaauaaaauaugaagguacggaugcaccauguaaaauaccuuuuucgacccaagaugaaaaagggguaacgcagaacggacgauuaauuaccgcaaacccuauaguuacugauaaggaaaaacccguaaauauugaagcagagccgccauuuggugaaucauauaucgugauuggugcaggcgaaaaagcacuaaagcuaucaugguucaagaaaggaucuuccauagguaagauguuugaagcaacugcacgaggagccagacgaauggcuaucuuaggagauaccgcaugggauuuuggaaguauaggaggcguauuuaccucgguuggcaaauuaauacaucaaauauuugguacagcauauggaguccucuucaguggcguuagcuggacaaugaaaaucgguauugguguauuacuuacauggcuaggauuaaacucacgaagcacgucguuaagcaugacauguauagcuguuggccuugucacacuauaucucgggguuaugguacaagcagauagugguuguguaaucaacuggaagggucgggaacugaagugcgguuccggaauauucgugacuaaugaaguacauaccuggaccgaacaauacaaauuucaggcagauuccccuaaacggcuguccgcagccaucggcaaagcaugggaagaagguguuugugguauaagauccgcaacacguuuagaaaacaucauguggaaacaaauuuccaaugaacuuaaucacauauuacuugaaaacgauaugaaauuaacuguaguuguaggugacguagcaggcauucuaggacaagguaagaaaaugauacguccucaacccauggaauauaaguauucauggaagaguuggggaaaagcuaaaauuauaggagcagacgcacaaaacacuaccuuuauaaucgaugguccuaauacgccagaauguccagaugaccaaagggcguggaauauaugggaagucgaagauuacggauucggaauuuuuacuacaaauauauggcuaaaacuaagggacucauauacgcaaguaugcgaucaccgauuaaugucugcugccauaaaagacucuaaagcuguacaugccgauauggguuacuggauugagagugagaaaaaugagacuuggaaauuggcaagagcgaguuuuauugagguuaaaaccuguauuuggccaaaaagccauacauuguggaguaauggaguacuagagucggagaugauaauacccaaaauauacggaggaccuauaucgcaacacaacuacagaccggguuaccuaacccaaacggcaggccccuggcauuuaggcaagcuggaauuagacuucgacuuaugugagggcacgaccguagugguugaugagcacugcggaaaucgugguccuagcuugaggacaacaacagugacggguaaaauuauacacgaguggugcugucguagcuguacacucccgccccuacgauucagaggcgaagacggguguugguauggaauggaaaucagaccugucaaagagaaagaagagaaccugguaaaaagcaugguuucugcgggaccaggcgaaguugacucuuuuucccuuggccuuuuauguaucagcauuaugauugaagaagugaugaggucuagauggucuaggaagauguuaaugacagguacguuagccguauucuuuuugcuaauuaugggucagcuuacauggaaugaucugauacgauuaugcaucauggugggagcuaacgccuuugauagaaugggcaugggaacuaccuacuuggcccuuauggccaccuuuaagaugcguccaauguuugccgugggauuacuauuuagaagacugacgaguagagaggugcuguugcuaacaauaggguuaaguuuaguagcaagcgucgaauugcccaacaguuuagaggaauuaggagacggauuggccaugggcauuaugaucuuaaaauuguuaacagauuuccaaucacaccaauuaugggcgacacuauugucacuuacuuucauuaagacaacuuucagcuuacauuaugccuggaaaaccauggcaaugguccuaaguaucguaucauuauucccauuauguuuaucuacgacaucacagaaaacgacgugguugccaguucuacuuggaagucugggcuguaaaccacuaacuauguucuuaauagcggagaauaaaauuuggggucguaagaguuggccgcugaaugaaggcauaauggccguugguauuguuucuauuuuauuaaguucauugcuuaaaaacgauguaccauuagcaggacccuuaauagcgggugggaugcucauugcauguuauguaauauccgguagcagugcugaccucaguuuagagaaggcggcagaagucucuugggaagaagaagcggaacacucaggagcaagucauaacauauuaguggaggugcaagacgaugguacaaugaaaauaaaagacgaggaaagagacgauacacucacuauuuuacuaaaagcuacgcuauuagcgguaagugggguuuacccucuuuccaucccagcuacacuauucguaugguacuuuuggcaaaagaagaaacaaaggucgggcguuuuaugggauacacccagcccuccggaaguggaacgagcaguacuagaugaugggauuuauagaauuaugcaacgcggacuauugggaagaucucaggugggaguaggaguauuucaggagaauguauuucacacgauguggcacguaacacgaggagcaguucuaauguaucaagguaaacgauuagaaccuagcugggcgucagucaagaaagaucuaauaucuuauggagguggauggagauuaagagggaguuggaacaccggagaagaaguucaaguuaucgcaguugaaccgggcaaaaauccuaagaauguccagaccgcccccgggacuuuuaaaacucccgaaggcgagguaggggcuaucgcacuggauuuuaaaccagguacaucagguuccccaauagucaauagggaagguaaaauaguaggauuauacggcaaugggguaguaacgaccucugggauauauguuucagccauugcccaagcuaaagcuagucaggaagguccauuaccagaaauagaagacgagguauuccguaaacguaacuuaaccauuauggaucuccacccgggaucagguaaaacaagaagguaccuuccagccauuguacgagaagcaaucaaaagaaaauugagaacauugauucuggcccccaccaggguaguagcgucugagauggcugaagcacugaaagguaugcccaucagguaccaaacaacagcaguaaaaucugaacacacaggaaaagaaaucguagaucuaaugugucaugcaacuuucaccaugaggcuuuuaucgccgguaagagugccuaauuauaauaugauaaucauggaugaagcccauuucacagaucccagcaguauagcugcuagaggauauauuagcacgcgcgucggaaugggugaagcugcagcaaucuucaugacugcuacaccaccugguaguguagaagccuucccacaaucaaaugcggugauucaggacgaagaacgugauauaccugaacguucauggaacagugggcaugaauggauaacagauuuuccgggcaaaacggucugguuuguuccuucaauaaaaagugguaacgauaucgcaaauugccuaaggaaaaaugguaaaagaguuauucaacuuagcagaaaaacauuugauacugaauaucagaaaacuaagaauaaugauugggacuauguggugacaacugacaucagugaaaugggagcgaauuuucgagcagauagagugauagaccccagaagaugucuaaaaccagugauacugaaagauggacccgaacgaguaauuuuagcagggccaaugccaguaacaguagcuucugcugcacaaagaaggggaaggauuggaagaaaccacaauaaagagggagaccaauacauauauaugggccaaccacuaaauaacgaugaagaccaugcucauuggacugaagccaaaaugcuucuugauaacauuaauacaccagaaggaauuauuccugcauuauuugagccagagagggagaagucagcggcuguagacggagaauauagguuaagaggggaagcuaggaaaacauuuguagaguuaaugagaaggggagacuuaccaguaugguugaguuacaaaguggcauccgaaggauuccaauauagugauagaagauggugcuuugauggugaaagaaauaaccagguauuggaggaaaacauggacguugagauauggacgaaggaaggagaacggaaaaaguuaaggccuagguggcuugaugcgcguacuuacucugacccauuagcucuacgagaauuuaaagaauuugcagcuggaagacguucggucucgggcgauuuaauacuagaaauugggaaauugccucaacauuuaacacaacgugcccagaaugcgcucgauaauuuggugaugcuacacaacucagagcagggaggucgcgccuauagacaugcaauggaggaauuacccgacacaauagaaacguugaugcuucucgcccuuauagcaguucuaacugguggaguaacacuauuuuuccuaucaggaagaggcuugggaaaaacgaguauaggacuuuuauguguuauggcaucgagugucuuacucuggauggcaucuguugaaccacauuggauugcagccucuauaauucucgaguuuuuccuuaugguuuuguuaauuccugaaccagauaggcaaagaacaccacaggacaaucaauuggcauacguaguaauuggauugcucuuuaugauacuaaccgucgcagccaaugaaauggguuuauuggagaccacuaaaaaggauuuaggaauaggccacguagcuguagaaaaccaccaucacgcugcuauguuagauguagauuuacauccagccucagccuggacacuauacgcuguagcaacgaccauaaucacuccuaugaugcgacauacaauugaaaauacaaccgcaaacauaucauuaacagcgauagccaaccaagcggccauucuaaugggacuggacaaaggauggccaauaaguaaaauggauauugggguuccguuacuggcacuugggugcuauucacaaguaaacccacuaacguugacagcagccgugcuuaugcucguagcacacuacgccauaaucggaccgggguugcaggcgaaagcuacccgugaagcacaaaagagaacagcggccgguauaaugaaaaauccaacagucgauggaauuguagcgauagaccuggauccuguuguauacgaugcuaaauuugaaaaacaacuaggccaaauaaugcuacucauuuugugcacaucacagauacuacuaaugcgcacaacuugggcauuaugcgaauccauuacuuuggcaacaggaccauuaacaacauugugggaaggaucccccggaaaauuuuggaacacuacgauagcagugaguauggcaaauauuuucagagguaguuacuuagccggugcaggacuagccuucagucucaugaaaucgcuggguggugggcgucgugggacaggagcacaaggagaaacguuaggcgaaaaauggaaaaggcaauuaaaucaacugucuaagucugaguuuaacacauauaaaagaucuggaaucauggaaguggauagaagugaagcgaaagagggacugaaaagaggagaaacaacuaaacacgcaguuagccgaggaacggcaaaauuacgaugguucgucgagcguaaccuugucaagccugaaggaaaagucaucgaucuuggcugcggacggggaggguggucuuacuacugugcgggguugaagaaaguaacagagguuaagggguacacaaaaggugggccaggucaugaggaaccuauaccaauggcaacuuacggauggaaucucguuaagcuacauucuggaaaagauguguucuuuauuccaccugaaaagugugacacacuauuaugugacauaggggagagcagcccgaauccuacgauugaggaaggacgaacgcuacgcguauuaaaaaugguagaaccuuggcuacguggaaaucaauuuuguaucaaaauacugaauccauauaugccguccguuguagaaacacuugaacagaugcaaaggaaacacggaggaaugcuaguaagaaauccacugucccgaaacucuacucacgaaauguauugggugagcugcgguacagguaacauuguaagugccguuaacaugacaaguagaaugcuccucaaucgcuuuacaauggcacacaggaaaccuacauacgaaagagacguggacuugggcacugguacaagacauguagccguugaaccggaaguugcgaacuuggauauaauagggcaacggauagaaaauauaaaacaugagcacaagaguacuuggcauuaugaugaggacaaucccuacaaaacuugggcuuaccaugguuccuaugaggucaaaccuucaggauccgcuagcagcaugguaaauggcguaguuaaauuauugacuaaacccugggauguuauaccaaugguaacgcaaauagcaaugacugacacuacuccguucggacaacaacguguauuuaaagaaaagguagacaccaggaccccgaaggcuaaacguggcacggcacagauaauggaaguaacagccagauggcuauggggauuuuuaagccguaauaagaaaccuagaauaugcacgcgagaggaguucaccagaaaagugagaucuaaugcggcgauuggagcaguguucguggacgaaaaucaauggaacucggcaaaggaagcaguagaagaugagagguuuugggaccugguacauagggagagagaguuacauaaacaaggcaaaugugcaacauguguauauaauaugauggggaaacgcgaaaagaaacuuggagaauuuggaaaggcaaaagggagccgcgcaauaugguauauguggcugggggcacgguuucuagaguucgaggcuuuaggauucaugaaugaagaucauugguuuucacgcgagaauagccuaucaggcguugaaggugagggauuacauaaacuaggauauauauuaagagauauuucaaaaauuccaggagguaacauguacgcugaugauacagcaggaugggauacucguaucacagaagacgaccugcaaaaugaagcaaaaauaaccgacauaauggaaccagaacaugccuuauuagcuaaagcgauauucaaacuuacauaccagaacaaagucguuagagugcaacgcccagcgaaaaaugggacuguaauggauguaauuaguagacgugaucagcgcgggucuggucaaguaggcacuuaugggcuaaauacuuucacaaauauggaggcgcaguuaauccggcagauggaaucugagggcauauucucaccuuccgaauuagagacaccuaauuuggcugagagagcacuugauuggcuggagaaauaugguguugaacgacugaaacgaauggcuaucucuggggacgauugcguaguaaaaccaauagacgaucguuucgcaacagccuuaacugcacuaaacgacauggggaaaguucgcaaagauauaccccaaugggagccaagcaaagguuggaaugacuggcaacaaguacccuucugcucucaucauuuucaucaacugauuaugaaggacgggagagagauuguaguacccugcaggaaucaagaugaauugguaggccgugcuagagugucacagggcgcugguuggucccuccgcgagacugccugccuagguaaaucauacgcgcagauguggcaacuuauguauuuucaucgucgugauuuaagauuggcagcaaaugccauauguucagcaguuccaguagauugggugccgacuucacgaacuacuuggucaauccacgcacaucaucaauggaugacuaccgaggacaugcucuccguauggaaucguguauggauugaagaaaacccuuggauggaagauaaaacacacauaaguucaugggaagacguacccuaccuaggaaagcgugaagaccaguggugcggaagucuaaucgguuuaacugcuagggcaaccugggcgacgaauauucaagucgcuauaaaucagguucggagguuaauuggaaaugagaacuaccuugauuauaugacgucuaugaaacguuucaaaaacgaaucagauccagaaggggcacuuugguag

SEQ ID NO: 21534 - RNA, 9879 nt, Artificial Sequence
  derived and/or modified CDS sequence (opt6) from DENV-1__FJ410198__SS-prME
agugucacaauguuacuaaugcuaaugccaacugcacuugcauuccaccucacuaccagagggggugaaccacacaugauaguuucaaaacaagaacgcggaaaaucucuacuuuuuaaaacaucagcuggagugaacaugugcaccuuaauagcaauggauuuaggugaauuaugugaagacaccaugacauauaaauguccaagaauaacagaaaccgaaccagaugacguagacuguuggugcaaugccacugauacuuggguuacauacggcacauguucgcaaacaggcgaacaucgcagagacaaaaggagcguugcguuggcuccucaugucggcuuaggacuugaaacacguacagaaaccuggaugaguuccgaaggugccuggaaacaaauacaacguguagaaacuugggcacuucggcacccaggauuuacagucauagcacuuuuucuggcacacgcaauaggcacgaguauuacacaaaaaggaauaauauuuauauuacucaugcuuguaaccccaucaauggcaaugcgcugcgugggaauuggaucaagagauuuuguagaaggauuaucaggggcaacuuggguugauguaguauuggaacauggaagcugugucacaacgauggcuaaagacaaaccaacauuggauaucgaacuacugaaaaccgaagucacuaacccagcaguucugcgaaaacuuuguaucgaagcaaaaauuucuaauaccacaacugacucucgauguccuacucaaggcgaagcaacauuggucgaagaacaagacgcaaauuuugucuguagaagaacguucgucgaccgagguuggggcaauggaugcggacuguuuggaaaaggaagccuaauaacuugcgcgaaauucaaaugugugacgaaacuagaaggcaaaauuguacaauaugagaacuuaaaauauaguguaauaguaacuguccauacuggagaucaacaucaaguaggcaacgagaguacagaacacgguacuacagcuacuaucacaccgcaagcucccacuacugaaauccaacuaacugacuauggagcauuaacacuggauuguucuccuagaacgggucuugacuuuaaugaaaugguacuacuuaccaugaaagagaaaaguugguuaguccacaaacaaugguucuuggauuuaccacugccauggacaagcggagccucuacaucacaagagacauggaauagacaagacuuauuagugacguuuaaaacagcacacgccaagaaacaagagguaguaguauuaggcucacaagaaggagcgaugcauacagccuuaacaggugcgacagaaauacaaacaagcggaaccaccacgauauucgcuggucaccucaaaugcagguuaaaaauggacaaacucacauuaaaagguaugaguuacgugaugugcacagggagcuuuaaauuagaaaaagaaguagcagagacucaacacgggacuguucuuguacaaauuaaauacgaggggacagaugcaccguguaaaauuccauuuagcacacaagaugaaaagggagugacucaaaacggccgguugauuacagcuaauccaaucguuaccgauaaggaaaaaccggugaacauagaagcagaacccccauuuggcgaaucuuacauuguaauuggugcgggugaaaaggcauugaaacugagcugguuuaagaaagguucgucuaucggcaaaauguuugaagcuacugcaagaggagcccgcaggauggccauacugggugauacagcaugggauuucggaaguauugguggaguguuuacaaguguugguaaauuaguacaucagauauuuggaacagccuauggcguuuuauuuaguggaguuucauggacuaugaaaauaggaaucgggguucuccugacauggcuagguuuaaacagcagaaguacaucacugaguaugacguguaucgccguaggucuagucacacuuuaucugggcguaauggugcaagcagacucaggaugcguaauuaauuggaagggaagagaguuaaaaugcggauccgggauuuucgucacaaaugaaguucauacauggaccgaacaauauaaguuccaagcugacucucccaagagauuguccgcggcaaucggcaaggccugggaagaggguguuugugguauaagaagugcuacaagauuggagaauauaauguggaagcagauuuccaacgaguuaaaucacauuuuacuagaaaaugacaugaaauuuaccgugguaguaggggacguugcugguauucuagcacaagggaagaaaaugauacgaccgcaaccaauggaauauaaauauucguggaaaucuuggggcaaagcaaaaauaauaggugcggauguacagaauacuacauuuaucaucgacgguccgaauacgccagaguguccagaugaucagcgcgcuuggaauauuugggaaguagaagauuaugguuucggaaucuucacaacgaacauaugguuaaaacuucgagacaguuacacucaagucugugaucaccgucuaaugucagcagcaauaaaagauuccaaagcuguucaugcggauaugggcuauuggaucgagucugagaaaaacgaaacuuggaaacuugcaagagccucauucaucgaaguuaagacauguauuuggccaaaaucacauacacuuuggaguaauggcguacuagagagugaaaugauuauaccgaagauauauggcgguccaauaagccaacacaacuaccgaccgggauauuucacccaaacagcugguccauggcaccuggguaaguuagaauuggacuuugacuugugugaggguacaaccgucgugguugaugaacauugcgguaacagggguccaucauuaagaacgaccacugucacgggaaaaauaauacaugaauggugcugucgauccuguacauugccucccuuaagauuuagaggggaagacggauguugguauggcauggaaauacgucccguuaaggaaaaagaagaaaacuuaguaaaaucuaugguaagugcgggauccggggagguagacucuuuuaguuuaggucugcuaugcaucucuauaaugauagaagaggugaugaggucacgaugguccagaaagauguuaaugacuggcacacuagcaguauuuuuccuacugauuaugggacaauuaaccuggaacgaccuaauaagacuaugcauaaugguuggugccaacgcuuccgaccgcauggguaugggcacaacauauuuagcccucauggcgaccuuuaaaaugcgccccauguuugcagugggauugcuguuucggcgucuaacgaguagagaggucuuauuguugacgaucggacucucauuaguagcaagcguagaauuaccaaauagcuuagaagaacugggagauggucuagcaauggguaucaugauauuaaagcuacugacagauuuccaaagucaucaacuuugggcaacccuacuuagcuuaacauucauaaaaacaaccuuuucguugcauuaugcauggaagacuauggcgaugguacugaguauaguuucauuauuuccuuuaugccucagcaccaccagucagaaaacuacauggcuaccuguucuacuugguagucuaggauguaaaccucuuaccauguuucuaauagcugaaaauaaaauuuggggccgucgcaguuggccacucaacgaaggaauaauggcugugggaaucguuagcauauuguuaaguucauuauuaaagaaugauguuccguuagccgggccgcuaauagcaggcgguaugcuuauagcuugcuauguaauuucaggaagcucagcagaucugucucuagaaaaagcagcugaagugagcugggaagaagaagccgagcauaguggugcaucacauaauauccuagucgaaguucaggaugacgguacaaugaaaauuaaagacgaagaaagagaugauacucugacuauuuugcugaaagcgacguuguuggcagugagugguguauauccauugucaauaccagcaacacuauucguuugguacuucuggcagaagaagaaacaaagaucuggaguuuuaugggauacacccucaccaccggaagucggccgcgcaguucuagaugauggcauauaucguaucaugcaaagaggacucuuaggacgaucacaaguuggcguuggaguuuuucaggagaacguauuccauacaauguggcauguaacaaggggugcggugcuaauguaccaagguaaaagacuagaaccaucaugggcaucagucaagaaagauuuaauuucauauggaggcggauggagacuucaaggaucguggaauacaggagaagaaguucaaguaauagcugucgaaccagggaaaaauccuaaaaauguucaaacugcaccagguacguuuaaaacuccugaaggagaaguuggagcaauagcgcuugacuucaaacccggcacaagugggagcccaauaguaaauagagaaggaaaaauugucggucuuuauggaaaugggguuguaacuacauccgggaccuauguaucugcaauagcucaagcuaaagcuagucaagaaggaccauuacccgagauagaagaugaaguguucagaaagaggaaccuuacaauuauggauuuacauccgggcucagguaaaacgagaagguauuuacccgcgaucguuagggaagcgauaaaacguaaacuccgcacguuaauucuugcaccgacgcgaguuguugccagugaaauggcugaggccuuaaaggggaugccgauaagauaccaaaccaccgcaguaaaaucggaacacaccggcaaagaaauuguagaucuaaugugucacgcuacuuuuaccaugagacuacucagcccaguacgcgucccgaauuauaauaugauaauaauggaugaagcccauuuuacagacccguccagcauagcagcacguggguacauaucgacccgcgucggaaugggagaagcagcagcaaucuuuaugacagcuacaccaccugggaguguagaagcauucccucaaucgaacgcugugauacaagaugaagaaagagacaucccugaaagaagcuggaacagcggcuaugaauggauaacagauuucccagguaaaacugucugguucguuccaucuaucaaaaguggcaaugacauugcgaauugccucagaaagaacgggaaaagggucauccaacucucuagaaaaacuuucgacacugaguaccagaaaacuaaaaauaaugacugggacuauguaguaacaacagacauaagugaaaugggggcaaauuuuagagcugaucgaguaauugaucccaggcgaugcuugaaaccagucauauuaaaagacgggccagaacgugucauuuuggcaggaccgaugccugucacaguagcgucggccgcucaaaggagaggacgaauagguagaaaucacaauaaagaaggagaucaauauauauacaugggacaaccguuaaacaaugacgaagaccaugcacacuggacagaggcaaaaauguuacuagacaacauaaauacaccagaaggaaucauaccugcauuauuugagccggaacgagagaaaagugcagccaucgauggagaguaucgacucagaggagaggcgagaaaaacauuuguagagcugaugcguagaggagaccuuccgguaugguuaaguuacaaaguugcuucggaaggguuucaauauucggauagaagguggugcuuugauggggaaagaaauaaccaggugcuagaagaaaauauggacguggaaauauggaccaaggaaggagaacguaagaaacugcgaccucguuggcuugaugcucgaacuuauucugacccucuugccuuacgcgaguucaaagaguucgcagcaggccggaggagcguaaguggugauuuaauuuuagaaauugggaaacucccgcagcauuuaacccaaagagcgcaaaaugcuuuggacaaccugguaauguuacauaauucagaacaaggugguagagcuuaccgacaugcaauggaagaacuaccagacaccauugaaacguugaugcuacuugccuuaaucgcuguauugacaggagguguaacgcuauuuuuccuaagcggacgugguuuggggaaaacaucuauuggauugcugugugucauggcaucuucaguuuuauuauggauggcaucaguagaaccacauuggauagcagcuucuauuaucuuggaguucuuuuugaugguauuacucauuccagaaccggacagacaaaggacuccccaagacaaucaauuagccuacgugguaauuggacuucuauuuaugauacuuacuguugccgccaaugaaaugggccuuuuagaaacaacaaagaaagaucuaggaaucggucacguagcuguagaaaaccaccaucacgccacaauguuggacguggauuugcacccugcauccgcauggacgcucuacgccguugcaacaacaaucauaacacccaugaugcggcauacgaucgagaacacaacagcuaacauauccuuaacagccauagccaaccaagcagccaucuuaaugggccuagauaagggauggccgauauccaaaauggacauagggguaccucuccuagcgcuaggauguuacucacaaguaaauccacuaacguuaacagcggcuguacuaauguuaguagcacauuaugcaauaauugggccgggacuacaagcaaaagcuacgagggaggcgcagaaaagaaccgcagcaggcauaaugaaaaacccuacgguagauggaaucguggccauagaucuagaccccguuguuuacgacgcaaaguucgaaaaacaacuaggacaaauaaugcuacuaauucuaugcacuucacaaauauuauuaaugcgcaccacuugggcacucugugagucaaucacauuagccacaggaccuuugacaacuuugugggagggcucaccagggaaauucuggaacaccacuaucgcgguaucgauggcaaacauuuuuagaggaucguauuuagcaggagcuggacuugcauucucgcucaugaagucgcugggcggaggcagaagaggaacuggcgcgcagggagaaacgcuuggagaaaaauggaaacgacaacuuaaccaauuaucuaaaucugaguuuaauacguacaaaaggagugguauaauggagguggauagaucggaagcaaaagaaggguugaaacgaggcgaaaccacgaagcacgcagucagucggggaacggcgaaacuacguugguuugucgaaagaaaccuuguaaaaccggaggggaaaguaauugaccugggaugcggaagaggaggauggucuuacuacugugcuggacucaagaaaguuacugaaguuaaaggauauacaaagggugguccuggacaugaagaaccaauuccaauggcuacauauggauggaauuuagucaaauuacauagcgggaaagacgucuucuuuauaccuccggaaaagugugauacacuuuugugcgauauaggugaaaguucuccgaacccaacgauugaagaaggacgcaccuuaagagugcuaaagaugguggaaccauggcuacgaggcaaucaauuuugcaucaagauucuaaauccuuauaugccaucgguaguugaaacacuagaacaaaugcagcggaaacacggugguauguuaguaagaaacccguuaucacgaaacucuacacaugaaauguauugggucucuuguggaacugggaauaucguuucagcagucaacaugacaucucgaaugcuucugaaucguuuuacaauggcacaccgcaaaccuacuuaugagagagacguggaucuaggagcagggacuagacauguagcaguagaaccugaaguagcgaauuuagacauuauaggccagaggaucgagaauauuaaacacgaacacaagucaacguggcacuacgaugaagacaacccuuacaaaacuugggcauaucauggaucauacgaagucaaaccgaguggaucugcuucaucaaugguaaauggagugguaaaguuauuaacaaaaccaugggacgugauuccaauggucacccaaauugcaaugacagacaccacgccauuuggacagcagcguguuuucaaggagaagguagauacaaggacgccuaaggcuaagcggggaacggcacaaauaauggagguuacagcaaaguggcuaugggguuuucugucccgcaauaagaaaccucguauuugcacuagggaagaauuuaccagaaagguaagauccaacgcugcgauaggggcuguauuugucgacgaaaaccaauggaacucugcaaaagaagcaguugaagacgaaagauucugggaucuagugcaucgcgaaagggaacuacacaagcagggaaaaugcgcaacaugcguauacaauaugauggguaagcgugagaagaaacuuggagaguucgguaaagccaaaggaucaagagcuaucugguauauguggcuuggagcgagguuccuagaauuugaagcauugggcuucaugaacgaagaccauugguuuuccagagaaaacucuuuaucagguguagaaggagaaggauuacacaaacugggauauauauuaagagauauaucaaauauaccaggugguaauauguacgcagaugauacugcaggaugggacacuaggauaaccgaggaugauuugcagaaugaggcuagaauaacggauauaauggaaccagaacaugcacugcuagcgaaaaguauauuuaaauugacuuaccaaaacaaaguaguaagaguacagcggccggccaaaaauggcacugugauggacguaauuucccgacgcgaccagagagguaguggacagguuggcacauauggacucaacacauuuaccaacauggaagcccaauuaauacgucaaauggaauccgaggguauuuucaguccaagcgaguuagaaacuccaaacuuagcagagagaguauuggauuggcuagaaaaauacgguguggagagacuaaaaagaauggccaucucuggggaugauugcguaguaaaaccgauugaugacagauuugcaacagcguuaacagcauuaaacgacaugggcaaaguucguaaggauauaccacaaugggaaccgagcaaagguuggaaugauuggcaacaaguucccuucugcagucaccauuuucaucaguuaauuaugaaagauggucgagagauaguagucccauguagaaaccaagaugaguuaguaggcagagcgcgugugucucaaggagcaggauggucauuaagagaaacggcauguuuagggaaaucauacgcucagauguggcaauuaauguauuuucauagacgcgaccuaagauuagccgccaaugcaauauguuccgcugugccuguagauuggauaccuacaucuagaaccacauggaguauacaugcucaucaucaauggaugaccacagaagauaugcuuucaguauggaaccgcguuuggauugaggaaaacccauggauggaagacaaaacgcauaucagcucauggggagauguuccauauuuaggaaagcgcgaagaccagugguguggaucauuaauuggucuuaccgccagggcgacaugggcaaccaauauacaaguagcuaucaaccaaguuagacgacuuauugggaaugaaaauuaucuagacuauaugaccucaaugaaacguuucaaaaacgagucugaucccgaaggcgcucuaugguag

SEQ ID NO: 21535 - RNA, 9879 nt, Artificial Sequence
  derived and/or modified CDS sequence (opt6) from DENV-1__FJ410199__SS-prME
ucgguuacaaugcuguuaauguuaaugccuacggcccuagcuuuucaucuuacuacacgcgguggugaaccucauaugaucgugucaaaacaagaacgagguaagagcuugcuuuuuaagacuucagcuggaguuaauaugugcacccuaauagccauggaucuaggcgaauuuugcgaagauacgaugaccuauaaauguccgcgaauuacggaagcagaaccagaugacguggacugcugguguaacgcuacagacacaugggugacauaugguacuuguucacaaacaggggaacaucgaagagauaaacguagcguagcucuugcuccacacguuggacuaggcuuggaaacuagaacugaaaccuggaugucuagcgaaggugcuuggaaacaaauacaaagaguggaaacaugggcauuaaggcauccaggguuuacuguaauagcacucuuucuagcacaugcuauaggaacuuccaucacacaaaaaggaaucauauuuaucuuauuaaugcuuguaacuccaagcauggcuaugagaugcguugguauaggauccagggacuuuguagaagguuuaucaggcgcgacauggguagaugugguacuagaacacggaagcuguguuacgacaauggcgaaggauaagccaacgcuagacauugaauuacuaaagacagaaguuaccaauccggcaguacuaagaaaacucugcauagaagccaaaauaaguaacacaacgacugauaguagaugcccuacucaaggagaagcuacccuaguagaagaacaagaugcuaauuucguaugcaggcgaacauuuguagauagaggaugggggaacggguguggucuauucggaaaagggucacuaaucacaugugcaaaguuuaaguguguuaccaagcuagaagggaaaacuguucaauaugaaaauuugaaguauucaguaaucguaaccgugcacaccggagaccaacaucaaguaggaaacgaaucaacugagcauggaacaacagcaacaauaacuccacaggcaccaucgacagagauucagcuaacugauuauggagcucuuacauuggacuguaguccaaggacaggacuagauuuuaaugaaaugguacuacuuacaaugaaagagaaauccugguuaguacauaaacagugguuucuggauuuaccacucccauggacaucuggggcuucgacaucacaagaaaccuggaauagaaaagaucuauuagugacuuuuaaaaccgcacacgcuaagaaacaggagguagucguacuagguucucaagaaggagcaaugcacacagcauuaacaggcgcgacagaaauucagacaagcgguacuacaacaauauuugccggacauuuaaaauguagauuaaaaauggacaagcugacacugaaaggaaugucuuaugucauguguacagguuccuuuaaacuagagaaagaaguagcagagacucaacacggcacagugcuuguacaaauaaaauacgagggaacggaugcgcccuguaaaauaccuuuuagcacacaagaugaaaaaggaguaacacaaaauggccgucuaaucacagccaaucccauuguaacggacaaagaaaaaccgguaaacauagaagccgagcccccguuuggagaaucuuacauaguuauuggagcaggcgaaaaggcuuuaaaacuaucuugguucaaaaagggaagcucuauaggaaagauguuugaagcuacugcuagaggggcucgaagaauggcgauccuaggagacacagccugggauuucgguucgauuggaggugucuuuaccucgguuggcaaacucgugcaccagauauuuggaacggcguacgggguccuauucucagguguaucuuggacaaugaaaauugguaucgguguauuacuuacaugguuaggacuaaauucacguucuacaucacuuagcaugaccugcauagcgguggguuuaguaacacuuuacuuaggggucaugguacaagcagauucaggauguguaauuaacuggaaagggagggaacucaaaugugggaguggaauauucguaacuaacgagguccacacguggacagaacaguacaaguuccaggcugauagccccaaaagacuaucggcugccauuggaaaggcgugggaagaaggcgugugugggauaagaucugcuacaagacuugaaaacauaauguggaagcagauuagcaacgaguugaaucauauauuacuggaaaacgauaugaaauucaccgugguaguaggcgacgucgcaggcauauuggcccaaggcaagaaaaugauaaggccacaaccgauggaauauaaauauuccuggaaaucuugggguaaagcaaaaaucauaggggcagacguacaaaacacuacauuuauaauagacggcccgaauaccccggaauguccagacgaccagcgcgcauggaauauuugggaaguagaggacuacggauuuggcaucuuuacuacaaacauauggcuuaaauugagagacucauacacccaaguaugugaccauagacucaugucggcagcgauuaaagauucuaaggcaguccaugcggauaugggauauuggaucgaaagugagaaaaacgaaacauggaaacuggcccgagcauccuuuauugaagugaagacuuguauuuggccgaagucucacacacuuuggagcaauggagugcuagaaucggagaugauaauacccaaaaauuacggagggccaaucagccaacacaauuacagaccaggauacuucacucaaacagcuggaccauggcacuuagguaaguuggaacuugacuuugauuuaugugagggaacgacgguggucguugacgaacacuguggcaaccguggaccuagccuuagaacaacuacaguuacgggaaagauaauccacgagugguguugccggucaugcacgcucccgccguugagauuuaaaggagaagaugggugcugguacggaauggaaauucguccaguaaaagaaaaagaagaaaauuuaguaaaaucaauggucucugcaggcucuggugaaguggauuccuuuagccugggauugcuaugcauaagcaucaugauagaagagguuaugagaucgcgauggaguagaaaaauguuaaugacggguacgcuagcagugcuuuuucuauuaaucaugggccaacuuacauggagugaucuaauaagacucugcauaaugguaggagcuaacgcgagugaucggaugggaauggguaccacuuaucuugcauugauggcaacauuuaagaugagacccauguucgcgguuggacuuuuauucagacgacucacaucccgugaaguauuauuacuaacaauuggauuaucacuuguagcuaguguugaacugccgaacucauuagaagaacuaggugauggcuuagcaaugggaauaaugauacuaaaauuauuaacugacuuucaaucacaccaacugugggcaacucuucuaucacucacuuucauuaaaaccacuuuuagcuuacacuaugccuggaaaacuauggccaugguauuaaguauagucagccuauuuccauuaugucuauccacuacaagccagaaaacaaccugguuaccaguacuacuugguuccuuaggcuguaaaccacuuaccauguuucuaaucgcagaaaauaaaauauggggucggaaaucguggccguuaaaugaaggaauaauggcagucggaauaguaucaauccuuuugaguucguugcuuaaaaaugacgugccccuagcaggaccucucauugcgggagguaugcugauagcuuguuauguaaucaguggaucaagugcggaucuaaguuuagaaaaagcugccgagguaaguugggaggaggaagcagaacauucaggugcaagccauaacauccuuguagaaguacaagacgauggaacgaugaaaaucaaagacgaagaacgugacgauacccuaacaauucuucuaaaggcuacacuacuugcaguuuccgggguauauccgcuuagcauaccggcuacauuauucguuugguacuuuuggcaaaagaagaaacagcgaucaggaguauuaugggauacaccgagcccaccagaaguagaaagagcugugcuagacgauggaauauaccgaauuaugcaaaggggccugcucggaagaucacaagugggcgugggugucuuucaagagaaugucuuucauacaauguggcauguaacaagaggcgcagugcuaauguaucagggaaaaagauuagaaccaaguugggcaucagucaagaaagaucuaauuucauacgguggaggcuggagauuacagggaucauggaauacuggagaggagguacagguaauugcuguagagccaggaaagaaccccaaaaauguacaaacggcgcccggcacauuuaagacgucagaaggggaaguaggagccauagcacuggacuuuaaaccgggaacaucggguaguccuauaguaaaucgcgaaggcaaaauagucggucuauacggcaauggagucgugaccacaucgggaacauauguguccgcaauugcucaggccaaagccucccaagagggaccuuuaccggaaaucgaagaugaaguguuccgaaagagaaacuuaacaaucauggacuuacacccagguagugguaagacuaggaaguaucuaccagcaauuguuagagaggcuaucaaacggaaacucagaacccucauccuugcaccaacucgugucgucgcaucggagauggcagaggcuuugaaaggaaugccgauaagauaucaaacgacugcgguuaaaagugaacauacuggaaaggaaauuguagacuuaaugugccacgcaacauuuacuaugagauugcuuucgccugugagagucccgaauuauaauaugauaauaauggacgaagcacauuuuacugacccuucuagcauagccgcuagggguuacauaaguaccaggguggggaugggggaagcagcagcaauauuuaugacugcaacgcccccuggaucgguggaggcauuuccccaaaguaaugcuguaauucaagaugaggaaagggauauucccgaaaggaguuggaauaguggcuaugaguggaucacugauuuuccaggaaaaacugugugguucguaccaucaauuaaaucggguaacgacauagcuaauugcuuacgaaagaaugggaaaagggucauucaguugucaagaaaaacauuugauacugaauaucagaagacuaaaaacaaugauugggacuaugucguuacgacagauauaucggaaaugggcgcaaacuucagggcagaucgaguaauagauccacgaagaugcuuaaaaccagucauucucaaggauggcccggagcgcguuauuuuagcugggccuaugccaguaacgguagcaucagcagcucagagacgaggaagaaucggcagaaaccacaacaaagaaggagaccaauacauauacauggggcaaccacugaauaacgacgaagaucaugcccacuggacagaagcgaaaaugcuauuagauaauauaaacacaccagaaggaauaauaccggcccuauucgaaccagaaagggagaagucagcugcgauagauggcgaauaccgauugagaggagaagcucgcaaaacauuugucgaacugaugcgaaggggugaccuaccaguguggcuaucguacaaaguugccagugaagguuuucaauacagugauagaagaugguguuuugacggggaacggaacaaccaaguacuggaggaaaauauggauguugaaauauggaccaaagaaggagaacgaaagaaauuaagaccacguuggcuugacgcacgaacguacucagauccuuuggcauuaagagaauuuaaagaguucgccgcuggaaggcgaucugugucuggugauuuaauacuagagauugguaaauuaccacaacaucuaacacaacgugcucaaaacgcacuggacaaucuggucaugcuccauaacucugaacaaggugggagagccuauagacaugcuauggaggaacuacccgauacuauugaaacuuuaaugcuucuugcauugauagcaguauuaacugguggagucacauuguucuuucuaucuggccgaggccuuggcaaaaccaguaucggauuacuuugcgucauggcgucauccguacugcuuuggauggcuucagucgaaccucacuggauugcugcuuccauaauuuuagaauuuuuccuaaugguacuccucauuccugaacccgacagacaacggacuccacaagauaaccaguuagcauacguaguuauuggacuguuauuuaugauuuuaacuguagcagcgaaugaaaugggauuacuugaaacaaccaagaaagacuuagggauuggucauguagcuguugaaaaucaccaucaugcagcuauguuagauguugaccuccauccggcuucugcauggacacuauaugcaguggcuacaacgauaauuacgccaaugaugagacauacaauugaaaauacaacggccaauauaagccuuacagccauagcuaaucaagccgcuauauuaaugggucuugacaaagguuggccaauaaguaagauggauauuggaguaccgcuacucgcgcugggcuguuacagucagguaaacccacuaacuuuaacagcagcaguacuaaugcuaguagcccacuaugccauaauuggaccgggauugcaagcaaaagcaacgagagaggcucagaaaaggacugcagcaggaaucaugaaaaauccaacuguagaugggauuguagcgauagaucuagaccccguaguuuaugaugcaaaauuugagaaacaacuaggccaaaucaugcuuuuaauuuuguguacaucacaaauauuacuuaugaggacgacaugggcacucugugaauccauaacacuggcaaccgguccauuaaccacauuaugggaagguucccccgggaaauuuuggaacacaacaauugcaguaagcauggcuaauauauuuagaggaucauaucuugccggugccggguuagcauuuucauuaaugaagucuuuagguggcggaaggaggggaacaggcgcgcaaggugaaacucucggugaaaaguggaaacgacaauuaaaucaauuaagcaaaucugaauuuaacacuuauaaaagaaguggaaucauggagguagaucgaagcgaagcgaaagagggguuaaagcgcggcgaaacaaccaagcacgcaguaaguagaggaacagcaaaauuacgaugguucguugagcgaaaucugguaaagccagaaggaaaaguaauagaucuaggaugcggccguggcggcuggagcuauuauugugcaggacugaaaaagguaacugaaguaaaggguuauacgaaagggggaccgggacacgaggaaccaauuccuauggcaacuuauggcuggaacuuaguaaaauuacacucagguaaagacguauucuuuauaccuccugaaaaaugcgacacuuugcuaugugauauuggagagaguagucccaacccaacaauagaggaagggaggacccugagagucuuaaagaugguugaaccuuggcuacggggcaaccaguuuugcaucaaaauucuaaacccauauaugccaucuguuguggagacauuggaacaaaugcagagaaaacacgggggaaugcugguaagaaacccacuaucaagaaacagcacacacgaaauguauuggguaucauguggaacagguaauaucgucagugcaguaaacaugacaucgcguaugcuauuaaaucgauuuacgauggcgcacagaaaaccgacauacgaacgagacguggaccuuggugccgguacacgacacgucgccguggagccugaagucgcaaauuuagauauaauugggcagcgcauugaaaauauuaaacaugaacacaaaaguaccuggcacuaugacgaagacaacccguacaaaacgugggcauaucaugguucuuacgagguaaaaccaagugguucugcaagcaguauggucaacggaguugugaagcuccuuacaaagccaugggaugucauacccauggugacucaaaucgcaaugacagacaccacaccguucggucaacaaaggguauuuaaagagaaaguugacacacgaacaccuaaagcgaagagagguaccgcccaaauuauggagguuacggccaaguggcuauggggcuucuuaucccggaacaagaaaccaaggauuugcacacgggaagaauuuacucgcaaaguacgaaguaaugcagcuaucggagccguuuuuguggacgaaaaucaguggaacagugcaaaagaggcuguagaggaugaacguuucugggacuuaguccaucgggagagagaauuacacaaacagggcaagugugcuacuuguguguauaacaugaugggcaaaagggagaagaaacuuggagaauuugggaaagcuaaaggaucaagagcaauaugguauauguggcucggcgcacgauucuuggaguuugaggcacugggauuuaugaacgaagaucauugguuuagucgcgaaaauucacuauccggcguggaaggagaaggguuacacaaauuaggcuacauccuaagagacauuuccaaaauuccaggagggaauauguaugcagaugacaccgcaggaugggacacaagaauaacggaagaugaccuucagaacgaggcaaagauuacagauauaauggaaccugaacaugcguuauuagcaaagucaaucuucaaacuuaccuaucaaaauaaaguagucagaguucagaggccagccaaaaacggaaccguuauggauguaaucucaagacgcgaucaaagaggaaguggacaaguugggacuuacggccuuaacacguucacgaauauggaagcucaguugauuagacaaauggaguccgaaggaaucuuuaguccuagcgagcuagagacacccaaucuagcggguagaguacucgauuggcuagaaaaacacggcguggaacgacuaaaaagaauggcaauauccggcgacgacugcgucguaaaacccaucgacgaucgguucgcuacugcacuaaccgcacuaaaugauauggguaaaguaagaaaagacauaccucaaugggaaccaaguaagggguggaacgauuggcagcaaguuccuuuuugcagucaucauuuccaucaguuaaucaugaaagacgggcgugaaauuguaguuccuugcagaaaccaagaugaauuagugggcagagcucgagugucacaaggggcaggcuggucauuaagggaaaccgcgugccuuggaaaaagcuaugcgcaaauguggcagcuaauguauuuccaucgucgggauuugagacuugcugccaacgcuauauguagcgcuguaccaguggacugggugccaaccucgcgaacuacguggaguauucaugcacaucaccaauggaugaccaccgaagauaugcuaucagucuggaaccggguauggaucgaagaaaacccauggauggaggauaaaacacacaucuccagcuggggugauguaccauaccugggcaaaagagaagaucaauggugugggagucugauuggccuaacugcuagagcaacgugggcgacuaauauccaaguugcaauuaaucaaguaagaagacuuauagguaacgaaaacuaccuugacuauaugacauccaugaaacguuuuaaaaacgaaagcgauccagaaggugcucuuugguaa

SEQ ID NO: 21536 - RNA, 9879 nt, Artificial Sequence
  derived and/or modified CDS sequence (opt6) from DENV-1__FJ432739__SS-prME
uccguuacuaugcuguuaaugcuuaugccaacagcacuggcauuucaccuuacaacacgaggcggagaaccgcauaugauagugucaaaacaagaaagagggaagucauuguuauuuaaaacaagcgcagggguuaauaugugcacgcuaauagccauggaccuaggcgaauuuugcgaagauacaaugacguacaaaugcccacgaauuacagaagcggagccggaugaugucgacuguugguguaaugcaacugacacuuggguaacuuacggaacuuguucacaaacuggagaacaucgacgagauaaaagaagcgucgccuuagccccgcacgucggccuaggacuggaaacccguaccgagacauggaugucaagugagggagcuuggaaacaaauucaacgugucgaaaccugggcacuccgucauccaggauucacaguuaucgcguuguuuuuagcgcaugcaauagggacaagcaucacccagaaagguauaauauuuauacuguugauguuaguuacuccaucaauggcgaugagguguguaggaauuggcagcagagauuucguagaaggguuaaguggugcaacguggguugauguaguacuagaacacggaagcugugucacuacaauggccaaagacaaaccaaccuuagacauugaauuacugaaaaccgaaguaacaaacccagcaguauuacguaaauuauguauagaagccaagauuaguaacacaacaacggacagcagauguccaacacaaggagaagcuaccuugguggaagaacaagaugccaacuuuguauguaggagaacuuuuguagaucgaggaugggguaacggaugugguuuauuuggcaaaggaucccuaauaacaugugcaaaauuuaagugcgugacgaaauuggagggcaaaacaguacaauaugagaauuuaaaauacucaguaauugugacuguacauacgggagaucaacaucaaguggguaaugaaucaaccgaacacgguacgacagcgacgauuaccccucaggccccuuccacagaaauacaacuuacagacuacggggcauuaacuuuagauugcucgccaaggacaggauuagauuucaacgagaugguucuacuaacgaugaaagaaaaggcuugguuaguacauaaacagugguuucuugaucugccucuuccuuggacaaguggagcaagcaccagucaagaaacauggaacagaaaagaucuauugguaacauuuaaaacugcacaugcgaagaaacaagaagucguaguacuuggcucacaggaaggugcgaugcacacggcccuaacaggcgcuacagaaauacagacuuccggaacuacuaccauauuugcaggucaccucaaaugucgucuaaaaauggacaaauugacguuaaaggguaugucauaugugauguguacagguaguuuuaaacuagagaaagaaguggcggagacacagcaugguacaguccuaguucaaaucaaauaugaagggacugacgcaccguguaaaaucccuuuuaguacacaagaugaaaaagggguaacacaaaauggaagacuaauaacagcaaaccccauugugacggacaaagaaaaacccguuaacauugaggcagaaccaccauucggggaaagcuauaucgucauaggggcaggagaaaaggcauuaaaauuaaguugguucaagaaagguuccucaauuggaaaaauguucgaagcuacggcaagaggugccagaaggauggcaauauuaggagacacugcgugggacuucggcagcauugggggaguauuuacaaguguaggcaagcugguccaccaaaucuuuggaacagccuauggagucuuguuuucagguguaucauggacuaugaagaucgguauaggaguuuugcucacuuggcugggacuaaauucaagaagcacuucucuaucaaugacuugcauagccgugggucuuguaacacuauaucuaggcguaaugguacaagcagauuccgguugcgucaucaauuggaaaggaagggaacuaaaaugcggaagugguauuuuugugaccaaugaaguacauacauggacagaacaauacaaauuucaagccgauagcccuaaacgacuaagugcugcaauagguaaggcaugggaagaaggugucuguggaauuagaucugcgacaagauuagaaaacauaauguggaaacaaauaagcaaugaauuaaaucauauucuauuggaaaacgauaugaaauucacgguaguggucggugacguggcagggauauuggcucaagggaagaaaaugauucgaccacaaccgauggaauauaaauauagcuggaaaaguugggggaaagcuaaaauuauaggagccgaugugcaaaaugcuacguucaucauagauggaccaaauacaccagaaugcccagacgaucaaagagcuuggaacaucugggaaguagaggacuacggauuuggaauauucacuacaaauauuuggcuuaaacuucgagauucuuauacucagguaugcgaucaccgauuaaugucugcagccauuaaagauucuaaagccguucaugcagacaugggcuauuggauugaaucugagaaaaaugaaacguggaaacuugcuagagccucauuuaucgaaguuaaaacuugcaucuggccaaaaucgcacacguuauggaguaacggaguccuagaaucugaaaugauuaucccuaaaauauaugguggaccaauaagccagcacaauuaccgaccugguuauuucacacaaaccgcugguccauggcaucucggcaaguuagaacuagacuuugacuuaugcgagggaacaacaguaguaguagacgaacacuguggaaacagagguccgucauuaagaacuacaacuguaaccggcaaaauaauccacgaaugguguuguagaucauguacgcucccaccguuaagauuuaaaggagaagaugggugcugguacgguauggagauuagaccagucaaagagaaggaagaaaacuuaguuaaaucaaugguuucggcgggguccggagaaguugauucuuuuucauuaggauuauugugcauaucaaucaugauugaggagguuaugcgaaguagguggagcaggaaaaugcuaaugaccggaauccuugcagucuuuuuccuacuaauuaugggucaacuuacuuggaaugacuugauacgccuauguauaauggugggugcaaaugcuucagacagaaugggcauggguacuaccuaccuugcucuaauggccaccuucaaaaugcguccuauguucgcuguaggacuuuuguuccgaagguuaacgaguagagagguucuacuuuuaacuauuggacucagucuuguugccucgguugaguugccaaacucauuggaagaauuaggugauggcuuggccauggguauaaugauacuaaaguuacuuacagauuuucagucucaccagcuaugggcuacauugcuuagucugacguuuaucaaaacaacauuuagucugcauuacgcguggaaaacuauggcgaugguauugucaauagugagcuuguuuccacugugccuuucgacuacgagucagaaaacaacauggcuccccgugcuuuuagguagccuggguuguaaaccacugacuauguuuuuaauugcagaaaauaaaauauggggaagaaagucauggccuuuaaaugaaggaauuauggcgguaggaaucguaucuauacuacucuccucccuacucaaaaaugaugugccuuuggcaggaccacuaaucgcaggaggcauguuaauagcauguuauguaauaagcggguccagcgcugauuuaucacuugagaaagcggcagaaguaucuugggaagaagaagcggagcacucaggugcuagucauaauauccuuguggaaguccaagacgacgggacgaugaaaauaaaagaugaggaacgagaugauacccuuacuauacuauugaaagcuacguuacuagcagucucuggaguuuacccauuaagcaucccugcaacacucuucguaugguauuuuuggcagaaaaagaaacaaagaucaggcguguugugggauaccccuucacccccggaagucgaaagagcaguacuggaugacggaauuuauaggauuaugcagagagggcuccuaggucgcucacagguagguguugguguuuuucaagagaacgucuuucauacuauguggcauguuaccaggggugcuguguugauguaucaaggaaaaagauuagaaccaucuugggccucagugaagaaggaccuuauuaguuauggaggcgguuggagauugcagggcaguuggaauacuggagaagaaguccaaguaauagcaguggaacccgggaagaaucccaaaaauguucaaacugcuccagguaccuuuaaaacuagcgaaggugaaguaggggccauugccuuagauuuuaaaccagguacuucuggcucuccuauaguuaaucgagaagggaaaauugucggauuguacgggaaugguguugucacaacaucagguacauaugucagcgcgaucgcucaagcuaaagccucccaggaagguccacucccagaaauagaagacgaagucuuuagaaaaagaaaucuaacuauaauggacuuacauccaggaucaggaaagacaaggagauaucucccagcuauagugcgcgaagccauuaagcgaaaacucagaacguugauccucgcacccacacgaguggucgccucugaaauggcugaagcauugaaggggaugccaauacgguaucagacuacggcaguuaaaucggaacauacuggaaaagagauuguagaccuaaugugccaugcaacauucaccaugcgccuauuaaguccgguaagaguaccaaauuacaauaugauaaucauggacgaagcacacuucacggauccaucaaguaucgccgcaagaggguacaucucuacuagaguugguaugggggaagcagcugcaauuuucaugacugcuaccccaccgggcucgguugaagccuuuccacagucaaaugcaguaauacaggacgaagaacgugacauucccgaaagaucguggaauagcggauaugaauggauaacugacuucccuggcaaaacuguaugguuuguuccuucgaucaaaucaggcaaugacauugcuaauugcuuacgcaagaaugggaaaaggguaauccaacucagccgaaaaacuuuugauacagaauaccagaaaaccaaaaacaacgauugggauuacgugguaacuacugauauaucggaaaugggagcaaacuucagagcggaucgaguuauagacccccgccgaugccuuaaaccgguaauauuaaaagacggaccugaacgaguuaucuuggcaggaccgaugcccgucaccguugccucugcugcucaaagacgaggaagaauuggaaggaaccacaacaaagaaggagaucaauauauuuauaugggacaaccucucaacaaugacgaagaccaugcucauuggacagaggcaaaaaugcuacuagacaauauaaacacuccugaaggaauuauuccagcguuguucgaaccugagagggagaaaagugccgccauagauggugaguaccguuuaagaggagaagcgagaaagacuuuugucgaguugaugcgaagaggugaucuuccaguauggcuaagcuauaaaguggccucggaaggauuucaauacucugauagacgcugguguuuugacggagaacgcaauaaccaaguuuuagaagaaaauauggacguagaaauuuggacgaaagagggagagaggaagaaacuccggccacguuggcuagaugcaagaacuuacucagauccauuagcacuaagggaauuuaaagaauuugccgcgggacgaaggucugucuccggggauuuaauacuagaaauaggcaagcuaccucaacaucuuacgcagagggcgcagaacgcacuugauaacuuagugaugcuccacaacagugaacaaggcggacgugcguaucgacacgcaauggaggaacuaccugacaccauugagacacuaauguuauuagcccuuauugcugugcuaacaggcgggguuacauuauucuuucuaucuggacgaggauugggaaaaacgucgauaggucuacuaugugugauggcuagcagcguucuacuuuggauggcaaguguugaaccacacuggaucgcagcuaguaucauccuagaguucuuucucaugguucucuuaaucccugaaccugaucgccagcguacaccgcaggauaaucaauuagcauauguuguaauaggacuccuauuuaugauauuaaccguagcagcaaaugagaugggccuauuagagacgacuaagaaagauuuagggauaggucacguugccguagagaaccaccaucaugccgcuaugcuagauguugaucuucacccagccucggcguggacgcuuuaugcuguggcuacgacaauaauaacuccaaugaugagacacacaauagaaaacacaaccgcaaauauuucacuuacagcuauugcaaaccaagcagcuauauuaauggguuuggauaaaggauggccuauuaguaaaauggauauaggaguuccguuacuugccuuggguuguuauucacagguuaauccgcugacgcuaacagcggcaguccucauguuaguggcacacuacgccauaauugguccuggacuacaagcuaaagcaacgcgagaagcccagaaacgcacggcagcaggaauaaugaaaaacccuacgguugaugguauuguagcaauagauuuagacccugucguuuacgauacgaaauucgaaaaacaacuagggcaaaucauguuacuaauauuauguacuagccaaauccucuugaugcgaacgacgugggcauuaugugaaucuauaacacuugccacugguccauugacaacauuaugggaggguucuccuggaaaauuuuggaacacuacuauugccgugucgauggccaauauuuuucgaggaucauaucuagcuggugccggguuagccuucucauuaaugaaaucauuagggggcggaagaaggggcacgggggcacagggagagacguuaggagaaaaguggaaacgccagcuaaaccaauuaagcaagucggaguuuaacaccuauaaacgaucgggaauaauggaaguagauagaagcgaagccaaagaagggcuaaaaaggggugaaacgacaaagcaugcugucucccgaggaacggcaaaauuacggugguucguggagcggaauuugguaaaaccugagggaaaagugaucgaccuaggguguggacgcggaggcuggucuuauuauugugcaggacucaagaaaguuacugaaguaaaaggguauacgaaaggagguccuggacaugaagaaccaauuccaauggcaacuuaugguuggaaucucguuaaauuacauuccggaaaagacgucuuuuucauuccgccagagaaaugugauacacuuuuaugcgauauaggcgaauccagcccgaacccaacgauagaagaagguagaacacuucgcguuuugaaaaugguggaacccuggcucagaggaaaucaauuuuguauaaaaauacuaaauccuuauaugccaaguguagucgaaaccuuggagcagaugcaaagaaaacauggaggaaugcucguucgaaacccgcuuaguagaaacucaacacaugaaauguacuggguaaguugcgguacaggaaacaucguaagcgcugugaacaugaccaguagaaugcuucugaaucgauucaccauggcccauagaaagcccacauaugaaagggauguugacuuaggggccggcacccgacauguggccguugagccagagguugcgaaucuugacauuauaggacagcguauugaaaacauaaagcaugaacacaaauccacuuggcauuaugacgaggauaacccauauaagacuugggccuaucacggaucguacgaaguaaaaccuucggggucagcgagcagcaugguaaaugguguaguuaaauuauugacaaaacccugggauguaauaccaaugguaacacaaauagcuaugacagacaccacaccauuuggucagcagcguguauuuaaagaaaaaguagauacgagaacuccgaaagccaaacgaggcacagcacagauuauggaaguuacugcaaaauggcuauggggauuccuuucaagaaauaaaaagcccagaauuuguacacgagaagaguuuaccagaaaagucaggucuaaugcagccauuggcgcaguauuuguagacgaaaaucaguggaacagcgcuaaagaagcuguggaggacgaaagauucugggaucuuguacaucgcgaaagagaacuucauaaacaagguaaaugugcgacuugcguauauaacaugaugggaaaacgugagaaaaagcuaggcgaguucggcaaagcaaaaggauccagagcuaucugguacauguggcuaggagcaagauuuuuagaguuugaagcauuaggauucaugaaugaggaucacugguucucaagagaaaauucguugagcggugucgaaggagaaggacuacauaaguuagguuauauacuaagagauauauccaagauaccaggugggaauauguaugcggacgauacggcugguugggauacaaggaucacagaagaugauuuacaaaacgaagcuaaaauuaccgauauaauggaaccugaacacgcacuuuuagcgaaaucaauauuuaaacugacuuaucaaaacaaaguuguaagaguacaaagacccgccaaaaauggaacaguuauggacgucaucagucgccgagaucaacgaggcaguggacaggugggcacauauggacugaacacuuuuacuaauauggaagcccagcuuauacgccaaauggaaagugaagggauuuucucuccgucggagcuugagaccccaaaucuagcuggaagaguucuagauugguuggaaaaacauggaguagaacgauugaaacgcauggccauauccggggacgauuguguuguaaaaccaauagacgaccguuuugcgacagcucucacagcacuuaacgauaugggcaaaguacgaaaagacaucccccaaugggaaccaucuaagggauggaacgacuggcaacaaguaccauuuuguagucaucacuuccaccaauugauaaugaaggauggacgagaaauuguagucccuuguagaaaucaagacgaacuuguagguagggcacgaguuagucaaggagcuggauggagcuuaagagagaccgcguguuuaggaaaaucguaugcgcaaauguggcaauugauguauuuucaccgaagagauuugagauuagcagccaaugccauuuguucggcaguaccgguugauugggucccuacaagucgaacaaccuggaguauucacgcucaucaucaauggaugacuaccgaagacaugcuuucgguuuggaauagaguguggauagaggagaaucccuggauggaagacaaaacacacauaucgucauggggagacgugccuuaucugggcaaacgugaagaccaaugguguggaucacucauuggacugacagcgagagcaacaugggcaacaaacauccagguagcaauaaaucagguuaggcguuuaauuggaaacgaaaacuaccucgacuacaugaccagcaugaaaagauuuaagaaugaaauagauccugaaggcgccuuaugguag

SEQ ID NO: 21537 - RNA, 9879 nt, Artificial Sequence
  derived and/or modified CDS sequence (opt6) from DENV-1__FJ410201__SS-prME
ucggugacuaugcuucuaaugcugaugcccacagcccuagcguuccaccuaacuacacgcgguggagaaccccacaugauaguaucuaaacaagagcgaggaaaaagccuucuauuuaagaccucagccggaguuaacaugugcacucucauagcuauggaccuaggagagcugugcgaggacaccaugacauacaaaugcccuagaauuacggaagcugaaccagacgacgucgacugcuggugcaaugcaaccgauacuuggguuacauaugggacgugcagucaaaccggugagcaccgaagagauaagcggucagucgcuuuagcaccccauguuggguuaggacuugaaacaagaacugaaacguggaugucaucugaaggagccuggaagcaaauccaacguguugagacaugggccuuaaggcauccaggguuuacugucauagcgcuauuuuuagcucacgcuauuggaaccucaaucacacaaaaaggaauaauuuucauauuacugauguuaguuacaccaaguauggcuaugcgcugcguaggaauuggaagcagagauuuuguagaaggauuauccggcgcuacauggguagaugucguauuagaacacggcucuugcgucaccacuauggccaaggauaaaccaacucuugauauugaacuucuaaagacagaagucacgaacccugcugugcucagaaaguuauguauugaagcuaaaauaucaaacacgacuacggauagccgaugccccacacaaggagaggcgacguuaguagaggaacaagacgcaaauuuugucugucgaaggacauuuguugauaggggauggggaaauggauguggcuuauuuggcaagggaucgcuaauaaccugugcaaaguucaaauguguaacaaagcuagaggguaaaauaguucaauaugaaaaccuaaaguauuccgucauugucacaguacacacaggagaucaacaccaaguagguaacgaaagcaccgagcaugggaccacugcgacaauaacaccacaagcuccaacaacagagauacaacugacagacuacggugcacuaacccuggauuguaguccuaggacugguuuagauuuuaacgaaaugguguuauuaacaaugaaagaaaaaucaugguugguacauaaacaaugguuuuuagauuugcccuuaccuuggacaaguggggcaagcaccucccaagagacauggaauagacaagacuugcuagucaccuuuaaaacagcucaugccaagaaacaagaaguaguuguacuagguucccaagagggggccaugcacaccgcccucacaggagcuacggagauccaaacgaguggaacaacgacuauauuugcugggcacuuaaaaugcagauugaaaauggauaaauuaacacugaaaggcauguccuacgugaugugcacuggaucuuucaagcuagaaaaagaaguagcagaaacccaacauggaacaguacucguacaaaucaaguaugaaggcacggaugcuccuugcaaaauaccauucucuacacaagacgaaaaaggcguuacccaaaauggcagacuuauaaccgcaaauccaauagugacugauaaagaaaagccagugaauauagaggccgaaccucccuucggugagagcuacauagugaucggcgcuggugaaaaagcacuaaaacuuucuugguuuaagaaaggaaguagcauaggcaagauguucgaagccacagcaagaggagcacgccguauggcaauccuaggggauacggcaugggauuuuggaagcauaggaggagucuucacgaguguggguaaauuagugcaucaaauauucggaacugcuuacgggguucuguucucagguguuaguuggacaaugaaaauuggaauaggagugcucuuaacgugguugggccuuaauucaagaaguacaagucugucaaugaccugcauagcuguuggccuaguuacccucuacuugggaguuaugguccaagcggacucaggauguguaaucaauuggaagggacgcgaacuaaaauguggguccggcauauuuguuaccaaugaaguccacacauggacagaacaauacaaguuucaggcggacaguccaaaaagauugagcgccgccauagggaaggcaugggaagaagguguuuguggcaucagaucugcgacaagauuagagaauauaauguggaaacaaauuaguaaugagcuuaaucacauauuauuggaaaaugacaugaaguugaccguuguaguaggagauguggcaggaauacuugggcaagggaagaaaaugauacgaccacaaccgauggaauauaaauauaguuggaaaucgugggguaaagcaaaaaucauaggagcugaugcucagaacacaacuuucauaauagaugggcccaauacccccgagugcccugacgaccaaagagccuggaacauuugggaaguagaagauuauggauuuggaauuuuuacuacaaacauauggcuuaagcuacgcgauagcuacacccaaguaugcgaucacagacugauguccgcagcaauuaaagauucaaaagcggugcaugcagauaugggauacuggauugaaucugagaagaacgaaacuuggaaauuagcaagagccaguuucaucgaagucaagacuuguauauggccuaaaagccauacucuuuggucaaauggggucuuagaaucugagaugauaauuccaaaaauauacgguggaccaauaucgcagcacaacuauagaccaggauauuucacacaaacagcgggaccuuggcaucuagggaaauuagaauuagacuuugauuugugugagggaacaacagugguuguagaugaacacugcgguaacagagguccuagucuucgaacaaccacagucaccgggaaaauuauccacgaauggugcuguaggucuugcacgcugccaccgcuaagguuuagaggcgaagaugggugcugguacgguauggaaaucagaccuguuaaagagaaggaggaaaaccuaguuaagucaauggugagugcuggaucgggcgaaguagauucauuuagcuuagguuuacucuguauaaguauuaugauagaggaaguuaugagaucgcgauggucuaggaaaauguugaugacggggacauuagcuguauucuuucuuuuaauuaugggacaacuuacauggaacgaucuuauuagguuauguauuauggugggugcaaacgcuucagaucgaauggggauggggacaacuuaccuagcauuaauggcaacauuuaagaugagacccauguuugcaguaggucuuuuauuuagaagauugacgucgagagagguacuuuuacugacaauaggccucucucuaguagccagcguagaacuaccgaacaguuuagaggaacuuggagauggucuagcaaugggcaucaugauuuuaaaguugcuuacagacuuucaaagucaccaguugugggcaacguuauugucucuuaccuucauuaaaacaacauuuucucugcacuaugcuuggaaaacaauggccaugguguuaucaaucguauccuuauucccuuuaugucuuuccacuacaucucagaaaacaacuugguuaccgguauuauuaggaagucucggaugcaagccacuaacgauguuuuuaaucgcugagaacaaaauuuggggccgaaagucguggccccuaaacgaagguauaauggcaguagguaucgugucaauacucuuaucaucucuacugaaaaaugaugucccauuagcaggaccucuuauagcggguggaauguugauagcaugcuaugugauaagcggaucaagcgcugaucuaucauuggaaaaagccgcggaaguaucgugggaagaggaagcugaacauucaggagccagccauaauauuuuaguagagguucaagaugacggcacgaugaagauaaaagacgaggagagagaugacacgcuaacaauucuuuuaaaagcaacacuacuagcaguaucaggaguguacccuuuaaguauaccugccaccuuauucguuugguauuuuuggcagaaaaagaaacagcggagugggguacuuugggacacuccaagcccaccagaaguugagcgcgcaguuuuagacgacggaauuuaucgcauuaugcagagaggucuauuaggucgcucgcaaguaggugugggcguauuccaagaaaauguauuccacacaauguggcauguaacgcgaggggcaguguuaauguaucaggguaaaagacucgagcccaguugggcgucaguuaagaaagaccuaaucagcuacgguggugguuggagacuucgaggauccuggaauacaggagaggaaguucagguaaucgcuguugaaccuggcaagaacccuaaaaauguccaaacagcaccugggaccuucaaaacuccggaaggagaagugggugccauagcacuagauuucaaaccagguacaagugggucaccaauaguuaaccgagagggaaaaauugucgguuuauacgguaauggcguaguaacaacgagugggacauacguaagugcaauagcgcaagcuaaggcuucccaagaaggaccuuuacccgaaaucgaagacgaaguguuucgaaaacggaaccuaaccauaauggaucugcauccggguuccgguaagaccagaagauauuuaccggccaucguucgagaggcaauaaaacgaaaacuaagaacacucauauuagcacccacacgagucguagcaucagaaauggcagaagcauuaaaaggaaugccgauacgauaucaaacaacagcaguuaaaucagaacauacaggcaaggagauaguugauuuaaugugccacgcaacauucacaaugcgacugcuaucgccaguaagaguuccgaauuauaauaugauaaucauggaugaagcgcacuucacugaucccucaaguauagccgcuagggguuauaucaguacucguguaggaaugggagaagcagcugcaauuuucaugaccgcgacaccacccggaucaguggaagccuucccucaaucuaaugcgguaauacaggacgaagaaagagacauacccgaaaggucuuggaauaguggauacgaauggauaacggauuuuccaggcaaaacaguuugguucguuccaaguaucaaauccggcaaugacauugcgaauugccuacguaaaaaugggaaacguguaauacaauuaucaagaaagaccuuugacacugaauaucagaaaaccaaaaacaaugauugggacuacguuguaacuacugauauuagugaaaugggagcgaauuucagagcagaucgcguaauagaccccagaagguguuuaaagccgguaauacucaaagaugguccagagagaguuauacuagcuggaccuaugccuguaaccguagccucagcugcgcagcggagaggaagaauuggucggaaucauaauaaagagggagaucaauauauauacaugggucaaccuuuaaauaaugaugaagaucaugcacauuggacugaagcaaaaauguuacuggauaacaucaauacaccagagggaaucauuccagcauuguucgagcccgaaagagaaaagucagcagcaguagauggugaguaucguuuacgaggcgaagcaaggaaaaccuuuguagaauuaaugaggcgcggggacuuacccguuugguuaucauauaaaguagccagugaaggauuccaauauagugauaggagaugguguuuugacggagaaaggaacaaccaaguucuagaagaaaacauggauguggaaauuuggacuaaagagggcgaaaggaagaaacuaagaccacgaugguuggaugcgcgcacauauucagacccauuagcacuaagggaguuuaaagaauuugcagcagguagaaggucgguaagcggcgacuuaauauuagaaauagggaaauuaccucaacaucucacgcaaagggcgcaaaacgcucuagacaaucucguaaugcuacauaauagcgagcagggaggaagggcuuauagacaugcuauggaggaguuaccggacacaauugaaacauugauguuguuagcgcucauugcuguucucacaggcggugucacgcuauucuuccugaguggaagggguuugggaaaaacguccauuggccuccuauguguaauggcuucuuccguacuucuguggauggcguccguagaaccgcacuggauagcugccucaauuauccucgaguucuuucucauggugcugcuuauaccggaacccgaucgucaaagaaccccacaagacaaccaauuagcauauguagugauaggcuuacucuuuaugauacucacaguagcggccaaugaaaugggucuguuagaaacaacaaagaaagaucuaggaauuggucacguagcgguugaaaaucaccaucacgcugcgaugcuugauguagaccuacacccagcaucugcuuggacucuuuaugcggucgcgacaacuauuauaacaccaaugaugcgccacacaaucgaaaacacaacggcuaauauuagucuaaccgccaucgcaaaucaagcugcaauuuuaaugggguuagauaaaggcuggcccauaucaaaaauggauauaggaguuccgcuucuugccuuaggcuguuauagucaaguuaauccguuaacacuaacagcggcgguauuaauguuaguugcgcacuaugcaauaauuggcccagggcuacaagccaaagcaacaagggaagcacagaaaagaacagccgcugguaucaugaaaaaucccacuguugacggaaucgucgcaauugaccuagacccaguaguuuacgacgcuaaauuugagaaacaacuuggccaaauaaugcuauuaauucuauguacaucacagauauuauuaaugcgaacaaccugggcccuuugugaaaguauuacuuuagcuacgggaccacuaacgacauuaugggaaggauccccugguaaguuuuggaauaccacaauugccguuucgauggcaaacauauuucgagggucuuauuuagcuggagccggacucgcauuuagcuuaaugaaaucgcuuggcgguggacgccgaggcacuggcgcucagggagagacauuaggagaaaaguggaaacgacagcugaaccaauuaucaaaaucagaguuuaacacauacaaaagauccgguauaauggagguagauagaucagaagcuaaggaaggacucaaaagaggugaaacgacuaagcacgcaguuaguagggggacagcgaagcuaaggugguucguggagcggaaucucguuaaaccugagggaaaaguaauugaccuuggaugcggucguggaggguggucauacuauugugcaggguuaaagaaagugacggaggugaaagguuauacuaaaggggguccgggucacgaggagccgauaccuauggccacauauggauggaaccuggugaaacuccacaguggcaaagacguauucuuuauaccaccagaaaagugcgacacauuauugugugacauaggagaaucaucacccaacccaacaauagaagaaggacgaacgcucaggguacuuaaaaugguagaaccuugguuacgugggaaucaauucugcauaaagaucuuaaacccauauaugccuuccguuguugaaacuuuagaacaaaugcaacgaaagcauggugggauguuaguccguaauccauuaaguagaaauucuacacacgaaauguauuggguuucauguggaacgggaaacauuguuagcgcugucaauaugacaucucguaugcuacugaauagguuuacaauggcgcauagaaaaccuacguaugaacgagauguggauuugggaacagggaccagacauguugcuguugaaccagaaguggcuaacuuagauaucauaggccagcgcauugaaaacauaaaacacgagcauaaaucuacauggcacuaugacgaagauaauccguacaaaacaugggcauaucaugggucauacgagguuaagccgagcggaucagcaaguucuauggugaauggaguuguaaaauuacuaacgaaaccaugggauguaauaccuauggucacacagaucgcaaugacggauacgacaccauuuggucaacaacggguauucaaagaaaagguagauacacgaacgccuaaagcaaaacgagguaccgcccaaauuauggaggucacagcaagauggcuauggggauuucuaucgcguaauaagaaaccacguauuuguacaagagaagaauuuacaagaaagguacgcucuaacgcugcaauuggagcuguauuuguugaugaaaaucaauggaacucugcuaaggaggcgguggaagacgaacguuuuugggauuuaguccauagagagcgagagcuacacaagcaaggcaaaugugcaacauguguauauaauaugaugggaaaacgagaaaagaaguugggcgaauuugggaaagcgaaaggaucucgugcuaucugguacauguggcuaggugcaagguuccuagaauuugaagcucuagguuuuaugaaugaagaucauugguuuucacgugaaaacagucuuucugguguagaaggagaaggauugcauaaacugggauacauacuaagggacauaucgaaaauaccaggagggaacauguacgcagaugauacagcaggaugggacacgagaauuacagaagaugaccuacaaaaugaggcaaagauuacagacaucauggagccggaacaugcucuauuagcaaaggcaauauuuaaauugacguaccagaacaaaguagucagaguucaaaggcccgcaaagaacgguacagugauggauguuauaaguagacgagaccaacgaggauccggucaaguggguacauauggauuaaauacguucaccaacauggaagcccaauuaauaaggcagauggaaagcgaaggcaucuucaguccgucagaacuagagacuccaaaccuugcugaaagagcccuagacuggcuagagaaguauggaguugagagauugaagagaauggcuauuucuggagaugacuguguagucaagccuaucgaugacagauuugccacugcacuaacugcguuaaacgacaugggcaaagucaggaaagauauuccacaaugggaacccuccaaaggauggaacgauuggcaacaagucccauucuguagucaucacuuucaucagcuaauaaugaaggaugguagagaaaucguaguaccaugccguaaucaagaugaacuuguuggcagagcaagagugagucaaggugcuggauggagucuucgcgaaacagcguguuuggggaaaucguacgcacaaauguggcaacugauguauuuucacaggagagacuuaagacucgcugcgaacgccaucugcagugcgguaccuguagauuggguuccaacaucacggacuacuuggucaauacaugcacaucaucaauggaugacaacagaggauaugcuaucaguauggaauagaguauggaucgaagaaaacccguggauggaagacaaaacccacauuaguaguugggaggacguacccuaccucgguaaacgcgaggaucaguggugcggaucccuaauaggacuuacugccagagcaacaugggcgaccaacauacaaguugcaauuaaucaggugcgaagguugauaggcaaugaaaauuacuuaaauuauaugacuucuaugaagagauucaaaaacgaaucagauccugaaggugcacucugguga

SEQ ID NO: 21538 - RNA, 9879 nt, Artificial Sequence
  derived and/or modified CDS sequence (opt6) from DENV-1__FJ410203__SS-prME
uccguaacuaugcuauuaauguuaaugccaacggcacuagcuuuucaucuaacuacucguggaggugaaccacacaugauuguuaguaaacaagaacguggaaaaucacuacuauucaaaacauccgcaggaguuaauaugugcacauugauugcuauggacuuaggagaauuaugugaagauacaaugacuuacaaaugccccaggaucacggaagcagaaccagaugauguugacugcuggugcaaugcuacagacacuugggugacauacggaacauguagccaaacaggugagcaucggagggacaaacggagcgucgcacuggcaccacacgucggauuaggccuugagacaagaacggaaaccuggaugucauccgaaggagcuuggaaacaaauacagagggucgaaacaugggcgcuaagacaucccggauucacugucauugcuuuguuccuggcacaugcuauagguacaagcauuacacaaaaaggcauaauauucauuuuacuuaugcucguuacuccaucaauggcgaugagaugugugggaauaggcagucgcgauuucguagagggucuaucaggugcaaccugggucgauguagugcuugaacaugggucaugugugacaaccauggccaaagacaaaccuaccuuggacauugagcuacuuaaaacagaaguuacaaacccagcaguucuaagaaaacuuuguauugaagcuaaaauuucuaauaccacuacugauucucgaugcccaacacaaggugaagccacacuuguggaagaacaagaugcgaauuucgugugucggaggacuuucguagaccgaggauggggaaauggcugcggacuuuuugggaaaggaagccugauuacuugcgccaaauuuaaaugcgucacaaaauuagaggguaaaauuguccaauacgagaacuuaaaauauucagucauagugacuguucacacaggagaucaacaucaaguaggcaaugagucgacagaacauggcaccacggcgacaauuacaccgcaagcaccaacaacagaaauacaauuaacugauuauggugcacuuacccuugauugcucaccaagaacggggcuagauuuuaacgagaugguauuauugacaaugaaggagaaguccuggcuggugcauaaacaaugguuucuagaccuaccgcuaccauggacgaguggggcuucaacgucgcaagaaaccuggaaucgucaagaucuacucguuacuuuuaaaaccgcacacgccaagaaacaggaaguaguuguacugggaucccaggagggagcaaugcauacugcacucacgggggccacugaaauacaaacaagugguacgacuaccauauuugccggacaucugaaaugcagacuuaaaauggauaagcuaacgcucaaaggaaugaguuaugugauguguacugggagcuuuaaacuugaaaaggaaguggcggaaacccaacauggaacaguuuugguacaaauuaaguacgaagguacggacgcaccgugcaaaauucccuucaguacacaagacgagaaaggaguuacgcaaaauggaagauugauaacagcuaaccccaucgugacggauaaagaaaagccugucaauauugaagcagaacccccauucggagaaucuuauaucguaauaggcgcaggggaaaaagcguugaaauuaucuugguucaagaaaggaucauccauaggaaaaauguuugaagcuaccgcuagaggagcaaggcgaauggcuauauuaggagauacugcgugggauuuugggucuauaggaggggucuuuaccucuguggguaagcuaauacaucaaauuuucgggacugcauacggcguacucuucucgggcguaucuuggacaaugaagauaggaaucgguguacuacuaacaugguuaggauuaaauagccgaaguacuucauugucaaugaccuguauagcuguaggucuaguuaccuuauaucuaggcgucaugguccaagcugauagcggauguguuaucaauuggaagggucgcgaauugaaaugugggagugggauauuuguaacuaaugaaguacacacauggacugagcaauauaaauuccaagccgacucuccaaaaagguuaucugccgccaucggaaaggcaugggaagaggggguauguggaauacgcucagcuacaagacuagaaaauaucauguggaagcagauaucaaacgaacucaaucauauacuacuagaaaaugauaugaaacuuacagucguggucggagaugucgcugggauuuuaggccaaggaaagaaaaugauaaggccacaaccuauggaauauaaguacaguuggaaaagcuggggcaaagcaaaaauaauuggagccgacgcccaaaauacaacguuuaucauugauggcccuaauacaccagaaugccccgaugaccaaagagcuuggaacaucugggaaguggaagauuacgguuuuggcauauucacuacgaauauuugguuaaaacuaagagauuccuauacucaagucugcgaccacagauuaaugucagccgcaauaaaagacucaaaagcaguccaugccgacauggguuauuggauugaaucugagaaaaacgaaaccuggaaacuggcgagagcuucauucaucgaaguaaagaccuguauauggcccaagucccacacgcuauggucaaacgguguucucgaaagcgagaugauaauaccuaagauauacgggggaccuauuucacaacauaauuaucggccggguuauuuuacucagaccgcaggaccauggcaccuagguaaauuagaguuggauuuugaccuaugugagggcacaacgguaguaguggaugaacauuguggaaacagaggaccaaguuuaaggacaaccacgguaacgggaaagauaauucaugaauggugcugucggagcuguacuuuacccccuuuaagguuuagaggagaagauggcuguugguauggaauggagauuagaccaguaaaagagaaagaggagaaucuaguaaaaagcaugguuagugcagguucuggggaagucgauagcuucagucuaggcuuauuaugcauaagcauaaugauugaagaagugaugagaagucguuggagucggaaaaugcuaaugaccggaacguuagcuguauuuuuccuuuuaauaauggggcaacuuacuuggaacgaucucauaagauuaugcauaaugguaggggcaaaugcauucgacagaauggggauggggacaaccuaucuagcacucauggcuacauucaaaaugagaccgauguuugcaguaggccuauuauucagaagauuaacaucaagagagguacugcuguuaacaauuggucuaaguuuaguugcuaguguagaauugccaaauagccuugaagaacuuggugauggucuagccaugggaauaaugauucucaaauugcuaaccgauuuccagucucaccaacucugggcuacauuacugucacucacauuuauuaaaacaacauuuaguuuacauuacgcuuggaaaacuauggccaugguccuaucuaucguaagucuguuuccacucugcuugaguacuacaagucagaaaacuacaugguuaccaguacucuuaggaucacugggaugcaaaccacuuacaauguucuuaaucgcugaaaauaaaauauggggacgaaaaucauggccauugaacgagggaauaauggccgucgggauaguaucuauauuauuauccagccuacugaagaaugauguuccuuuagcuggaccccuaaucgcugggggaaugcucauagccuguuacguaauaagcggaaguagcgcagaucuaucgcuagagaaagcggcggaaguuucuugggaagaagaagcugaacacuccggggcuucacauaacauauuagucgagguacaagaugacggaacuaugaaaauaaaagaugaagaaagagaugauacguugaccauucuuuuaaaagccacucuauuagcugugagcgguguauauccucuaaguauuccggcuacacuauuuguuugguauuucuggcaaaagaagaaacaaaggucagguguccuaugggacacuccaucgccaccugaaguagaaagggcaguuuuagaugacggaauuuaucguauaaugcaacgcggucuauugggcagaagucaaguggggguaggaguauuucaagagaacgucuuucauacaauguggcauguuacaaggggagccguucuuauguaccaagguaaacgauuggagccuucaugggcaucagucaaaaaggaccuaauaaguuacgguggaggguggcgccuacgaggguccuggaauacgggcgaagaaguacagguuaucgccguggaaccaggcaaaaacccuaaaaaugugcaaacagcaccugguacguuuaagacuccagagggagaaguaggggcuauagcuuuggacuuuaaaccgggcacaagcggaucaccaauuguaaaucgagaagguaagaucguaggauuauacgggaauggaguuguuacuacuagcgguacuuauguauccgcaauugcacaggcaaaggcaucucaagaagggccacuuccagaaauagaagacgaaguuuuuagaaagagaaaucuaacaauaauggacuuacauccgggcagcgggaagacucgaagauaucuaccagccaucguacgagaagccauuaagcgaaaauuacgcacacucauuuuggcuccaacgagagucgucgccagcgaaauggccgaagcgcugaagggaaugccaauucgauaucaaacaacagcagucaaaagugaacacaccggcaaggaaauaguugaucuaaugugccaugcuacguuuacgaugcgccugcucucuccaguucgaguaccuaauuauaauaugauaauaauggacgaggcacacuuuacggauccuucaagcaucgcagcaagaggauauauuaguacacgcguaggaaugggagaggcugccgccauauuuaugacugccacaccuccgggaaguguugaggcauucccgcaauccaacgccguaauacaagacgaagaacgugauauaccugagagaagcuggaacucugggcaugaguggauaacagauuuuccagguaaaaccguuugguuuguaccuuccauaaaaucugggaaugauauagcaaauugccugagaaagaacggaaaacggguaauucaacugaguagaaaaaccuuugauacagaguaucagaaaacgaaaaauaaugauugggauuauguaguuacaacggauauuagugaaaugggagcaaacuuuagggcugauagaguaauagauccacgucguugccuaaaaccuguaauccucaaagauggaccugagcguguuauacuagcagggccaaugccggugacuguagcuucagcugcccaaaggagggggagaauagggcguaaccauaauaaagaaggagaccaguauaucuauaugggucagccauuaaacaacgacgaggaucacgcacacuggacggaggcgaaaauguuauuagacaacauuaauacuccagagggaauuauaccagcauuauuugagccugaaagggaaaaaucagcagcuguggauggugaguaucgauuaaggggugaagcacguaaaacauuuguugagcugaugaggcggggugaucuacccguuuggcuauccuacaaagucgcaucugaaggauuucaauacucggacagacgguggugcuuugacggugaacguaauaaucaagugcuagaggagaacauggaugucgaaaucuggacaaaagaaggggagagaaagaaacuacguccucgauggcuagaugcuagaaccuauagugauccacuugcauugagagaauuuaaagaguucgcugcaggaagacgaucagugucaggagaucugauacuugaaauuggaaaauugccgcaacauuuaacacaaagagcgcaaaaugcauuagacaaucugguaaugcuacauaauucagaacaaggcgguagagcauacaggcaugccauggaagaacuacccgacacaauagaaaccuuaaugcuccuugcguuaauagcgguuuugacaggaggagugacacuauucuuccuaaguggaagaggauuagguaaaacgaguaucggucucuuaugugucauggcuucgucaguuuuauuguggauggccuccguagaaccucacuggauugcagcaaguauuauacucgaguucuuucugaugguacuguuaauuccggaaccagauaggcagcgaacuccacaagauaaccaacuagcuuauguugugauaggacuuuuauucaugauacuaacaguagcggcuaaugaaaugggacuucuggaaacuacuaagaaagaucuaggcauaggacacguggcaguggaaaaucaucaccaugccgcaaugcuugauguagauuuacauccugcuucagccuggacacuauaugcaguagccacaacuauaauuacaccaaugaugcgucauacgauagaaaauacaaccgcaaauauaucauuaacagcaauugcuaaucaagcagcuauuuuaaugggauuagacaaaggauggccuaucaguaaaauggauauaggcguaccauuauuagcauuaggaugcuacucccaagucaacccucuuacauugacagcugccguauuaaugcuaguagcgcacuaugcaauuauaggcccuggauugcaagcgaaagcgacaagagaagcacagaagaggaccgcagcggguauuaugaaaaauccuacaguugaugguauuguagccauagaccuugauccggucguauaugacgccaaauuugagaaacagcuuggacaaauaaugcuucucauuuuaugcacgagucagaucuuauuaaugaggacuaccugggcauuaugugagagcaucacacuagcaacaggaccguuaacuacauuaugggaaggaucuccugguaaguuuuggaauacuacaauagccguaucgauggcgaauauuuuccgcggaaguuaccuugcuggcgcuggcuuagcauuuucccucaugaaaucguuaggcggaggucgacgcggaacuggagcucaaggggaaacauuaggggaaaaguggaaacgucaauugaaucaguugaguaaauccgaguucaauaccuacaaacgaucuggcauuauggaggucgacagaucugaagcaaaagaaggguuaaagcggggugagaccacaaaacaugcaguuucucgagguaccgcaaagcuaagaugguucguugaacguaauuuagugaaaccagaaggaaaaguaaucgaccuuggauguggucguggaggauggucuuacuacugugcuggcuugaagaaggucacagaaguaaaagguuacacgaaagggggucccggccaugaagaaccgauuccaauggcaacauaugguuggaauuuaguaaaguuacacaguggaaaagacguauucuuuauacccccagagaaaugugacacauuauuaugugacauaggugaaucaucaccgaacccaacaauagaggaaggaagaacucuuagaguguugaagaugguagaaccuuggcuuagagggaaucaauuuugcauuaaaauacugaauccauauaugcccagcguaguagagacguuagaacagaugcagagaaagcaugggggaaugcuuguuagaaacccauugucaagaaauuccacucaugaaauguauuggguaucaugcgguacgggcaauauagugagugcugucaacaugacgucaagaaugcuacuaaaucguuucacaauggcacauaggaaacccacauacgaaagagacguugacuuagguacagggacacgacacguggcggucgagccggagguagcaaaccuagauauuauaggucaaagaauugagaacauaaaacacgaacacaaaaguacauggcauuacgaugaagauaacccauacaaaacgugggcauaucauggaucauaugaagucaaaccgucaggaucggcaucgucuauggugaacggaguagugaagcuacucacaaaaccaugggauguaauuccgauggugacgcaaauagcaaugacagauacaaccccauuugggcaacaaagaguauucaaggaaaaaguggauacucgaacacccaaggcaaagaggggcacugcccaaauaauggaggugaccgcacgaugguuguggggcuucuugucuagaaacaagaaaccaagaauaugcacgcgagaggaauuuacaagaaaaguuagauccaaugcugcgauaggcgcuguuuuuguggacgaaaaccaguggaacuccgcuaaagaagcuguagaagaugaaagauucugggaccucgugcauagggaacgugaauuacacaaacagggaaagugugcaacauguguauacaacaugaugggaaaacgggagaagaaacuuggugaguucggaaaagcuaaagguucucgugcaauaugguacaugugguuaggagcaagauuuuuagaguuugaagcucuaggcuuuaugaacgaagaccacugguucucaagagaaaauaguuuaagugggguggaaggcgaaggauugcauaaauuagguuauauauugcgugacauaagcaaaauuccaggagguaacauguaugcagacgacacggcuggaugggauacucguauaaccgaagaugaccuucaaaacgaagcuaagaucacagacauaauggaaccagagcaugcgcuucuugccaaagcaauauucaaauuaacauaucagaacaaagucguaagaguucaacguccagccaaaaacgguacuguaauggacguaauuucuagaagagaucagaggggcaguggacaagucggaaccuacggcuuaaacacauuuacaaauauggaggcccaauugauuagacaaauggaauccgaaggcauuuuuagcccgucagaguuagaaacuccaaacuuggcggaacgggcuuuagacuggcuagagaaguaugggguagaaagacuaaaaagaauggccauuucuggagaugauugcguugucaaaccuauugacgaucgauucgcaacagcguuaacugcuuuaaaugauauggguaaaguuaggaaagacauuccgcaaugggaacccucuaaaggguggaacgauuggcaacaagucccauucuguagucaucacuuucaccaguuaauaaugaaggaugggcgcgaaauuguagugccauguagaaaccaagaugaauuagucggacgagcaaggguaagucaaggcgcugguuggucguuaagagaaacagcaugcuuggggaaaucguaugcccaaauguggcaauuaauguacuuucauaggagagaccuuaggcuagcugcaaacgcgauauguagugcagucccuguagacugggugcccacaagucgaacuacauggaguauccaugcucaucaccaguggaugacaacagaagacaugcuaagcguuuggaauaggguguggauagaagagaacccguggauggaagauaaaacccacauuucuagcugggaagauguaccguaucuuggcaaaagagaagaucaaugguguggaucccuuauuggucuuacagcacgugcaacaugggcuacuaauauccagguagcaauaaaccagguacgaagacuuauaggcaaugagaauuaccuagauuauaugacaaguaugaagcgcuucaaaaacgaaucugacccugaaggcgcuuuaugguga

SEQ ID NO: 21539 - RNA, 9879 nt, Artificial Sequence
  derived and/or modified CDS sequence (opt6) from DENV-1__FJ410204__SS-prME
uccguuacgaugcuucucauguugaugccuacugcauuagcuuuccacuugacaacucguggaggagagccucauaugaucguaucgaaacaagaaagagguaagagucuauuguuuaagacaagugcagggguaaauauguguacacuuauugcgauggaucuaggggaacuuugugaggacaccaugacauauaaauguccacgaauuacggaggcugaacccgacgauguagauuguugguguaaugcaacagauacaugggucacuuacgguacguguucacaaacaggggaacacagaagagauaaacgaaguguagcacuugcaccucaugugggacugggauuagagacgaggaccgagaccuggaugaguucagaaggagcguggaaacaaauucaaagaguugaaacaugggcacuccgacacccagguuuuaccguaauugcacuguucuuggcucaugcuauaggaacuucgaucacccaaaaagguaucauauuuauauuacuuauguugguaacuccaaguauggcgaugagaugcguaggaauagggagccgagauuucgucgaaggauuaagcggugcuacguggguugaugucguacuugaacauggcaguugcgucacaacaauggcaaaagacaaaccuacacucgacauagaacuuuuaaagacagaagugacaaauccugccguauuaagaaaacuaugcauagaagcgaaaauaucaaauacaacaacagacucaagguguccgacacaaggcgaagcuacguuaguagaggaacaagacgccaauuucgugugucggcgcacuuuuguagauagggggugggggaacggaugcggccuauuuggcaaaggcucauuaauuacaugugcaaaauuuaaaugcguuacaaaauuagaaggaaaaauuguucaguacgaaaauuuaaaauacucggucauaguuacaguacacacaggagaccagcaccagguugguaaugaaagcaccgaacacgguacgaccgccacaauuacgccgcaagcucccacgacugaaauccagcucacagauuauggagcuuuaacguuggacugcagcccccgaacgggauuagauuucaacgaaauggucuuacuaacaaugaaagaaaagaguugguuaguucauaaacaaugguuucuagaccuaccacucccauggacaucuggagcuucuaccucucaggaaacauggaaucgucaagauuuguuaguaaccuuuaaaacggcucacgccaagaagcaggaagugguagucuuaggaucacaggaaggagcgaugcauacugcucugacaggagcuacugaaauacaaacaucggggacuacgaccauauucgcaggucaucuaaaauguagacuaaaaauggauaaacucacucuuaaggggaugucguauguaaugugcacuggaucuuucaaacuagaaaaagaaguugccgaaacacaacauggcacaguccuaguacaaauaaaauacgaaggaacagacgcuccuuguaaaauucccuucaguacucaagacgaaaagggaguaacacagaacggaagacucauaacagcaaacccaaucgucacugacaaagaaaagccagucaacauugaagcagaaccaccuuuuggagaaucauauauuguuaucggagcgggcgagaaggccuuaaaauuaagcugguucaagaaagggaguaguauaggaaaaauguuugaagcuacagccagaggugcacgaagaauggcaauacuaggcgauacagcgugggauuuuggaucgauuggcgguguguucaccucaguagguaaacugauucaccagauauuugguacggcauacggaguauuauuuucuggagugagcuggacaaugaaaauaggaauagggguacuccugacuugguugggucucaauucaagaucaacuucuuuaaguaugaccuguaucgcaguaggccuugucacucuauacuugggcgugauggugcaagcagauaguggauguguaauuaauuggaaaggaagggaauuaaagugugggucagguauuuuuguuacaaacgagguuuauaccuggacagaacaguacaaauuucaggcagacucgccaaaaagauuaagugcagccauagggaaagccugggaagaaggaguuuguggcauacggagcgcaacaagguuagagaauauaauguggaaacaaaucagcaacgaauugaaucauauacuauuagaaaaugauaugaaacuuaccguuguaguaggugauguagcggggauccugggacaaggcaagaaaaugaucagaccccaaccaauggaguacaaauauucauggaaaucaugggguaaagcaaaaaucaucggagcagaugcgcaaaauacgacguucaucauagaugguccaaacacaccugaauguccagacgaccaaagggcuuggaauauuugggaagucgaggauuacggauuugguauauuuacaacaaacauauggcugaaacuuagggauaguuauacacagguaugcgaucauaggcugauguccgcagccauaaaagauaguaaggcuguacaugcugauaugggcuauuggauagaaagcgagaagaacgagacuuggaaguuagcaagagcuucauucauagaagugaagacauguauuuggccaaaaucucacacacucuggucaaacggaguacuagagagugaaaugauuauaccgaaaauauacggcgggcccaucucacagcauaauuauagaccagguuacuucacucaaacagcuggacccuggcaucuaggcaaacuugaacuagacuucgauuugugugaaggaacaacaguuguugucgaugaacacugcggaaauagaggucccagucucagaacuacaacgguaacaggaaaaauaauucaugaaugguguugcagaucuugcacguuacccccgcuucgauuuagaggugaagacggguguugguauggaauggagauaaggccuguaaaagaaaaagaagagaacuuaguaaaaucaauggucucugcaggcaguggagaggucgacuccuucucucuaggguuacucuguaucucaauuaugauugaagagguuaugagaaguagauggucgaggaaaauguuaaugacaggaacgcucgcaguuuucuuucuccuaauaaugggacaacuaacauggaacgacuuaauccgccuuugcaucaugguaggagcuaaugcauuugaucguaugggaaugggaaccacauacuuagcccuuauggccacauucaaaaugagacccauguucgcagucggacuauuguuucgaagguuaacaaguagggaagugcugcuuuuaacaauagggcucuccuuaguagcaucgguugaguuaccaaacaguuuagaagaacucggagaugggcuugcuaugggaauuaugaucuuaaaacuccuaacagauuuccaaagucaucaauuaugggccacucuguugucgcuaacguucauuaagacuacauuuagccuacacuacgcauggaagacuauggcuaugguacuuaguauaguuucgcuuuucccgcuaugucugucuaccaccucacaaaagacaaccuggcuuccaguccuacucgguucguuggguuguaaaccuuuaacuauguuucuaauagcugagaacaaaaucuggggaaggaaaucauggccauugaaugaagguauaauggccguaggcauaguaaguauacucuugagcucucuguugaaaaacgacguaccacucgccggcccgcuaauagcaggagggaugcucauugcuugcuaugucauuucugggaguagcgcggaucuauccuuggaaaaagccgcugaaguaucaugggaagaagaagccgagcacucaggcgcaagccauaacauucucguagagguccaggaugauggaacuaugaaaaucaaagacgaagaacgugacgauacacuaacaauuuuauuaaaagcuacuuuauuagcagucaguggagucuacccacuuaguauuccugcaacguuguuuguaugguacuucuggcagaaaaagaaacaaagaaguggaguccucugggauaccccuucgccaccggagguagaaagggcgguauuagacgacgggaucuaucgcaucaugcagagaggauuacuugggcgaucucaaguaggagucggagucuuucaggaaaauguauuucacacaauguggcauguuacaagaggggcgguuuuaauguaccaaggaaaaagauuagaaccaucuugggcuucuguaaagaaagaucuaauuaguuauggugggggcuggcgucuucggggaucguggaauacaggugaggaagugcaaguuauagcagucgaacccgggaaaaauccuaaaaauguucaaaccgcaccaggaacauuuaaaacaccggagggagaagucggagcgauagcuuuagacuucaaaccuggaacaaguggaaguccgauaguuaaccgagaagggaaaauaguaggguuguacggcaaugggguaguaacaacuuccgguacguacguaucugcaauugcccaagccaaggcaucccaggaagggcccuugccggagauagaggacgaaguauuucguaagagaaaucuaacuaucauggauuuacauccugguaguggaaaaacucgacgcuauuuaccagcaauaguaagagaggcaauaaaacgaaaauugagaacauugauuuuagcaccaaccaggguaguagcaucagagauggcagaagcguuaaaaggaaugccaauaagauaucaaacgacggcaguaaaaucagaacauacaggcaaagaaauugucgaccucaugugucacgcgacguuuaccaugaggcuccuaucuccaguaagagugcccaacuauaacaugaucauaauggaugaagcccauuuuaccgauccaucaucaauugcagcaagaggguacauaucaaccaggguaggcaugggugaggcagcggcuauauuuaugacugcaacuccaccaggcuccguagaagcauuuccacaaagcaaugccgucauacaagaugaagaaagggacauacccgagcggucauggaacucaggucaugaauggauuacugacuucccagguaagaccgugugguucguaccaucuauaaagucuggcaacgauauugcuaauugucucaggaaaaacgguaaacgcguuauucaauuaucaagaaaaacauucgauacugaauaccaaaagaccaaaaacaaugacugggacuaugucguaacuaccgacauaucagaaaugggagcaaauuuucgagcugauagagucauagauccucguagaugccuuaagcccgugauacuuaaagauggaccugaacggguuauauuagccgggccgaugccuguuacgguagcgucagcagcgcagagacgggggagaauagggcgaaaccauaacaaagagggagaccaauauaucuauaugggccaaccacugaacaacgacgaagaucaugcccauuggacagaggcuaagaugcuauuggacaauauuaacacaccagaggguauaaucccagcauuauucgaaccagaaagagagaaaagugcggcuguggauggggaauaucgacucaggggugaagcgcguaagaccuucguugaauuaaugcguagaggagaucuaccagugugguuaucauacaaaguagcaagcgaaggguuccaauacucugacagaagauggugcuuugauggugaaagaaauaaccaaguacuagaagagaauauggacguagaaauauggacuaaagaaggagaaaccaagaaauuaagacaucgauggccugacgcccgucaauauucagauccuuuaggccuuagggaauuuaaggaauuugcugcaggaagaagaagcguaaguggagaccuuauucucgaaauaggcaaauuaccacaacacuuaacucaacgugcccaaaacgcuuuagauaaucuaguaaugcuacacaacucugaacaaggaggcagagcauauagacaugcaauggaagaacuuccugacacaauugaaacucuuaugcuuuuagcauuaauugcgguacugacuggcggaguuacgcuauucuuuuugucaggaagaggacuuggcaaaacaagcauaggauugcuuugcgugauggcgaguagcguauugcuguggauggccucugucgaaccccauuggauagcagcaucgauuauccuagaguucuuucugaugguacucuuaauaccagaacccgaucgacagagaacuccucaggauaaccaacuggcauacguaguaauaggcuuacuuuuuaugauucuaacaguagcugcaaaugaaauggggcuauuggagacaacuaagaaagacuuggguauuggucauguggccguugaaaaucaucaucacgccgcaauguuagauguagaccuucaccccgcaucugcauggacauuguacgcgguagcgaccacuauuauuaccccgaugaugcgacacaccauagagaauacaacagcgaauauuucucuuacugccauagccaaccaagcggcuauucugaugggucuagauaaggguuggccaauaucgaaaauggauauuggcgugccauuacuggcccuagguuguuacucucaaguaaacccgcugacauuaaccgcagccgucuugauguugguggcacauuacgcaauuauagguccaggucuccaagcgaaggcaacaagggaagcacaaaaacggacugcggccggaauaaugaaaaauccaacugucgauggaauuguggccauugauuuggauccugugguguacgaugcaaaauuugaaaaacagcuaggacaaauaaugcuacuaauuuuauguacaagucaaaucuuauuaaugcgaacaacaugggcacuuugugaaaguauaacuuuagcuaccggaccauugacaacguuaugggaaggaucaccuggcaaauucuggaauaccacuauagcuguuucuauggcuaacauauuucgagguaguuaccuggcuggcgcgggucuagcauuuagcuugaugaaaagccuugguggaggucgaagaggaacaggggcacagggcgaaacucuuggcgaaaaauggaagcgucaguuaaaucaauuguccaaaucagaauuuaauacuuauaaacgcuccgggauaauggagguugacaggucagaagcgaaagaaggacuaaaaagaggagaaacaacgaaacacgcaguaucucgcggcacagcgaaauugaggugguuuguggaaagaaaucugguuaaaccggaaggaaaagucauagacuuaggaugugggaggggcggguggucguauuauugcgcaggguuaaagaaaguuacggaaguaaaagguuauacaaaaggaggcccuggucaugaggagccaauaccgauggcaacuuauggauggaauuugguaaaacuacacucaggcaaagauguguucuuuauaccacccgagaaaugcgacaccuuacuaugugauaucggagaaucuagcccaaauccaacgauagaagaaggaaggacucuucggguauuaaaaaugguugaacccugguuacgagguaaccaauucuguauaaaaauauugaauccuuauaugccauccgucguggaaacacuugagcagaugcaaagaaagcacggugggaugcuaguccggaauccauuaagcagaaauucuacucaugaaauguacuggguaucaugcggaacaggaaacauagucagugccguaaacaugacaaguagaaugcuuuuaaaucgauuuacaauggcgcauaggaagccaacuuaugaaagggaugucgaucuuggaacagggacccggcacguagcagucgagccagaaguggcaaauuuggauauuauaggucagagaaucgaaaacauaaaacaugagcacaaguccacauggcauuaugacgaggacaacccguauaaaacaugggccuaccacgggucuuaugaaguaaagccgucgggaagcgcuucaucgaugguuaauggaguaguuaaguuguuaacgaaaccaugggaugugauacccaugguaacgcagauugcaaugacggauaccacaccauucggucaacagaggguuuuuaaagagaagguugacaccagaacacccaaagcaaaaagaggaacagcgcagauaauggaaguaacugcaagauggcuauggggguuuuuaaguagaaauaagaaaccgagaaucuguacgcgcgaagaauuuaccaggaagguacguucaaaugcagcaauaggggcgguauuuguugaugaaaaucaguggaauagugccaaagaagcggucgaagaugaacgauuuugggaccuaguacauagagagagagaauuacauaaacaagguaagugcgcaacauguguguacaauaugaugggcaaacgagagaagaaauuaggagaauuugguaaagcaaaagguagucgugcaauaugguacaugugguuaggggcucguuuucuagaauuugaggcauuaggauucaugaacgaggaucauugguuuucacgagaaaauucuuugagugggguugaaggggaaggucuacauaaacuugguuacauacuaagagacauuaguaaaauaccuggagggaauauguacgcugaugacacggccgggugggacacuaggauaacggaagacgaccugcaaaaugaggccaaaauuacugauauaauggaaccagaacaugccuuacuugcgaaggcuauuuuuaaauugacauaucaaaauaaaguuguuagaguccagcggccagcuaaaaacggaacagucauggauguuaucucucguagagaccaacgaggaucagggcaaguagguacauauggauuaaauaccuucacaaauauggaagcucaguuaauccgccaaauggaaucagaagggauauucucccccagcgagcuugaaaccccgaaucucgcagaacgagcacuagauugguuagaaaaauauggcguugaacgucucaagcgcauggcuauuaguggggacgauugcguaguaaaaccaauagaugacagauuugcaacagccuuaacggcacugaaugauaugggaaaagugcgaaaagacauaccccagugggagccaaguaaaggguggaaugacuggcaacaaguaccguucugcucccaccacuuucaucagcuaauuaugaaagacggcagagagauugugguacccugcagaaaucaggaugaguugguaggcagagcgagaguaucacaaggagcaggguggagccuuagagaaacagcuugcuuaggcaaauccuacgcacaaauguggcaauuaauguacuuucauaggcgagaucucagauuggcagcaaaugcuaucuguagugcuguucccguugacugggugcccacaucaagaacuacuuggucaauucacgcucaccaccaauggaugacaacggaagauaugcuaagcguguggaacagggucuggauagaagaaaacccauggauggaagacaagacccacauaucuagcugggaagauguaccauauuuaggcaaacgggaagaccaauggugugggagcuuaauaggacuuacggcgcgugcaacuugggcaaccaauauucaaguggccauaaaccaaguucggagguuaauuggaaacgaaaacuauuuggacuacaugacgaguaugaagcgauuuaaaaaugagagcgacccagaaggagcacucugguag

SEQ ID NO: 21540 - RNA, 9879 nt, Artificial Sequence
  derived and/or modified CDS sequence (opt6) from DENV-1__FJ432742__SS-prME
ucugugaccauguuauugauguuaaugccgacggcauuggccuuccaucuaaccacacguggaggugaaccucacaugauagucacuaaacaagaacguggaaaaagucuauuauuuaaaaccucagcuggaguaaacauguguacccuaauagcgauggaucuaggcgaauuaugcgaggacacgaugacuuacaaauguccuagaauaacagaagcggagccagaugauguagacuguugguguaacgcaacugauacuuggguuaccuaugguacaugcagccaaacuggugaacauagacgcgauaaaagaaguguagcccuagcaccccacguaggccucgguuuagagacucggacagagacguggaugagcucagaaggagcauggaaacaaauacaacgagucgaaacuugggcacuucggcauccuggauucacagucaucgcguuguuuuuagcacaugccaucggaacaagcauaacacaaaaaggaauuauuuucauauuauuaauguugguaaccccaaguauggcuaugcguuguguagggauaggaucacgugauuucguugaaggucugaguggcgcuacauggguagaugugguucuggaacauggaaguugcgugacaacaauggcaaaagauaagcccacacuagauauugaguuacucaagacagagguaacgaauccugcuguacuacgaaaacuaugcauagaagcgaagauaaguaauaccacuacagauucgcguuguccaacucaaggagaagcaacguuaauggaagaacaagaugccaauuuugucugcaggcggacauucguggauagagggugggguaaugggugcggacuauucggcaagggcucauuaauaacgugugccaaauucaaauguguaacaaaacuggaaggaaaaauuguacaauacgagaacuuaaaauauucuguuauuguuacaguucacaccggagaucaacaucagguugggaacgaaaguacagaacacggcaccacagcuacuauaacuccccaagcaccgacuagcgaaauacagcuaaccgacuauggcgcgcuaaccuuagauugcucaccucguaccggauuagacuuuaaugaaaugguucuauuaacaaugaaagaaaagucaugguuaguacacaagcaaugguuccuagaccuaccuuuaccguggacgaguggagcaagcacgagucaagaaacauggaauaggcaggauuugcuaguaacauuuaaaacagcccacgccaaaaagcaagaagucguaguacuaggaucacaggagggcgcaaugcacacagcauuaacaggcgcaacugaaauacaaacgucaggaacuacaacaauuuuugcgggccacuugaaaugccgauuaaagauggauaaguugacuuugaaagguaugucguauguuauguguacgggauccuuuaaauuagaaaaagaaguggcagaaacucaacaugguacuguccuaguccagauaaaguaugaaggaacugacgcaccuuguaaaaucccauuuagcacucaagacgaaaaagguguuacacaaaauggcaggcucaucacugcaaaccccaucguuacugauaaggaaaaaccagugaacaucgaagcggaaccaccuuucggcgaaaguuauauaguuauaggagccggagaaaaagcauuaaaguuaagcugguucaagaaaggaucuucaauaggcaagauguucgaagcaacggcuagaggagcacguagaauggcaauucuaggcgauaccgcuugggacuucgggucaguaggugguguguucacaucaguggguaaauuaguucaccaaauuuucgggacugcauacgguguucuauuuuccggagugucauggacaaugaagauuggaauagggguauuguuaacguggcuaggccuuaauucuagaaguacaagucuaaguaugaccugcauagcaguaggauuggucacucuauauuuaggaguuaugguucaagcagacaguggguguguaaucaacuggaaaggacgcgagcuaaaaugugggucagguauauucguaacaaacgaaguucacacauggaccgaacaauauaaauuccaagcugauucuccuaagagauuaagcgccgcaauaggaaaagcgugggaagaagguguauguggaaucaggagugcuacacguuuggagaacauuauguggaaacagaucaguaacgaacugaaucacauccucuuagagaaugauaugaaguucacagucguaguaggagacgugguuggaauuuuggcgcaagguaagaaaaugauuagaccacagccuauggagcauaaguauaguuggaaaaguuggggcaaagcaaaaauaauuggggccgauguccaaaauacaacuuucauaauugacggaccaaacacuccagaauguccagacgaucaaagagcuuggaacauaugggaaguugaagauuacgguuucgggauuuucaccacaaacauauggcuuaaauuacgagacucauauacacaaguaugcgaucaucgauuaaugucagcggcaauaaaagacucaaaagcuguacacgcugauauggguuauuggauagagagcgagaagaacgagacguggaaauuagcaagggcaaguuuuauagaaguuaaaacguguauuuggccaaagucccauacacugugguccaauggaguuuuagaaagugaaaugauuauaccgaaaauauacggcgguccaauaucacaacauaauuaucguccgggauauuuuacacagacagcaggaccguggcauuuagguaaacucgagcuugauuuugaucugugugaagguacaacugugguuguggacgaacauugugguaauagaggccccagcuuaagaacuacuacggucacggggaaaauuauccaugaaugguguugcagaucuuguacacuaccaccauugagauuuaagggagaagacggguguugguacggcauggaaauacguccugucaaggaaaaagaagaaaauuuagugaaaaguaugguaucugcugguucaggggaaguagauaguuuuucacugggacuguuauguaucagcauuaugauugaagaaguaaugagaucaagauggaguaggaaaaugcuaaugaccgggacucuagcuguuuuucucuuacugauuaugggccagcucacuuggaaugaccuuauccgccugugcaucaugguuggagcuaaugccucggaucgaauggguauggguacaacauacuuagccuuaauggcuacuuucaagaugagaccgauguuugccguuggauuguuauuccgacgucugacgagucgggaagugcuacuguuaacaaucggacuaucucuaguggcaucagucgaacugccaaauucacuagaggaacucggcgacggauuagcuaugggaauuaugauacuuaaacuccuaacagacuuccaaagccaucaacuaugggcaacuuuacugucguuaacauucauuaaaacuacucuuucacuucauuaugcauggaaaacaauggcaaugguccuaucgauugucagcuuauucccguuauguuuaagcacaacuucgcagaaaacaacgugguugcccgugcuauuagggucccuaggcugcaaaccauuaacaauguuccuuaucacagaaaauaaaauaugggggcgaaaaaguuggccucuaaaugaagggauaauggcuguggguguaguaucuaucuuacucagcagccuuuuaaagaaugacguuccccuagcgggaccucuaaucgcgggaggaaugcuaaucgcauguuacgucauaucagguucauccgcagacuugagucuggaaaaagcagcggagguaaguugggaagaagaggcggagcacuccggggcuagucacaacauacucguugaaguucaagacgauggaaccaugaaaaucaaagaugaagaacgggaugacacgcuaacuauauugcugaaagcuacauuacuagcugugagugguguguacccacuuaguauaccggcaacacuuuucguaugguauuuuuggcaaaagaagaaacagagaucaggagucuuaugggacacacccaguccaccagagguagaacgagcgguguuagacgacgguauauacagaaucaugcagcgugguuuacucgggaggagccaaguaggcgucggaguauuccaagaaaacgucuuucacacuauguggcauguaacgcgcggggcaguauugauguaucaaggcaaaagacucgaaccuucuugggcguccguuaagaaggaucuaauuuccuaugggggaggauggcgccuucaaggaucauggaacaccggggaagagguucaaguaauagcgguagaaccaggcaaaaacccaaagaauguucaaacagcacccgggacauucaagacaccagagggagaaguaggugcgaucgcccucgauuuuaagccaggaacuuccggaucaccaauaguaaaucgugaaggaaaaauagucgguuuauauggaaacggcguggucacaacuucaggaacauacguaucggcuauagcgcaagcaaaggcuucacaggaaggaccucuaccggagauugaggaugagguuuucagaaaacgaaaucuuacuaucauggaccuucauccgggcagcggaaaaacucgaagauacuuacccgcaauaguaagggaagcaauuaagcgaaaacucagaacucugauacucgcuccuacacgaguuguugcaagugaaauggcugaagcauuaaaagggaugccuaucagauaucaaaccacggccgucaaauccgagcauacugggaaagaaauaguggaccuuaugugccacgcgaccuuuaccaugagacuauuauccccaguuagaguaccaaauuacaauaugauaauaauggaugaggcucacuucaccgauccgagcucaauagcugcccgaggguauauuucaacaagaguaggaaugggggaagcggccgcuauauuuaugacggcgacaccaccagggagcguagaagcauuuccucaauccaaugccguaauacaagaugaagaaagggauaucccugaacgaucauggaacuccggguaugaauggauaacagauuuucccgguaaaacuguuugguucguaccaucaauaaaaaguggaaaugacauugccaacugucuucggaaaaauggaaaaagagucauacaacuaaguagaaagacauuugauaccgaguaucaaaagaccaaaaacaacgacugggacuaugucguuacaacugauauaucagaaaugggugcaaacuuuagggcugaucgaguaauugacccaagaaggugucuuaaaccugugauacuuaaggaugggccagaaagaguuaucuuggcaggcccaaugccaguuacaguagccagcgcagcgcaacgaagagguagaauuggaagaaaucacaauaaagaaggagaccaauacauauauaugggucagccccucaauaaugacgaggaccaugcucacuggacagaagcuaaaauguugcuugauaauauuaauacuccugaaggaauuauaccagcuuuguuugaaccugaaagggagaaaagugcggcgauugauggugaguaucgccuaagaggggaagcuagaaagaccuucguugaacucaugcggaggggugaccuuccagucuggcuaaguuauaaaguagcaucagagggcuuucaauauucagacaggagaugguguuuugauggagaacguaacaaucaagugcuagaagaaaacauggauguggaaauauggacaaaggagggugagagaaagaaacuacguccccguuggcuagaugcaagaacuuauucagacccuuuagcgcuuagagaauuuaaagaauuugcugcagguagaagaagcguuucuggugaccuuauauuagaaauuggcaaacuuccucaacaucugacucagagagcacaaaaugcccuugauaacuugguuaugcuucacaacagcgaacaagggggucgcgcuuauaggcacgcgauggaggaauuaccagacacuaucgaaacauugaugcuucuugcucuaaucgcaguacuaaccggaggaguaacguuguucuuccuaaguggaagaggacuagguaaaacuucaaucggacuacuaugugucauggccagcucaguacuacuauggauggcaaguguagaaccgcauuggauugcggcaucuauaauauuagaguucuuucuaaugguauuguugauaccugaaccagauagacaaaggacaccccaagauaaccaacuagcuuauguaguaauaggauuguuauuuaugauauuaacaguugcagcaaaugaaaugggucuguuggaaacgacuaaaaaggaucuuggaauaggacauguagcagucgaaaaucaucaucacgcaacaaugcuagauguagaucuucacccagcaucugcauggacuuuauacgcagucgccacaaccauaauaacgccaaugaugagacauacaauugagaauacaacugcaaauauaucguuaacagcuauugcgaaucaggccgcaauccugauggguuuagacaaaggauggcccauaucuaaaauggacauagggguaccuuuacucgcucuaggcugcuacagucaagugaacccuuugacacuuacugcugcaguauuaaugcucguggcgcacuaugcaauuaucggaccaggauuacaggcaaaagccacacgugaagcacagaaacgcacagcggcuggaaucaugaagaacccaacaguggaugggaucguugcaauugaccuagauccggucguuuaugacgcaaaguuugagaaacaguuaggccaaauaaugcuguuaauucuuuguaccucacaaauccuucuuaugcgcaccacaugggcacucugugaaucuauaacucuugcuaccggaccacuuacgacgcuuugggaaggcagcccagguaaauucuggaauacaacaauugcagucaguauggccaacaucuuuagagguucauaccuagcuggugcaggacuagccuucucauugaugaagucacuaggcggaggacgucgaggcaccggcgcacaaggagaaacucuaggggaaaaguggaaacgucaacuaaaucaacuuucuaaguccgaauuuaauauauacaaacguagugggaucauggaaguagauagaucggaggcaaaagagggcuuaaaaagaggagaaacgacaagacaugcuguaagucgcgguacagcuaagcuccgcugguuuguagaacgaaaccucguuaagccugagggcaaaguaauagaucucggaugcgguaggggcggauggucuuauuauugugccggccuaaagaaaguaacagaaguaaaagguuauacaaaaggugguccuggccacgaagaaccaauaccuauggccacauaugguuggaaccugguaaaacuacauucagguaaggacguauucuuuacaccacccgaaaaaugugauacccugcuuugcgacauuggugaaucaucuccaaauccuaccauagaagaggggagaacuuuaagggugcugaaaauggucgaaccuuggcuccggggaaaucaauuuuguaucaaaauacuaaacccauacaugcccucaguaguggaaacccuggagcaaaugcaaagaaaacaugguggcaugcugguucgaaacccacuuucacgcaauagcacccaugaaauguacuggguaucaugugggacaggaaauauuguuucagcuguaaauaugacaucgagaauguugcucaaccgguuuacgauggcacacaggaaaccuacauaugaacgcgacgucgacuuaggagcaggaacuagacauguagcaguagaaccagaaguagcuaauuuagacauuauuggucagagaaucgaaaacauuaaacaugagcacaaaucgacauggcauuaugaugaagauaauccuuacaagacaugggcauaucacggaagcuacgaagugaaacccagugggagugcaucgaguaugguaaaugguguugugaagcuccuuacaaaaccaugggacguaauuccaaugguuacacaaauagcaaugacggauacaacacccuuugggcaacaaagaguguucaaagaaaaaguagauacgagaacgcccaaggccaaacgaggcacagcccagaucauggaaguuacagcgagaugguuguggggauuucugucucgaaauaagaaaccaagaauauguacuagagaagaguucacgagaaaggucagaaguaaugcagcaauaggagcaguuuucguagaugaaaaccaguggaauagugccaaagaagcugucgaagacgagcgauuuugggauuuaguacaaaaggaacgagaauuacacaagcaagggaagugcgcuaccuguguauauaacaugauggggaaaagagaaaagaaacugggagaguucgguaaggcaaaaggcucuagagcgauaugguauaugugguugggagcuagguucuuggaguucgaagcgcuagguuuuaugaaugaagaccauugguuuagcagagaaaauucauuguccggaguugagggugaaggauuacauaaacuugguuacauauuaagagacaucucuaaaaucccgggugggaacauguaugcagacgacaccgcuggaugggauaccagaaucacugaagacgauuuacaaaaugaggcaaagaucaccgacauuauggagccagaacacgcguuacuagcuacgaguauauuuaaacuuacauaucaaaauaaaguuguacgaguucaaagaccggccaaaaacggaacuguaauggaugugauaucucggcgagaucagagagguagcggacaaguuggaaccuauggcuuaaauacuuucacaaauauggaggcccagcucauuagacaaauggagagugaaggaauuuuucuuccuucugaauuggaaacaccaaacuuagcugaaaggguccuggauuggcuagaaaaauacggaguggagcgauuaaagcgcauggcaauaaguggagacgauugcguagugaagcccaucgacgauagauuugcuacugcauugacugcucuuaacgacaugggcaaaguccggaaagauauaccacaaugggaacccucaaagggauggaaugacuggcaacaagugccauuuuguucacaccacuuucaccagcuaaucaugaaggaugggcgagaaauuguagugccgugccgcaaucaagacgaauugguuggcagagcaaggguuagucaaggcgcugguuggaguuuaagagaaacugcaugcuuggggaaaucauacgcgcagauguggcaacugauguauuuucauaggagagacuuacgucucgcagcuaacgcuauauguagcgcuguuccaguugacuggguaccuacaagucgaaccacuuggagcauacacgcccaucaucaguggaugacgacugaagauaugcucuccgucuggaaucgaguauggauagaagaaaauccguggauggaagacaaaacucaugucucaucauggggagacguuccuuaucuagguaaaagagaggaucaaugguguggaucccuaauagguuuaaccgcucgggcaaccugggcgaguaauauacaaguagcaauaaaccaggugagaagauuaauuggcaacgaaaauuauuuagauuauaugacgagcaugaaaagguuuaagaaugaaggugauccugagggggcauugugguaa

SEQ ID NO: 21541 - RNA, 9879 nt, Artificial Sequence
  derived and/or modified CDS sequence (opt6) from DENV-1__FJ410205__SS-prME
ucuguaacaaugcugcuaauguugaugccuacagcacuugcauuccaucuuacuacgagagggggugaaccgcacaugaucguaucgaaacaagaacgcggaaaaucacuucucuuuaaaacaucagcaggaguaaacauguguacacugauugcaauggaccuaggagaacuaugcgaagauacgaugacauacaaaugcccaaggaucacugaaacagaaccggaugauguagauugcugguguaaugcaacagacacguggguaacguaugguacuugcagccaaacuggcgaacauagacgggacaaaagaagcguggcucuugcaccccacgucggccuaggguuagaaacacgaacggaaaccuggaugagcagugaaggugcauggaaacaaauccaacguguagaaacuugggcguugagacaccccggguucacagucauagccuuauuucuagcacacgcaauagguacaagcaucacccaaaaaggaauuauauucauccuauuaaugcuagucacuccuaguauggcgaugagaugcguuggcaucgguaguagagauuuuguagaaggguuaaguggagcaaccuggguggaugucguccuugaacauggcucuuguguaacaaccauggcgaaagauaaaccaacacuggacauugaauuguugaaaacggaaguuacaaauccugcaguucuucgaaaacuuuguauugaagcaaaaauauccaauacuacuacagauaguagguguccuacucaaggugaagccacauuagucgaggaacaagaugcaaacuuuguuugucgucgaacauuuguagaccgaggcuggggcaaugguugcgggcuauuugguaaaggaagccuuauuacaugugcaaaauucaaauguguuacuaaauuagaagguaaaaucguacaauacgaaaacuuaaaauauucaguaaucguaacuguacacacaggagaucaacaccaaguagguaaugaaucuacugaacacggcacaacggcuacaauaaccccgcaagcaccaacgacggagauacaauuaacggacuauggagcguuaacacuagacuguucuccaagaacaggacuagacuuuaacgagaugguauuauuaacuaugaaagaaaaauccuggcuugugcauaaacaaugguuccucgaucuaccguuacccuggacaucaggcgcaucaacaucucaagaaacguggaaucgucaagauuuacuugugacuuuuaaaacugcucaugcuaaaaagcaagaaguggucguuuuagggagccaagagggugcuaugcauacggcgcuaacaggagcuaccgaaauccaaacauccggaacaaccacaaucuuugcaggacacuuaaaauguaggcugaagauggacaaacuaacuuuaaaaggcaugucuuaugucaugugcacaggauccuuuaaauuagagaaagaguuagcggaaacacaacauggaacuguuuuaguccaaauuaaauacgaaggaacagaugcaccauguaaaauacccuucaguacucaagacgaaaaaggaguaacacaaaauggaagauuaauaaccgcgaauccaauaguaacagauaaagaaaaaccaguaaacaucgaggccgagccuccuuuuggugaaaguuauauaguaauaggggcaggagagaaggcacuaaaacuaagcugguucaaaaagggaaguucgauaggaaaaauguucgaggcuacagcacgaggggccagaagaauggcgauuuuaggcgauacggcgugggauuucggaagcauaggagguguguuuaccagugcuggcaagcuaguccaucaaauuuuugggaccgcuuacgggguacuguucagcggaguaucauggacaaugaaaauugguauaggaguacuauugacuugguuaggguuaaauaguagaagcacgucgcuuagcaugaccugcauugccguagguuuaguaacacuguacuuagguguaaugguacaagcagauucaggaugugucaucaauuggaaagggagagaacuaaaaugcggcucuggaaucuuuguaacaaaugagguacacaccuggacagaacaauauaaauuucaagccgauagcccuaagagacuuagugcugcuauagguaaagcgugggaagaaggaguauguggcauacggucggcuacaagauuagagaauaucauguggaaacagaucucaaacgaacuuaaucacaucuuguuagaaaacgauaugaaauuuacaguaguuguaggagauguagcagggauacuggcacaagguaagaaaaugauucgaccucagccuauggaguacaaauauucguggaagucgugggggaaggcaaaaauaaucggagcagacguucagaauaccacuuuuauuauagauggccccaacacuccagaaugcccggaugaccagagagcuuggaauauaugggaagucgaggacuacggauucggcauuuucacgacgaauauaugguuaaaacugcgagauaguuacacgcagguaugugaucaucguuuaauguccgccgcgauaaaggacaguaaagcuguucacgcugacaugggguauuggauugaaagugagaaaaacgagaccuggaaacuagcaagagcuucuuucaucgagguaaaaaccuguauauggccuaaaucucacacauuauggucgaacggcgugcucgagucagaaaugaucauacccaaaaucuaugguggucccauaucucaacauaacuauagaccaggauauuucacacaaacagcagggccauggcauuuaggcaaacuugaauuagauuuugaucuaugugaagguacgacagucguagucgaugaacacugcgggaauaggggcccgucuuuaaggacuacuacaguaacugguaaaauuauacaugaauggugcuguagaucauguacacucccaccucuaagguuucguggagaagaugguuguugguacgggauggaaaucagaccuguaaaagaaaaggaagaaaacuuaguuaaaucaaugguaucagcaggcaguggugaaguugauucauucaguuuaggcuugcucuguauuucaauuaugaucgaagaagucaugaggaguagauggucacgaaagauguuaaugacuggaacgcucgcggucuucuuucuauuaauuaugggucaacuaacauggaaugaccuuauaaggcuaugcauuauggugggagcgaaugccagcgauagaaugggaaugggaacuacuuauuuagcccuaauggcuacguuuaagaugcgccccauguucgccguagguuuacuauuuagaagguugacaucaagagaaguccuccuacugaccaucgguuugucauuaguugcauccgucgaacuaccaaacucacuugaagaauugggggauggccuagcuauggguaucaugauuuuaaaauuguugacagauuuccaaucacaucaauuaugggccaccuugcuaaguuuaacauucauuaaaacuacauucucccuucauuaugccuggaagacuauggcuaugguccucaguauaguuagucuauuuccccuaugcuuaaguacaacaagccagaaaacaacaugguugccaguacugcuaggaagucuagguuguaagccguugaccauguuccuaauugccgaaaauaaaauauggggccgucguucauggccguuaaacgaaggaauaauggccguaggaaucguaucuauccuucuuagcucauuacuaaagaacgacguaccauuagccgguccguuaauagcgggcggcaugcuaauugcuugcuauguaaucagugguaguagugcugaccucucauuggagaaagcggcagaggugaguugggaagaagaagcggaacauucaggugccucccauaacauuuuaguagagguucaagaugacggaacaaugaaaaucaaagacgaggaacgagaugauacucugaccaucuuauuaaaagcgacccugcuagcggucucggggguguacccacuguccauuccggcaacccucuucgucugguacuuuuggcagaaaaagaaacaaagaucgggaguucugugggauacacccucuccaccagaaguagaacgcgccgugcuagacgaugggaucuaccguaucaugcaacgaggucuguuaggcagaagccaagucggagucggcguuuuucaggaaaacguauuccacaccauguggcauguaacuagaggagcaguauuaauguaccaagggaaacgucuugaacccucuugggcuucagucaagaaagauuugauaucauauggcggcggauggagauuacagggaaguuggaacacaggcgaagaaguacaggucaucgcaguggaaccaggcaaaaaucccaaaaacguucaaacggcuccagggacauucaaaacuccggagggcgaaguaggagcuauagcauuggauuuuaaaccagguacaagugguagcccgauugugaaccgugaagggaaaauuguaggacuguacggaaacggaguuguaacuacuucaggaacguacguaagcgcgaucgcucaagccaaagcaucacaagaaggaccauuaccugagauagaagacgaagucuuucgaaaaagaaaucugacuauuauggauuuacauccuggauccggaaagacucguagauacuuaccagcgauugugagagaagcuauaaaacggaaauugagaacucucaucuuggccccaacaagaguaguugcuucagaaauggcugaagcauugaaagguaugccuauuagauaucaaacuaccgcuguuaaaagcgaacacacugggaaagagaucguagaccucaugugucaugcgaccuuuaccaugcgcuuguuaaguccaguuagaguuccaaauuacaacaugauaauaauggaugaagcacauuucacagauccuagcuccauagcugccagaggcuacauuucaacgcgcguaggcaugggggaagcggccgcuauauucaugacugcgaccccaccaggcaguguugaagccuuuccacaauccaacgcgguaauccaagaugaagaaagggauauaccagaaaggucguggaauagugguuaugaauggauaacggauuuucccggcaagacuguuugguucguuccuucuaucaagagcggcaaugacauugcgaauugccuccguaaaaacggcaaaagagucauccaacuaucaagaaaaaccuuugauacugaguaucaaaagaccaaaaacaacgacugggauuacguuguaacaacugauauauccgagaugggagcaaauuucagggcugaucgaguaauagauccaagaagaugcuuaaaaccgguuauauuaaaagauggaccggagagagugauucuagcuggaccuaugccggucacuguggcuucugcugcacaacgaaggggcagaauaggucguaaucacaacaaagagggagaucaguauaucuacaugggccaaccauuaaacaaugaugaggaucaugcucauuggacugaagccaaaauguugcuagauaauaucaauacuccagaaggaauuauacccgcuuuauucgaaccggagcgugaaaaaucagcagcgauugauggugaauauagacuuagaggggaagcacgcaagacauucguggaguuaaugagacgaggagaucugcccguauggcuuaguuauaaagucgcaucagaaggcuuccaauacuccgauagacgaugguguuuugacggugaacgaaauaaucaaguccuagaagagaauauggacguagagauauggaccaaagaaggcgaacgcaagaaauuaagaccaagauggcuugaugccaggacuuacucagacccgcucgcauuacgugaguucaaagaauuugcugcaggucgacgaucggugucaggagaucugauacuggaaauugggaaauugccacaacaucuuacucaacgagcacaaaacgcuuuggauaauuuaguuaugcuacauaauagugaacaagguggacgugcauauagacaugcaauggaagaguuaccugacacaauagaaacucuaaugcuguuagcccuaauagcaguucucacagggggaguuacacuguucuuucuauccggucgcggauuagguaaaacaucgauuggacuacuaugcgugauggccaguucuguuuuacucuggauggcuucaguugaaccacauuggauagcugcgucuauaauucuggaauuuuuccuaaugguacuucugauaccagaaccugauagacagcgcacgccacaagacaaucagcucgcguacguggugauaggcuuauuguuuaugauccuaacaguagccgcuaacgaaauggggcuauuagagacaacuaaaaaggauuuaggaauuggacauguagcaguugagaaucaucaccaugcggcuauguuagauguugaccuacaccccgcgucugcguggacucucuacgccguggcuacuacuauuauuacaccuaugaugagacauacaauugaaaacacaacagccaauauuucacuaacggcaauugcuaaucaagcagcgauccuaaugggacuagacaaaggauggccaauaagcaaaauggauauugggguaccucuacucgcacuugguuguuauagucaaguaaauccauuaacacugacggccgcuguauugauguugguugcacacuaugcuauuauaggaccuggacugcaagccaaagcgacaagagaagcccagaaaagaaccgcggcuggcauaaugaaaaacccgacaguagacggaauaguggccauugauuuagacccuguaguauaugacgcgaaauuugaaaagcagcuaggacaaauuaugcuucuaaucuuaugcacaagucaaauauuacuaaugagaacaacaugggcccuaugugagucuauuaccuuagcgacagguccauuaacaacuuugugggaaggaucuccagggaaauuuuggaauacuaccaucgccguuuccauggccaauaucuuuaggggaucuuauuuagccggugcggguuuagcguuuagucuaaugaaaucacuaggaggaggaaggcgcgguacaggugcucaaggcgagacauuaggagaaaaauggaaaagacaauuaaaucaacugucuaaaagcgaauuuaauaccuauaaaaggagcggaauuauggaaguggaucgaucagaagcgaaagaaggguuaaagcguggcgaaacaacgaaacacgcaguuucucgaggaacugccaaguuaaggugguuuguggagcgaaaucuuguaaagcccgaagggaaaguaauagacuuaggguguggacgaggcggguggagcuauuauugcgcaggauuaaagaaaguuacggaaguuaaaggauauaccaaaggugggccgggacaugaggaaccaauccccauggccacuuaugguuggaaucuagugaaauuacacaguggaaaagacguuuucuuuauaccuccagaaaaaugcgacacucuccugugugacauaggugagucaucgccaaauccaacuauagaagaagggagaacccuaagaguauugaaaaugguagaaccuugguuacguggcaaucaauucugcauaaaaaucuugaacccguauaugccgucgguuguagaaacauuggagcaaaugcaaaggaagcacgguggaaugcuugugagaaacccccuaucacgcaacaguacucaugaaauguacuggguaucaugcggaacuggcaacauaguuuccgcuguuaauaugacuuccaggauguuacuaaauagauuuacgauggcccauagaaaaccuacuuaugaaagagaugucgaccuaggagcugguacucgucacguugcagucgaaccggaaguagcuaauuuagacaucauagggcagcguauugaaaauauuaaacacgaacacaagucuacauggcacuaugacgaagauaacccauacaagacaugggcuuaccauggcucauacgagguaaagccaucaggaucagcaagcuccauggucaauggagugguaaaauuacucacuaaaccuugggauguaauaccaaugguuacacaaaucgcuaugacggacacaacgccuuuuggacaacaacgagucuucaaagaaaaaguagauaccaggacuccuaaagcaaaaagaggaacagcucaaaucauggaaguaacagcgaaauggcuauggggauuccuuucacguaacaagaaaccucguauauguacacgugaagaauuuacaagaaagguaagauccaacgcugccaucggugcaguuuuugucgaugaaaaucaauggaacucagcaaaggaggcugucgaggacgaaagauucugggacuuaguacauagggaacgagaguuacauaaacaagguaagugugcaaccugcguuuauaauaugaugggaaaaagagagaagaaauuaggagaguucgggaaagcuaaggguagucgcgcuauuugguauauguggcuuggagccagauuuuuagaguucgaagcgcuuggguuuaugaacgaagaucacugguuuucucgagaaaauucccuuucagggguggagggcgaaggccuucacaaauugggauauauuuuaagagacauaaguaaaauacccggagguaacauguacgcagaugauaccgcuggaugggacaccaggauuacugaagaugauuuacaaaaugaagcuagaauaacugauaucauggaaccggaacacgcguugcuagcgaaaagcauauuuaaauugaccuaccagaacaaaguaguaagaguacaacgacccgccaaaaauggaacaguaauggauguaauaagccggagagaucaaagagguucgggacagguugguacauauggauuaaacaccuucacgaauauggaagcccaacuaauucggcagauggaaucagaaggaauauuuucuccaagcgaauuagaaacaccgaaccuugcggaacgcguucucgauugguuagaaaaauauggagucgaaaggcugaaacgaauggcaauauccggcgacgacugcgucgucaaaccgauugacgaccgguucgccacagcauuaacagcgcuaaaugauauggggaaggucaggaaggacauaccccaaugggaaccuucuaaagguuggaaugacuggcaacaaguaccguucuguucacaccacuuucaucaacuaauaaugaaagacgguagagaaauaguagugccauguaggaaucaggaugagcuuguaggcagagcaagaguaucccagggagcaggauggagucuucgagaaacugcgugccucgggaaguccuaugcucaaauguggcagcuaauguacuuucacagacgcgauuuacgacuagcugcaaaugcgauauguagcgcuguaccuguugauuggauaccuacgucucgaacuacauggucgauacaugcccaucaccaguggaugacaaccgaagacaugcuuaguguauggaaccguguguggauagaagagaaccccuggauggaagauaaaacacauauuucuagcuggggugauguacccuaucuugguaaaagggaggaccaauggugugguucauuaauuggauugacagccagagcaaccugggcaacuaacauucaagucgcaaucaaucaaguaagacgcuuaauuggaaaugagaacuaucucgauuacaugacuucgaugaaaagauuuaaaaaugaguccgauccagaaggcgccuuaugguaa

SEQ ID NO: 21542 - RNA, 9879 nt, Artificial Sequence
  derived and/or modified CDS sequence (opt6) from DENV-1__FJ410207__SS-prME
ucuguuacuauguuacucauguuaaugcccacugccuuagcauuucauuuaacaacgcgcgguggggagccacauaugauugucaguaaacaagaaagagggaaaucacuccuauuuaaaacuucugcaggaguaaacauguguacucuuauagcuauggauuuaggggaauuuugugaagacacaaugacauauaaauguccaagaauuacagaagccgaaccugaugacguugauuguugguguaacgcgacugauacguggguuacauauggaacguguucacagacuggugaacauagacgagacaaaaggagugucgcucuagcaccucauguuggguuaggacuagaaacgagaacugaaacuuggaugagcagugaaggggcauggaaacaaauccaaagaguggagacgugggcucucagacauccaggauuuaugguaauagcguuauuuuuggcgcacgcuaucggaacuucaaucacucaaaaaggcaucauuuucauacuccuuaugcuagugacacccaguauggcgaugcguuguguagggauaggaucuagggacuuuguagaagguuuaaguggugcaaccuggguagacguaguauuagagcauggaagcugcguaaccacaauggcaaaagauaaaccgacguuagauauagaacuauuaaagacugaaguaacgaauccugcuguucuucgaaaauuguguauagaagcuaaaauaagcaauacuacgacggacucaagauguccuacucaaggagaagcaacacugguagaagaacaggacgcaaacuucguuugccgaagaacguucguagaucggggcugggguaacggcugcgggcuauuuggaaaggguagccuaauuacgugugcgaaauucaaauguguuacaaaacuggaagguaaaacuguacaauaugaaaaucuuaaauauucaguaauuguaaccguucauacaggggaucaacaucaaguaggaaacgaauccaccgaacaugggacaaccgccaccaucacuccucaagcuccaaguacagaaauacaauugacugacuacggggcacuaacccuagauuguuccccucgaacuggacuagauuucaaugaaauggugcuacucacuaugaaggagaaaagcugguuaguucacaaacaaugguuucuagacuugccuuugccuuggacuucuggagccucaacgucucaagaaacauggaauaggaaagacuugcuuguaacauuuaaaacugcucacgcgaagaaacaagaaguuguugugcucggcucacaggagggagcaaugcauacagcuuuaacgggagccacugaaauucaaacaucggggacaacgacaauauuugcaggacaccuaaaauguaggcuuaagauggacaaauuaacucucaaaggaaugucauacguuauguguacgggcucauucaagcuagaaaaggaaguagcagaaacacaacauggcacaguauuaguacaaaucaaauacgaaggcacagacgcaccuugcaagauaccguuuucuacccaagacgaaaaaggagugacacaaaaugggagauugauuacugcaaauccaauagucacagauaaagaaaaguugguuaacauugaagcugaaccuccauucggggaaucuuacauuguuauuggagcaggagaaaaagcacucaaacugaguugguuuaagaaggggaguagcauaggcaaaauguuugaggcuacugcuagaggagcacguagaauggcgauauuaggagauacggcuugggauuucgguagcauuggcgguguuuuuacaaguguaggaaaacuuguacaucagauuuucgggacagcuuacggcguauuguuuucuggcguaucuuggacaaugaagauagguauuggaguccuacucacuugguuaggacuaaauagcaggaguacuagcuuaagcaugaccuguauagccgucggguuagugacauuauaucugggagucaugguacaggcugacucaggaugugugauaaacuggaaagggagagaacugaaaugcgggucugggauauuuguaacaaacgaaguacauacuuggacagaacaauauaaguuccaagcagauucaccaaaacgauuauccgccgcuauagguaaagcaugggaggaagguguuugugggauuagaucagcaacgagauuggagaacaucauguggaaacaaaucuccaacgaacuuaaucacauucuucuugaaaacgauaugaaauucacagucguugugggagacguggcaggaauccuggcgcaagguaagaaaaugauacggccucaaccaauggaauacaaauacucauggaaaaguugggguaaggcaaagauuauuggagccgacguucagaacaccacauuuauaaucgauggaccaaauacccccgaaugcccggacgaccaacgcgcauggaacauaugggaaguagaggauuacggauuuggaauauuuacuacuaacauaugguuaaaauugagggauucuuacacgcaaguuugcgaucauaggcugauguccgcggcaauaaaggacucaaaggcagugcacgcagacaugggauauuggauagaaucugagaaaaaugaaacauggaaacuugcaagagcaucguucaucgaaguuaagacgugcauuuggccaaagucucauacucuauggucaaacgguguccuagaaucagaaaugaucauaccaaaaauauacggaggaccuauuucacaacacaauuacaggccaggauacuuuacacagacagcaggcccauggcauuuggguaaauuagaacuagauuucgaccuuugugaaggaaccacaguugugguggaugaacauugcggaaacagaggaccaaguuuacgcaccacaacuguaacgggaaaaauaauucaugagugguguugucgaucuuguacgcuuccuccacuuagauucaagggugaggacggauguugguauggaauggaaauaaggccuguaaaggaaaaagaagagaauuugguaaaaucaaugguaucggcggguucgggcgagguugacaguuucucauuaggucuuuuaugcaucuccauaaugauugaagagguuaugcgaucucguuggucaagaaagauguuaaugacaggaacacuugcaguauucuuuuuacugauaaugggucaguugacuuggaacgaucugaucagacuuugcauaaugguuggcgcaaacgccucugauagaaugggaaugggcacuacguauuuagcucuaauggcuacauuuaaaaugcgcccgauguucgcgguagguuuguuauucagaagauuaacaaguagggagguucuucuucucacuaucggguuaucacucguugccucaguugaacugccuaauucacuagaagaacugggagacggacuagcaauggggauaaugaucuuaaaguuacugacagauuuccaaucacaucaacuaugggccacguuauugagccuaacguucauuaagacaacauuuucacuucauuacgcuuggaagacgauggcaaugguacugaguauugugaguuuauucccguuauguuuaaguaccacuagccagaaaaccacgugguuaccagugcuacuuggaucccuugguuguaagccccugacgauguuucuuauugcggagaauagaauaugggggagaaaaucauggccgcuaaacgagggaauaauggccgucgggaucgucucaauacuauuaaguucuuugcucaaaaaugauguucccuuagcagggccuuugauagcuggaggaaugcugauugcuugcuacguuauaucaggaucaagcgccgaucucucccuagaaaaggccgcugagguuucaugggaagaagaagcugaacauagcggagcuucacauaauauccuaguggaaguccaggacgaugggacaaugaagauaaaagaugaggaacgagaugauacucuaacaauacuuuugaaggccacccuauuagccguaucgggugucuacccuuuaucuauaccggcuacgcuuuuugugugguauuucuggcagaagaagaaacaacgaagcggcguauuaugggacaccccaucuccaccggaaguagaaagggcaguucuugacgauggcauauauagaauuaugcagcgcggucuauuaggacgaagucaaguagggguugggguauuucaagaaaacguauuucauaccauguggcauguuacucguggcgcgguuuuaauguaccagggaaaacggcucgagccuagcugggcauccgugaagaaagauuugauuucuuaugguggugguuggcgucuccaggguucauggaauacuggugaagaaguucaaguuauugcaguagaaccugguaaaaaccccaaaaauguacaaaccgcaccugguacauuuaaaacgagugagggcgaaguuggggcuauagccuuggauuucaaaccugggacauccggaagcccgauuguaaauagagaagguaagauaguaggauuauaugggaacggggugguaacaacaucugggacguacguuagugcuaucgcucaagcgaaggcuucccaggaaggaccacugccugaaauagaggacgaaguauucagaaaaagaaacuugacaauaauggacuuacauccaggaaguggcaaaacaaggagguauuugccggccauugucagagaggccauaaagcgaaaauuaagaacacuaauauuagccccuacacgaguaguugccagcgaaauggcugaagcacucaaagggaugccuauucguuaccaaaccacugccgugaaaagugaacauacaggaaaagaaauuguagauuugaugugccaugcuacguuuacaaugagacuucuaucuccaguaagaguaccaaauuacaauaugaucauuauggaugaagcacauuucacagauccaucgucaaucgcugcucgcggauacauaucuacccggguaggaaugggagaagcagcugcaauauuuaugacagcgacgccuccagguaguguagaggcauuuccucaaucuaaugcuguaauacaagacgaagagagagauauuccagaacguucauggaacagugguuacgaguggauaacugacuucccugggaagacugucugguucguaccgaguauuaaauccgguaaugacauugcgaauugucuaaggaaaaacggaaaaagaguuauacaauugucacgcaaaacguuugacacugaauaucagaaaacaaagaauaaugauugggauuaugucgugacaacagacauaucggagaugggagcaaauuuccgugcggaucgugugaucgauccgagacguuguuugaaaccugugauauuaaaagauggacccgagagggugauauuagcaggcccuaugccagucacgguggccagugcagcacaaagacgaggucgcaucggccgaaaccauaauaaagaaggugaccaauacauauacaugggacagccucuaaacaacgaugaagaccacgcgcacuggacggaagcaaaaaugcuuuuggauaauauaaauacaccagaagguauuauuccugcauuguuugaaccagagagagaaaaguccgccgccauagacggugaauauagauuacguggagaggcacgcaagaccuucgucgagcuaaugcgacguggggaccuaccaguauggcucucauacaaaguugcuagugagggcuuucaauacucugaccguagauggugcuuugauggcgaaagaaauaaucaagugcuggaggaaaauauggauguggaaauauggacuaaggaaggagaaagaaagaaauugagaccgagaugguuagacgcacgcaccuacagugauccccuugcauuacgagaauuuaaagaauuugcagcaggacgucgcucaguaaguggagauuuaauuuuagaaaucgguaaauugccccagcaucuaacucagagggcgcagaaugcauuagauaacuuaguaaugcuucacaacucugagcaaggugggagagccuauaggcaugcaauggaagaguuaccagacacaauagaaacgcugaugcucuuagcucucaucgcuguucuaacuggaggcguaacucuauucuuucuaagugguagggguuuggguaaaacaucaauaggauuauuaugugugauggcauccaguguauuauuauggauggcuucaguggagccccacuggauagccgccagcauuauauuagaguucuuucugaugguauugcuuauuccagaaccugauagacagagaacgccacaagacaaucaauuagccuauguggugauuggauuguuauuuaugauacuuacaguagcugcuaaugaaaugggucuccucgaaacuacaaagaaagacuuagguauaggacauguggcaguagaaaaucaucaucaugcagcgaugcucgacguggaucuacauccggccucggcauggacucuuuaugcuguagcaaccacuauaaucacuccaaugaugaggcauaccaucgagaauacaacagcuaacauaaguuugacagcaauagcaaaccaggcagcaauucuuaugggacuagauaaaggauggccaauaucgaaaauggauauaggcgucccuuuguuagcccuugguuguuacucacaaguuaaccccuugacgcuaacugcugcaguccuaaugcuuguagcacauuacgcuauaauugguccaggucuacaggcuaaagcaacucgugaagcucagaaaaggacagcagcagggauaaugaaaaacccuacuguggauggaauuguagcaaucgaucuugacccaguaguauaugaugcaaaauucgaaaaacagcuagggcaaauuauguuacuuauauuaugcaccucccagauauuguuaaugaggacaacgugggcucugugugaaucaauuacuuuagccacagggccauugaccacauuaugggaaggcucaccagguaaauuuuggaauacuacaaucgccguuucaauggcuaacaucuuuagaggaucauaucuugcaggagcuggacucgcauuuucacuaaugaaguccuuagggggaggucgacgggguacaggagcacaaggagaaacguuaggagaaaaauggaaaagacaauuaaaucagcuuagcaaaagugaauuuaacacguauaaacgguccggaaucauggaaguugacagaagugaagcuaaagaaggccugaaaagaggggaaacaaccaaacaugcuguaaguagagguacugcuaagcucagaugguucguugaaagaaacuuggugaagcccgagggaaaaguuauagaccuaggguguggacgaggcggauggucauacuauugugcagggcuaaagaaaguuacggaggugaaaggguauacaaaaggaggaccaggccaugaagaacccauaccaauggccaccuacggauggaaucuaguaaaguugcauuccggcaaagacguauucuuuacaccgccagaaaagugcgauacacuauuaugcgacaucggagaaucuucuccaaauccaaccaucgaagaaggcaggacacuacguguccugaaaaugguugaaccgugguugcggggaaaucaauucuguaucaaaauauuaaauccguauaugccuuccgucguagaaacgcuggagcaaaugcaaaggaaacauggagggaugcugguaaggaacccacucucacgaaacucaacucacgaaauguacuggguaucguguggaacgggaaauauaguaagugcgguaaauaugaccucaagaaugcuuuuaaaccgguuuacaauggcacacagaaaaccaacguaugaacgugauguugaucugggugcuggaacccgucacguugcuguugaaccagaaguagcaaacuuggacaucauugggcagagaaucgagaauaucaagcaugaacauaagucgaccuggcacuaugaugaagauaauccauacaagacuugggccuaucaugguuccuaugaagucaaaccuagcgguucggcuucgucaaugguaaaugguguuguaaaacugcuuaccaaacccugggacguaauucccaugguuacacagauugcaaugacagacacuacuccguuugggcagcaaagaguuuuuaaagaaaaaguagauacaagaacccccaaggcgaaaagaggcacugcacagauaauggaaguaacagcuaaauggcuaugggguuuccuuaguagaaauaagaaaccgagaauauguaccagagaagaauuuacacgaaagguuagaagcaacgcagcgauaggagcaguguuuguugaugaaaaucaauggaacucagcaaaagaagcgguugaagaugagcgcuucugggaucuaguacaccgugaacgggaauuacauaaacaaggaaagugugcaacuugcguauacaauaugaugggaaaaagagaaaagaagcuaggcgaauuuggaaaggccaaaggaucgagagcgaucugguauaugugguuaggagcgcgguuccuggaguucgaagcauuaggauuuaugaaugaagaucauugguuuucaagagaaaacucgcuguccgggguggagggagaaggauuacauaaauuaggauacauauuaagggauaucaguaagaucccuggggguaauauguacgcagaugacacagcuggaugggauacccgcaucacugaagacgaucuacagaacgaagcgaaaaucacggacauaauggaaccugaacaugccuugcucgcaaagucgaucuucaaacuaaccuaucaaaauaaaguaguucguguacaaaggccagcuaaaaacggaacagucauggacgugauauccagacgcgaucaaagaggaucaggacaggugggaaccuacggucuaaauacguuuacaaauauggaagcacaauugauuagacaaauggaauccgagggaauuuuuaguccgucagaguuagagacgccaaaucuagcagguagaguguuagauuggcuagaaaaacauggaguggaacgacuuaagcguauggccauaagcggagacgauuguguaguuaaacccauugacgacagauuugcaaccgccuugacagcuuuaaaugacaugggaaaaguaagaaaagauaucccacaaugggaaccuagcaaagguuggaacgauuggcaacaaguuccuuucuguucccaccauuuccaccaacuaauaaugaaggacgguagagaaauagucguuccaugucgcaaccaggacgaguuagugggucgagcuagggucucacagggugcaggguggucucugagagaaacagcgugucuuggaaaauccuaugcgcaaauguggcaauuaauguauuuucacagaagggaucuacgacucgcagcuaaugcuaucuguuccgccguacccguagauugggugccuacaagcagaaccacuuggaguauccaugcacaucaccaauggaugacaacagaagauaugcugucaguguggaauagaguauggauugaagaaaauccuuggauggaggacaaaacacacauaucgucauggggagauguaccuuacuuaggcaagcgugaagaucaaugguguggaucucuuauaggauuaacagcccgugcgacaugggcuacuaacauucaaguagcuauaaaucaaguacguagacuaauagguaaugaaaauuauuuagacuacaugaccucaaugaaacgauuuaaaaaugaaagcgauccagaaggcgcuuugugguga

SEQ ID NO: 21543 - RNA, 9879 nt, Artificial Sequence
  derived and/or modified CDS sequence (opt6) from DENV-1__FJ432744__SS-prME
ucaguaacuaugcuccuaauguuaaugccuaccgcucuugcguuccaccucacuacacguggaggggaaccccacaugauaguuuccaaacaagaacguggcaaaucacuucucuuuaaaaccagugcuggaguaaauauguguacacuaaucgcaauggauuuaggugaguuuugcgaagacacaaugacuuacaaauguccacgaauaacugaagcggaaccggaugacguagacugcugguguaaugcaacagauacaugggugacauauggaacuugcucacaaacaggagaacauaggagggauaaacgguccgucgcuuuggcaccacacgucgguuuaggucucgaaacaaggacggaaaccuggauguccagugaaggggcauggaaacaaauacaacgagucgaaacuugggccuuaagacaucccggcuuuacagucauugcacucuuuuuagcucaugcgauugggacauccauaacgcaaaaaggaaucauuuucauacuccucaugcugguuaccccuagcauggcuaugcgguguguaggaauaggaagccgagacuuuguagaaggauuguccggcgcuacauggguagauguaguuuuggaacaugguucaugcguuacuacuauggcgaaagacaaaccgacacuagauauagaacuauuaaaaacugaaguaacgaacccagcgguacuucguaaacuaugcauagaggcgaaaauuagcaacacgacgacagacucaaggugucccacacaaggcgaagcaacucuaguagaggagcaagacgcaaauuuugucuguaggagaacauuuguggaucgcgguuggggaaacgggugcggacucuucggaaaagggucccuuauuacgugugcgaaauuuaaaugcgugacuaaacuugaaggaaaaacgguccaauaugaaaaccuuaaauauagugucauagucacaguacauacuggugaucaacaucaaguggggaaugagucaacagaacauggaacuacugccaccauuaccccacaagcaccaucaacggaaauccaauuaacagacuacggagcccuuacucucgacuguucucccagaacaggauuagacuucaacgagaugguacuacucacaaugaaagaaaaggcgugguuaguccauaagcaaugguuucuagauuuaccauuaccauggacgucaggugcaaguacuucucaagaaacauggaaucggaaagaccugcuagugacauuuaaaaccgcacacgccaagaaacaagagguuguuguguuaggcucgcaagaaggagcaaugcauaccgcacuaacuggcgccaccgagauccaaacuucaggaacaacaacgauauucgcaggacauuuaaaaugccgacuaaaaauggauaaauuaacccucaaaggaaugaguuacguaauguguacugguucuuuuaaacuugagaaagaaguagccgaaacacagcacggcacgguccuuguacagaucaaauaugaaggcacagacgcuccauguaaaauaccauucuccacgcaagaugaaaaagguguaacacaaaauggccgccuaauaacagcaaaccccauaguaacagauaaagaaaaaccgguaaauaucgaagccgagccaccauucggagaaucauauauugucaucggugccggagaaaaagcacuaaaacuuucuugguuuaagaaagggucaucaauagguaagauguuugaagccacugcgcgcggggcacguagaauggcaauucugggcgacacagccugggacuucggaucuauuggugguguguucacuucuguuggcaaacugguacaucagauuuucggcaccgcuuauggagugcuauuuucgggaguaucauggacgaugaagauagggauaggugucuuauugacauggcuagggcuuaacucuagaaguaccucacucaguaugacaugcauugcuguggggcuuguaacauuguauuuagggguuaugguucaagcagacaguggauguguaauaaauuggaaagggagagaauugaaaugugguuccggcauauucguuacaaaugaagugcauacuuggacggaacaauacaaguuucaagccgauagcccaaaaagacuaagcgcggcgauaggcaaagcaugggaagaaggggugugugguauaagaucggcuacgcgauuagaaaauauaauguggaaacaaauuaguaaugagcuaaaccauauauuauuagagaaugacaugaaauuuacaguuguaguaggggacguagccggcauuuuagcucaagguaagaaaaugauacguccgcaaccaauggaguacaaauacaguuggaaaucuugggguaaagcuaaaauuauaggggcagauguacaaaacgcgacuuucauaaucgacggaccuaauacacccgaaugcccugaugaccaaagagcuuggaauaucugggagguugaagacuauggauuuggaaucuucacaacgaauauauggcuaaaauuacgugacuccuauacacaggucugugaucaccgauugaugucugccgcgauaaaggauucgaaagcuguucacgccgauauggguuacuggauagagucugaaaagaaugaaacuuggaaauuggcccgcgcaucauucaucgaagugaaaacauguauuuggccuaagucgcacaccuuauggagcaacggcgugcucgaauccgagaugauaauaccuaaaauauacgguggaccgauuagucagcacaauuauagaccuggauauuuuacucagacggccgggccauggcauuuggguaaacuugaguuagauuucgaccuaugugaagguaccacugucguuguggacgagcauuguggcaauagaggucccagcuuaaggacgacuacagugacagggaaaauaauacaugagugguguuguagguccugcacauuaccgccgcuaagauucaaaggagaggauggauguugguaugguauggaaauucgcccagugaaagagaaggaggaaaaucugguaaagaguauggucagugccggaagcggagaaguagauuccuuuucccuuggacuuuuauguaucagcaucaugauagaagaggugaugcgcaguagauggagcagaaagauguugaugacugggauucuggcaguauucuuuuugcucaucaugggucaacugacauggaacgauuuaauaagacuaugcauaaugguuggugcaaacgccucagacaggaugggaaugggcacuaccuaucuggcauuaauggcuaccuuuaaaaugagaccuauguuugcaguaggcuugcucuuuagaaggcuaacuucacgugaaguauuauuauuaacaaucggucugucauuaguagcuucuguagaacuuccuaauucauuggaagaacuaggugacggacuugcgauggguauuaugaucuuaaaacuacugacagauuuucaaucacaccaacuaugggcuacacuacuaaguuuaacuuucauuaaaaccacuuuuucacuucauuacgcauggaagacaauggcuaugguauuauccaucgucagcuuauuccccuuaugccuaagcacaaccagucagaaaacuacguggcuuccgguccuguuaggaucucucggauguaaaccucuaacuauguucuuaaucgcagaaaacaaaauuugggguaggaaauccuggccacuuaaugaaggaauaauggcuguaggaauugugucuaucuuacucaguucuuugcuuaaaaaugacguaccuuuagccggaccucuuaucgcgggugguaugcuaaucgccuguuaugugauuucagguucaucggcagauuuaagucucgaaaaagcugcagaagugagcugggaagaagaagcugaacacaguggagcgucacauaacauacucguagagguacaagaugaugggacaaugaaaauuaaagaugaagaacgugacgauacacuuaccauacucuuaaaggcaacccuucuagcugugagugguguauacccguuguccauacccgcgacgcuauucguaugguauuucuggcagaagaagaaacgaaggaguggaguauuaugggacacuccaucuccaccagaagucgaacgagcgguucuagaugauggaauauaucgcauuaugcaaagaggacuacuagguaggucccaagucggcguagguguuuuucaagaaaauguauuucauacaauguggcacguaacuagaggggcuguuuugauguaucagggaaaaagacuugaacccagcugggcuucaguuaagaaagauuuaauuucauauggugguggguggaggcuccaaggaucuuggaauacuggcgaagaaguucagguuauugcgguggaaccagggaaaaauccuaaaaauguucaaacggcaccggguacauuuaaaacaagugagggggaaguuggcgccauugcauuagauuuuaaaccagguacuuccgguagcccaaucgucaauagggaggguaagauaguaggauuauacgguaauggagucguaacuacauccggaacauacgugagcgccauagcacaagcuaaagcgucccaggaaggcccacugccagaaaucgaagaugagguauuucguaagagaaauuugaccaucauggacuuacaucccggaucaggcaaaacaagacgauacuugccggccauugucagagaagccauaaaacgaaagcuacgcaccuuaauauuagccccuacaaggguaguagcaucugagauggcagaagcucuaaaaggcaugccaauuagauaccagaccaccgccgugaaauccgaacauacaggaaaagaaauaguggauuuaaugugucacgcgacauucaccaugagauuauuaagcccuguucguguaccaaauuauaauaugauuaucauggaugaagcucauuuuacggaucccaguucaauagcggcacgcgguuauauaagcacaagaguaggaaugggugaagccgcugcaauuuuuaugacagcaacuccaccaggcucaguagaagcauucccucaaaguaaugccguaauacaagaugaggaacgagauaucccugaaagaucauggaacucagguuacgaauggauaacagacuuuccaggcaaaacgguaugguuugugccuucuauuaagagcggcaacgacauugcaaauugucuaagaaagaacggcaaacgaguuauacaacuuuccagaaaaacauuugacacggaauaccagaaaacuaaaaauaaugacugggauuaugugguaacuaccgacaucucugaaaugggagcuaauuuuagagcugaccgagugauagacccccggcgaugucuaaagcccguuauacucaaagacggaccagaacgcgucauauuagcugguccaaugccgguuacuguugcaagcgcagcgcaaagaaggggucgaauuggaagaaaccacaauaaagaaggagaucaauacauuuauaugggucagccacucaacaacgacgaagaucacgcucauuggacggaagcaaaaaugcuuuuagacaauauuaauaccccugaagguauaauaccugcacuauucgaaccagaacgugaaaagucagcagcuauagacggggaauaucgguuaagaggggaagcuagaaaaaccuuugucgaacuaaugagaagaggagacuuacccguaugguuauccuacaaaguagcaucggaaggguuucaauacucugauaggcguugguguuucgacggagaaagaaauaaucaaguucuugaagaaaauauggauguugaaauauggacaaaggaaggagaaagaaagaaauuaagaccuagauggcuagacgcaagaacuuacucugaucccuuagccuugcgcgaauuuaaagaauuugcugccgguaggagaucaguaagcggagauuugauucuugaaaucggaaaauuaccacagcacuuaacacaacgggcccaaaaugcucucgacaacuuagucauguuacauaauucugaacaagguggcagagcuuaccggcacgcgauggaagaacuaccugacacgauagaaacacucaugcuucuggcauuaauagcaguucuaaccggugguguuacuuuguucuuucuaagcggacgaggacuagggaagacuucaaucgggcucuuauguguuauggccucgagcguacuccucuggauggccucuguugaaccacauuggauagccgcuucaauaauacuugaguucuuucuaaugguauuguugaucccggagccugauagacaaagaaccccacaagacaaccaauuagccuacguuguuauugggcuauuauuuaugaucuuaacaguagcugcaaacgaaaugggauuacucgaaacaacgaagaaagauuuaggaauaggucauguagcggucgaaaaccaccaccacgcugcaaugcuugauguagaccugcacccagcaucagccuggacacucuaugcuguagcuacaacaauaauaacaccgaugaugcgucacaccauagaaaauacaacagccaauauaucauuaacagcaauagcgaaucaagcugcuauacucaugggguuagacaaaggguggccgaucaguaaaauggacauuggcguuccccugcuugcacuagguuguuauagucaggucaacccgcuaacguuaacagcggcaguauuaaugcuuguggcacauuaugcaauaauaggaccgggauuacaggccaaagcaacacgagaagcacaaaaacgaacggcagccggaauaaugaagaauccuacaguggaugguauuguggcaauagauuuagauccaguaguauacgauaccaaguuugaaaaacaacuaggccaaauaauguuacuuauauuguguacaucacaaauacuccucaugagaacaacaugggcgcuaugugagucgaucacucucgcgaccgguccauugaccacacucugggaagguaguccagguaaauuuuggaacacgaccauagcugucucgauggcaaacauuuuuagggguagcuaucuagccggcgcaggacuagcauuuucacuaaugaaaucgcuagggggcggacggagagguaccggcgcacaaggagagacucuaggagaaaaauggaaacgacaauugaaucagcuaucuaaaagugaguucaauacuuauaagaggucaggcauuauggaaguagauaggucagaagccaaggaagggcuaaaacgaggugaaacaacaaaacaugcggugagccgugguacagcuaaguuacgaugguucguagaaagaaaucuugucaaaccagaaggaaaggugauugacuuaggauguggacgagguggcugguccuacuacugugcagggcuuaagaaaguaacagaagucaaaggauauacaaaaggagguccgggccaugaagaaccaauuccuauggcuacuuaugguuggaaccuaguuaagcuccacaguggaaaagacguauucuuuauuccacccgaaaaaugcgauacccuuuuaugcgacaucggugaaucuucuccuaauccuacuaucgaagaaggaagaacgcuaagaguucuuaaaauggucgagccuuggcugcgcggcaaucaauucugcaucaaaauauuaaacccauacaugccuaguguaguagaaacgcuugaacaaaugcaaaggaagcauggaggaauguuaguucggaauccccugagcagaaacucaacccaugaaauguauugggucaguugcgguacugggaauauaguuucagccguaaacaugaccucaaggauguuacuuaaucgcuuuacuauggcgcaucguaaaccuacauaugaaagggauguugaccugggcgccggaacgaggcacguagccguagagccggaaguagcaaaucuagacaucauaggacaacgaaucgaaaacauaaaacaugagcacaagucgacauggcauuacgacgaagacaacccauacaaaacaugggcauaccaugggaguuacgagguuaagccaucuggcucugcuucuuccauggugaacggaguuguuaaguuacuuacuaaaccgugggauguaauaccuauggugacacaaaucgcaaugaccgacaccacaccauucggucaacaacggguauucaaagagaaaguugauaccaggacuccaaaagcgaaacgagggacagcucaaauaauggagguuacugcaaaaugguuauggggauuccucaguagaaacaagaaaccacgcauaugcaccagagaagaauuuacaagaaaaguacgcaguaacgcugcuaucggcgcaguuuucguagacgaaaaucaauggaacagugcuaaagaagccgucgaagaugagcgauuuugggaccuuguccauagggagagggaguuacacaaacaagguaaaugcgcaacuugcgucuauaauaugaugggcaaacgggagaagaaauugggugaauuuggcaaagcaaaagggucaagagcaauaugguacaugugguugggagcgagauuucucgaauuugaggcauuaggauucaugaacgaagaucauugguuuucaagagagaacuccuuaaguggaguugaaggagagggauuacacaaguuaggcuacauacuuagagacauaaguaaaauaccgggugggaacauguaugcagaugauacggcaggaugggacacuagaaucacagaagaugaccuacaaaaugaagcaaaaauaacggacauaauggagcccgaacaugcacuucuugcuaagucaauuuuuaaauuaacguaucaaaauaagguuguaaggguucaacguccagccaaaaaugguacagugauggauguuauuucacguagagaucaacggggaucaggccaaguaggaaccuaugguuuaaacacauuuacuaacauggaagcucaguuaauucgucaaauggagagcgagggaaucuuuagcccaagugaacuugaaacaccuaaccuugccggaaggguacuagauugguuagaaaaacacggcguggaacgacuaaagagaauggcgauaucuggugaugacuguguagugaaaccaaucgacgauagauucgcaacagcacuaacugcgcuuaacgacaugggaaaagucagaaaagauauaccacaaugggaaccuucgaaaggauggaaugacuggcaacaaguuccuuuuugcucacaucacuuucaucaacucauaaugaaagacggacgugaaauuguagucccgugcagaaaccaggacgaauuaguuggaagggcgcgaguaucccaaggugcaggauggucuuuaagggaaacagcgugucuagguaagucauaugcccaaauguggcagcuuauguacuuccaccgaagggaccuccgacucgccgcaaaugcuauuugcagcgcaguaccugucgacuggguuccuacaagucggacuacauggagcauacaugcucaucaucaauggaugaccacagaagacaugcuuucaguauggaaccgaguauggauagaagaaaaucccuggauggaagacaagacacacauaucgucguggggcgaugucccauaccuaggaaaaagagaagaucaauggugcggaagucugauaggacuaacagcuagagcuaccugggcaacaaacauucaaguagcaaucaaucaagugcgaagauuaauaggaaacgagaauuaccuagauuacaugacaucuaugaaacguuucaaaaaugaaauugaccccgaaggcgcacuaugguag

SEQ ID NO: 21544 - RNA, 9879 nt, Artificial Sequence
  derived and/or modified CDS sequence (opt6) from DENV-1__FJ547060__SS-prME
agcguaaccaugcuauugaugcuaaugccgacugcauuggcauuucaucucaccacuagagggggagaaccucauaugauugugaccaaacaagaacgugggaaaucgcuuuuauuuaaaacgucagcuggagugaacaugugcaccuuaauagcuauggacuugggagaacuaugcgaagauacaaugacuuauaaaugcccaagaauuacagaagcagaaccugaugacguagauugcugguguaaugcuacagacacauggguaacauaugguacaugcucgcaaaccggagaacacagaagagacaaaagaucuguagcacuagcgccucauguugguuuaggacuggaaacaagaacggaaacauggaugucaagugaaggcgcauggaaacaaauacaaagaguagaaacuugggcccuacgccacccaggauucacgguaauugcacuguuccucgcccaugcuauaggaacauccauuacgcaaaaaggaauaaucuucauccuucuuauguuggucaccccgaguauggccaugcgguguguaggaauaggaagccgagauuucguugaaggccuuucaggagcaacuuggguagacgugguccuugagcacggaucuugcguaacaacuauggccaaagauaaaccuacccuagauauagaauuacuaaaaaccgaaguaacuaauccagcaguccuacgcaaauuaugcauagaggccaaaauaucaaauacuacaacagacucgcgaugcccgacccagggugaagcaacuuuaauggaggaacaagacgcaaacuuuguauguagaagaacuuucguugauaggggauggggaaauggguguggcuuauuuggaaaagggagccuuauaacaugugcaaaauucaaaugcguuacgaaauuagaagguaaaauaguacaguaugagaaccuaaaauauagcguaauuguaaccguacauacaggagaucaacaucagguuggcaaugaaaguacagaacauggcacaacagcuacaaucaccccacaagcaccuacauccgaaauacaacucacugauuauggagcacuaacccuagauuguaguccucgaacaggucucgauuuuaaugaaaugguacucuuaacaaugaaagaaaaaucgugguuagugcacaaacaaugguuccucgauuuaccucuaccauggaccaguggagcgaguacaagucaagaaacauggaauagacaagauuuacuggucacauuuaaaaccgcacaugccaagaaacaggaaguugucguguugggaagccaggaaggagcgaugcauacagcgcuaaccggcgcaacugaaauucaaacaagugggacgacuacaaucuuugcaggucacuuaaaauguagauugaaaauggauaaauugacucugaaaggaaugucguacguuaugugcaccggcucauuuaaacuagaaaaagaaguagcagaaacacaacauggaacuguucuuguacagauaaaauaugaagggaccgaugcuccauguaaaauccccuucucuacacaagaugaaaaaggggucacucagaauggaagacuuauaacggcaaauccgauagucacagacaaagaaaaaccaguaaauauugaagcggagccgcccuucggugagaguuacauuguaauaggagcuggagagaaagcccuaaaacugucuugguucaagaaagguaguucaauaggcaaaauguuugaagcaaccgcgagaggagcacggcgaauggcaaucuuaggggauaccgcaugggauuuugggucuaucggugguguauuuaccagugugggaaaauuaguucaucaaauauucgguacagccuaugguguguuauuuagcggaguuagcuggacaaugaaaaucggaauaggaguucuacuaacgugguugggcuuaaauaguagaucaacuucuuuaucaaugacuuguauagcaguuggucuaguuacgcucuaccuagggguaauggugcaagcugauucuggguguguuaucaacuggaaaggccgggaacucaaaugcggaaguggaaucuuuguuacuaaugagguccacacguggacagaacaguauaaauuucaagcagauagcccuaaaagguuaucugcagcaaucgguaaggcuugggaagagggcguaugcgguauacgaucagcuacaagauuagaaaacaucauguggaaacaaauaucgaaugagcuaaaucauauucuccuggaaaacgauaugaaauucacaguuguuguaggugacguaguagggauccuugcucaagguaagaaaaugaucagaccacaaccgauggaacauaaauauucuuggaaaucguggggaaaagcuaaaaucauuggugcagauguacaaaauacaacguuuauaaucgacggaccaaauacuccagagugcccagaugaucaaagagcuuggaauauuugggaagucgaggauuacggauucggcauauucacgacaaauaucuggcuaaaacuccgugauucuuauacgcaaguaugugaccauaggcugaugucagccgcaauaaaagacuccaaagcagugcacgcggauaugggauacuggaucgagagugaaaagaaugaaaccuggaaacuggcuagagcuucguucaucgaaguaaaaaccuguauauggccaaaaucacacacgcuauggaguaauggaguauuagaaagugaaaugaucauaccgaaaaucuauggagggccaauaucccagcauaauuaccgaccaggauauuuuacccagacagcagguccguggcauuuaggaaagcuagaacuugauuuugauuuaugugaaggaacgacggucgucguagacgaacauugugguaaucgaggcccgagccuacgaacaacgacuguaacagguaagaucauacaugagugguguugcagaucuuguacucuaccaccgcugcgguucaaaggagaagauggguguugguauggaauggaaauaagaccggugaaagaaaaagaggaaaaccuuguuaaaaguaugguuucugccgguucgggagaggucgacagcuucuccuuaggacuuuugugcauaucuauaaugauagaagaggucaugaggagucgauggaguagaaaaaugcucaugacgggaacuuuagcaguauuucuucuguuaaucaugggacaacugaccuggaaugaccuuauacgauuauguauuaugguaggugcuaaugcaagugacaggauggggauggguaccacuuacuuagcacuuauggcuacguucaaaaugaggccuauguucgcgguaggccuauuguucagaaggcuaacaucuagggaaguauuauuacuaaccauuggauuaagccugguggcgucagucgaacuaccuaauagucuagaagaauuaggagacggcuuagcaaugggcaucaugauuuuaaaauuauuaacugauuuucaaucccaucaauuaugggcgacauuacucagucucacuuuuauaaaaacaacauuaucauuacacuacgcuuggaaaacuauggcuauggucuuaagcauaguaucauuauuuccuuuaugccuaagcacuaccagucagaaaacgacaugguuaccuguccuuuuagguaguuugggaugcaaaccauuaacaauguuucuaauagccgaaaauaaaauauggggaagaaaaucuuggccacuaaacgaggguaucauggcagucggaguuguuucaauauuacucucaucucuacuaaagaacgauguuccauuagcgggcccucuaauagcuggagguauguuaaucgcguguuacgugauauccgguagcagugcagaucuuucgcuagaaaaggcagcagaaguuucaugggaagaagaagcggaacacaguggagcaucacauaacauauuaguagagguucaagaugacgggacaaugaaaaucaaagacgaagaaagggacgauacacuaaccaucuuauuaaaggcaacucuauuagcgguuucaggaguguacccgcuuucaauuccugcuacucucuuuguuugguauuucuggcaaaagaagaaacagcguaguggaguuuuaugggacacuccuucuccuccagaaguugaaagagcuguauuagacgaugggaucuaucgaauaaugcaacgagggcuauuaggaaggucacaaguggggguugggguauuccaagaaaacguauuccauacgauguggcauguaacgcgaggugcuguauuaauguaccaaggaaaaagacuagagccauccugggcaucagugaagaaagaucugauaagcuacggcgguggauggcgcuuacaggguuccuggaauacgggggaggagguucaggugauugcugucgaaccaggcaaaaacccuaaaaauguacaaaccgcgccuggaacauuuaaaacgcccgagggagagguaggcgcaaucgcacuagacuuuaaacccgguacaucuggcucaccuaucgucaauagggaaggaaaaauaguaggacucuacggaaauggaguaguuaccacuucggggacuuacguaucggcuauugcacaaacuaaggcaagccaagaagggccucuuccagagaucgaagaugaaguauuucgaaaaaggaaccuuacaauaauggaucuacacccaggaucuggaaaaacaaggcgauaucuaccugcaaucgugagagaagccauaaaacgcaaacugcgaacucugauauuagcuccuacaagaguggucgcauccgaaauggcagaggcuuuaaaaggcaugccaauaagguaucaaacgacagcuguaaaaucggagcacacuggaaaggaaauuguagauuugaugugccaugcaacauucaccaugagacuauugucaccaguaagggucccaaauuauaacaugauuauaauggaugaggcacauuuuacggacccuucuucuauagccgccagagguuauauuucuacacguguagguaugggcgaggcagcagcuaucuuuaugacugcgacaccaccagggagcguugaagccuucccacaaucuaaugcuguaauccaagaugaggagcgagauauucccgagagaagcuggaauaguggguaugaguggauaaccgauuucccuggcaaaacuguuugguuugugccgagcauaaagucugguaaugauauugcuaauugccugaggaaaaacggaaaaaggguuauacaguuaaguagaaaaacguuugauacugaauaccagaaaacgaaaaacaaugauugggacuaugucgugacuacggacauaagugagaugggggcaaauuuucgagcugauagagugaucgauccucgccgcugccucaagcccguaauacugaaagauggaccagagcguguuauucuagcaggaccaaugccaguaaccguggcuucggcggcacaaagaaggggacguauagguagaaaucauaauaaggaaggugaccaauacauuuacaugggucaaccucucaauaacgaugaagaccaugcucauuggacggaagccaaaaugcuccuugacaauauaaauacaccugaaggaauaauaccagcauuauucgagccagaaagggagaaaagcgcagccaucgauggcgaauacagguugcguggagaagcgcggaaaacauucgucgaacuuaugaggcgaggggaucucccgguaugguugucuuauaaagucgcauccgaaggauuucaauacucggacagacguuggugcuuugauggcgaacguaauaaccaaguucucgaggaaaacauggacguagaaauauggacuaaagaaggagagaggaagaaacuacgaccccguugguuagacgcaagaacauauuccgauccauuagcgcuuagagaauuuaaagaauuugcagcagguagaagaucagugucaggugauuugauauuagaaaucggaaaacuaccacaacauuugacccaacgagcccaaaaugcguuagacaacuuaguaaugcuccauaauuccgaacaagguggacgcgccuaucggcacgcaauggaagaacucccggauaccauugaaacgcuaaugcuuuuggcucuaauagcuguucuaaccggaggaguaacauuguucuuucucagcggacgaggacuaggaaaaaccucaauaggauuauuaugcgugauggcaagcaguguauuguuguggauggcaucaguugagccacauuggauugcagcaucaauaauacuugaguucuuccuuauggugcucuuaauaccugaaccugacagacaacgaacuccgcaagauaaccaauuggcguauguaguaauaggucuccuuuuuaugauuuugacggucgcggcaaaugaaaugggucuucuggaaaccacaaagaaagauuuaggaauaggacacguagcaguggagaaucaccaucaugcaacaaugcuggauguggacuuacauccagcaucagcauggacucuuuaugcaguagcaacuacuaucauaacaccuaugaugaggcauaccauugaaaacacaacagccaauauaucacuaacggcuauugccaaccaagccgccauacuuaugggacuggacaaaggauggcccauaagcaaaauggauauugguguaccauuacucgcacugggaugcuauucacaaguaaauccauuaacuuugacggcugcuguacugaugcuaguagcgcauuaugcgauuauuggaccaggacuccaagcuaaggcaacacgcgaagcccaaaaacgaacugcggccggaauuaugaagaacccuaccguagaugggaucgucgcaaucgaucuagauccuguaguguaugacgcgaaauuugagaaacagcuuggucaaaucauguuauugauacuauguacaagucaaauacucuugaugcgcacuaccugggcacugugugaaagcaucacgcuggcaacgggaccuuuaacuacacucugggaaggaucaccagguaaauuuuggaacacgacaauagcagugagcauggcuaauauauuccgaggaucauaccuugcaggagcaggacucgccuucuccuuaaugaaaucacuaggagggggcagacguggaacuggugcacaaggugagacacuuggagaaaaauggaaaagacaacuaaaccaauuaucaaaaucugaauuuaacauauacaagagaucaggcaucauggaaguagauagaucggaagcaaaggaaggauugaaacgcggggaaacaacaagacacgcugucagccgcgggaccgcuaaacuucgaugguuuguggagaggaacuuaguaaaaccggaaggaaaagucauugacuuaggauguggccgaggaggauggucauauuacugcgccggacuaaagaaaguaacggaggucaaaggauauaccaagggaggaccuggucacgaagaaccuauaccaauggcaacauauggauggaacuugguuaaauuacauucaggaaaagacguguuuuucacuccuccagaaaaaugugauacacuucuaugugauaucggcgagucuagucccaauccaacaauagaagaaggaagaacauugcgaguauuaaagaugguugaacccuggcuaagagguaaucaguuuugcauaaaaauucuaaauccauacaugccgucuguuguugaaacccuagaacagaugcaaagaaaacauggagguaugcuaguacgaaaucccuugucucgaaacaguacgcaugagauguacuggguuagcugugggacaggaaacaucgucucugcuguuaacaugacaaguagaauguuacucaauagauucacaauggcacaucggaaaccgacuuaugagagggauguagauuugggugcaggaacuaggcauguagcuguagagccagaaguggcaaauuuggauauaauaggucagcguauugagaauauuaaacacgaacauaagucgacauggcacuacgacgaggacaacccguacaagacgugggcauaccauggaucuuacgaaguaaagcccucuggcucugcuucaucgaugguaaacgguguagugaaacugcuuacaaaaccuugggacguaauuccaauggugacucaaauagcaaugacugacacaacgccuuucggacagcaaagagucuuuaaggagaagguugacaccagaacacccaaggcgaagagagguacagcucaaauuauggagguuacagccagauggcucuggggguuuuuaagccgaaacaagaaaccuaggaucuguacgagagaagaguuuacgagaaaaguccgaucuaacgcugcuaucggggcagucuucguugaugaaaaucaguggaauagugccaaagaagcaguagaagaugaaagauuuugggaucuaguccaaaaggaaagagagcugcauaagcaagggaaaugcgcgacuugugucuauaauaugauggguaaaagagagaagaagcuaggagaauuuggaaaggccaagggaagcagagcuauuugguauauguggcucggugcucguuuccuugaguucgaagcucuaggauucaugaaugaagaccacugguucagcagagaaaauucuuuaucaggaguagaaggagaagguuuacacaaacuaggauacauacuucgugauauaucaaagauaccagggggaaauauguacgccgaugauacagcgggaugggauacccgaauuacugaagaugaucuucaaaaugaagcuaagauaacggauauaauggagccagagcacgccuuguuagcuacuucaauauuuaaacugaccuaucaaaacaaaguaguaagaguacagcgaccagcaaagaaugguacaguuauggaugucauuucgaggagagaccaaagagggaguggacaggucgguacauacggauuaaacaccuuuaccaacauggaggcgcaacugguuagacaaauggaaagugaagggauauucucacccugcgagcuagaaaucccaaauuuggcugagcgaguucuagauugguuagaaaaauacggaguggaacgacucaagcguauggccaucucgggugacgacugcguuguaaagccaauugaugauagauucgcaaccgcguuaacggcacugaacgacaugggaaaggugcguaaagauguuccgcaaugggaacccuccaagggauggaaugacuggcaacagguuccauuuuguagccaucauuuucaccaauuaaucaugaaggacggaagagagauuguuguccccuguagaaaucaagacgaguuagugggcagagcuagagucagucaaggugcaggauggucauugcgggagaccgcuugccugggaaaaaguuaugcacaaauguggcaacuaauguacuuucaccgacgagacuuaagacuugccgcaaacgcaauuuguagcgcgguuccagucgauuggguaccgaccagucgaacaacaugguccauucacgcacaucaucaauggaugaccacugaagauaugcuuagcgucuggaauaggguguggaucgaagaaaacccguggauggaggauaaaacgcaugugaguuccuggggugacgugccauacuuagguaaacgagaagaccaauggugcgguaguuuaauuggccuaacggcucgggccacaugggcgaguaacauucaaguagcgauuaaccaaguccgacgacuuauaggcaacgaaaauuaccuagacuacaugacaaguaugaaaagguuuaaaaaugaaggugacccagaaggagcccuuugguaa

SEQ ID NO: 21545 - RNA, 9879 nt, Artificial Sequence
  derived and/or modified CDS sequence (opt6) from DENV-1__FJ432745__SS-prME
agcguaacuaugcuucuaaugcugaugccuacagcacucgcauuucacuuaaccaccagggguggagaaccccacaugguugucaguaaacaagaaagaggaaaaucguuacucuucaagacaagcgcggguguaaauauguguacgcuaauagcaauggaccuuggagaauuaugugaagacaccaugacauauaaaugccccaggauaaccgaagcagaaccagaugacguugauuguuggugcaaugcaacagauacaugggugacuuaugggacauguagucaaacaggcgagcacagaagggacaaacgcagcguagcuuuagcgccgcacgucggauugggacuagaaacacggaccgagacauggaugaguagugaaggcgcguggaaacaaauucaaagaguagaaacaugggcucuuagacauccaggguucacagugauagcguuguuucuagcucaugccauagguacaucaauaacccaaaaaggaauaauauuuauacucuuaaugcucguuacuccgucaauggcaaugcggugcguaggcauugguagccgagauuucguagagggucuuucgggugcaaccuggguagauguuguauuagaacacgggucaugugugaccacaauggcuaaagauaagccgacauuagauauugagcuuuuaaaaacugagguaacaaauccugcaauuuuaaggaaguuauguaucgaagcaaaaauaucaaauacgacuaccgauaguagauguccuacacaaggagaggcaacccuggucgaagaacaagacgcaaauuucguguguagaagaacuuuuguugacagaggauggggaaacggauguggauuauuuggaaaggguucuuuaauuacgugcgcaaaauuuaaaugugugacuaaauuggaagguaaaauuguacaauaugaaaaucuuaaauacucugugauagucacaguacacaccggggaucaacaucaagucggcaaugaaucuacugaacacggaacgacugcgacuauaacuccgcaggcaccaaccacugaaauacaauuaacagauuauggcgcacucacguuagauuguagcccgaggacugguuuagacuuuaaugaaaugguucuccuaacuaugaaagagaaaucguggcugguccauaaacaaugguuucuugaccuuccacucccauggacaagcggagcaaguacaucacaagagacguggaaucgacaagacuuauuaguuacguuuaagacggcccacgccaagaaacaagaagucguagugcucggaagucaagaaggagcgaugcauaccgcucuaacaggagccacugaaauccaaacaagcgguacaacgacaauauucgcaggccauuugaaaugucgguuaaaaauggacaaacuuacacuaaaagguaugucguacgugauguguacuggaaguuuuaaauuagaaaaagaaguagcugaaacgcaacauggaacagucuuagugcaaauaaaauaugaagggacagaugcaccauguaaaauuccguucaguacacaagacgaaaaaggcgucacccaaaacgggagguuaauaacagcuaacccuauugugacagacaaagagaaaccgguaaauauagaggcagaaccuccuuuuggcgagucuuauauaguaauaggagcgggagaaaaggcuuuaaaacuaaguugguuuaagaaaggaucaaguaucggaaaaauguucgaagcuaccgcucgaggagcacgaaggauggcaaucuuaggagauaccgcaugggacuuuggaucuauuggggguguguucacaaguguuggaaaguuaguacaucaaaucuuuggaacggcguaugguguucuguuuaguggaguaagcuggacgaugaaaauaggguugggcguucuuuuaacauggcuaggauuaaauucuagaagcacuucauuaaguaugacaugcauugcaguuggauuagugacguuguauuuaggugugaugguacaggcugauuccggaugugugauaaauuggaaaggcagagaauuaaaaugugguaguggcaucuuuguaacaaaugaaguacacacauggacagaacaguauaaguuucaggcagacucgccuaaacgacuuucggcagccauugguaaggcaugggaggaaggugucugcggaaucagaagugccaccagacuggaaaacguaauguggaagcaaaucaguaaugaacuaaaucauauauuauuagaaaaugauaugaaguuuaccgucgucgugggugauguugcgggcauauuagcgcaaggcaagaaaaugauuaggccccaaccaauggaguauaaguauucguggaagucuuggggaaaagcaaaaaucauaggagccgacguucaaaauacaacauuuauuauagacggaccgaacacuccggaauguccagaugaccaaagggcuuggaacauuugggaaguagaagacuacggcuuugguauauucaccacaaauauaugguugaaacuccgugacucuuauacgcaagugugcgaccaucgguuaaugucagcggcuauuaaagacucuaaagcaguacaugcggacaugggguauuggauugagucagagaaaaacgagacauggaaguuggcucgagcuucauuuaucgaaguaaagacaugcauauggccuaaaucucauacacucuggucuaauggagugcuagaaagcgagaugauaauaccuaagauuuauggcggcccaauaagucaacacaauuaccgaccagguuacuuuacacaaacggcggguccauggcaucuagggaaauuagaacuagauuucgauuuaugcgaaggaaccacagugguaguagacgagcacugugguaaccggggaccaucauuacggacuacaacuguaacaggaaaaaucauucacgaauggugcugucgcucuugcacacuaccaccgcugagauuccgcggcgaggauggcuguugguaugggauggagauucgcccugugaaagaaaaagaagaaaaccuaguaaaaucuauggucucugcugguucaggcgaaguugauucauucagcuuggguuuacuauguaucucuauuaugauagaggaagugaugagaucccgauggagcagaaaaaugcuaaugacggguacacuagcuguauuuuuauugcuuauaauggggcaacuaacuuggaacgaccugauaagauuaugcaucauggugggggccaacgcuagcgaccgaauggguaugggaacgaccuauuuggcguuaauggccacauuuaaaaugcgaccgauguucgccguuggcuuauuauuucgaaggcuuacuagcagagaaguccuauuauugacgauuggauugucauuaguugcaucagucgaauuaccaaauucauuggaggaacuaggagauggacuagcaaugggaauaaugauacugaaacuucuuacggauuuccaaagccaucaacuaugggcuaccuuauuaaguuuaacuuucauaaaaacgacauuuucucugcacuaugcauggaaaacgauggcuaugguuuuaucgauaguaagccuuuuuccucugugcuuaucgacgacuucacagaaaacgaccuggcugccuguacuccucgguaguuugggauguaaaccauuaaccauguuucugauugccgagaacaaaauauggggaagacguagcuggccauugaacgaaggcauaauggcgguggguauaguaagcaucuuauugucaucauuauuaaagaacgauguuccacuagcagguccuuugauagcagggggcauguuaauagcgugcuacgucauaaguggcagcagugcugaucugucgcuagagaaagcagcagaaguaaguugggaagaggaagcggagcauucgggagccucccacaacauauuagucgagguacaagaugaugguacuaugaaaauaaaggaugaggaaagagaugacacucuuacuauccuauuaaaagcaacauuguuagcugucaguggaguauauccauuaucaauuccggcaacgcuguucguuugguacuucuggcagaaaaagaaacaacgaagcggaguauuaugggauacgccaucacccccugaagucgaaagggcagugcuugacgaugguauauaccgcaucaugcaacgugguuuacuaggucguucucaaguaggaguaggaguuuuccaagaaaacguauuucacacaauguggcauguuacacgaggggcuguucugauguaccaaggcaaacggcuagaaccaagcugggcuucagucaagaaagauuuaauaucauaugguggugguuggagauuacaaggaaguuggaacaccggagaagaaguacaagucauugcuguugaaccagggaaaaacccgaaaaauguacaaacugcgccuggaacauuuaaaacaccugaaggagaaguaggggcgauagcucuagacuuuaaaccggguaccucuggcagcccuauaguaaaccgcgaagggaaaauuguaggcuuguauggcaaugguguaguuacuacaagugguacguacgucagcgccaucgcacaagcaaaagcaucucaagaagguccuuuaccggaaauugaagaugaagucuuccgaaagagaaacuugacaaucauggaucuacacccaggaucaggcaaaacuagacgguaccugccugcaauaguacgggaagccauaaaaagaaaacuaagaacauuaauuuuagcgccaacaagaguaguagccucagagauggccgaggcccuaaaagguaugccgauaagguaucaaacgaccgcagugaagucugagcacacuggaaaagaaauagucgauuuaaugugucaugcuacauuuacuaugagauugcugaguccaguaagaguaccuaauuauaacaugauaauaauggacgaggcgcacuucacagacccaagcaguauagcagcacgagguuauaucaguacccgaguugggaugggagaagcugcugcuauuuuuaugacagccacgccacccggguccguugaggcauuuccucaaucaaaugccguuauucaagacgaagaaagggauauuccggagagaucguggaacucagguuacgaauggauaacagacuucccaggcaaaacgguaugguuuguaccuucaauuaagucggggaaugauauagcuaauugccuccggaagaaugggaaacgaguuauucagcugucacgaaaaacauucgacaccgaauaucagaaaacaaagaauaacgauugggauuaugucgugaccacagacaucagcgaaaugggagcuaauuuuagagcagaucgaguuauugauccacgccggugccuuaaaccuguuauauuaaaggacggaccagagcguguaauacuugcagguccaaugcccgugaccguagcuagugcagcacaacgacgaggucgaauuggacgaaaccauaauaaagaaggugaucaauauauuuauaugggacaaccgcugaauaacgacgaggaccacgcucacuggacagaagccaaaaugcuucuagauaacauaaacacucccgaagguauaauaccugcauuauuugaaccugaacgagagaaaucugcagcaauagauggcgaauauaggcuucggggugaagcaagaaaaacuuucguagaacuaaugagaagaggggacuuaccaguauggcuuagcuacaaagucgcaagugaaggauuucaauauucggaucgacguuggugcuuugacggggaacguaacaaucaaguucuagaagagaauauggauguagagauauggaccaaagaaggggagcguaagaaacuucguccgcggugguuagaugcaagaacuuauucagaucccuuagcuuuaagggaauuuaaagaauuugccgcugggaggagaagcguaaguggugaucuaauacuagaaauaggaaaacugccucaacaccuaacacagcgagcacagaaugcacuggauaauuuagugaugcuacauaauucagaacagggagggagggcuuacagacacgcaauggaggaacuaccggacacaauugaaaccuuaaugcucuuagcacuuauagcgguacuaaccggugggguaaccuuauucuuuuuaucuggucgcggguuaggaaaaacgagcauaggcuuguuaugcgugauggcuucuaguguauuauuauggauggccagcguagaaccgcauuggauugcugcuagcauuauacuagaguucuuucuaaugguacuacuaaucccagaaccugacaggcaaagaacaccacaggacaaucaauuagcguacgucguaauuggccuauuauucaugauacugacaguagcagccaacgaaaugggacuucuggaaacgacaaagaaagaccuagggauagggcaugccgcggucggcaaucaccaucaugcagcaaugcuggauguggaucuucaccccgcuagugcuuggacuuuauaugcuguugcgacgacgauuauaacaccgaugaugagacauacaaucgaaaacacaacagcuaauauaucccuaacagccauagcaaaccaggcggcaauucucaugggacuagacaaaggguggccaauaaguaaaauggacaucggagucccguuacuagcgcuaggauguuacagucagguuaauccacuaacauuaacugcggcugucuugaugcuagucgcccauuaugccauaaucgguccggguuuacaagcuaaggcuacacgggaagcgcaaaagcguaccgccgccgguauaaugaaaaacccgacaguggacggaauagucgcaauugauuuagacccaguggucuacgaugcaaaauuugaaaaacagcuuggacaaauaaugcuauuaauacuauguacuucacaaauauuauuaaugcgaacaacuugggcucuuugugaaucuauaacuuuagcuaccggacccuuaaccacgcuaugggaaggguccccagguaaguucuggaacacuacgauugcaguaucaauggcaaauaucuuccgaggaaguuacuuagcaggggcagggcucgcuuuuucuuugaugaaaagccuagguggcggucgaagaggaacaggagcacaaggagaaacacuuggagaaaaauggaaaaggcagcugaaccagcuaucuaaaucagaauuuaacacguauaaaagaucaggcauaauggaagucgauagaucagaggccaaagaaggacugaagagaggagaaacgacaaaacaugcgguuagucgagggacggcgaaauuacgaugguuugucgaaagaaacuuaguaaagcccgagggaaagguaaucgaccuagguuguggccgcggaggauggucauauuauugugcgggucucaagaaaguuacagaaguaaaaggcuauacgaaagguggaccgggacaugaagaacccauuccaauggcgaccuaugguuggaaccuaguaaaacuacauucaggaaaagacgucuucuucauaccuccugagaagugugacacucuuuuaugugauauaggagagucaagucccaauccgacgauagaggaagggcguacucuaagaguauuaaaaaugguagagccguggcugcgugggaaucaauucuguauuaaaauacugaacccauauaugccauccguaguagaaacuuuagaacaaaugcaaagaaaacacggcggaaugcuugucagaaacccacugagcagaaacucuacacaugagauguauugggugagcuguggaacagguaacauuguuagugcuguuaacaugacuucacguaugcuacugaauagguuuacaauggcucaccgaaaacccacuuaugaaagagaugucgauuuaggugccggaacaagacacguggcaguagaacccgaaguagcaaaccuugauauuauugggcaaaggauagagaauaucaaacaugaacauaaaagcacuuggcacuaugaugaagauaacccguauaaaacaugggccuaucauggcucuuacgaaguaaagccuucagguucugccucuucgauggucaacggagugguaaaacuuuugacgaaaccuugggacguaauuccaauggucacacaaauugcaaugacugauaccacaccuuucggacagcaaagaguauuuaaagaaaagguugauacucgaacuccaaaggcaaagcggggcacagcgcagauaauggaaguaacggcaaaaugguuaugggguuuucucucaagaaacaagaaaccaagaauauguacaagagaagaauuuaccaggaagguaaggucaaacgcugcuauaggagcagucuuuguugacgagaaucaauggaacucugcuaaggaagcugucgaagaugaaagauuuugggauuugguccauagagaacgcgaguugcauaaacaaggaaaaugugcaacuugcgucuauaacaugauggggaaaagagaaaagaaguuaggagaauuugggaaagcaaaaggaucacgagccaucugguacaugugguugggugccagauuccuugaauuugaagcacugggcuuuaugaaugaagaucacugguuuucaagagaaaauagccuaaguggaguagagggagaaggguuacacaaguugggauacauucuuagggacauaucuaaaauacccgguggcaauauguacgcugaugacacugccggcugggauacaaggauaaccgaagaugaucuccagaaugaagcaaggauaaccgacaucauggagccagagcaugcauuacuagcuaaaagcauauuuaaauuaacauaucaaaauaaggucguuagggugcagcgaccagcuaaaaauggaacugugauggacguuauuucaagaagagaucagcguggcagugggcaaguugguacuuauggacuaaacacuuuuacaaauauggaggcgcaauuaauaagacagauggaaagcgaaggaauauuuuccccgagcgaacuugaaacucccaaucuugcugaaagggucuuagacugguuagaaaaauacggcguagagaggcucaaaagaauggcuaucuccggagacgauugcguaguuaagccaaucgaugauagguuugcaacagcacuaaccgccuuaaaugauaugggaaagguuagaaaagauauaccgcagugggaaccaucaaaaggauggaacgauuggcaacagguacccuuuuguagucaucauuuccaucagcuaaucaugaaggacggcagggaaauaguuguaccguguagaaaucaggaugaauuggucggucgcgcucgcgugagccaaggagcggguuggagccuccgagaaacagccuguuuagguaaaucauacgcacaaauguggcaauugauguauuuucauagaagagauuuaagacuggcagcaaaugcgauaugcucugcaguaccugucgauuggaucccgaccagccguacaacauggucaauccaugcucaccaccaauggaugacuacagaagacaugcugucugucuggaauagaguauggauugaggaaaauccauggauggaagacaaaacgcauaucaguucauggggagauguucccuaccuaggaaaacgugaggaccaauggugcgggucauuaauaggucugacggcacgugcuacuugggccacgaacauucaaguugcgaucaaucaaguaaggcgucuaauagguaacgaaaauuaucuggacuauaugacuucaaugaagagauuuaaaaaugagucggauccagagggugcauuaugguaa

SEQ ID NO: 21546 - RNA, 9879 nt, Artificial Sequence
  derived and/or modified CDS sequence (opt6) from DENV-1__FJ432746__SS-prME
agcgugaccaugcuacuuaugcugaugccuacggcguuagcuuuucacuugacuacucgcgguggagaaccccacaugauuguaucaaaacaagaaaggggaaaaaguuuacuauuuaaaaccagugccggugugaauauguguacuuugauagcuauggauuuaggagaguuuugcgaagauaccaugaccuauaaauguccacgcauaacugaagcggaaccugacgacguagacuguugguguaaugcaacugauacauggguaacguaugggacauguagccaaacgggcgaacauaggagagauaaaaggaguguagcauuagcuccacacguggguuuaggucuugagacacgaacagaaacauggaugagcagugagggugcuuggaaacagauccaaagaguagaaacgugggcacuaagacauccugguuucacagugauagccuuauuuuuagcccaugcgaucggaaccaguauaacucaaaaagguauaauuuuuaucuuacuaaugcugguuacucccaguauggcaaugcgaugugucgggauaggcaguagagacuucguagaaggccucucgggagcaacuuggguggauguuguucuggaacacgguucaugcguaacaacaauggcaaaagauaaacccaccuuagauaucgaauugcuaaaaacggaagugacgaaucccgcaguacugaggaaauuguguauagaggcuaaaauuucaaauaccacuacggauucucgcugccccacacaaggugaagcaacccuuguagaagaacaagaugccaauuuuguguguagaagaacuuucgucgauaggggauggggaaacgggugugggcuguucggaaaaggaucucuuauuacaugcgcaaaauucaaaugcgugacgaaauuagaggggaaaauuguacaauaugagaacuuaaaauacagcguaauuguuaccguucauacaggggaucaacaccaaguaggaaacgaaucaacggaacacggaacuacggccacaauaacgccgcaagcaccuaguacagaaauacagcugacagauuacggggcauugacacuagauuguagcccuagaacaggcuuagacuucaacgagaugguacuguuaacaaugaaagaaaaaucuuggcuaguccacaaacaaugguuuuuggaccugccauuacccuggacaagcggggcuagcacaagccaggaaacuuggaauaggcaggaucuauuagugacuuucaaaacggcacaugcgaagaaacaagaaguuguaguccuugggucacaagagggugcaaugcacaccgcauugacaggcgccacggagauucagacuucuggaacuacaacuaucuuugcagggcacuuaaaauguagauuaaaaauggauaaauuaacgcuaaaagguaugucguacguaaugugcacggguucuuucaaauuagaaaaagaagucgcagagacucaacacggaacuguucucguacaaauuaaauaugaaggaacugacgccccaugcaaaauuccauucuccacgcaggaugaaaaaggcguaacucaaaacgggcgcuugauaacugcuaaucccauagucaccgauaaggagaaaccaguuaacauagaagcugaaccuccauucggagaaaguuacauuguaauaggugcuggggaaaaagcgcuaaagcugucgugguuuaagaaagggucuuccauuggaaaaauguucgaagccacggcacguggagcaaggcgcauggcaaucuuaggugacacugcuugggauuucgguucuauaggagguguauuuacgucgguuggcaagcucguucaucagauauuugguaccgcguaugguguucuauucaguggaguaaguuggaccaugaagauaggaauagguguccuucuaacguggcuuggacucaauagccgaucgacaucucugucaaugaccugcauagcaguggggcuuguuacucuauauuuagguguaaugguccaagcagauuccgguuguguuauaaauuggaaaggccgugaguuaaagugcggaaguggcauauuuguaacaaaugaaguucacacuuggacagagcaguacaaauuucaagccgauucaccuaaacguuuaagugcagcgauaggaaaagcaugggaagaaggaguauguggcauuagaucagcaacacgguuagagaauauaauguggaaacaaauaagcaacgaacuaaauuacauccuguuagaaaaugauaugaaacugacggucguuguaggagacguagcggggauauuagcacagggaaagaaaaugauccgaccucaaccgauggaauauaaauauagcuggaaaaguuggggcaaagcgaaaauaauaggggcugacguucagaacacaacauucauuauagaugggccaaacacuccagaguguccagaugaccaacgagcauggaacauaugggaagucgaagauuacggguucggaauauucacuacuaacauauggcugaagcucagagauucauauacucaaguaugugaucaccgauuaaugagugcugcaauaaaagauacaaaagcggugcaugcugacauggguuacuggaucgaaucagaaaagaaugaaaccuggaaguuagcaagagccagcuuuauagaggugaaaacuuguauauggccaaagucgcauacgcucuggucaaacgggguauuggagucagaaaugauaauuccaaaaauuuauggaggccccaucucacagcauaacuaccgaccaggauacuuuacacaaacagcugggcccuggcacuuagguaaauuagaauuagacuuugacuuaugcgaagguaccacaguaguuguagacgaacauugugggaaucgagguccaagccuaaggacuacuacgguaacaggaaaaauuauacaugaguggugcuguagaucuuguacacuacccccacuacguuucaagggugaagacggcuguugguauggcauggaaauuagacccgucaaagaaaaagaagaaaaucuugucaaauccauggucagugcgggauccggagaaguggacucauucagucuggggcuauuguguauuaguauaaugauugaggagguaaugagaucccgauggaguagaaaaauguuaaugacgggaaccuuagccguauucuuucuccuuauuaugggccaguuaacauggaaugaucugauacggcugugcauuaugguaggagcaaacgcuucggauagaauggggaugggaacuacauaucuagcccuuauggcaacuuucaagaugaggccaauguucgcagugggccuguuauuuagaagguugaccucgagggaaguguuacugcuuacaauaggacugucacuuguagcuucuguagaguuaccgaacucuuuagaagaauuaggugauggguuagcaauggguauaaugauauuaaagcugcuaacugacuuccagagccaucaguugugggcuacacucuuaucucuaacauucguaagaacuacauuuaguuuacauuacgcguggaagacaauggcuaugguucuuucaauaguuagucucuuuccuuuaugccucagcacuacaagucagaagacaacauggcucccagugcuauuaggaucuuuaggcuguaaaccgcugaccauguuucuaauugcagaaaauaaaauaugggggcggaaaaguuggccgcuuaacgaggggaucauggcagucgguauugugucuauauuacucaguucauuguugaaaaaugauguuccccucgcaggaccacucauagcuggcggcauguuaauagcauguuaugucauaucgggaaguucggcggaccuaaguuuagagaaagcagccguggucuccugggaggaagaagcagaacauucaggagccucucauaauauuuugguggagguacaagaugaugguacgaugaaaauaaaggaugaggagagagacgacacacuuacuauuuuacuuaaagcaacauuauuagcaguaucgggcguuuauccguuaagcauaccggcuaccuuauucgugugguauuuuuggcagaagaagaaacaacguagugguguauuaugggacacaccaagcccaccagaaguggaaagagcggugcuugacgauggaaucuacagaaucaugcaaagaggacuauuaggccgaucacagguuggaguaggcgucuuccaggagaauguguuccauaccauguggcacguaaccagaggggcaguacuaauguaucaagggaaaagacucgagccaucaugggcuaguguaaagaaagaucuaaucucauauggagguggauggagauugcaaggcaguuggaacacgggugaagagguacaaguaauagccguugaaccagguaaaaauccgaaaaauguucaaaccgccccagguacauuuaagacuucagagggggaaguuggugcaaucgcccuugauuucaaaccuggcaccucaggaucaccaauaguaaaucgagaagggaaaauuguaggucuuuacggaaacggaguuguuacuacaagcggaacauacguaucggcgauugcgcaagcgaaggcaucccaagaaggcccccuuccugaaauagaggacgaaguuuuccgaaaacgcaaucuaacaaucauggaucugcauccagguucagguaagacacgacgauacuuacccgcuauuguuagagaagccauaaaaagaaaacuuaggacccuuaucuuggccccgacaagaguuguggcgucugaaauggcugaggcacuaaaaggaaugcccauuagguaucaaacuacggcaguaaagagugaacacacgggcaaagagauaguugaucucaugugccaugcaacauuuacuaugagacucuuaagucccguacgagucccaaauuacaauaugaucauuauggaugaagcucacuuuacagaccccaguucaauagccgccagagguuacauaucaacuagaguagggaugggggaggccgcggcuauuuuuaugacggccacucccccagguaguguggaggcauuuccucagucgaacgcuguuauacaagaugaagaaagagacauacccgaacgauccuggaacucuggguacgaauggauaacagauuuuccagguaaaaccgugugguuuguuccaucaauaaagagcggcaaugacauagcaaauugcuugaggaaaaaugggaaaagagugauacaauuaaguaggaaaacuuucgacaccgaauaucagaaaacgaaaaauaaugauugggacuauguaguaacaacggauauaagugaaaugggggccaauuucagagcagauaggguaauugauccucgccgauguuuaaagccaguaaucuuaaaagauggacccgaacgcgucauucuggcagggccuaugccuguaacaguagccucugcggcccagaggcggggaagaauagguagaaaucauaauaaagaaggcgaucaauauaucuauaugggccaaccacugaauaaugacgaggaucaugcacacuggacugaagcgaaaauguuacuggauaauauaaacacaccugaggggauuaucccagcauuauuugaaccugaacgugagaaaagugcugcuaucgacggagaguaucgauuaagaggagaagcucggaaaaccuucguggaguuaaugcgacgaggggaucuaccuguauggcuaagcuacaaaguugccucggagggauuucaguacucugaccgaagauggugcuucgauggugagagaaacaaucagguacuagaagaaaacauggaugucgagaucuggacuaaagaaggugaaaggaaaaagcuaaggccaaggugguuagaugcuagaacuuauagugauccucuagccuugagagaauuuaaagaauuugccgcaggucgcagaucuguuucaggagaucucauuuuagaaauaggaaaauuaccacaacacuuaacucaacgagcacaaaacgcauuagacaaucuugugaugcugcauaauucagagcaaggcggcagagcauacagacacgccauggaagaacugccggauaccauugaaacgcuuaugcuacuagcguuaauagcaguuuuaaccggcgguguuaccuuauuuuucuuaaguggacgaggauuggguaagacaagcaucggucugcuuuguguaauggcgaguagcgugcuuuuguggauggcaagcguugaaccucacuggauagcugcaucaauuaucuuagaguucuucuuaaugguacuccuaauaccagaaccagacaggcaacguaccccacaagacaaucaauuagcuuaugucguaauaggacugcuauuuaugauacuaacaguagccgcaaaugaaauggguuuacucgaaacuaccaaaaaggauuuagguaucgggcacguagcuguugaaaaucaccaucacgcagccaugcuugacguagaucuucacccagcaucugcguggacgcuguacgcaguagcgacaacuaucauuacaccaaugaugcgucauaccauugagaauacuacugcaaacauaucccucacagcuaucgccaaucaagcagcaauacuaaugggcuuagauaaaggcuggccaauuucuaaaauggauaucggaguaccucuucucgcacuaggguguuauucacaaguaaacccucuuacuuugaccgcugcugugcuaaugcuuguagcacacuacgcuauaauaggaccaggacuacaagcgaaagcuacuagagaagcacaaaaacguacagcagcagguaucaugaaaaauccaaccguagacggaaucguagcgauugaccuagacccuguagucuaugaugcgaaauucgagaaacagcuaggacaaauaauguuacucauuuuaugcacgagucaaauacuacuuaugagaacuacgugggccuugugcgagucaauuacacucgcaacgggaccguuaaccacauuaugggaaggcucacccggaaaauuuuggaacacaacgauugcuguauccauggcuaauauauucagaggcucguaucuggcaggagcuggacuugcauuuucauuaaugaaaucacuugggggcggcagacgcggaacgggugcacagggagaaacccuaggggagaaauggaaacgacaacuaaaccagcuaucgaaaucugaguucaacacauauaaacgcucgggcauaauggaagucgauaggucugaagccaaggaaggguuaaaacggggcgaaacaacaaaacacgcagugucuagagguacagcuaaauugcgaugguucguggaaaggaaucugguuaaaccagaaggaaaagugauugauuuaggaugcgggcgaggcggauggucauauuacugugcgggccucaagaaaguaaccgaaguuaaagguuauaccaaaggcgguccggggcaugaggaaccuaucccuauggcuacauauggauggaauuuaguuaaguugcacaguggaaaagacgucuucuuuauuccaccagagaaaugugacacguuacugugugacauaggcgaaucuaguccuaauccaaccauugaagaaggaaggacccuaagaguuuugaaaaugguagaaccaugguuaagagggaaccaauuuuguauuaaaauacuaaauccuuauaugccuuccgugguagaaacgcucgaacagaugcaaagaaagcacggugguaugcuaguuagaaauccucuaucaagaaauuccacacaugaaauguacugggucagcuguggcacgggcaauaucguaucagccguuaacaugaccagucggauguuacuuaaucgcuuuacaauggcacacagaaagccaacauacgaaagagauguugaccucggagcagguacaagacacguagcagucgagccggaaguugcuaauuuggacauaauuggccaaagaauagaaaacauaaagcacgaacauaaaucuacauggcacuaugaugaagauaaccccuacaagacaugggcauaccauggaagcuaugagguaaagccuucuggaucggcgucgucgaugguuaauggaguaguuaaguuauuaaccaaaccaugggaugugauucccaugguaacacaaauugcaaugacagauacaacaccuuuuggucaacaacgcguauuuaaagaaaaaguugauaccagaaccccuaaagcaaaacgagggacagcacaaaucauggaaguuacagcuaaauggcuguggggguuccuaucuaggaacaagaaaccgagaauuuguacgcgagaagaauuuacuagaaaaguaaggucaaacgccgcaauaggagcuguuuucguugaugaaaaucaauggaacucagccaaggaagcaguagaagacgaacgauucugggacuuagugcaucgagaacgggaauuacacaaacagggaaaaugcgccacaugcguauacaacaugauggguaaaagagagaagaaauuaggagaauuuggcaaagcuaaaggauccagagcaauaugguacaugugguuaggagcaagguuuuuagaguucgaagccuugggcuuuaugaaugaggaccauugguuuucuagagaaaacucacuuucaggaguggaaggagaaggacuccacaaauugggguauauucuacgugacaucucaaaaauacccggcgggaauauguaugcugaugauacggcaggaugggauacaaggauaacagaggaugaucuacagaacgaagcaaaaaucacagacauaauggaaccagaacacgcguuacuugcaaaaucuauuuuuaaauuaacauaucaaaauaaaguaguacgaguacaaagaccugcgaaaaauggcaccgucauggauguuauaaguagaagggaccagagaggaucggggcaaguaggaacauauggucuaaauacauucacuaacauggaggcacaauugauaaggcaaauggaaucagaggggauauucucaccgagugaacuugaaacaccuaacuuagccgguagaguauuagauuggcuugaaaaacacgguguugaacgguuaaagagaauggcgauuaguggugaugacuguguuguuaaaccaaucgaugauagguucgcuacagcgcuuacagcgcuaaaugacaugggaaaagugcguaaagacauuccccagugggagcccucaaaggguuggaaugauuggcagcaaguaccauucuguagucaccauuuucaucaauugauuaugaaagauggacgggaaaucguagucccauguagaaaccaagaugaauuaguugguagagcuagagugucucaaggcgccgguuggagucuaagagaaacggcuugucuggguaaauccuaugcucaaauguggcaacucauguacuuucaucgaagagacuugagacuagcagcuaacgcaauaugcucggcuguaccgguagauuggguuccuacuucaagaacaacauggagcauucaugcucaccaucaauggaugacgacagaagauauguuaucaguauggaacagaguuuggaucgaggaaaauccauggauggaagacaagacucauauuuccucauggggugauguaccauaucuagguaaacgcgaagaucaauggugugguagcuuaauuggccucacagcucgagcuacuugggcuacaaacauucagguugcaauaaaccaaguaaggagauugcuagggaaugaaaacuaccuugauuauaugacuucgaugaaacgcuucaaaaacgaaagugauccagaaggggcccuuugguga

SEQ ID NO: 21547 - RNA, 9879 nt, Artificial Sequence
  derived and/or modified CDS sequence (opt6) from DENV-1__FJ432748__SS-prME
agcguuacuaugcuacuaauguuaaugccuacagcguuagcauuucacuugacaacaagagguggagaaccccauaugauaguaucgaaacaagaaagagggaaaagccuauuauuuaaaaccucagcgggcguaaauauguguacauugauugcaauggacuugggugaauuaugcgaagauaccaugacguacaaaugucccagaaucacagaaacagaaccagaugauguagauugcugguguaaugcuacagauacauggguaacauacgguacauguucccagaccggugaacauaggagagauaaacguucuguugcucucgcaccacacguaggguuaggacuagaaacucggaccgaaacauggaugucuuccgaaggggcuuggaaacaaauucaaaggguggaaacaugggcauuaagacauccuggcuuuacagugauagcacuuuuucuggcacaugcuauaggcacgagcauuacgcaaaaaggcaucauauucauucuauugaugcuuguaaccccaucaauggcuaugcgaugugucggaauaggguccagagauuuuguagagggacugaguggagcuacauggguagaugucguuuuagaacacggaucuugcguuaccacaauggcaaaggacaaaccaacacuggacauugaacuacuaaagacagaaguuacaaacccugcgguccuacggaaacuauguaucgaggcuaagaucucuaauacgacaaccgauaguaggugcccuacacaaggggaagccacucuuguugaagaacaagacgccaauuuugugugcagacggacuuuugucgacaggggcugggggaaugguugcggccuuuuugguaaagggaguuuaaucacaugcgcuaaauuuaaaugugugacaaagcuagaagguaaaaucguacaauacgagaaccucaaguauucgguuauuguaacuguacauacaggagaccaacaucaaguuggaaaugagucaaccgagcaugguacuacugcaaccauaaccccgcaggcaccaacuacagaaauucaauuaacagauuauggugcacuaacucuagacuguaguccuagaaccggcuuggauuuuaacgaaaugguacuguugacaaugaaggagaaaagcuggcuuguacacaagcaaugguuuuuagacuuaccacuccccuggacaucaggagccagcacuagccaagaaacauggaaucgacaagaucuauuaguaacuuucaaaacugcacacgccaagaaacaggaaguaguagucuugggcagucaagaaggagcgaugcauaccgcacugacgggggcuacugaaauccagacaagugggacaaccacaauauuugcaggccauuuaaaaugcagauuaaaaauggacaaacuuacacucaaaggaaugucguauguaaugugcacaggaucauuuaaacuggaaaaagaagucgcggaaacccaacacgguacgguccuaguucagauuaaauaugagggaacugacgcuccguguaagguaccauucaguacucaagacgagaaaggugugacacagaacggucgucuaaucacagcgaacccgaucgucacggacaaagaaaaaccagugaauaucgaagcagaaccuccauuuggggaaucuuauauuguuauaggcgcuggagaaaaggcucuaaaauuaucaugguuuaagaaaggaucaucaaucgggaaaauguuugaagcaacagcacgaggugcgaggcguauggcaauacuuggagauacugcuugggacuucggaaguauagguggaguguuuacgucgguagggaaauuaguccaucagauuuucggaacggcuuacgguguacucuuuagcggagucaguuggacaaugaaaauaggcauugguguuuuauuaacuugguuagguuuaaacucaagaucgacaucacuauccaugaccuguaucgcaguagggcuaguuacauuguacuuggggguaaugguacaggcagauuccggauguguaauaaacuggaaaggaagagaauuaaaauguggaagcggaauuuucguaacuaaugaaguucauacauggacggagcaguacaaauuucaggcagacagcccuaaaagauuaucugcagcaauaggcaaggcuugggaagaagguguaugugggauccguuccgcaacaaggcuugaaaauauuauguggaaacagauaucuaaugaacuaaaucauauucuuuuagaaaacgauaugaaguucacaguaguuguaggcgauguugcuggaauauuagcacaggguaagaagaugauaagaccucaacccauggaauacaaauauaguuggaagucauggggcaaggcaaaaauuaucggagcagacguccagaauacuacauuuauaaucgacggcccuaacacaccagaguguccagacgaccaaagggccuggaauauaugggaaguugaagacuacggguucgggauauucacaacuaauauaugguuaaagcucagggacucauauacucaaguuugugaccauagacucaugagugcggcuaucaaagauucaaaggcaguucaugcggauaugggauacuggauagaguccgagaaaaaugaaacuuggaaacuagcacgagcuucuuucauagaaguuaaaacuugcauauggccaaaaucgcauacauuauggucaaaugggguacuagagagcgaaaugauuauucccaaaauauauggcgggccaauaagucaacacaacuauaggccagguuauuuuacgcaggcagcaggaccuuggcaucuagguaaauuagaacuugauuuugaccugugcgaaggcaccacaguuguaguagaugaacauuguggcaaucgugguccaucacuaagaacgaccaccgugacaggaaagauaauccaugaaugguguuguaggagcugcacguugccaccauuacguuucaaaggcgaagauggaugcugguacggaauggaaauaagaccaguaaaagaaaaagaggagaacuuagucaagucaauggucagugcagguucaggugaaguagauucuuucucauuggggcuacuauguauaaguauaaugaucgaagagguuaugaggucuagauggagcaggcgcaugcucaugacgggaacguuggcuguauucuuuuuauuaauaaugggacaauuaacauggaaugaccuuauaagacucugcauaaugguuggcgcaaaugcaucagauagaauggggaugggaacaacauaucucgcccuaauggccacauuuaaaaugcgaccaauguuugcuguuggacugcuauucagacgguugaccucacgggagguucuucugcuuaccauaggacuaucauuaguagcaucaguggagcucccaaauucacuagaagaacucggggacgggcuggcaaugggcauaaugauucuaaaacuucucacagacuuucaaagucaccaacuaugggcuacccuacugagccuuacauucauaaaaacaacuuucucacuucacuaugcauggaagacaauggcaauggucuugucaaucguaucccucuucccauugugucugucuacaacgucacagaaaacuacuugguuaccaguacuauuagguucuuugggguguaaacccuuaacaauguuuuuaauagcugaaaacaagauaugggggagacguucauggccgcugaaugaaggcauaauggcgguugggauaguaucgauccugcugucgaguuuacugaaaaaugacgugccacuagcagggccccuuauugcuggaggaauguugaucgcauguuauguaauaucaggcagcagcgccgaucuuagucuugaaaaagccgcagaagugucaugggaggaagaagcugaacauucuggugcuucgcauaacauauuggucgaaguacaagaugauggaaccaugaaaauaaaagaugaagaaagagaugauacacuuacaaucuuacuaaaagccacguugcucgccguaucaggugucuauccucugucaauacccgccacgcuauuuguuugguacuuuuggcagaagaagaaacaacgaaguggaguacuuugggacacaccaagucccccugagguggaacgugcgguguuagaugauggaauauacagaauuaugcaaaggggauuauuaggcagaucacaagucggcguuggaguauuucaagaaaacguauuccauacaauguggcauguaacucgcggagcaguuuugauguaucaaggaaagcgacucgagccaagcugggccucagucaagaaagaucuuauuucuuacgguggaggcuggaggcuucagggcaguuggaacacaggcgaggaaguacaaguuaucgcaguugagccaggcaagaacccuaagaauguucaaacugcacccgguacguuuaaaacgccggaaggagaaguaggugcgauugcccucgauuucaaaccaggcacaucgggauccccaauugucaaccgugaagggaaaaucguggguuuauacggaaauggugucguaacaacaucugggacauacguaucugcaaucgcacaagccaaagcgucccaagaaggaccucuacccgaaauagaagacgaaguauuucggaaaagaaacuugacuauaauggaccuccauccagggucagguaagacccgacgguauuugcccgccauuguccgcgaagcaauaaaaagaaaacuaagaacuuugauucuagcgccaacaagaguaguugcauccgaaauggcugaggcacuaaaagggaugccaauacgcuaccaaacuacagccguuaagucugaacauacagggaaagaaauuguggauuugaugugccacgcaacauucacaaugagauuguuaaguccugugagaguaccuaacuacaacaugauuauuauggaugaggcacauuuuacugacccaagcucuauagcagcaagaggauauauaucuacgagaguuggaaugggggaagcagccgcuauauucaugaccgcgacgccuccaggcucaguggaagcauuuccccagucaaacgcugugauacaagaugaagaaagagauaucccagaacguaguuggaauaguggauaugaguggauaacggauuuucccgguaagacaguuugguucguaccuagcauaaaaucggguaacgacauagcaaauuguuuaagaaagaacggaaaaagaguuauccagcugagccgaaaaacauuugauacagaauaucagaagaccaaaaacaacgauugggauuauguugucaccacagauauaucggaaaugggagcuaauuucagagcagauagggugauugaccccagacgaugcuuaaaaccgguuauauugaaagacggaccagagagaguaauauuagcuggaccaaugccuguaacagucgcaagugcagcucagagaagaggucgcauaggacgaaaucauaauaaagagggugaucaguauauauauaugggacaaccuuuaaacaacgaugaagaucacgcucacuggacagaggcaaaaaugcuauuggauaauauaaauacaccagaaggaauaauaccggcauuauucgagccggaaagggagaagagugcugcaauagacggagaauacaggcugaggggagaagcgcgaaagacuuuuguagaacuaaugcgacggggcgaccuaccaguuuggcuuucuuauaaaguggcuagcgaggguuuucaauacucggauagaaggugguguuucgauggugaaaggaauaaucaaguauuagaagagaauauggacguagaaauauggaccaaagaaggagaacguaagaaauuaagaccgcgauggcuugaugcgaggacauauagcgaccccuuggccuugagagaauuuaaagaguucgccgccggaagaagaaguguaaguggagaucuaauccucgaaauagggaaacuuccacagcacuuaacccagcgcgcacaaaacgcacuugauaauuuagugaugcuccacaacucugaacaaggcggucgagcuuaucgucacgcgauggaggaauuaccagacacuaucgaaacauugaugcuacuugcgcuuauagcaguacuaacuggaggcguaacauuauucuuccugagcggacgaggcuuaggaaaaacuagcaucgguuuacuguguguaauggccagcucaguacuccucuggauggcaaguguugaaccucauuggauagcugcaucgaucauauuagaauuuuucuugaugguucuacugauaccagagccggaccgacaaaggacuccgcaggauaaucaguuggccuauguggucauaggauuacuauuuaugauacuuacaguagcugcuaaugaaaugggucugcuggagacuacgaagaaagaucugggcauuggacacguagcgguagaaaaccaucaccaugcugcaauguuagauguugaucuacauccagcaagcgcguggacucuguaugcgguagcgacaacgauuaucacgcccaugaugagacacacuaucgaaaauacgacagcaaauaucagcuugacagcgauugccaaccaagcugcgauccucaugggccuagacaaaggguggccaauaucaaaaauggacauuggagugccccuacucgcucuaggauguuacucacaagugaauccacucacguuaacugccgcuguauuaauguuaguagcacauuaugccauuauuggcccuggauuacaagcgaaagcuaccagagaagcacagaaaaggacagcugcagguaucaugaagaauccaacgguagaugggauagucgcgaucgauuuagauccugucgucuacgaugcuaaauuugagaaacaacuuggacaaauaaugcuacugauacuauguacaagucaaauccuauuaaugcgaacaacaugggcauugugugagaguauuacauuagcuacagggccacuuacgacucuaugggaaggaucuccaggaaaauuuuggaauacgacaauugcaguaucgauggccaauauauuuaggggauccuaccucgccggcgcaggguuagccuuuagucuaaugaaaagucugggagggggacgacgcgguacaggagcgcagggagaaacgcucggugaaaaauggaaacgacaacuaaaucaguuaagcaagucagaguucaauacuuacaaaagaaguggcaucauggagguugaucguucagaagcaaaagaagguuugaagagaggugaaaccacaaaacacgcagucagcagaggaacugccaaauuacgaugguuuguugaacgaaaccugguaaaaccagaaggcaaagucauagaccucgguugcggaaggggcggcuggucguauuacugugcuggacuuaagaaaguaacagaaguuaagggguauacaaaagggggaccuggccaugaagaaccaauaccuauggcaacauaugguuggaacuuaguuaaauugcauucugguaaggauguauucuuuauuccacccgagaaaugugauacguuguuaugugauauuggagaaaguaguccaaacccgacgauagaagaagguagaacacugagaguuuuaaaaaugguagagccguggcugcgagggaaccaguuuugcauaaaaauauuaaauccauauaugccaucaguuguugagacacucgaacagaugcagagaaaacaugggggaaugcucguucgaaacccccuuagccgcaauagcacacaugaaauguacugggugucaugcggaacuggcaacauugucagugcgguuaauaugacgagucgcaugcuauugaaucgcuucacaauggcgcaucgaaaaccaacuuacgaaagggacguggauuugggggcggggacacgacauguagccgucgagccagagguugcuaaucuagauauuauugggcagagaauagagaauauaaaacaugaacauaaaucuacauggcacuacgacgaagacaauccauauaaaacuugggcauaucaugguaguuaugaagugaagccaucaggcucagcaucaucuaugguuaauggcguugucaaguuguuaacaaaaccuugggauguaauccccaugguuacgcagauagccaugaccgacaccacgccuuucggccaacaaagaguauuuaaagagaagguugauacaagaacaccaaaagccaaaagaggaaccgcacagauaauggagguaacagcaaaauggcuuuggggauuccuaucccgaaauaagaaaccucgaauauguacccgugaagaauuuacccgcaaaguacggucuaaugcugcuauuggagcgguuuuuguggacgaaaaucaauggaacucugcuaaagaagcgguagaagaugaaagauucugggauuugguucaucgugagcgcgaauuacauaaacaaggaaaaugcgccacuugcguauauaauaugaugggaaaacgcgaaaagaaauuaggugaauuugguaaagcaaaaggauccagagcgauaugguauauguggcuaggagcaagauuucuugaguuugaagcacuagguuuuaugaaugaggaucauugguucucacgcgaaaacucgcugucugggguagaaggagaaggacuacauaaacuuggauauauauuacgagauauaucaaaaauaccuggaggaaacauguaugccgacgacacagcaggcugggacacgaggauuacagaggacgaucuacaaaaugaggccaggauuacugauauaauggaaccagaacaugcccuauuggcaaaaaguauauuuaaguuaacuuaucaaaauaagguugucaggguacaacgucccgcuaaaaaugggaccguuauggaugugaucagucgaagagaucaaaggggaucagggcaaguaggaacuuacggacuaaacaccuucacaaauauggaagcacagcucauccgacaaauggagucugaaggcaucuuuucuccuucagaacuagagacgccaaacuuagcugagagaguacuugauuggcuagaaaaauacggaguugaaaggcugaaaaggauggcaauuagcggagacgacuguguagucaagccgauagaugauagauucgcuacggcguuaaccgcuuugaacgauauggggaaaguaagaaaagacaucccucaaugggagccauccaagggcuggaacgauuggcaacaagucccauucuguagccaccauuuccaucaauugauaaugaaggacgguagggaaauaguagugccgugucgcaaccaggaugagcuaguaggaagggccagaguuagccaaggugcgggguggucccuacgggaaacagcuugcuuggggaaaucauaugcgcaaauguggcaguuaauguacuuucauagaagagaucuuagauuggcagcuaacgcgauuuguucugccguaccuguagauuggauaccaacaagucgaacaaccuggucuauacacgcacaucaccaauggaugacaacagaagacaugcuuuccgucuggaaccgagucuggauugaagaaaauccauggauggaggauaaaacacauauaaguucuuggggcgacguuccuuaccuaggaaaaagggaagaccaauggugcggaaguuuaauagguuugacggcucgagcgacuugggcuaccaacauccaaguagcuauuaaucaagucagaagacuuauuggaaaugaaaauuacuuagacuauaugacaucaaugaaaagauucaaaaaugaaagugauccagaaggagcuuugugguaa

SEQ ID NO: 21548 - RNA, 9879 nt, Artificial Sequence
  derived and/or modified CDS sequence (opt6) from DENV-1__FJ432749__SS-prME
agcguaaccaugcuccucauguuaaugcccacggcauuagcauuucauuuaacuacaagagguggggaaccucauaugauuguaaccaaacaagaaagagggaaaaguuuacuuuucaaaacuagcgccggggucaauauguguacauugauagcaauggaucuuggggaacuaugugaagacacaaugacuuauaaauguccgaggauaacagaagcagaaccugacgauguugacuguugguguaacgcgacagauacgugggucacauauggaacauguucucaaacaggcgaacauaggagagacaaaagaaguguagcauuagcaccacaugucggauuaggucuugaaacaagaacagaaaccuggaugucgagcgaaggugccuggaaacagauacaaagaguugaaacaugggcacugcgccauccggguuuuacaguaauagccuuguuucuugcacacgcuauagguacaucaauaacgcaaaaaggcauaaucuucauccuauuaaugcuaguaacaccuucaauggcuaugagauguguagggauaggauccagagacuuuguagaaggacugucgggggcaacaugggucgauguuguuuuagaacacggaucuugcguuaccacgauggcaaaagauaaaccgacguuagacauagaauuauuaaaaacagaaguaacaaaucccgcaguacuucgaaaauuauguaucgaagcuaaaauaucgaauacaacuaccgauucgagaugcccuacacaaggagaagcgacccuaauggaagaacaagaugcgaauuucgucugccgacgaacauucguugaucgaggaugggggaacggcuguggucuuuucggaaaagguagucuuauuacaugcgcuaaauucaaauguguaacaaaacuggaggggaaaauaguacaguaugaaaauuuaaaauauucugugauuguaacaguacacaccggugaucaacaccaaguagggaacgaauccacggaacaugguacaacagccacaauuacaccccaagcuccaacaucggaaauacaacucaccgauuacggagcauuaacccuggauugcuccccacguaccggucuugacuuuaacgaaaugguuuuacuaacgaugaaagagaaaaguuggcuaguacacaaacagugguuucuagaccuaccauuaccguggaccagcggugcaagcacaagccaagaaacauggaacagacaggacuugcugguaacguuuaaaacagcacaugcgaagaaacaagaagugguuguacucggcucacaagagggagcaaugcacaccgcacugacaggagcaacagaaauacaaacaucuggaacaacuacaauauuugcaggucaucuuaaaugcagauuaaagauggauaaacuuacacucaaaggaauguccuauguaaugugcaccgguaguuucaaacucgagaaagagguagcagaaacacaacaugguacuguuuuaguacaaauaaaauacgaaggcacagacgcaccauguaagauaccguucuugacacaggaugagaaagguguaacucaaaauggaagauuaauuaccgccaaccccaucguaacagauaaagagaaaccggucaauauagaggcggagccaccuuuuggugaauccuauauugugauuggagccggugaaaaggcauuaaaguuaaguugguuuaaaaaggguucaucuauaggcaagauguucgaagcuacagcaagaggggcacgacgaauggccauccugggcgacacggcuugggacuuuggaucgaucggaggaguguucacgagcguugguaaguuaguacaccaaauuuuuggaacagcuuacggcguuuuauuuuccgguguauccuggacaaugaaaauagguauagggguuuuauugaccugguuaggccuaaauucgcgaucaacaucucuuucgaugacuuguauagcaguuggccuaguuacauuauacuuaggugugauggugcaagccgauaguggaugcguuauuaauuggaagggcagagaauugaagugcggcuccggaaucuuugugaccaaugaaguucauacguggacagaacaauacaaauuccaggcagacuccccaaagagacuaagcgcggcuaucggcaaggcuugggaagaagguguaugcggaauacguucggcaacuagauuggagaauauuauguggaaacaaauuagcaacgaauuaaaccauauccuauuagaaaacgacaugaaauucaccgucguaguaggcgauguugucgggauacucgcacaagguaagaaaaugauacgaccgcaaccaauggagcauaaguacagcuggaaaucauggggcaaagccaaaauaauaggagccgauguccaaaauacaacuuucauuauagauggaccaaacacaccagaaugcccagaugaccaacgugcuuggaauauaugggagguagaggauuacgguuucggaaucuucaccacgaauauauggcucaaacuccgagauagcuauacacaaguaugugaucacaggcuaaugucugcugcuauaaaagauucuaaagcaguacacgccgacaugggauauuggauugaaucagagaaaaaugaaacuuggaagcuggcgagagccagcuucauugagguaaaaacauguauauggccuaagagucacacucuuuggaguaacggugugcuagaaucagaaaugauaauaccgaaaauauaugguggcccaaucagucaacauaacuaccgaccaggcuauuucacucaaaccgcaggccccuggcacuuaggaaaacuugaauuggauuuugaucuuugcgaaggcacaacaguaguuguagaugaacauugcggcaaucgaggucccucccugcgaacuacaaccguuaccgggaaaaucauacacgaaugguguugucgaagcuguacacuuccuccauugagguuuaaaggugaggauggcuguugguaugguauggaaauacggcccgugaaagagaaagaagaaaaucuagugaaaucaauggucucagcuggauccggcgaaguugauagcuuuucacugggucuacuguguauuucuauuaugauugaggaaguaaugagaucgcguuggaguagaaaaauguugaugacugguacccucgcaguuuuucuguuguuaauuaugggacaacuaacuuggaacgaucugauccgacuuuguauaauggugggagccaaugcuucagaccgaaugggaauggguacuacguaccuagcauugauggcgacauucaagaugcgcccaauguuugcgguggggcucuuauuuagaagauuaacaagcagagaaguacuucuauuaaccauaggacuaucauuaguagcuucuguggaacuuccaaacucuuuggaagaacuaggagacggguuggcgaugggcauaaugauacuaaaacuucuaacugauuuucagagccaucaacucugggcaacucuccuuucuuuaacuuuuauuaaaacaacucugucuuugcauuaugccuggaaaaccauggcaaugguauugagcauaguaagccuuuuuccauugugcuuaaguacuaccucacagaaaacaacauggcuaccagugcuacuuggaucgcugggaugcaaaccacuaaccauguuucuuauugcagaaaauaaaauaugggggagaaaaucguggccacuaaacgaaggaauaauggcgguuggaguuguaucgauauugcuuucauccuugcugaaaaaugacguaccccuagcuggcccacuaaucgcugguggcauguuaauugcaugcuauguuauaucaggcucaagugcagauuugaguuuagaaaaggcagcagaagugaguugggaggaagaagcagaacacucuggagcaucacauaauauucucguagagguucaagacgaugggacaaugaaaauuaaggaugaggaaagagacgacacauugacgauucugcuaaaggcaacguuacuggccgucucagguguguacccacugucuaucccugcaacacuuuuugucugguacuuuuggcagaagaagaaacaaagguccggugucuugugggauacaccgaguccgccagaaguagaaaaagcaguacuugaugauggaauuuauagaauuaugcaaaggggguugcucggaagaagccaaguugguguaggaguauuccaggaaaaugucuuccauacaauguggcaugucaccagaggagcagugcugauguaucaagguaaacgauuagaaccaucuugggcuucugugaaaaaggacuuaaucaguuacgggggaggguggaggcuucaagguucauggaacacuggcgaagaaguacaaguuauagcaguagaacccggcaaaaacccaaagaacguucaaacagcaccgggaacauucaaaacuccagagggagaagucggggcaauagcauuagauuuuaaaccaggaaccuccggcucacccauuguaaacagagaaggcaaaauaguuggucuguauggcaaugguguagucaccacaagcgggacguaugucagcgccauagcacaagcuaaggccagucaagaagguccauuaccagagaucgaagaugaaguauuccgaaaaagaaaucuaacaauaauggacuugcacccgggcuccggcaagacaagacgcuaccuaccagcaauaguaagagaggccauaaaacguaaauuaaggacacugaucuuggcaccuacucgaguuguggcaucagaaauggccgaggcuuuaaaaggaaugccaauacgguaucaaaccacugcagugaaauccgaacacacuggaaaagaaauaguagacuuaaugugccacgcgacauucacgaugagauuauuaucuccaguccggguaccaaacuauaauaugauaauaauggacgaggcccacuuuacagacccauccucuauugcagcuagggguuauauaucaacacgcgugggaaugggugaagcggcagccauuuucaugacggccaccccaccgggaucugucgaggcuuuuccgcaaaguaaugcaguaauucaggacgaagaaagagauauccccgaaaggucauggaacagcgguuaugaauggauuaccgauuucccgggaaaaacugucugguucgugccuucaauaaaaagcgggaaugacauagccaauugucuaaggaaaaaugggaagagaguaauccaacuuucacgcaaaacuuuugauacagaauaucagaagaccaaaaacaaugacugggauuaugucgucaccacagacauaucagaaaugggugcaaauuuccgugccgaccgagugauugauccacggcgcugucuaaagcccguaauuuuaaaagaugggcccgagagagucauucuugcagggccgaugccaguaacuguugcuucagccgcucaacgacgaggccguauaggacgaaaccauaauaaagagggagaucaauauaucuauaugggucagccccuuaauaaugacgaggaucaugcgcacuggacagaagccaaaaugcuauuagauaauauuaauacacccgaagggauaauaccugcgcuauuugaacccgaacgagaaaagagugccgcuaucgauggagaauaucgucuucgaggugaagcuagaaaaaccuucguagaacuaaugagaaggggugacuuaccggugugguuaaguuauaagguagcauccgaaggauuccaauauucggauaggagauggugcuuugacggagaacggaacaaucaaguguuggaagaaaauauggacguugagauuuggacaaaggaaggcgaaaggaagaaauugagaccgcguuggcuagacgcgcgcacauacucugacccuuuagcauuacgagaguuuaaagaguucgccgcgggaaggaggagcguaucaggagacuuaauacucgagauuggaaaauuaccccaacaccugacccaaagagcacagaaugcacuagauaaucuuguaauguuacauaauucagaacaagggggcagagccuauagacaugcaauggaagaauuaccagauacaauagaaaccuuaaugcuauuagcuuugauagccguacuaacaggagguguaacucuauuuuuccuaaguggccgcggauuaggaaagacaaguauuggcguacucuguguaauggcaucaagcguccuccuauggauggccagcguggaaccucauuggauagcugcuucaauaauucuagaauuuuuccugaugguauuauuaauaccagaaccagaccgucaaaggacuccucaagacaaccaauuagcuuacguaguuauaggauugcuauucaugauuuugacuguggcagcaaacgaaaugggauuguuggaaacuaccaagaaagaccuggguauaggucauguagcaguagaaaaucaccaucacgcaacgaugcuagacguagaccuacauccagccagugcauggaccuuauacgcaguagcgaccacaauuauaaccccgaugaugagacauacaauugaaaauacuacugccaacauaagccuaacagcgauagccaaccaagcagcaauacuuaugggacuugacaaaggauggccuauuaguaaaauggacauuggaguaccuuuguuagcgcuggggugcuacucacaagucaacccccugacccucacggcagccgugcugaugcugguagcgcauuacgccauaaucgguccagguuugcaagcuaaagcaacccgagaagcgcagaaaaggacagcugcuggaauuaugaagaacccaacaguagacgguaucgucgcaauagaucuagauccgguaguguacgaugcaaaauuugagaaacaguuaggacagauaauguuacuuauucuuugcacuucucaaauauuacugaugcgaacaacgugggcuuuaugcgagucaaucaccuuagcgacagguccacuuacuacauugugggaaggaaguccgggaaaguuuuggaauacuacgauugcuguaaguauggcaaacaucuuccgggguucuuauuuagcgggagcuggccuugcguucagcuugaugaagucacuaggggguggacgucggggcacgggugcgcaaggagaaacccugggagagaaguggaagcgucagcuaaaucaauugucaaaaagugaguuuaacaucuauaaaagaucggguauuauggaaguugaccgcagugaggccaaagagggauuaaaaagaggagaaacgacuaggcaugccguuucgagaggcacggcaaaacugcgaugguucguagagaggaauuuaguaaaaccggaggguaaaguuauagaucuuggcugugggcgcggaggguggucauauuacugugcaggucugaagaaagucacagaagucaaaggcuacacaaaaggagggccagggcacgaagaacccauucccauggcuacuuacggauggaaucuaguaaaacuacacucgggaaaagaugucuucuuuacaccgcccgaaaaaugugauacauuauuaugugauauaggggaaucaucgccaaacccaacgauagaagaggggcgaacccuaaggguucuaaaaaugguugaaccguggcuccgaggaaaccaauucuguauaaaaauacuuaacccauauaugccuucuguuguagaaacacuggagcagaugcaacgaaaacauggcgguauguugguaaggaacccacuaucucgaaauucgacccaugagauguauuggguuucguguggaacuggaaauauaguaucagcuguuaauaugacaagucgcauguuauugaaucgguuuacaauggcucacagaaagccuacauacgagagagauguagaucugggggcuggaacgaggcauguagcuguagagccugaaguugcaaaucuugauauaaucggucaaagaaucgaaaauauuaaacaugaacacaaaagcacauggcauuaugacgaggacaacccauacaagacuugggcuuaucauggaucauaugaagucaagccaucaggaucggccagcucaaugguuaaugggguuguaaaacuucuaacaaagcccugggacguaauuccuaugguaacgcagauagcaaugacagauacaacucccuuuggacaacaaagaguuuuuaaagaaaaaguagacacaagaaccccaaaagccaaacgagguaccgcccaaauaauggaaguaaccgcuagaugguuauggggauuccuaucacgcaacaagaaaccaaggauaugcacaagagaggaauuuacucggaagguuagaaguaaugcagcaauaggugcuguguuuguagacgagaaccaauggaauagcgcaaaagaggccguagaagacgagagauucugggaccuaguucaaaaagagagagaacuucauaaacaggggaaaugugcaacaugcguauacaacaugauggguaagagggaaaagaaacugggagaguucggaaaagcaaaaggauccagagcaaucugguauauguggcuaggagcgagauuuuuagaguucgaggcuuugggauuuaugaaugaagaccauugguucucacgugaaaauucacuuucuggaguugagggagaaggacuucauaaacucggauauauucuaagagacauaucaaaaauuccaggagggaauauguaugcagaugauacagccggaugggacacaagaauaacugaagacgaccuacaaaaugaggcaaaaaucacagacauaauggaaccggaacaugcucucuuggcgacaagcauuuuuaaauuaacguaccaaaauaagguugugcguguacagagaccggcuaagaacggcacugucauggauguaauuagucguagggaccagcgugguaguggucaggugggaacauacggauuaaacacauuuacaaacauggaggcacaauugauaagacaaauggaaagcgaaggaauauuucuaccaagugagcuugaaacaccuaaucuugcugaaagaguucuggauuggcuugaaaaauauggugucgaacgauuaaaaagaauggcaauuaguggugacgacugcguugugaagccuauagaugacagauuugccacagcucucacugcauuaaaugauauggguaaaguuaggaaggauauaccucaaugggaaccaucgaaaggcuggaaugauuggcaacaaguacccuuuuguucgcaucauuuucaucaacuuauaaugaaagacgguagagagauaguagucccuugcagaaaucaagaugaauuaguugguagggcucgaguuucgcagggagcugguuggagucuacgugaaaccgcgugucuagggaaaucuuaugcucaaauguggcaauuaauguauuuccauaggcgagacuugagauuagcugcgaacgcaauaugcuccgcagugccaguagauugggugccuacaucgagaacuaccugguccauccaugcacaccaccaguggaugacgacagaggacauguuaaguguuuggaacaggguauggauagaagagaauccauggauggaagacaaaacacacguauccuccuggggagauguacccuaucuaggaaaacgugaggaccaaugguguggaucacuuauaggucuuaccgcacgagcaacuugggcaucuaauauacaagucgcuaucaaucaagugagacguuugauaggaaacgagaacuaucuagacuauaugacaucaaugaagagauucaaaaacgaaggcgauccagagggugccuucugguaa

SEQ ID NO: 21549 - RNA, 9879 nt, Artificial Sequence
  derived and/or modified CDS sequence (opt6) from DENV-1__FJ410212__SS-prME
ucgguuaccaugcucuuaauguugaugccgacagcacucgcguuccaucugacaacuagggguggagaaccacauaugaucguaucgaaacaagaacguggaaaaagucuauuauuuaaaacuucggcuggugugaacauguguaccuugaucgcuauggaucucggagaauugugugaagauacaaugacuuauaaauguccaagaaucacagaagcggaaccugacgauguugauuguuggugcaacgcaacggacacauggguuacauacggcacuuguucucagacaggcgaacacagaagggaaaaacguagcguggcauuggcuccucauguuggcuugggccuggaaacgagaacagagacuuggaugucgagugaaggcgcauggaaacaaauacaaagaguugagaccugggcacuuagacauccagguuucacggugaucgcgcucuuucuagcacacgcaauuggcacuucgauaacucaaaaagguauaauuuucauucucuuaaugcuuguuacaccaucgauggcaaugagaugugucggaauuggcaguagggacuuuguugaaggauugucuggcgcuacuuggguggaugucguacuugaacaugguucaugcguuacaacuauggcuaaagauaaaccuacacuggacauugagcuacuuaaaacagaagucacaaauccggcugugcuacgcaaauuauguaucgaagcaaaaaucagcaacacuacuacugauaguaggugcccaacacaaggagaagccacgcuaguagaagaacaagaugcaaacuucguuugcagaaggacauuuguugacaggggauggggaaacggaugugggcuuuucggaaaaggaucacuacuaaccugcgcaaaauuuaaauguguaacgaaauuagagggaaaaauuguacaauaugaaaaucuuaaauauucaguuaucguuacuguacauacgggugaccaacaccaaguagguaacgaaucuacagagcauggaacgaccgccacaauaacuccccaagcaccaacuaccgagauacaauuaacugacuacggugcucuaacacuagauuguucgccuaggaccgggcuagauuuuaaugaaauggugcuuuuaaccaugaaagaaaaaucauggcucgugcauaaacagugguuuuuggaucuaccucuuccauggacaucaggagcaaguacaucucaggaaacauggaacagacaagaucuccuagucacuuuuaaaacugcacacgccaagaaacaagaagucgucguguuaggcucacaggaaggugccaugcauacugcacuaaccggugccaccgaaauccagacaucaggaaccaccaccauuuucgcaggucaucucaaaugcagacuaaaaauggacaaacucacuuuaaaaggaaugucguaugugaugugcacagggucguucaaacuagaaaaagagguagcagaaacacagcaugggacaguauugguccagauuaaauaugaaggaacagaugcccccuguaaaauuccauucuccacgcaagaugagaaaggggucacccaaaauggucgauuaauaacagcaaaucccaucguuacggauaaagagaaaccagucaacauugaagccgaaccuccuuuuggagaaucauauauuguaauaggggcaggagaaaaggcuuugaaacuaucaugguucaagaaagggucaucgauagguaaaauguuugaggcaacagcaagaggagcuaggcgaauggcaauauuaggugauacagcgugggacuuugguuccaucgguggaguguucacaagcguagguaaauuaguucaccagauauuuggaacagccuacggcguuuuauuuucaggaguaaguuggacaaugaaaauaggaauaggagccuuacuaaccugguugggauugaacucucgaucuaccucuuuaucuaugacuugcauugcagucggauuagucacauuauaccuugguguuaugguccaagcagacucggguuguguuauaaauuggaaaggacgagaauugaaaugcgguuccggaaucuuugugacaaacgagguacacacauggaccgaacaguauaaauuucaagcagauaguccuaaaagacuuucugcagcgauugggaaagccugggaagaagguguaugugggauaagaagcgcuaccagacuagaaaacauaauguggaaacaaauuagcaacgaacuaaaucacauuuuacuggagaaugacaugaaauucaccguaguuguaggugacguagccggaauacucguacaagguaagaaaaugauaagaccccagccaauggaauauaaauauucauggaaaaguuggggcaaagccaaaauuauuggggcugacguacaaaacucuacauuuaucauugacggaccgaauaccccagaguguccagacgaucaacgagcuuggaauauaugggaagucgaggacuauggguuuggaauuuuuacaacuaauauauggcucaaauuacgcgacagcuauacgcaaguuugcgaccaccgcuuaauguccgccgcaaucaaagauuccaaagcaguacacgcagauaugggcuacuggauagaaagcgagaaaaacgagacuuggaaguuagcuagagcaaguuucauagaaguuaagacuuguauauggcccaaaucgcauacacuguggagcaacggaguuuuagagucagaaaugauaauaccuaagauacauggcggucccaucagccaacauaacuaucgaccgggauacuucacacagaccgcaggacccuggcaccugggaaaacuagagcuagauuuugauuuaugugaaggcacaacagucgugguggacgaacauuguggaaauagaggacccagcuuaaggacgaccacggucacaggaaaaauaauacacgaguggugcugucgaucauguacauuaccaccucuaagauuccggggagaagacggcuguugguaugggauggagaucaggcccguaaaagagaaagaagaaaaccuaguuaagucuauggucucugccggauccggugagguggacucauucucauugggccuacuauguaucagcauuaugauagaagaaguuaugagaucucgauggucacgaaaaauguuaaugacagguacuuuagcgguuuucuuccuauuaauuaugggacaguuaacuuggaaugaucugauacgacucuguauuauggucggcgcuaaugccucagauagaaugggaaugggaacaacauauuuggcucucauggcaacauucaaaaugaggccgauguuugccguugguuuauuauuccgccgucucacgucaagagaagugcuuuuauugacaauaggccuaucgcugguugcaucaguugaauuaccaaauagccuggaggaguuaggugauggucuagcgaugggaauaaugauacugaaguuacuuacagauuuccaaucuuaccagcucugggcaacucuauugucauuaaccuucauaaaaaccacguuuucgcuacauuaugcauggaagacgauggccaugguucucucaauuguaucauuguuuccucuaugucuaucaacuacuucgcagaaaacaacaugguuacccguucuacuugggaguuuaggauguaaaccuuuaacaauguuccugauagcugagaauaaaaucuggggaaggaaguccuggccacugaaugaggguauuauggcaguagggauaguuucuauucucuuaucgucgcuauuaaagaaugacgugccacuagcggguccacuuauagcuggagggauguuaaucgcaugcuauguuauaucaggauccucggccgaucuaucacuagaaaaagcagcggaaguuagcugggaggaggaagccgagcacucaggggccagucacaacauauuaguugaaguccaggacgauggaacaaugaaaauaaaagaugaagagagagaugauacgcucaccauacuuuuaaaagcaacauuacuagcuguauccggaguuuacccuuuaucaauacccgcuacauuauucgucuggcauuucuggcagaagaagaaacagcgauccggaguuuuaugggauacgccuucacccccagaaguggagagagcaguucuggaugacgguauuuauaggaucaugcaaagaggguugcuaggccgaucacagguugguguaggaguuuuucaagagaauguuuuucauacaauguggcauguaacgcgcggagcaguuuugauguaucaagguaaaagacuagagccaagcugggcaucuguaaagaaagauuugauuucauacgguggcggcuggagauuucaaggaucguggaauacuggcgaagaaguucagguuaucgccguugagccugguaaaaacccuaaaaauguacagacggcaccaggcacuuucaagacgcccgaaggggaggucggagcaauugcuuuggauuuuaaaccaggaacaucggguagucccauaguuaaccgcgaaggaaaaauaguaggauuauauggaaacggggucguaacaacgucuggaacauauguuuccgcaaucgcccaagcaaaagcaucccaagaaggaccccuacccgaaaucgaggaugagguauuccguaaacggaaccuuacaauuauggaccugcacccgggcuccgggaaaacucgacgauaucuucccgcgauaguacgugaagcuaucaaaagaaaacuucguacucuaauacuagcaccaaccagaguggucgcaucagagauggcagaggcauugaaaggaaugccaauuagauaucaaacaacagcaguaaaaagcgaacauaccgguaaggagauaguagauuuaaugugucacgcgacuuucacaaugagguuacuaagucccgugcgaguuccaaauuauaauaugauuaucauggaugaagcgcauuuuacugaucccucuaguauugccgccagaggauauauuucaacuagagucggcaugggcgaagcugcagcaauauuuaugacugcaacaccucccggaucuauggaagcauuuccccagagcaaugcaguuauacaggaugaagaaagggacauacccgaaaggucguggaacucuggguacgaauggauaacugauuuuccagggaaaacaguaugguuugucccgucaauuaaggccggaaaugacauugcaaacugucuuagaaagaaugguaaacggguuauccaacuaucucgaaaaacguucgauacugaauaccagaaaacgaaaaacaaugauugggauuacguaguaacaacagauauaagcgaaaugggugcaaacuucagagcagaccggguaauagacccucgacgcuguuuaaagcccguaauuuugaaagaugguccugagcgagugauucuagcagguccaaugccaguuacuguggcguccgcagcacagagaagagguagaauaggcagaaaucacaauaaagaaggagaucaguauaucuacaugggacaaccucuaaauaacgacgaagaccaugcccauuggacugaggcuaaaaugcugcuagauaacaucaauacaccagaaggaaucauuccggcacuuuuugagccagaaagagagaaaagcgccgcaauagauggugaguauagacucaggggagaagcacggaaaacuuuuguggaacuuaugagaagaggagacuugccaguuuggcucucuuauaagguugcaucagaaggauuccaauauagugaccggaggugguguuuugauggggaaaggaacaaucaaguacuggaagaaaacauggacgucgaaauauggacaaaagaaggagaaaggaagaaauuaaggccacgcuggcuggacgcaagaacuuacucagaccccuuagcacugagagaauuuaaggaauuugcagcaggacgaaggucagugucuggcgaucugauacuagaaauugguaaauugccucaacaccugacacaacgggcucagaacgcccuugacaaucuaguuauguuacauaauucugaacaagguggacgagcuuaucgacacgcgauggaggaacugccugacacaauagaaacuuuaaugcuucucgcgcucauugccguacugaccggaggagucaccuuguucuuucuuucagggaaaggacuaggcaaaacuucuauuggucuucuguguguaauggccucuucagugcuacuuuggauggcaucaguagagccacacuggauugcagcgucgauuauacuagaauuuuucuuaaugguuuugcugauaccagaacccgacaggcaacgaacaccucaggauaaccaacuagcauacgucgugauuggucucuuauuuaugauccuaacaguagcggccaaugaaaugggacuacuggagaccaccaagaaagauuuagguauaggacacguugcaguugaaaaucaucaccaugccgcgauguuagauguagaucugcaucccgcaucugccuggacucucuaugcugucgccacaacgaucgucacuccaaugaugagacauacgauagaaaacacaacugcuaacauaucguuaacagcaauagcaaaccaagcagccauacugaugggacuagacaaaggguggccaauuaguaaaauggauauaggaguuccuuuauuggcccuaggaugcuauagucaaguaaacccacucacgcucacggcagcuguuuuaaugcuugucgcacacuaugcaauaauaggaccgggacuacaggcuaaagcaacucgcgaagcacagaaaagaacagcagccggcaucaugaaaaauccuacuaucgacggcauuguagcaauagaucucgacccgguuguuuacgacgcaaaauuugagaaacagcuagggcagauaaugcuguuaauacuuuguacaagucaaauacuauuaaugcguacgacaugggcauugugcgaguccauuacacuagcuacuggcccacucacaacucucugggaaggaucuccaggaaaauuuuggaacacuacgauagcagugucaauggcaaauauauucagaggcucauacuuggcuggagcuggacuagccuuuagucugaugaagaguuuagggggaggaagaagggggacgggagcacagggugaaacauugggagaaaaauggaagaggcaauuaaaccaauuaagcaaauccgaguuuaauacuuacaagagaucugguauuauggagguagaccguuccgaagcaaaggagggauugaaacguggggaaacaacaaaacacgcagucucaagaggcacagcgaaguuacggugguuuguugaacgcaaucuaguaaaacccgaaggaaaaguaauugacuuaggauguggucgagggggauggucauauuacugugcgggacuaaagaaagugacggaaguaaaaggauacacaaaaggugguccuggccacgaagaaccgauuccaauggcgacuuauggguggaauuuaguaaaacuucauucuggaaaggacguguucuuuauaccaccugaaaaaugugacacgcuucuuugugauauaggugagaguagcccgaaucccacgauagaagagggaagaacacuaagaguauuaaaaaugguugaaccaugguuaaggggaaaccaauucuguauaaaaauauuaaauccguauaugccuagcgucguagaaacuuuagaacaaaugcaaagaaaacauggcggcauguugguacgaaaucccuuaucaagaaacagcacacacgagauguacuggguaaguugugguacuggaaacaucgucuccgcugugaacaugaccucacgaaugcugcuaaauagauucacgauggcacacagaaagccuacauacgagcgggauguagacuuaggagcaggaaccagacacguggcaguagagccugaagucgcaaaccucgauauaauaggacaaagaauagaaaauauaaaacaugaacauaaaagcaccuggcacuaugaugaagauaacccguauaaaacuugggcauaucacggcucauacgagguaaagccauccgguucagcauccaguaugguuaacggcguaguaaaacuauugacuaaaccgugggacguuauuccuaugguuacucaaauagcaaugacggacacgacaccauuuggucagcaaagggucuuuaaggaaaagguagauacuagaacgccaaaagcaaaacggggaacagcacaaaucauggaaguaacugcuagaugguuaugggguuuccuuucccguaauaaaaagccuagaauuugcacacgugaagaauuuacacgaaaaguccgauccaacgcggcaauaggagcgguuuuuguagaugaaaaccaguggaauagugcaaaagaagccguugaagaugaucgcuucugggaucugguacaucgcgagcgcgagcugcacaaacaaggcaaaugugcaaccugcguguauaacaugaugggaaaacgugagaagaaauuaggugaguucggcaaggcuaagggcagccgcgcaauaugguacaugugguuaggugcuagauuuuuagaauuugaagcucuuggauuuaugaaugaggaccacugguucucacgugaaaacucgcugucggguguagaaggcgaagguuuacauaaauuagguuauauauugagggauauuucaaagauaccaggaggaaacauguacgcggaugauacugccgggugggacacucguauaacagaggacgauuugcaaaaugaggccaaaauuacugauauuauggaaccggaacaugcuuuacucgcaaaaucuauuuucaaacuuacuuaucaaaauaagguuguucgugugcaaagaccugccaaaaacgguacugucauggauguaauuucuagacgagaucaacggggcuccggacaaguagguacauacggcuugaacacauuuaccaauauggaggcacaacucauaagacaaauggaaucagaaggaauauuucuccccaaugaacuugagacaccaaaucucgccggacgcguacuagacuggcucgagaaauacgguguugaaagacugaaaagaauggccauaaguggcgacgauugugugguaaaaccgauugacgaccguuuugcgacagcauuaaccgcguuaaaugacauggguaaaguuaggaaagauaucccacaaugggagccuucuaaaggcuggaaugauuggcaacaaguacccuuuugcucccaucauuuccaucagcuaauaaugaaagacggaagagaaaucgucguaccaugccggaaucaagaugaauuagucgguagagcaagggugagccagggugcaggauggucuuuaagagaaaccgcguguuuagguaaaucauacgcgcagauguggcaauugauguauuuucaucgacgagacuugagacuagcggcaaaugcaauaugcuccgccguucccguagauuggguaccuaccucaagaacaacauggaguauacaugcccaucaucaauggaugacaacugaagacauguuaagcguauggaaccgaguuuggauugaggaaaauccguggauggaagauaagacaagaauuucuuccugggaggauguaccuuaucuagguaagagggaagaucaaugguguggaucuuuaauagggcucacagcgagagcuacaugggccacgaauauucaagucgcgauaaaucagguuagaagauuaauaggaaacgaaaauuacucagauuauaugaccucuaugaaaagguucaaaaaugaaagcgagccagagggagcuuuaugguaa

SEQ ID NO: 21550 - RNA, 9879 nt, Artificial Sequence
  derived and/or modified CDS sequence (opt6) from DENV-1__FJ461307__SS-prME
ucgguaacaaugcuguuaauguuaaugcccaccgcguuggcuuuccaucuaacaacgagagguggagaaccacauaugauuguaucuaaacaagaacgcggaaaaucuuuguuauuuaaaacauccgcaggcguaaacauguguaccuuaaucgccauggaccucggugaacuuugcgaagacacaaugacauauaaaugucccagaauaacagaagcagaaccugaugauguggacuguuggugcaacgcaacggacacuuggguaaccuaugguacguguagucaaacaggagaacaucgacgggagaaacggaguguugcucuagcgccucauguaggcuuaggucuugaaacgagaacagagacguggaugagcagcgaaggagccuggaaacaaauccaacggguagaaacaugggcuuugcgccauccuggauucacaguaauugcacuauuuuuggcacaugcaauuggaacaucaauuacacaaaaaggaauuauuuuuauccuauuaaugcuaguaacuccaucuauggcuaugagauguguagguauugguucucgggacuucguagaggggcuuagcggugcaacuuggguagaugucguucuugaacauggaucaugcgucacuacaauggcgaaagauaaacccacacucgauauugaacuauugaaaacagaagucacuaacccagcuguucuucggaagcugugcauugaggcaaaaauaucaaacacaaccacagacaguagaugcccuacacaaggagaagccacgcuaguagaagaacaagaugcgaauuucguaugucggagaacauuuguagauagaggaugggggaauggcugcggcuuguucggaaaaggaucucuuuuaacgugugcaaaauuuaaaugcgucacuaagcuagaaggaaagauaguucaauaugaaaaccuaaaauacucaguuauagucacaguucacaccggggaucaacaccaaguuggaaaugagaguacagaacacgguacaacggcaacaauaacuccacaagcuccuacaacggaaauccaauugacugacuacggugcacugacacuagacugcucuccaagaaccggccuggacuucaaugaaaugguacuacuaacaaugaaagagaagucgugguuaguucauaaacaaugguuucuugacuuaccccuaccauggacgucaggcgcuucaaccagccaagagaccuggaauagacaagaucugcuugucacuuuuaaaacagcacaugccaagaaacaagaggucguaguuuuagguagucaagagggagcaaugcauacagcacugacgggagcaacugaaauucaaacuucaggcacgacaacaauauuugccggacaccucaaauguagauuaaagauggauaaauuaacauugaagggaaugucguacguaaugugcacaggaaguuuuaaauuagagaaggaaguagcagaaacacaacacgggacugugcuaguacagauaaaauacgaagguacagacgcucccugcaaaaucccauuuucuacucaagaugaaaaagggguaacccaaaauggucgacuuaucacggccaauccgaucguuaccgauaaagaaaagcccguaaauauagaagccgaaccuccuuuuggcgaaucguacauuguaaucggcgcaggagaaaaagcauuaaaacuaaguugguuuaagaaaggaucuagcauagguaagauguuugaagcaacggcacgaggggcacgccgaauggccauacuaggugauacagcuugggauuucggcagcauuggaggaguauucacaucaguuggaaagcucguucaucaaauuuuuggcaccgcauacggaguuuuauucucggggguuaguuggacaaugaaaauaggaauaggaguauuacuuaccugguuaggauuaaauucaagaucuacaaguuuaucaaugacguguauagcaguuggccucguaacccuuuauuuaggugugaugguacaggcugauaguggcugcguuaucaauuggaaagguagggagcugaaauguggcaguggaauuuuuguaacuaaugaagugcauacuuggacggaacaauacaaauuucaagcagauagucccaaacgguuaagcgcugcaauagguaaagcaugggaagaaggcguuuguggaauuagauccgccacacgauuagaaaauauuauguggaaacaaauaaguaaugaacucaaucauauauuacuggaaaaugauaugaaauucacuguagucgugggagauguagcgggcauauuaguccaaggcaagaaaaugauacggccacaaccuauggaauauaaguauucuuggaaaagcuggggcaaggcaaagaucauaggagccgauguacaaaacucaacuuuuaucauagaugggccaaauacgccagaaugcccggacgaucaaagagcauggaacaucugggaaguggaagauuacggcuucgguauauuuacuacuaacauuuggcuuaaacucagagacucauauacucaaguaugcgaucauagacuaaugagugcagcaauaaaagacagcaaagccguacacgcugauaugggcuacuggauagaaucggagaaaaaugagacuuggaaacuugcacgugcuucuuucauagaagugaagacauguauuuggccaaagagucauacauuaugguccaauggugucuuagaguccgaaaugauuauuccaaaaauucacggaggaccaaucucacaacauaacuaucgaccaggcuauuucacccagacagccggaccauggcauuuagguaaacuagaauuagauuuugauuuaugugaagguacgacgguagugguagaugaacauuguggaaauaggggccccagucuacgaacuacuaccguuacaggaaaaauuauacaugagugguguugcagaaguugcaccuugccuccacuaagauuuaggggagaagauggauguugguacggaauggaaauaagaccagucaaagaaaaagaagaaaacuuggugaaaaguaugguaucugcaggcagcggugaagucgacaguuuuagcuugggacuacuauguauaucaauaaugauugaagaaguaaugagaaguagauggucaagaaaaaugcuuaugaccggaacucuagcaguauuuuuccuauuaauuauggggcaacucaccuggaaugauuuaauaaggcuuugcaucaugguaggcgcaaaugcgucggacagaauggguaugggaacuacuuacuuagcauuaauggcaacauucaagaugcgaccgauguucgcagucggucuguuauuuagacgguuaacgucccgcgagguuuugcuccucacgauaggguuaucucuaguagccucaguagagcuuccaaauucguuggaagaacucggggacggauuagcuaugggcauaaugauuuugaaacuacuuacagauuuccaaucauaucaguuaugggcuacauuacuaagucuaacauucaucaaaacuaccuucucauuacacuacgcauggaaaaccauggccaugguucuuucaaucgucagcuuguucccauuauguuuaagcacuacgucucagaaaacuacuugguuaccaguacugcuugguucccucggcuguaaaccauuaacuauguuuuuaauagcugagaauaaaauauggggucgaaagucauggccguuaaaugaaggaaucauggccguuggaauaguaaguauacuuuugagcucuuugcuuaaaaacgauguuccuuuggcaggaccauugauagccggugggauguuaaucgcauguuacgucauaucagggagcagugcagauuuaucccucgagaaagccgcagaggugagcugggaagaagaagcagaacacuccggcgcuucucacaauauucuaguggaaguucaagaugaugguaccaugaaaaucaaagaugaagaacgugacgacacucuaacuauuuuguugaaggcaacguuauuagcaguuagugggguauacccucugucgauaccagcaacauuauuuguuuggcacuuuuggcagaaaaagaaacagcggucgggaguacucugggauacgcccucuccaccagaagucgaacgagcaguauuagacgauggaaucuacaggaucaugcagagaggacuccuugggagaucucaaguuggcguuggaguuuuucaggagaacguauuccauaccauguggcacguaacccgaggugcaguucugauguaucaagggaaacguuuagaaccgucaugggcaucugucaagaaagaucuuaucucguauggaggaggauggagguuccaaggaucguggaauacuggcgaagaggugcaagucauugcagucgaacccggcaaaaauccaaagaauguucagaccgcuccuggcacuuucaaaacuccagaaggcgagguuggagcgaucgcucuagacuuuaagccuggcacuucaggcagcccuauugucaauagagagggaaaaaucguuggccuuuauggcaauggcgugguaacgacaaguggcaccuacguaagcgcgauagcacaagcgaaagcaucucaagagggcccauuaccagaaauagaggacgaagucuuuaggaaacguaauuuaaccauuauggaucuacacccggguucuggaaagacucgacgauaccuuccagcuauugugagagaggcaauuaaaagaaaguugagaacgcuaaucuuggccccuacacguguaguagccuccgaaauggcugaagcacuuaaaggcaugccaauuagauaccaaacgacagcugugaaaucugagcauacagguaaagaaauuguggaccucaugugucaugcgacauuuacgaugcggcuacuaaguccuguucguguaccuaacuacaauaugaucauaauggacgaagcacauuuuacagauccaucaucuauagcggcgagggguuacaucucaacgcgagucggcaugggugaggcugcagcaauauuuaugaccgcuacuccuccggguagcauggaagcauuuccacagagcaacgcgguuauacaagacgaggaacgagacauuccugaaagguccuggaacucuggcuacgaauggauaacugacuuuccagggaaaaccguuugguuugucccaucaauaaaagcaggaaaugauauugcgaauugccuacggaagaauggcaaacgugugauacaguugucaaggaagacauuugauacugaauaucagaaaacgaaaaauaaugauugggauuauguugugacaacugacauaagugaaaugggggcgaauuuuagggcagaucgcguuaucgauccaagaagauguuugaaaccgguuauuuugaaagacgggccagagagggucauauuagccggaccgaugccuguuacaguagcgucagcagcccagcguagaggaaggauaggcagaaaucauaauaaggagggugaucaauacauuuauaugggccaaccccuuaacaacgaugaagaucacgcccauuggacagaggcaaaaauguugcucgauaauauuaacacacccgaaggaauaauuccagcccuuuucgaaccagaaagagagaaaagugcugcgauagauggagaauacagauuaagaggggaagccagaaaaaccuucguggaauuaaugcggcguggugaucuaccgguuuggcuauccuacaaggucgcaucugaagguuuucaauacucggauagacgguggugcuucgauggugaaagaaauaaucaggucuuagaagaaaauauggauguagaaauuuggacaaaagagggggaaaggaagaaauugcgaccuagguggcucgaugcaaggacauauagcgauccucuagcauugagagaguuuaaagaguucgcagcgggaaggcgaucaguaucuggggaccugaucuuagaaauagguaaacucccccagcaccugacccaacgagcacaaaaugcauuagacaaucuggugaugcuacauaacagugaacaggguggcagagccuacagacaugcgauggaagaacuuccugauacuauagaaacacugaugcuguuagcauugaucgcuguacucacaggcggugugacgcuauuuuucuuaucgggcaaaggacuagguaaaacaucgauaggucuacucugugugauggcuagcuccguuuuacuauggauggccuccguagagccucacuggauagcagcaucaauaauucuagaauuuuuccuuaugguuuuauugauaccagaaccagaucggcaacguaccccgcaagauaaucaguuggccuauguggucauuggguuacuauuuaugauuuuaacaguugccgccaaugaaaugggcuuauuagaaacuacuaagaaagaucuagggauuggccacgucgccguugaaaaccaucaucaugccgccaugcuagauguagacuuacauccagccucagcauggacucuauaugcggucgcuacaacaauuaucacucccaugaugaggcauaccauagagaacacgacagcgaacauaucacucacagccauugccaaucaagcagccauucucauggguuuagacaagggauggccaauauccaagauggauauaggaguaccauuacuggcacuagguuguuacagccaagugaauccauuaacgcuaaccgcggcaguuuugauguuaguagcucauuaugccauaauaggaccaggucugcaagcuaaagcaacaagagaggcucaaaagagaacagcagcaggaauuaugaaaaacccuacaauagacggcaucguagcgauagauuuagaucccgugguguaugaugcgaaguucgaaaagcaauuaggacaaauuaugcuauugauccuaugcaccucacaaauucuguugaugagaacuacaugggcuuuaugcgaaucuauuacucuggcgacagguccuuugacgacauuaugggaaggcaguccuggaaaauucuggaacacaacuauugcagucagcauggcgaacauuuuuagagguaguuacuuagcaggggcgggauuggcguuuagcuuaaugaagagucuaggggguggccgacgagguacgggagcacaaggggaaacucugggagaaaaguggaaaaggcaacuaaaccaauuaucuaagucagaauuuaacacguacaagaggagcggaauaauggaaguagaucguuccgaagcgaaagaaggauugaaaagaggagagaccacuaaacacgcgguuucgcgugggacggcaaaauugcgaugguucguagaaaggaaccugguaaagcccgaagguaaaguaauagacuuagguugcggaagaggugguuggagcuacuacugugcaggucucaagaaagucacagaggugaaaggauauacgaaagggggaccaggucaugaagaaccaauuccaauggcuacauauggcuggaaccuaguaaaacugcauucagggaaagacguauucuuuauaccgccggaaaaaugcgacacacuguuaugcgacauuggggaaucaucucccaauccaacaauagaggagggacgcacuuuacgcguguugaagaugguugaaccauggcucaggggaaaucaguuuuguauaaaaauacuaaacccauauaugccgucaguuguggaaacauuagaacagaugcaaaggaaacauggaggcauguuaguuaggaaccccuugaguagaaauucaacacaugaaauguacugggugucuuguggaacgggaaauauaguaagcgcaguaaacaugacgagccgcauguuguugaacagauuuacaauggcucaucgcaaaccgacauaugaaagagacgucgauuuaggggcugguacgaggcauguugcuguagagccagaaguagcuaauuuagauauuauuggucagcgaauagagaauauaaagcacgaacacaaguccacauggcauuaugacgaagauaauccguauaaaaccugggcauaucauggaagcuaugaaguaaagccaucagguagugcgucaucaaugguuaaugguguaguaaaacuucuaacgaaaccaugggacgucauuccuaugguaacacaaauagcaaugaccgauacaacaccauucggacaacaacgaguuuucaaagaaaaaguggacacaagaacaccaaaggcaaaacgagguacagcccaaauuauggaagugacagcacgaugguuguggggcuuccuuaguagaaauaagaaaccgcguauaugcacacgagaagaauuuacuaggaaaguacguucuaaugcggcaaucggagcaguauucguugaugagaaucaauggaacagcgcaaaagaggcagucgaagaugaccguuuuugggaccugguacacagagaacgcgaacuacauaaacaagggaaaugugcaacguguguauauaauaugaugggaaaacgcgagaagaaauuaggagaauuuggaaaagcgaagggaucuagagcaauuugguauauguggcugggugcaagauuuuuagaguucgaagcauuaggauuuaugaacgaagaucacugguuuucaagagaaaacucacuaaguggagucgaaggggagggacuucauaaacuugguuacauauuaagagauauaucaaaaauuccugggggaaacauguacgcggacgacacugccgguugggauacaaggauaaccgaagacgaucuacaaaaugaagcuaaaaucacggauauaauggaaccugaacaugcguuauuagccaagucaauauucaaacuuaccuaccagaauaaggucguaagggugcagagaccagcuaaaaauggaaccgucauggaugucauuagcagaagagaccaacgugguaguggccaaguagguacauacggacuaaacacguuuaccaauauggaagcacaacucauaagacaaauggaaagcgaagguauauuucuaccuaaugaacuugaaacaccuaaucuugcaggucguguucuggacugguuagaaaaguacggaguugaacgccucaaacguauggcaauaagcggagaugacuguguaguaaaaccaaucgacgaucguuuugcuacugccuuaaccgcucuaaaugauaugggaaagguaagaaaagacaucccucagugggagccuucgaaagguuggaacgauuggcaacaaguuccuuuuuguagccaccacuuucaucaguuaauuaugaaagauggaagagaaauagugguuccaugcaggaaccaggaugaguuaguuggacgugcuaggguaagccaaggugccgguuggagucuaagggaaaccgcauguuuagggaagucuuaugcucaaauguggcagcuuauguacuuucaucgaagagaucuacgacuagcagcgaacgcgauuugcucagccgugccuguggacuggguucccacgucaagaaccacuugguccauccaugcucaccaucaguggaugacuaccgaagacaugcuuucaguuuggaaccgcgucuggauagaagagaacccauggauggaggauaaaacucgcauaucaucaugggaagauguacccuacuuggguaaacgggaagaucaauggugcggaaguuuaauaggucuaacagccagagcaacgugggcaacgaauauucaagucgccauaaaucaggugagacgccuaaucgggaaugaaaacuauagcgauuauaugauuucaaugaagcguuuuaagaaugaaucagagccugaaggcgcuuuaugguaa

SEQ ID NO: 21551 - RNA, 9879 nt, Artificial Sequence
  derived and/or modified CDS sequence (opt6) from DENV-1__FJ410213__SS-prME
uccguaacuaugcuucuaauguuaaugccuacugcucuggcuuuccaucucaccacccgagggggugaaccccauaugaucguaacaaaacaagaaaggggaaaaucgcuacuauuuaaaaccagcgcgggcguaaauaugugcacacuuaucgcaauggaucuaggggaacugugcgaagauaccaugacguauaaaugcccucgcaucacugaagcagaacccgacgauguugauuguugguguaacgcaacggacacaugggucaccuauggcacuugcucgcaaaccggggaacacagaagagauaaacggucaguagcacucgcuccgcauguuggucugggccuagaaacccgcacugaaacauggaugagcagugaaggagcuuggaaacaaauccaacggguugaaacaugggcccuucgacaccccgguuuuaccgucauagcacuauuuuuagcucacgcaauuggcacaucaauuacgcaaaaaggaaucauuuucauacuacuaaugcugguuacuccaucaauggcgaugagauguguagguaucgggagccgagacuucguagaaggacuaucuggggcgacuuggguagacguaguccuagaacacgguaguuguguaacaacaauggcaaaagauaaacccacguuggacauagagcuucugaaaaccgaggucaccaauccggcugugcuaagaaaauuaugcaucgaagcuaaaauaaguaacacuacaacagacucacgaugcccuacucaaggagaagcaacacucauggaagaacaagacgcgaauuuugugugucgacgcacuuucguagaucguggauggggaaaugguuguggccuuuuuggaaaagguucuuuaauuacuugugcuaaauucaaguguguuaccaaguuggaagggaaaauugugcaauaugagaaucugaaauacucagugauaguaaccguccauacaggagaccaacaucaaguaggcaaugaaagcacugaacacggaacgacagcuacaauaaccccacaagcgccaacguccgaaauccaacugacggacuauggcgcuuuaacuuuggacuguucaccacggacaggacuggauuucaaugaaaugguccuauuaacaaugaaagagaaaucguggcuuguacacaagcaaugguuuuuagacuuaccauuaccuuggacaaguggggcaagcaccagucaggaaaccuggaaucgacaggaucuuuuaguuacuuucaaaacggcacacgccaagaaacaggaagucguaguuuuaggaucacaagagggagcaaugcacaccgcgcuuacaggugcgacagaaauucaaacaucagguacgacaacuaucuucgcaggucaucugaaauguagauuaaaaauggauaaguugacuuugaaaggcaugaguuauguaauguguacuggcucauucaagcuggaaaaagagguugcagaaacccagcacgguacuguauuaguucaaaucaaauaugagggaacagaugcaccuuguaagaucccuuucucuacgcaagacgagaaaggcguaacccagaauggaagacuaauaaccgcaaauccgauaguuacagauaaagaaaagccagucaacauagaggcugagccaccuuucggagagucguacaucguaaucggcgcaggcgaaaaagcauugaaguuaucaugguucaagaaggguagcaguauuggcaagauguucgaagcgacagcaaggggagcuagacgaauggcuauacuaggcgacacugcaugggacuucggaucaguaggaggggucuuuacaagcgucggaaaguuagugcaucaaauauuuggaacagcauacgggguucuauuuucaggaguaagcuggacgaugaaaauaggaauaggaguucuccuaacauggcucggauuaaauucgcgaucaacaucauugucgaugaccugcauagcaguagguuugguaacucuuuaucuaggcgucaugguacaagcggauucugguuguguuauaaauuggaaaggcagggaauuaaaauguggaaguggaaucuucgucacuaacgaaguccacaccuggacugagcaguacaaauuucaagcagacucgcccaagagacugagugcagcaaucggcaaggcaugggaagaaggaguaugcggcaucagaagcgcuacaagguuagagaauauuauguggaaacaaauaucaaacgaauuaaaccacauacuucuugaaaacgauaugaaauuuacuguaguaguuggcgaugucguugggauacuugcccaaggcaagaaaaugauuagaccgcagccaauggaacauaaauauucuuggaaaagcuggggaaaagcaaaaauaauaggagcggauguucaaaacacaacguuuauaauugauggaccaaacacccccgaguguccagacgaucaacgagcauggaauauuugggaaguggaagauuacgguuucggcaucuuuacgacgaauauuugguugaaacuucgcgacucauauacacaagugugugaccaucgacucauguccgcagcaauaaaagacucuaaagcaguacacgcugauaugggcuacuggauagaaucagagaaaaacgaaacauggaaacuagcuagggcaucauucaucgaaguaaagaccugcauuuggccuaaaucucauacuuuauggucaaaugggguacuagaauccgagaugauaauaccuaaaaucuacggaggaccgaucagccaacauaauuaucguccagguuauuucacccaaacugccgggccuuggcauuuaggaaaacuagaauuagauuuugaccugugugaagggacaacaguagucguagacgaacacugugguaaucgugggccgagucugcgaacgacaacugucacaggaaaaaucauccaugaaugguguugucgaucauguacgcucccaccguuaagauuuaagggagaagauggauguugguacggcauggaaauucgaccugucaaagaaaaagaagaaaaucuaguaaaaagcaugguaucagcagggucuggcgagguagauucauucucgcuuggcuuauuaugcauuucaauaaugauugaggaagugaugcggagucgauggucaaggaaaauguuaaugacaggaacgcuagcuguuuuccuuuuauugauuaugggccaguuaacuuggaacgacuuaauuagguuauguauuauggugggcgccaaugccuccgaccguaugggcauggguaccacuuaucuugccuuaauggccacuuucaagaugaggccuauguuugcugugggcuuauuauuucgacgacugacaucgagagaaguucuacuauuaacuauagguuugaguuuaguugcuagcguggaacuuccaaauucccuugaagaacugggugauggccuagcaauggguauaaugaucuuaaaacucuuaacagauuuucaaucacaccaauugugggcaacccuguuaucucucacuuuuauuaagacuacccuaucucugcauuaugcguggaaaacaauggcuaugguacugucuauaguuucuuuauuuccccucugccuuucaacuacaagucagaaaacuacuuggcugccuguacuacucggaucacuaggauguaaaccauugacuauguucuugauuacugaaaacaaaauuuggggcagaaagagcuggccccuaaacgaggguauaauggcagugggaguaguaagcauacugcuuaguuccuuguuaaaagacgaugugccauuggcagggccauugauugcugguggaaugcuuauagcauguuacguaauuaguggaucgagcgcagauuuaucucuugaaaaagcugcagaggugaguugggaagaagaagcagaacauaguggagcaagucauaauauccugguagaaguccaagaugauggaaccaugaaaaucaaagaugaagaaagggaugacacccugacuauacuacuaaaggcuacacucuuagcuguaucaggggucuacccccuaucaauaccggcaacacuauucgucugguacuucuggcaaaagaagaaacaacggaguggggucuuaugggauacaccuaguccaccagagguagaaagagcuguguuagacgaugggauauauagaauaaugcaacgcggucuacuuggacguucacaagucggagugggcgucuuucaagaaaauguauuucacacaauguggcauguaacaagaggugcuguacuaauguaccaaggaaaaagauuggaaccaucaugggcuagugugaagaaagaucuaauaucguaugguggggguuggagauuacaggguaguuggaacacgggggaagaaguacaaguaaucgcgguagaacccgguaaaaaucccaaaaauguccaaacagcuccuggaacauucaaaacuccagaaggagaaguuggcgcaauagcuuuagacuuuaagccagguacaucagguucuccaauuguuaaccgugagggaaagauagucggauuauaugguaaugguguuguaacuacuucuggcacauacgugagugcuauugcucaggcaaaagcaucucaagaaggaccauuaccagagauugaagaugaagucuuucgcaaacgaaacuugacuauaauggaccugcauccaggaucuggaaaaacuagaagauauuuaccagcaauaguacgcgaggccaucaaaagaaaauuaagaaccuuaauauuagcaccaacucggguuguggccagcgaaauggcggaggcuuuaaagggaaugccaauucgauaucaaaccacggcgguaaaaucggaacauacgggaaaagaaauaguagauuuaaugugccaugccacuuuuacaaugagauuauugaguccaguuagaguaccaaauuauaacaugauuauuauggacgaagcacauuuuacagauccuuccucaauagcagcaagaggauacauaagcacaaggguagguaugggcgaggcugcagccauauuuaugacugcaacaccacccgggucgguggaggcauuuccgcaaagcaaugcgguaauacaggacgaagaaagagacauaccagagcguaguuggaacucaggcuacgaauggauaaccgacuucccaggaaaaacggugugguuugugccuucaauaaaaucagggaaugauauugcgaauuguuuacgaaagaauggaaaacgaguaauucaguuaagcagaaagacauucgacacugaguaucagaaaacgaaaaauaacgauugggauuauguugugacuacagacauauccgaaaugggugcgaauuuuagagcagaccgaguaauagacccgagaagauguuugaaaccagugauauuaaaagacggaccagaaagagucauauuggcgggacccaugccaguuacaguagcaucagcggcacagaggagagggcgaauaggucgaaaccauaacaaagaaggcgaucaauauauuuauaugggacaaccucucaacaaugacgaagaccacgcacauuggacagaagcaaagaugcucuuagauaauaucaacacaccagaagguauuauuccagcucucuuugaaccggaaagagaaaagagcgcggcaauagauggcgaauacagauugagaggggaagcgcgaaaaacuuuuguagaacuaaugagaagaggugacuuacccguauggcuauccuauaagguagcauccgagggauuccaauacagugaucggagaugguguuuugauggugaaagaaauaaucaaguacuagaggaaaauauggaugucgaaaucuggacaaaagagggagaaagaaagaaauugcggcccagguggcuggaugcuagaaccuauucagacccccuggccuugcgugaauuuaaagaauuugcugccggucguagaagcgucaguggagaucugauacucgaaauuggaaaauugccacaacaucugacacaacgagcucaaaaugcccuggacaacuuagucaugcuccacaauucagaacaaggagggcgcgcauaucgacacgcuauggaagaauuaccagauacgauagaaacccuaaugcuguuggcccuuauugcaguccuuacaggaggaguaacacuauucuuucugagcggucgaggauugggaaagacuagcauaggguuauuaugugucauggcgucuucuguucuacuguggauggcuagcguugaaccccacuggauagcggcaucuauaauccuagaauuuuucuuaaugguacucuuaauaccugaaccugauagacaacgaacuccacaagacaaccaacuagcauacguuguaauaggcuugcuuuuuaugauauuaacgguagcugcaaaugagaugggcuuauuagaaacaaccaagaaagaucuaggcauuggccauguagcaguugaaaaucaccaucaugcaacgauguuggacguggacuuacacccagcaagugcauggacgcuuuaugcagucgcgacgacaauuauaacccccaugaugagacacacuauugaaaauacaacagcgaacauaagucucaccgcaauagcuaaccaagcggcaauauugaugggacuggauaaaggauggccgaucaguaagauggauauaggaguaccguuauuagcuuuagguuguuauagccaaguuaacccucuaacucuaacagcagcagucuuaauguuaguagcccacuacgcaauaauaggaccggggcuucaagcuaaagccacgcgggaagcucagaagagaacagcggcaggaauuaugaagaaucccacaguugacggcauagucgccaucgaccuggacccuguggucuacgaugcaaaauuugaaaaacaacucggacaaaucaugcuacuaauucuguguacgucucaaauccuucuaaugagaaccacaugggccuuaugugagucgauaaccuuagccacaggcccauuaacaacucugugggaagguaguccuggaaaauucuggaacacuacaauagcagugucaauggccaauauuuuccgagggucuuaucuagcgggcgcuggauuggcauucucccuuaugaaaucuuuaggaggcgguagacgaggaacgggagcacaaggcgagacacuaggugagaaguggaaacgacaauugaaccaacugagcaagagugaauuuaauauauacaaaaggucugguaucauggagguggauagaagcgaagcuaaggaaggucugaaacgaggagaaacgacucgacacgccgucucucgaggcacagccaaacuccguugguucguggagagaaaucuggucaagccugaaggaaaaguaaucgaccucgguugcggaagaggcggguggagcuacuauugcgcagguuuaaagaaaguuacagaagugaaagguuacaccaaagguggcccuggacacgaggagccuauuccgauggcuacauauggguggaacuuaguuaaacuacauaguggaaaagaugucuucuuuacaccgcccgaaaagugcgauacauugcuaugugacaucggagaaucgucuccaaauccgacaauagaggaggguagaacacugcgaguguugaaaauggucgagccaugguuaagagggaaucaauuuuguauaaagauacugaacccuuacaugccaagcguugucgaaacgcuagaacaaaugcaacggaaacaugggggcauguugguccguaacccucugucuaggaacagcacgcaugagauguauuggguaucaugcggaaccgguaacaucguaagugcugugaacaugacgucgagaaugcuauuaaaccgguucacuauggcucacagaaaaccaacauaugagagagacgucgauuuaggagcuggaacacggcauguugcuguagaacccgagguugcuaauuuagauauaauuggucaacgcauagaaaauauaaaacacgaacauaaaucaacguggcauuacgaugaggauaauccguauaagacuugggcauaccauggaucguacgaaguuaaaccaucuggaucugcgucuucgauggucaauggaguuguaaagcuacuaacaaaacccugggacguaauuccaauggugacccaaauugcaaugaccgauacuacaccuuuuggucagcagcgaguauucaaggaaaaaguagauacacgaacucccaaggcaaagagagguacugcacagauaauggaagugacggcaagaugguuauggggauuuuugucgaggaauaagaaaccucguauauguacuagagaggaguucacaagaaaaguucgaucaaaugcagccauuggagcgguuuuuguugacgaaaaccaauggaacuccgcaaaagaagcgguugaagaugagcgauuuugggauuugguacaaaaagagagagaacuucauaagcaaggaaaaugugcaacauguguauacaauaugaugggaaagagagagaagaaacuuggcgaauuuggaaaagcaaaggguagucgcgcaaucugguacaugugguugggagcgcguuuucucgaauuugaggcccuaggauuuaugaaugaagaucauugguuuagcagggaaaauucucucaguggaguggagggggaaggacuacacaaacuaggauauauucuucgcgauauaucuaaaauuccggguggcaauauguaugcugaugacaccgcugguugggacacacguauuacagaagacgacuuacaaaacgaggcuaaaaucacugacaucauggaaccagaacaugcucuacuagcgaccucaauauucaaauugacauaucaaaacaaagucguaagagugcagcgucccgcgaaaaauggcacgguaauggauguaauaaguaggagagaucagagaggcucaggacaagucgggacauauggacucaacacauucacuaacauggaagcgcaauugauccgacaaauggaaucggagggaauuuuucuaccuucagaguuagagacacccaaccuagcagaacgcgucuuggacuggcuugaaaaauauggagucgaacgacugaagagaauggcuaucaguggagaugauugugucguaaaaccuaucgaugauagauuugccacugcuuuaacggcccuaaaugauaugggcaaaguuagaaaggauaucccccaaugggaaccgucaaaaggcuggaacgacuggcagcaaguuccguucugcucucaucacuuccaucaguugaucaugaaagauggccgagaaauaguaguaccaugcaggaaucaggaugaauuaguaggucgggcccgaguuagucaaggcgccggauggagcuuacgagaaacggccugccuuggaaaaucauacgcacaaauguggcaacucauguauuuucauagaagagacuuacgacuagcggcgaaugccauauguagugcaguacccguugacuggguaccgacgucgagaacaacguggucuauacacgcacaucaucaauggaugacaacagaggauauguuauccguuuggaacagagucuggauagaagaaaauccauggauggaagauaagacgcauguaucaaguuggggagauguaccauaccugggaaaacgagaagaucaauggugugguucacugauagguuuaaccgcucgagcuacaugggccagcaauauucagguugcgauuaaucaaguaagaagacugauuggaaacgaaaauuauuuagauuacaugaccaguaugaaaagauucaaaaacgaaggagacccagaaggagcucuaugguaa

SEQ ID NO: 21552 - RNA, 9879 nt, Artificial Sequence
  derived and/or modified CDS sequence (opt6) from DENV-1__FJ461308__SS-prME
agcguuacgaugcucuugauguuaaugccuacagccuuagcauuucaccuaacaacacgaggcggugaaccacauaugauuguuaguaaacaagaacgcgguaaauccuugcuauuuaaaacaucugccggaguaaacauguguacgcuaauugccauggaccuuggagaguuuugugaagauaccaugacuuacaaaugucccaggauaacggaagcggaaccagaugauguagauuguugguguaacgcuaccgauacgugggugacuuauggaacgugcucacaaacuggggaacacaggcgugauaaacgaucuguggcacuagccccucacguuggucucggacuugaaacaagagcugaaacauggaugaguucagagggugcuuggaaacaaauacaacguguugaaaccugggcucuccgucauccugguuucacuguuauagcucuuuuucuagcacacgcaauugggacaaguauuacgcagaaagguauaaucuuuauacuguuaaugcuaguuacaccgagcauggcaaugagauguguaggaaucgggucacgggauuuuguagagggccuuucaggggcaacaugggucgauguuguccuugaacaugguucuugcguaaccacaauggcuaaagacaaacccacuuuagauaucgaacuacuaaaaacugaaguaacgaacccagcuguauuacgaaaauuaugcauagaagcuaagaucagcaauaccacgaccgauagccgaugcccaacacaaggagaagcuacacuggucgaagaacaagacgcaaauuucguaugcagaagaacauuuguagaucgugguugggguaacggauguggccuauucgguaaaggcagcuuaauaacaugugcgaaguuuaaaugcguuaccaaguuagaaggaaagacaguacaauaugaaaauuuaaaauauagugucaucguuacuguucauacaggagaucaacaucagguggguaaugagucaaccgaacacgguacuacagcaacuaucacgccucaagccccaaguacggaaauucaguuaacugacuacggagcguuaacucuagauugcucuccccgaacuggucuggauuucaaugaaauggugcuuuugacgaugaaagagaaaaguugguuggugcauaaacaaugguuucuagauuugccucuaccguggacgaguggugcaaguacaucacaagagacuuggaaucguaaagaccugcuaguuacauucaagacagcacacgcgaagaaacaagaaguaguaguucuugguucacaagagggagccaugcauacagcacuaacgggagcaacugaaauccaaacuucagguacaacaacaauauucgcaggacaccuaaaaugucgacuaaaaauggacaaauuaacacucaaggguauguccuacguuaugugcacaggcucguucaaguuagaaaaagaaguugcagaaacucagcauggcacuguucuaguacaaauaaaauaugaagguaccgaugccccuuguaagauccccuucucuacucaggacgaaaagggugugacacaaaauggccggcucauaacugcgaaucccaucguaacugauaaagaaaaaccuguaaauauugaagcggagccaccauuuggagaaucuuguauagugauaggagcaggcgagaaagcacuuaaacuuaguugguuuaaaaaggggucuuccaucgguaaaauguuugaagcgaccgcccguggagcaaggcgaauggcgaucuuaggcgacacagcuugggauuuuggcuccauagguggagucuucacuucggugggcaaauugguccaucagauauucggaaccgcuuacggaguccucuuuucugguguauccuggacaaugaaaauugggauagguguacuuuuaacuuggcucggucuaaauaguaggucaacaagccuaucgaugacauguaucgccgugggccucguaacucuuuacuuaggcguaaugguacaagccgauucugguuguguaauaaacuggaaaggacgugaacuuaaauguggcagugguauauuuguaacaaacgaaguacacacguggacugagcaauacaaauuccaagcggauucaccuaaaagacucagugcggcaauaggcaaagcaugggaagaagguguuugcggaauaagaagugcaacgcgauuagagaauauuauguggaaacaaauuagcaaugaguugaaccauauccuucuagaaaacgauaugaaguucacaguaguaguaggagauguagcaggaauacucgcgcaagggaaaaagaugauaagaccacaaccuauggaacauaaauauucauggaaaagcugggggaaagcaaaaaucaucggagccgacguacaaaauacuacuuuuaucauagauggaccuaacacaccggaaugcccggaugaucaaagggcuuggaauauuugggaagucgaagauuaugguuucggaaucuuuacaacaaacaucugguuaaaacugagggauucauauacucaaguuugcgaucaucgacuaaugagugcugcaauuaaggauaguaaagcaguccacgcugacaugggcuacuggaucgaaagugagaaaaaugaaacauggaaacuugcccgugcgagcuuuauagaagucaaaacguguauauggccgaaaagucauacacuuugguccaacggaguucuugagagcgaaaugaucauuccaaagauauacggcggaccuauuagucaacacaauuaucgaccuggcuacuucacgcaaacggcaggaccuuggcaucugggaaaacuagaauuagacuucgaucuaugugaaggaacaacaguuguaguggacgaacauugcggaaaucguggcccuuccuugagaaccacgacugucacugggaaaaucauccacgaaugguguugucguucuugcacccuaccaccucuacgcuucaaaggagaggaugguugcugguacggcauggaaaucaggccgguaaaggaaaaggaggaaaauuuaguaaaaaguaugguaagugcuggcucaggcgagguagauagcuucucucuaggauuauuaugcauuuccaucaugauugaggaaguaaugcguucaagauggucucgaaaaaugcucaugacaggaacuuuagccguauucuuucuacuaauuaugggacaacuaaccuggaacgaucuuaucagguuauguauaaugguaggagcaaaugcaucagauagaaugggcaugggaacgacauaucucgcguuaauggccaccuuuaaaaugagaccaauguucgcugucggauuguuauucagaagauuaaccaguagagaaguacuacuacucacaauuggccucaguuugguggccucgguagagcuuccaaauucguuagaagaacucggagauggccuagcaauggguauaaugauucuaaaacuuuugacagacuuccaaagccaccaacucugggcaacacuucuaucccuuaccuucaucaaaacaacguucucuuuacauuaugcauggaaaacaauggcgaugguacuaucgaucgucaguuuguuuccauugugucugaguacaacaagccagaaaacuacuugguugccgguuuugcuagggagucuagggugcaagccauugaccauguuccucauugcugaaaauaagauuuggggcagaaaaagcuggcccuuaaaugaaggaauuauggcugucggaauaguaaguauacuguuaaguucauuacuuaaaaacgauguuccucuagcaggaccacuuauugcaggaggaaugcugauugcuuguuauguuauaucagguaguucugccgauuuauccuuagaaaaagcagccgaagugucuugggaagaggaggcggaacacucaggugcaagccacaacauuuuaguagaagugcaagacgacggaacgaugaagauaaaagacgaagaaagggacgauacccuuacaauuuugcuuaaagccacguuacuggcaguaucaggaguuuacccacuuaguauaccagcuacuuuauuugugugguauuuuuggcagaagaagaaacaacgaaguggaguguugugggacacgccauccccaccagaaguggaaagagcgguuuuggaugauggaauauaucguaucaugcaaagaggacuucuaggacgaagucagguaggggucggaguauuucaggaaaacguauuucacacgauguggcauguaacacgaggagcgguacuaauguaccaaggaaaacggcuagaaccuucaugggcgagugucaagaaagaccuaauaucguauggaggugguuggcgguuacaagggucauggaauaccggagaagaaguacaagugaucgcaguugaacccggcaagaaucccaaaaaugugcagaccgcaccgggaacuuuuaaaacuucagagggagaagucggagcgauagcuuuagauuuuaaaccuggcacuucuggaucaccaauuguaaauagagaaggaaaaauaguaggacuauaugguaauggaguuguuacgacaagcgguacauacguuagugcuauagcacaagcaaaagcaucucaagagggcccuuuaccagaaauagaggacgaggucuuucguaaacggaaucuuacaauuauggaucuucauccuggaucuggaaaaaccagacgcuaccuaccggcuauuguacgggaagcaaucaagcgcaaacuaaggacuuuaauccuagcuccaacaaggguuguagcguccgaaauggcagaagcguugaaaggaaugcccauacguuaccagacuacugcuguuaaaucggaacacacugggaaagaaaucguagaccuuaugugucacgcuacuuucacgaugagauuacuuaguccuguaagaguaccaaacuacaacaugaucauaauggacgaagcgcauuucacagacccuucaucaauagcggcaagaggauauauaaguacuaggguaggaaugggcgaagcggcagcaauauuuaugacagccacaccuccuggaucaguggaggcauuuccucaaucaaaugcaguaauacaggaugaggagcgcgauauaccagagagaucauggaacuccggauacgaauggauaacagauuuuccaggaaaaacagucugguuuguacccaguauaaaauccggaaaugauauugcaaacugccuccgaaagaacgguaaacgggugauacaauuaucaaggaaaacauuugauacugaauaccaaaagacgaagaauaaugauugggauuauguaguaacgacugauauaagugaaaugggugcaaacuuccgggcugauagaguuaucgacccaagacgaugcuuaaaaccuguaauucuaaaggacgguccagaacgaguaauccuggccggaccaaugccuguaacugucgcguccgcagcgcagagacguggacguauaggcagaaaccacaauaaggagggagaucaguauauauauaugggacagccuuuaaacaacgaugaagaucacgcacacuggacagaagccaaaauguugcucgauaacaucaauacaccagaagguauaaucccugcuuuauuugaaccugaaagagaaaaaucugcagcgauagacggcgaauaucguuuacgcggggaagcucguaagacauuuguagaauuaaugcgaagaggagauuugccggugugguuaucauauaaaguugcaucugaggguuuucaauauuccgauaggagauggugcuuugacggggaaagaaauaaucagguuuuagaagaaaacauggacguagaaauuuggacaaaagaaggagaaaggaagaaacuacgcccucgaugguuggacgccagaacauauagugacccacuggcuuuacgagaguuuaaggaguuugccgcuggucggaggaguguuagcggugaccuuauucuugagauagguaaacuuccacaacaccuaacacaacgugcacagaaugcacuggacaaucuuguaaugcuucacaauucagaacaagguggacgggcauaucgccaugcaauggaagaauuaccugauacaauagaaacacuaaugcuccuggcuuuaauagcgguacuuacagggggugucacuuuauucuuccuaaguggaagagggcuaggaaaaaccuccaucggccuauuaugugugauggcaaguucagucuuacuguggauggcaucuguagagccacauuggauagcugcguccauaauccuagaguucuuucuaaugguacuacucauaccagaaccggacaggcaacgaacaccacaagauaaccaacucgcuuaugucguuaucggccuacuuuucaugauauuaacgguagcagccaacgagaugggacucuuagaaacaacuaagaaagaccuugggauuggacauguggcaguagaaaaccaccaccaugcggccaugcuagauguagaucuccauccagcaucagcguggacauuauaugcaguugcuaccacaauuaucacaccgaugaugcgacacacuauagagaauacuacagcuaacauaaguuugacggcaauugcaaaucaagccgcaauauuaaugggacuugauaaaggauggccgauaagcaagauggauaucggaguuccucuauuagcgcuaggcuguuacucucaagugaacccucucacucuaacugccgcaguguuaaugcugguagcucacuacgcaauaauagggcccggacuucaagcaaaagcuacccgugaagcacaaaagcguacagcugcaggcauaaugaaaaauccaaccgucgacgggauaguugcaaucgauuuagauccaguuguauaugacgcgaaguucgaaaaacaauugggucagauaauguugcucauccucugcacuucacaaauacuucugaugcguacaacaugggcauuaugcgaauccauaacacuggcuacgggucccuugacaacucuaugggaaggaucgccagguaaauucuggaauaccacaauagccguuucuauggcaaauauauuuagaggcagcuaccuugccggugcaggacuagcguuuagucuaaugaaaucacuuggugguggccgacgagguaccggagcacaaggagaaacacucggagaaaaauggaaacgucaacuaaaucaacuaaguaagucagaguucaacacuuauaaaagaucgggaaucauggagguugauagaagugaggcgaaagaaggccugaaaagaggggaaacaacuaaacaugcgguaaguaggggaacggcaaaacuucgcugguuugucgaaaggaaucuuguuaagccagaggguaaaguaaucgaucuagguuguggaagagguggauggucauauuauugcgcugggcucaagaaaguaacagaagugaaaggauauacaaaaggaggcccgggacacgaggaaccgauuccaauggccacauaugguuggaaccugguaaaauuacacagcggaaaagaugucuucuucauuccaccggaaaaaugugauacuuugcuaugcgauauuggcgagaguucccccaaccccacaauugaagaagguaggacucugagggugcuaaaaaugguggagccuugguuaagaggaaaccaauucuguaucaaaauacuaaacccuuauaugccaucaguuguggagacguuagagcaaaugcaaagaaagcacgguggcauguugguuagaaauccucucagucguaacucaacacaugaaauguauugggugagcugcggaacagguaacaucguaucugcaguaaauaugacaucccggaugcuacuuaauagauuuacgauggcacaccgaaaacccacuuaugaaagagacguagaucucggcgcaggcacaagacaugucgcuguagagcccgaaguggcuaaucuggacauuauaggccagagaauugaaaauauuaaacacgaacauaaaucuacuuggcacuaugacgaagauaaucccuauaaaacaugggcauaccacgguucauacgaagugaagccaucaggaagcgcauccagcaugguaaacggcguugucaaacuacuaacaaaaccgugggacguuauacccauggucacucaaauagcuaugaccgacacuaccccauuuggucaacaacgugucuucaaagaaaaagucgauacucgaacaccaaaagcuaaaaggggaacugcacaaaucauggaaguaacggcaaaauggcucugggguuuccucagcaggaauaaaaagccuagaauauguacacgugaagaauuuacucgaaaagugaggucaaaugcagcaauaggugcgguuuuuguagaugaaaaccaauggaacuccgcuaaagaagcuguggaagaugaacgguuuugggauuuaguccauagggagagggaguuacauaaacaaggaaaaugugcgacauguguauauaacaugaugggaaaaagagaaaagaaacuaggugaauuuggcaaggcgaaagggucaagggcaauuugguauauguggcucggcgcaagauuuuuagaauuugaagcgcugggcuuuaugaacgaggaucacugguucagcagagaaaauucccucucagggguugaaggugaaggauugcacaaguuaggauauauccucagagacauuaguaaaauaccugggggcaacauguaugccgacgauacagcaggcugggauacgagaauuacugaagaugaucuacaaaacgaagcgaaaauaacagauauaauggagccagagcaugcuuuacuggcuaaaaguauauucaaacuaaccuaucaaaacaaaguuguuagaguucaaaggccagcgaaaaacgguacaguaauggaugucaucagucgacgagaccaacgagggucaggucaaguaggaacuuacggacuaaacacauuuacgaauauggaagcgcaauuaauaagacaaauggaaucagaagguauuuucucgccaucugaacuugagacgccgaauuuagcagggagaguuuuagauuggcuagaaaaacacgguguugaacguuuaaaacgaauggcgauaucaggagaugauuguguugugaaacccauagacgauagguucgccacugcguugacagcuuuaaaugacaugggaaagguaagaaaagacauuccgcaaugggaacccaguaagggcuggaaugacuggcaacagguccccuuuugcucacaccauuuccaucaacuaaucaugaaggaugggcgugagaucgucguacccugucgaaaccaagacgaauuaguuggaagggcucguguaagucagggagcaggauggagccuuagggagaccgcaugccucggaaaguccuaugcacaaauguggcaauugauguacuuccacagacgagacuugagacuggcagcaaacgcaauaugcucugcaguuccuguugauugggucccgaccucacggacaacuuggaguauacacgcccaucaccaauggaugacaacugaagauauguuguccguuuggaauagggucuggauagaagaaaauccauggauggaagauaaaacacacauaagcucuuggggcgauguuccuuaucucgggaaacgggaggaucagugguguggaagucuuaucggcuuaacagcuagagcaaccugggcuacaaacauacaaguagcgauaaaccaaguaagacgauuaauuggcaaugaaaacuaucucgauuauaugacaaguaugaaaagauucaagaacgaaucugacccggaaggggcacuaugguaa

SEQ ID NO: 21553 - RNA, 9879 nt, Artificial Sequence
  derived and/or modified CDS sequence (opt6) from DENV-1__FJ461310__SS-prME
ucuguaacaaugcuacuaaugcugaugccuacugcuuuagcguuucaucucacaacucgaggcggggaaccgcauaugauaguauccaaacaagaaagagggaaaucauugcucuuuaaaacauccgcaggaguaaauauguguacguuaauugcgauggaucucggagaacuaugugaagauacaaugacuuacaaauguccacgaauuacagaagcggaaccagacgacguugauuguugguguaaugccacagacaccuggguaaccuacgggacaugcucacaaacaggugaacaucggcgugauaagaggucgguggcccucgcuccccacguaggacucgguuuggaaacacgaaccgaaacauggaugucaucggaaggagccuggaaacaaauacaacgaguggagacuugggcacuuagacauccuggauuuacaguuauagcacuauuuuuggcucacgcgauaggaacaagcaucacacaaaaagguauaauauuuauauuguuaauguugguaaccccuagcauggcuaugagauguguugggauuggaagucgagacuuuguggaaggacuuucaggcgcaacuuggguagacgucguccucgaacauggguccuguguuacaacgauggcaaaagauaaaccaacccucgacauugagcuguugaaaacggaagugaccaacccagccguucuaagaaaacucuguauugaagcuaaaauauccaauaccacaacagauagucggugucccacccaaggcgaagcuaccuuaguugaagaacaagaugcaaacuucguaugccgcagaacguuuguugauagaggaugggggaauggaugugggcuauuugguaaagguucacucauaacaugugcaaaauuuaaauguguaacuaaacuagaaggaaagauaguacaauacgaaaaccuuaaauacuccguaauaguaacugugcacacaggcgaucaacaucaagucggcaaugaaucuacggaacaugguacgacagcaacuauuacuccucaagcuccaacuacagagauacaacugacugacuauggagcacuuacuuuggacugcucuccacguaccggucuagauuuuaacgaaaugguccuguuaacaaugaaagaaaaauccugguuagugcauaaacaaugguucuuggaccuaccucucccuuggacaucaggugcgucaacgucucaagaaaccuggaaccgucaagaccuacucgucacguuuaaaaccgcucacgcuaagaagcaagaaguuguuguauuagguucucaagaaggagccaugcacacagcucucacgggagcaaccgagauacaaacgucuggaacaaccaccauuuucgccgggcaccuaaaaugccgacugaaaauggacaaauugacguugaagggaaugaguuauguuaugugcacugguagcuucaaacuugaaaaggaaguugcugaaacucagcacggcacaguuuuaguucaaauaaaauaugaaggcacggaugcgccuuguaagauaccuuuuucgacucaggacgaaaaaggcguuacgcaaaacgggagauuaaucacggcuaacccgauagugacagauaaagaaaagcccguaaauauagaggcagaacccccguuuggugaaucuuacaucguaaucggagcuggagaaaaagcacuuaaauuaucaugguucaagaaaggaucaucaauaggaaagauguucgaagcgacggcacgaggugcuagaagaauggccauacuaggugacaccgcuugggauuuuggauccauuggagggguuuuuacaagcguagguaaguugguacaucagauuuuugguacagccuauggggugcuauucaguggugugucauggacuaugaaaauuggaauagggguucugcuuaccuggcuagggcucaacucucgaucaacaucguuaucuaugacauguauagccgucggauuaauaacucuauacuuagguguuaugguccaggcagauucugguuguguaauaaauuggaagggccgcgagcucaaauguggcucaggcauauuugugacaaaugagguacauaccuggaccgaacaauauaaauuucaggcagacaguccaaaaagacuaagugcggcgaucggcaaggcaugggaggaaggcguauguggcaucagaagugcgacaaggcucgaaaauaucauguggaaacagauuucuaacgaauuaaaccauauucuguuagagaaugauaugaaauuuaccgucguuguaggcgaugucgccgguauauuagcccaaggaaagaagaugauaaggccacaaccuauggaauacaaguauuccuggaaaagcugggguaaagcaaagauuauuggagcugauguacagaauacgaccuuuauuauugacggaccuaauacuccugaaugcccagaugaccaaagggcauggaacauaugggaaguagaagauuauggauuugguauauuuacaacaaacauuuggcuuaaacuucgggauagcuauacacagguuugugaccacagauuaaugucugcggccaucaaagacagcaaagccguucaugcggacauggguuacuggauagagagcgagaaaaaugaaacuuggaaacucgcacgagcaucauucauagaaguaaaaacauguauauggcccaaaucucacacauuguggagcaauggcguacuggaaagugagaugauuauuccaaaaauauauggaggaccuauaucgcagcauaauuaucgaccuggauauuuuacacaagcugcuggucccuggcacuuagggaaacucgaacuugacuuugaucugugugaggggacaacagucguaguugaugaacacugugguaauagaggcccaucuuugcgaacaacaacugucacuggaaagauaauccacgagugguguugccggucaugcacccuaccaccauuacguuuuagaggagaagacggauguugguauggaauggagauacgaccggucaaagaaaaagaagaaaaucuaguuaaaucaaugguaucagccggaagcggugaaguugauucauuuagucuugguuuacucugcauuagcauuaugauagaagaaguuaugcguaguagguggagucgaagaauguuaaugacugggacacuagcaguauucuuuuuauuaauaaugggacaacuuacuuggaaugauuuaauuagauuguguauuauggugggcgcgaaugccagcgaucgcauggggauggguaccacauaucucgcgcuuauggcaacuuuuaagaugagaccgauguucgcagucggacuacuauuccgacguuuaaccagucgagaaguuuuauugcucacgauaggccugucucuaguugcaagcguagaacuuccuaacucacuagaagaacuuggcgacgggcucgcaaugggaauaaugauucuuaaacuccuuacggacuuccaaucucaccaacuaugggcaacguuacugucacuuacauucauaaagacaacuuucucucugcauuaugcguggaaaaccauggcuaugguacuuucgaucguuucacucuuuccgcugugccuaucaacaacaagccagaaaacgacaugguuacccguacuuuuagggagcuuaggaugcaaaccacuaacaauguuuuugauagccgaaaauaaaaucugggggcgcagaagcuggccccucaaugaagguauaauggccguaggaauaguaaguauuuuauuaagcaguuugcucaaaaaugacgugccgcuagcaggaccccugauugcuggcggaaugcugauugcauguuauguuauaucaggaucuucugccgaucuaagccuugaaaaggcagcugagguaucaugggaagaggaagcugaacauagcggggcaucccauaauauacucguagaaguucaagacgauggaacuaugaaaauuaaagacgaggaaagagacgacacacuuacuauacuauuaaaagcgacguuauuagcaguaagugguguuuauccacuaaguauccccgcuacccuauuuguaugguauuucuggcaaaggaagaaacaaagauccggcguacugugggacacaccgaguccgccagagguugaacgugcuguauuggacgacggaaucuaucgcauaaugcaaagagguuuauuagggcgaagccaaguaggaguaggcguauuccaagaaaacguuuuccauacgauguggcacguuaccagaggggcaguauugauguaccaggggaaaagguuggaaccaucgugggcuaguguaaagaaggacuuaauaaguuauggaggaggauggagacuacaagguuccuggaauacuggagaggaaguccaggugauugcaguugaaccuggcaaaaacccaaagaacguacaaacagcaccagguacauuuaaaacacccgaaggcgagguuggagcuauugcccuggauuuuaaaccgggaacaucaggaagcccgauagugaacagagaaggaaaaauagucggcuuauacggaaaugggguaguuacaacgucaggaacauauguaagugcuauagcucaggccaaagcaucucaagaaggaccacugccagaaaucgaagacgaaguuuucaggaaaagaaacuuaacgauuauggauuuacaccccggaaguggcaaaaccagaagauaucuuccugcgauaguacgggaagcaauaaaacguaaauuacgaacacuaauauuagcaccaacgaggguaguugcuucggaaauggcagaagcacuuaagggaaugccaaucagauaucaaacuacugcgguaaagagugaacauacggggaaagaaauaguagaucuaaugugccaugcaacguuuacaaugcgccuauuaaguccugugagaguacccaauuacaacaugauuauuauggaugaagcacauuuuaccgauccaucguccauugcagcuagaggguacauaucaacuagagugggaaugggggaggcggcugcaauuuucaugacugcaacaccuccugguucgguggaagccuucccacaaaguaaugcuguuauacaggaugaggagagggauauaccagaaagaucauggaacucaggguaugaguggauuacugauuuuccuggaaagacugucugguuugugccuucgaucaaauccggaaacgacauagcaaauugucuaaggaaaaacgguaagagaguaauacaauuaagcagaaagaccuuugauacugaauaucagaaaacuaaaaacaacgacugggacuauguuguaacaacagauauauccgaaaugggggcuaacuuucgcgcugaccgagucauagacccgagacguuguuuaaaaccuguaauuuuaaaagauggcccggagcgcgugauacuagcagguccuaugccaguuacaguugcuucggcagcacagcgaagggggcgaauugggagaaaucauaauaaggaaggggaucaauauauauauaugggacagccacuuaauaacgacgaagaucacgcacauuggacugaggcaaaaauguuauuagacaauauaaacacgccugagggcauaauaccagcauuguucgaaccggaacgugagaaaagcgcugccauagauggggaauaucgauuacggggcgaagcuagaaaaacauucguugaacucaugagaagaggagaccuucccgucuggcuaucuuauaagguugccagugagggauuccaauauucugaccggaggugguguuucgauggagagcgcaauaaccaaguauuagaggagaacauggauguagaaauauggaccaaagaaggcgagaggaagaaacuaagaccgagaugguuagaugcaagaacauauagcgacccacuugcuuuacgggaauuuaaagaguucgcagcaggaagaaggucaguaucuggagaccuaauacucgaaauugggaaguuaccucagcaucuaacacaaagagcacaaaacgcgcuagacaaucuugugauguuacauaacucggagcaaggcgggagagcuuauaggcaugccauugaagaauugcccgauacgauagagacauuaauguuauuggccuuaauugcgguauugacagggggcguuacguuauuuuucuuaaguggaagaggacuaggaaaaacuuccauuggucuacuuugugucauggcgucaaguguacuuuuauggauggcaucgguagaaccgcacuggauagcugcuaguaucauacuugaguucuuucuuaugguucuacugauuccagaacccgaucgucaacgaacuccacaggacaaucaauuggcuuaugucguaauaggacuacucuucaugauuuugacgguagcagcgaaugaaaugggccuucuggaaacuaccaagaaagaccuaggaauaggccaugucgcuguugaaaaccaucaucacgcagcuaugcuagacguagauuugcaucccgcgucagccuggacacucuacgcaguugcuacaacuauaauuacgccaaugaugaggcacacaauagaaaacacaacagcuaacauaagccucacugcuauagcuaaccaagccgcaauacuaaugggucuagacaagggcuggccaauaaguaaaauggauauuggaguucccuuacuagcauugggcugcuauagucaagugaauccacuuacauuaacagcagcuguguugauguuagucgcacacuacgcaaucauagguccggggcugcaagcaaaagcuacaagggaagcgcagaaacgcacggcagcugguaucaugaaaaacccuacuguugaugguauuguagcgauagaccuagaucccguuguuuaugacgcaaaauucgaaaagcaauuaggucaaauaaugcuccugaucuuauguacaucgcagauacuauuaaugcgaaccacaugggcguugugugaaucuauaaccuuagcuacgggcccuuugacaacgcugugggaaggauccccuggcaaguucuggaacaccaccauagcaguuuccauggccaacaucuuucguggcagcuacuuagcuggggcaggauuggcauuuucuuuaaugaaaucacuuggcgguggucgaagagguacaggcgcacagggagaaacuuuaggggaaaaauggaaaagacagcuuaaccaacuuaguaaaagcgaguuuaacacauacaagcgaagugguauuauggagguggauagaagugaagcaaaggagggguugaagagaggggaaacuacaaaacacgcuguaucuagaggcacggcaaaacuaagaugguuuguugaacgaaaucugguaaaaccggagggaaaagucaucgaucucggcugugguagggguggauggagcuauuauugugcuggauugaagaaaguaacugaagucaagggauauacaaaaggcgguccaggucacgaggagccaauaccgauggccacguauggauggaaucuagugaaauugcauagugguaaagauguguuuuucauaccgccagagaaaugugauaccuuauugugugauauaggagaaucuaguccaaauccaacuaucgaagaaggaagaacauuacgaguauugaagaugguagaaccauggcuaagaggaaaucaguuuugcauaaaaauauuaaacccguacaugcccagugugguagaaacuuuagaacagaugcagcgaaaacauggcggaaugcuaguacgaaacccucucaguagaaauaguacccacgaaauguacugggucagcuguggaaccggaaacaucgugucagcuguaaauaugaccucaaggaugcuauugaacagauucacuauggcacaucguaaaccuaccuacgaaagagauguagacuugggagcagguacccggcauguagccguagaaccugaaguugcuaauuuagauauaauaggacaacgaauagaaaauauaaaacacgaacacaaaaguacauggcauuacgaugaagacaacccuuauaaaacuugggcuuaccauggcucguacgaggugaaaccgucaggaucggcuagcuccaugguaaauggaguaguaaaauuacucacaaaaccuugggacguuauaccaaugguuacacaaauagcgaugacugauacaacucccuucggucaacagaggguuuuuaaggaaaagguagauacaaggacgccaaaagcaaaaaggggaaccgcucaaauaauggaagugacagcaaaauggcuaugggguuuucuaucgcguaacaagaaaccacguaucuguaccagggaagaguucacacgaaaaguaagaaguaaugcagccauaggcgcaguguucguagaugaaaaccaauggaacucagcuaaagaagcaguugaggacgaacgguuuugggaccuaguacauagggaaagagaacuacauaaacagggaaaaugugcaaccugcguauacaauaugaugggcaaacgagagaagaaacuuggugaguucgggaaggcaaaagguuccagagcaauaugguacaugugguugggagcaagauuccuagaguucgaggcacuaggcuuuaugaacgaagaucauugguucuccagagaaaauucacuaucggguguggagggugaaggacugcauaaauuaggauauauucuacgagauauaucaaagauaccaggagggaauauguaugcagacgacacagcuggaugggauacacgcauaaccgaagacgacuuacaaaacgaggcaaggaucacagauaucauggagccagagcacgcgcucuuggcgaaaucuauuuuuaaauuaacauaccagaacaaaguaguucgcgugcagcgaccugccaaaaacggaaccgugauggacguuaucucccggcgagaccaacgaggaucgggacaggugggaacguacggauuaaauacuuucacaaacauggaggcccaguugauaagacaaauggaaagcgaagggauuuuuaguccgucagaacucgaaaccccaaaucuugcagaaagaguguuagauuggcuagagaaauacggaguugaaagacucaaacgcauggcgauaagcggcgaugacugugugguaaaaccuauugacgaccgcuuugcgaccgcauuaacggcuuuaaacgacauggggaaaguacggaaagauauuccucagugggagccgucaaaaggcuggaacgacuggcaacaaguacccuuuugcagucaucacuuucaccaacucauaaugaaagacggucgcgagauugucguaccaugcagaaaccaagacgaauuaguuggaagggcucgaguaucacaaggcgcaggguggucccuaagagaaacugcaugcuuggggaaaucauacgcacaaauguggcaauugauguauuuccacagaagagauuuacggcuagcagcaaaugccauuuguagcgcgguuccaguugauuggauaccgacaagucgaacgaccuggucuauacaugcacaccaccaauggaugacaaccgaagacauguuaucggucuggaaucgggucuggaucgaagaaaauccauggauggaggacaaaacacacauuaguucuuggggagacguuccauaucuuggaaaaagagaagaccaaugguguggaucguuaauuggguuaacugcaagagcuacaugggcgacaaacauacaaguugcaauuaaccaaguaagacgacuaauuggaaacgaaaacuauuuagacuauaugacaucuaugaaacgguucaaaaaugagucagacccagagggugcuuugugguaa

SEQ ID NO: 21554 - RNA, 9879 nt, Artificial Sequence
  derived and/or modified CDS sequence (opt6) from DENV-1__FJ906728__SS-prME
aguguuacaauguuacugaugcuaaugccgacagcgcuagcauuccaccuaacaacccgagguggagaaccucauaugauaguaucaaaacaagaaagaggaaaaucucuucuauuuaaaaccucugcaggaguaaauauguguacuuuaauagcuauggaccugggggaacuaugugaagauacaaugaccuauaaauguccaagaauaacggaagcugaaccagacgauguagauugcugguguaacgcuacggacacauggguuacauauggaaccugcucacaaacaggagagcaccgcagagacaaaagaucaguugccuuagcaccacacguuggucuugggcuugagacuagaacagagacguggaugucaucugaaggagcuuggaaacaaauucaacggguagaaacgugggcucuaagacacccgggcuucacuguaauugcauuauucuuagcucacgcuauaggaaccuccauaacacaaaaagguauaauauucauacucuuaauguuaguuaccccaucgauggcuaugcgauguguuggaauagguaguagagacuuuguagaggguuuaagcggagccacauggguugaugugguauuggagcacgguucaugcguaacaacaauggcgaaagacaaaccgacuuuggacauagaauugcuuaaaaccgaagugaccaacccugcgguacuaagaaaauuaugcauagaagcuaaaauaucaaacacaacgaccgacucaagauguccaacgcaaggagaggcaacuuugguagaagaacaggaugcgaacuuuguguguagacguaccuuuguagauagggguugggguaacggaugcggacuauuuggaaaaggaucucucauuaccugcgcaaaauuuaaaugugucacaaaauuagaagguaaaaucguacaauaugaaaaccuaaaguauucaguaauagucacaguccacacuggggaucaacaucaagugggaaaugaaaguacagaacacggaacuacggccacaauaacgccucaagcaccgaccacugaaauucaauuaaccgacuacggagcacugauacucgauugcucuccuagaacuggcuuagauuuuaaugaaaugguccuacuaacuaugaaagagaaaucuugguuaguacauaaacaaugguuucuugauuuaccucugccguggaccucuggggccucgacuucgcaggagacauggaaucgacaggaccucuuaguuacauuuaaaacugcacaugccaagaaacaagaaguaguugucuuaggaucgcaagaaggggccaugcacacugcacuaacaggugcaaccgaaauacaaacuucgggaacaacaacgauuuuugcaggccaccuaaaaugcagauuaaagauggauaagcuaacgcuaaaaggaaugucauauguaaugugcaccgggcccuucaaauuggagaaggaaguggcagaaacccaacaugguacugucuuaguacagauuaaauacgagggaaccgacgcaccuuguaaaauuccguucaguacgcaggaugaaaaaggagugacucaaaauggacguuuaaucaccgcaaauccaauagucacagauaaagagaaaccagucaauauugaggcagaaccaccauucggagagucauauauuguuauuggcgcuggggaaaaagcgcucaaacucucaugguucaagaaagggucgucaauugguaaaauguucgaagcuacagcgagaggcgcacgccguauggcaauauuaggugauacagcuugggacuuuggauccauaggcgggguuuuuacgagcguagguaaauuaguucaucagauauucgguaccgccuacgggguguuguucucuggggucagcuggaccaugaagauuggcauagggguuuuacugacaugguuaggauuaaacagucgaaguacaucauuaaguaugacauguauugcuguagguuuggugacccuuuauuuaggggucaugguacaagccgacucuggcuguguaauaaacuggaaagggagagaacucaaaugcgggaguggaauauuuguaacaaaugaaguacauacauggacagagcaauauaaauuccaggcggacuccccaaaaagguuauccgcugcaauagggaaagcaugggaagagggaguuugcgggaucagguccgcaacuagauuagaaaacauuauguggaaacaaauaaguaaugaguuaaaucauauacuauuggaaaaugauaugaaguugacaguaguggucggggauguagcagggauuuugggucaggguaagaaaaugauaagaccgcaaccgauggaauacaaauauaguuggaagucaugggggaaggcaaaaauuauuggagcugacgcgcaaaauacaacauucaucaucgauggaccgaauacaccagaaugucccgacgaccaacgcgcauggaacaucugggaaguagaagauuauggauuugggauauuuacuacaaauauaugguuaaaauuaagagacuccuauacucaaguaugcgaccacagauuaauguccgcagcgaucaaagauucgaaagcuguucacgcagauauggguuauuggauugaaagcgaaaagaacgaaacguggaagcuagcaagggccucauucaucgagguaaaaacaugcauuuggccuaagagccauaccuuauggucaaaugggguccuggaaucugaaaugaucauaccuaaaaucuacggaggaccaauuucacagcacaauuaucgaccugguuacuuuacacagacagcggggccauggcaccuuggcaaacuagaguuagacuuugaucuuugcgaaggaacgacaguuguuguugaugaacauuguggaaacagggggccgucucuacgaacgacaacagucacggguaaaauuauccaugaguggugcugccguaguuguacccuuccaccgcuuagauuucgcggagaagacggguguugguaugguauggaaauuaggccagugaaagaaaaggaagaaaaccuuguuaagaguauggugagugcugggaguggagaaguggacucauuuagucuuggacucuuaugcauuucaauuaugauagaagagguaaugaggucaagauggaguagaaaaaugcugaugaccggcacacuggcagucuuuuuccugcugaucaugggucaauuaacguggaacgauuuaaucagacuauguauaaugguuggagcaaaugcgagugauaggaugggaauggggacaacauaccuggcucuaauggcaaccuuuaagaugcggcccauguuugcaguaggccuccuguuaagaaggcuaacgagucgugaaguucuccuacuaacgauagguuuaagccuaguagcaagcguugaauuaccgaacagucucgaagaauuaggcgacgggcucgcuaugggcauaaugauucuaaaguuauuaacggauuuccaaucucaccaacuaugggcgacacugcuuucauuaacauuuauuaagacuaccuucucacuacauuaugcuuggaaaaccauggccaugguuuugucaauuguaucauuauuuccacuuugccugagcacgaccagucagaaaacuacuuggcugccaguacugcuggguagcuuaggaugcaaaccccuaacuauguuucuaaucgcggagaauaaaauauggggcagaaaaucauggccacugaaugaagguaucauggcaguugguauaguaaguauccuauuaucuucucuucuaaagaacgaugugcccuuagccggaccauugauagcaggcggaauguugauagcauguuauguaauaagugguucaagcgcagauuugucauuggaaaaagccgccgaagugucgugggaggaagaggcagaacauagcggagcgagccauaacauucuaguggagguacaggaugacggcacuaugaaaauuaaagaugaagaacgagacgacacuuugacaauccuccugaaggccacauuacuagcuguaucugggguuuacccuuuauccauaccugcaacauuguucguaugguacuuuuggcagaaaaagaaacaaagauccgguguucuaugggacacgcccucgccuccagaggucgaacgcgcgguauuagacgaugguauauacaggauaaugcaaagaggccugcuaggacggagucaaguaggcguuggggucuuccaagaaaacguauuucacacaauguggcaugugacacguggagcuguauugauguaucaaggaaaacgccucgagccaucaugggcaucagucaagaaagauuugauaaguuauggaggagguuggcgcuugagagggucauggaauacgggagaggagguacaaguaauagcuguugagccaggcaaaaaucccaaaaacgugcagaccgccccaggaacauucaaaaccccagaaggggaaguuggugcuauagcgcuagauuuuaaaccuggaacgaguggcucuccuauaguaaauagggaaggaaaaauagugggucuuuauggcaauggcguuguaacuacgagcgggacguauguuagcgccaucgcucaagcaaaagccagucaagaaggaccacuuccagagauagaagaugaagucuucagaaaaagaaaccugacuauaauggaccuccacccgggcagcgguaagacuagacguuaucuaccugcaauagugcgugaagccauuaaaagaaaacugagaacccuaauucucgccccuaccagaguuguagcaucagaaauggcagaggcccugaagggaaugccaauaagauaccagacgacagcagugaaaucagagcacacagguaaagaaauuguagaucucaugugucacgcaacauuuacuaugagauugcugucaccugugcgagucccaaauuauaacaugauuauaauggaugaggcccauuucacggauccauccucaauagcagcuaggggauacauaaguacccgaguggguaugggggaagcagcggcuauuuuuaugacugcaacgccaccuggaaguguugaggccuuuccacaaaguaaugcugucauacaggacgaagaaagagacauaccggagcgaucauggaacacuggauaugaauggauuacagacuuuccggggaagacagucugguuuguaccuagcauuaaaaguggcaaugauauagcaaauuguuuacgaaagaaugguaagagagugauacaauuaaguagaaagacguucgauaccgaauaucagaaaaccaaaaacaaugauugggauuauguuguaacaacagauaucucagaaaugggugcaaauuuuagagcugacagaguaauugauccucgacgaugucuuaagccaguaauauugaaagacggccccgaaagggugauauuagcuggcccaaugccaguaacaguagcuagugcugcacaacggcguggaagaaucggaagaaaucacaauaaagagggagaccaauauauuuauaugggccaaccacuaaauaaugaugaggaccaugcgcauuggacggaagcaaagauguuacucgauaacauuaacacaccugaaggcauaaucccagcccuguuugaaccagaaagagagaagucugccgccguugacggagaauaucgacugcgcggagaagcucguaaaacauucguugagcuaaugaggcguggugauuuaccaguguggcuuuccuauaagguugcaucagaaggcuuucaauacagcgauagaagaugguguuuugauggagaaaggaauaaucagguucuugaagaaaauauggauguugaaauuuggacaaaagagggugaaagaaagaagcuaaggccacgaugguuggaugccagaacguauagugacccguuggcucucagagaguuuaaagaauuugcggcagggagacgaucaguuagcggggaucuuaucuuggagauagguaaauugccucaacaucugacacaacgcgcgcaaaaugcccuugauaacuuagucauguuacauaauucugagcaaggaggucgagcuuaucggcaugcaauggaggaauuaccagacacuaucgaaacuuuaaugcuauuagcuuuaaucgcgguuuuaacgggcggaguaacauuguucuuuuuaucuggcaggggguuaggcaaaacaagcauaggauuauuauguguuauggcauccaguguccuucuauggauggcuucgguugagccacacuggauagcagcuucuauuauauuagaguucuuucucauggugcuauuaauaccagaaccggauagacaaagaacaccgcaagauaaucaguuggccuauguaguaaucggcuuacuuuucaugauauuagcgguagccgcuaaugaaaugggccuccucgaaacaaccaaaaaggaccuaggcauuggucauguugcgguagaaaaucaccaccaugcagcaauguuagauguggaccuucacccugcguccgcauggacuuuauacgcuguagcuacaacaauaauuacgccuaugaugaggcauacaauagaaaacacuacugcuaacaucuccuuaacagccauugcaaaucaggccgcgaucuugaugggccucgauaaagguuggccaauaucgaaaauggauaucgguguaccuuuauuagcgcucggaugcuauucccaagugaacccuuuaacacucacagccgcaguguuaauguuaguggcacauuaugcuaucauuggaccuggauuacaagccaaagcgacaagggaggcccagaaaagaacugcagcaggaauaaugaaaaauccaacugucgaugguauaguggcuaucgaccuugaccccguagucuaugacgcgaaauucgagaagcaauugggacaaauaauguugcugauccuuugcaccagucaaauccuuuuaaugcgaacgaccugggcucuaugcgaaaguauaacuuuggccacagguccacuuacuacuuugugggaggguaguccagggaaauuuuggaauacaacgauagcgguaucaauggccaacauauuuagagguucauauuuagcuggggcaggauuagcauucucguuaaugaaaagucucggggguggucgaagggguaccggggcccaaggggaaacguugggagaaaaguggaaacgacaauugaaucaauuaagcaagucugaguuuaacacauauaaacgcucggguaucauggaaguugaucguagcgaagccaaagaaggacuuaaaagaggagaaacuacuaaacacgcaguaucacgugguaccgcaaaauuacgcugguuugucgaacgcaauuuaguaaagccagagggcaaagugauagacuuagguugcggucgcggcggauggucuuauuauugcgcaggucuaaagaaaguuacagaagugaaaggcuauacaaagggaggaccaggacaugaagaaccaauaccgauggcaacauaugguuggaacuuaguaaaacuacauucugggaaagacgucuuuuucauuccaccagaaaaaugugauacacuguuaugcgauaucggcgaauccucuccgaauccuaccauugaagaagggcgaacucuacgaguucucaaaaugguugagccgugguuacgaggaaaucaauuuuguauuaagauucucaaucccuauaugccaucuguaguugaaacguuagaacaaaugcaacgaaagcacggugguaugcugguaaggaauccguuaagucgaaauucgacgcacgaaauguauuggguuucguguggcacggguaauauaguuucagccgucaacaugacgagucguauguuauuaaacagauuuacaauggcucaccgaaaaccaacauaugaaagggauguagacuuagguacgggaacuaggcauguagcuguugagccugaaguugcaaaccuggauauuauaggucaaagaauugaaaauauuaaacacgaacauaagucaaccuggcauuaugacgaagauaacccguacaaaacaugggccuaccauggcucuuaugaaguaaagccgucggguagcgcuucaaguauggugaauggagugguaaaacuacuaacuaagcccugggaugucauaccaaugguuacacaaauagcgaugacagauacaacuccguucggacaacaacguguauuuaaagaaaaaguugacacuagaacaccuaaggcaaaaaggggcacugcccaaauaauggaagugaccgcuagauggcuuuggggcuuuuuaucuaggaauaagaaaccaagaaucugcacaagagaggaguucacgagaaagguacggucuaaugccgcuauaggagcagucuucguagaugaaaaucaauggaacucagcuaaagaggccguagaggaugaaagauucugggaucuaguacacagagaaagagaauuacauaaacaggguaaaugugcaacaugcguuuauaacaugauggguaaaagagagaagaaacuaggcgaauuugguaaagcgaagggaagcagagcaaucugguacaugugguuaggugcuagauucuuagaguucgaagcucuaggauucaugaacgaggaccauugguucucacgggaaaacucucuaucagguguagagggcgaaggccuucauaaacuaggauacauacuucgagauauaagcaaaauuccaggcgggaauauguaugcagaugacacagcaggaugggauacaagaauaaccgaagaugacuuacaaaacgaagcgaaaauaacugauauaauggaacccgaacaugcgcuauuagcuaaagcuauuuuuaaauuaacguaccaaaauaaagugguuaggguucaaagaccugcgaaaaaugguacagugauggauguaaucaguaggagagaucaaaggggcucaggccaaguuggaacauacgguuuaaauacauuuacgaauauggaagcgcaguuaauuaggcaaauggagucagaagguauuuucaguccaagcgaauuggaaacgcccaaucuugccgagagagcauuagauuggcuagaaaaauaugguguugagagauuaaaaagaauggcuauauccggggaugacugugugguaaaaccuaucgaugauagguuugcuacggcgcucacugcuuuaaacgacaugggaaaaguccgaaaggauauuccucaaugggagccuaguaaaggcuggaaugacuggcagcagguaccuuuuuguucgcaucauuuucaccagcuuauaaugaaagauggaagagagauaguuguuccaugucgaaaccaagaugaauuaguagguagagcaaggguaucccaaggugcuggguggucguuacgugaaaccgcuugucuggguaaaucauacgcacaaauguggcaacuuauguacuuccauagaagagacuugagacuugccgcuaacgccauauguucggcaguaccaguagauuggguaccgacaagucguacuacuuggaguauccaugcacaccaucaauggaugacgacugaggacaugcuaucuguauggaaccguguguggauugaggaaaacccguggauggaagauaagacacauauaucaucaugggaagaugucccuuaucuaggcaaacgagaagaucaauggugugguagucugauaggauugaccgcgagagccacaugggcaacgaacauucaaguagcaauaaaccaagucagacgacugauagggaaugaaaacuauuuagacuauaugacgucaaugaagcgcuuuaaaaaugaaagugacccagagggagcauugugguga

SEQ ID NO: 21555 - RNA, 9879 nt, Artificial Sequence
  derived and/or modified CDS sequence (opt6) from DENV-1__FJ461313__SS-prME
ucuguaacuaugcuguuaauguuaaugccuacugcuuuagcauuccauuuaacaacacgagguggagaaccccacaugaucguaagcaaacaagaacgaggaaaaagucuacuuuucaaaacauccgccggcguaaauaugugcacacuaauagcgauggaucuaggagaacuaugugaagauacuaugaccuacaaaugucccaggauaacugaagcagaacccgaugacguugauuguugguguaaugccacagacacuuggguaacguacgguacuugcucccaaacaggugaacaccgccgugacaaacgaucaguggcguuggcuccucauguuggguuaggguuagaaacccguacagaaacauggaugaguucagaaggagcauggaagcaaauacagcgagucgaaaccugggcucuacgucauccuggguuuacaguuauugcacuguuccucgcccaugcaauagggacgaguaucacccaaaaagggauuauuuucauauuacuuauguuaguaacuccaucgauggccaugagauguguuggaauuggaucaagagacuucgucgaaggguuaagcggcgccacuuggguagauguaguauuagaacauggaucgugugugacgacaauggcgaaagauaaacccacuuuagacaucgaacuuuugaaaacugaaguuacaaauccugcaguucuacggaaguuguguaucgaagcuaaaauuucgaauacaacuacagacagucgauguccaacgcaaggagaagccacacugguagaagaacaggaugcuaauuucguuuguaggagaacuuuuguagaccggggaugggguaacggauguggccuauuuggaaaaggcaguuugauaacaugugcaaaguuuaagugcguaacgaaacuagaaggaaaaauugugcaauaugaaaauuuaaaauauaguguuauagucacaguucacacaggggaccagcaucagguaggaaaugaauccaccgaacauggaacuacagcaacuauaaccccacaagcccccacuacagagauacaacuaaccgacuauggagcacugacgcuggacugcucuccaagaacaggucucgauuuuaacgagaugguucuucuuacaaugaaggaaaagucguggcucguacauaaacaaugguucuuggauuuaccauuaccuuggacuucuggugccucaacaucacaagagacguggaaccgucaagauuugcuaguaacauucaaaacagcgcaugcuaagaaacaagaaguggugguacuuggaucucaagagggagcuaugcauaccgcacugaccggugcaacagaaauacaaaccagugguacgaccacaaucuuugcaggccaucuaaaauguaggcuaaagauggauaaacuaacccugaaagggaugagcuacgugauguguacaggaucauuuaagcuggagaaggagguagcagaaacccaacacgguacuguucugguacagauaaaauaugaaggaaccgaugcaccuuguaaaauuccauucucuacacaagacgaaaaggguguuacacagaauggcagauuaaucaccgcgaacccuauaguuacggauaaggaaaaaccagugaauauugaagcagaaccuccuuuuggagagagcuauauaguaauuggcgccggugaaaaggcauuaaagcucagcugguuuaagaagggaagcucaaucgggaaaauguucgaggcaacugcgcguggugcaagaaggauggcaauuuugggcgacacugccugggauuuugggucaauuggagggguauucacaaguguggguaaguuaguucaucagauauucggaacagcauacgguguguuguuuagcggcgugucguggacuaugaaaaucggaauagggguguuacuaacauggcuuggacuaaacucacgaaguacguccuuaucgaugacuugcaucgcaguugggcuuguaacucuauauuugggggcaaugguucaggcagauucuggaugcguaauaaacuggaaaggaagggaguuaaaauguggaucagggauauuuguuacgaacgaagugcauacuuggacagagcaauauaaauuucaagcagauagccccaagagauuaucagcagcaauaggcaaagcaugggaggaagguguaugcggaauaagaagugcuacgcgacuugaaaauauuauguggaaacagaucucaaacgaauuaaaucauauuuuacuagaaaacgauaugaaacuaacaguaguaguuggugauguggcuggaauacugggucaagguaaaaagaugauaaggccacaacccauggaauacaaauacucguggaaaucaugggggaaagccaaaauaaucggagcagacgcacagaauacuacauucauuauagacgguccuaacacgccagaauguccugaugaccaacgagcuuggaauaucugggaaguggaagauuacggcuuugguauauuuaccacgaacauuuggcuuaaacuaagggacucguacacccaaguaugugaccauagacuaaugucagcagcgauaaaagauagcaaagcaguacaugcugauaugggguauuggauugaaagugagaaaaaugaaacauggaaguuagcucgcgcaucauuuauugaaguaaaaacauguauauggccaaagagccauacucuauggucaaacgguguacuggaaucugaaaugauaauaccgaaaauauauggagguccaauaucccagcacaauuauagaccuggauauuuuacacaaacggcuggaccauggcaucuggggaaacuggaauuagacuuugauuuaugcgaaggaacuacuguuguaguggaugaacauugcggaaaucguggcccaucacugagaacgaccacugucacuggaaaaauaauacacgaaugguguugucgaucauguacucugccgccguugcgauuuagaggagaagauggauguugguacggcauggaaauaagaccaguuaaagaaaaagaagaaaaucuugugaagucaauggucagugcuggcucuggagaagucgauaguuucagucucgggcuauuauguauaucaauaaugauagaagaaguuaugcgaucgcgauggucccgcaaaauguuaaugacaggaacauuagcagucuucuuccuccucauaaugggacaacuuacguggaaugauuuaauacgauugugcauuauggugggggccaacgccucugaccgaauggggaugggaacaacauacuuagcucuuauggcaaccuucaaaaugagaccaauguuugcaguuggguuauuguucagaaggcuaaccucgcgcgaaguauuacuuuuaacaauuggcuuaucacuuguugcaagcguagaguuaccuaauucguuagaggaauuaggagauggguuagcaauggguauaaugauacuaaaacuacugacagauuuucaaucacaccagcuuugggcgacgcuucuaucgcuaacauucauuaaaaccaccuuuucauuacauuaugcauggaagaccauggccaugguuuuaaguaucgucucucuauucccauuaugcuuaucaacaacaucccagaaaacaacuuggcucccuguguuauuaggaucuuugggcugcaaaccacugacuauguuucuaauugcugaaaacaaaauauggggacgaaagucguggccgcuuaaugaaggaauaauggcuguaggaaucguaucaauccuucuuucguccuuauugaaaaacgaugugccucuagccggucccuugauagcuggcgggaugcugaucgcauguuauguuauaagcgguucuucagcagauuuaucacuggaaaaggcagccgaaguaucaugggaggaagaggcagagcauucgggagcgucacacaacauucuuguagaagugcaagacgauggcacgaugaaaauuaaagacgaggaaagagaugacacucucacuauucuauuaaaagcuacauuacucgccgucucaggcguguauccauuaaguaucccagcaacccucuuuguaugguauuucuggcagaaaaagaaacaacgcucaggcguccuuugggauacacccucaccuccggagguagaaagagcaguucuugaugauggaauauaccgaaucaugcaacguggccuacuaggaaggucacagguaggaguggggguguuucaggaaaacgucuuucacacaauguggcauguaacacggggcgcuguccuuauguaucaaggaaaaagacuugaaccaucaugggcgagugucaagaaagauuuaauauccuauggaggaggauggcgguugagagguucuuggaauacaggagaagaaguucagguaauagcuguugaaccagguaagaacccuaaaaauguucaaacagcaccagguacuuuuaaaacaccugaaggggaaguuggugcuauagcccuagauuuuaaaccuggaacgucagguaguccaauaguaaacagagaagggaaaaucguagggcuauaugguaauggaguagugacuacuagcgggacuuaugugagcgcaaucgcucaagcaaaagcaucgcaagaaggacccuuaccagagauugaagaugaaguauucagaaaaagaaaucuaacaauaauggaccuccacccugguucggguaaaaccagacguuacuuaccggcuauagucagagaggcuauaaaaagaaaacucagaacguuaaucuuagcccccacuagaguagucgccagugaaauggcugaggcuuuaaaaggaaugccuauucgcuaccaaacuacggcugucaaaucugaacauacaggcaaggagaucguagaccuaaugugucaugcaacuuuuacaaugcgacuacucucaccagugcguguaccuaauuacaacaugauaaucauggacgaagcucauuucacugacccuucgucgauagccgccagaggcuauauuaguacgagaguaggaaugggggaagcggcagcuauauucaugacggccacgccaccaggaagcguggaagcauucccucagucaaaugcaguuauccaggaugaagaacgagauauacccgaaagaucguggaacucgggauaugaauggaucaccgacuucccagggaaaacgguuugguuuguucccucgauuaaaucgggaaaugacauagcaaacugccuaaggaaaaauggcaaacgcgugauccaauuaucaagaaaaacguuugauacagaauaucagaagaccaaaaauaacgacugggacuauguagugacaacugauauaagugaaaugggugcaaauuuuagagcugacagaguaauagauccaagaagaugcuugaagcccguaauauugaaagacggaccagaacgagugauuuuagcuggaccaaugccaguaacgguugcaagcgcagcucagcgaagagguagaauagguagaaaucauaauaaggaaggagaccaguauaucuacauggggcagccauuaaacaacgaugaagaucacgcacauuggacggaagcaaaaauguugcucgauaauauuaauaccccugaggguauaaucccugcauuguuugagccagaaagagaaaaaucagcugccguugauggagaauaccgcuuaagaggcgaggcucgcaaaacuuucguugaauuaaugagaagaggcgacuugccugucugguuaagcuacaagguagcgucggaaggcuuucaauauagugaucguagaugguguuuugacggagagcgcaauaaccaaguccuggaggaaaacauggacguagaaauauggaccaaggaaggagagagaaagaaauuaagaccgcguugguuagaugcucgaaccuacagugacccgcuggcacuucgagaauuuaaggaauuugccgccggaaggcguuccguaagcggagacuugaucuuagaaauaggaaaacuaccucaacauuuaacgcagagggcccaaaacgccuuggauaauuugguuauguuacauaacagugaacaagguggacgagcuuauaggcacgccauggaagaacuucccgacacaauagagacacuaaugcuacuagcgcuaauagcuguuuuaacggguggcguaacuuuauucuuuuuauccggacgaggacucggaaaaaccaguaucggacuauuauguguaauggcuucaucuguauuacuauggauggcaucuguagagccccauuggaucgcggcaucaauaauccuugaguucuuucugaugguccuguugauaccggaaccugauagacaacgaacuccacaagauaaccaacuagcuuaugugguuaucggacuccucuucaugauuuugaccgucgcugccaacgaaauggggcuacuugaaacaaccaagaaagauuuaggcauaggucaugucgcuguagaaaaccaccaucaugcugcgaugcuagacguagaccuacauccugccucagcuuggacacuauacgcggucgcaacuacuaucauaacaccgaugaugaggcacacgaucgaaaacacaacagcaaacaucucucugaccgccauugcaaaccaagccgcaauauuaaugggguuagacaaaggauggccaauaucuaagauggauauuggugugccgcuccucgcacugggaugcuacagccaaguaaauccucuaaccuuaacagcagcaguccucaugcuaguagcgcauuaugcgauuauuggaccggggcuccaagcaaaagcaacacgagaagcucagaaaagaacagcagcgggcauaaugaaaaauccgacaguagauggaauagucgcaaucgaccucgauccagugguauaugaugcuaaauucgaaaaacagcuaggucaaauuauguuacuaauuuuaugcacuucucagauauuauugaugcgaacaaccugggcauuaugugaaucaaucacucuggcuacaggccccuuaacaacuuuaugggagggaucaccggggaaauucuggaauacgacaauagccgucuccauggcuaacaucuucagggguucauaccucgcgggcgcuggucuagcuuucagucuuaugaaaagccuaggagguggccguaggucuacuggagcacaaggugaaacccuaggagaaaaguggaagcgacaauugaaccaauugaguaaaagugaguucaacaccuauaaacguucagguauuauggaaguugaucgcucugaagcaaaagaaggguuaaaacguggugaaacaacgaaacaugcuguuucaagaggaaccgcgaaacuacgaugguuuguggagaggaauuuaguuaaaccggaagggaaagugauagaccuaggcugcggaagaggagggugguccuauuauugugcaggacuaaagaaggucacugagguaaaagguuauacuaaaggaggcccaggccaugaagaaccuauacccauggccacuuauggauggaauuugguaaaacuacacucgggcaaagauguauucuuuaucccuccagagaaaugcgacacguuacucugcgauauuggugagucuucacccaaucccacaaucgaagaaggacgaacacuacgggugcuaaagaugguggaaccauggcugagaggcaaucaauucuguauuaaaauacuaaauccuuauaugcccagugucguugaaacucuggaacaaaugcagagaaaacacggcgguaugcucguaagaaaccccuuaagucgaaacaguacccaugaaauguauugggucaguuguggaacgggaaacauaguuuccgcaguuaauaugacguccagaaugcuucuaaauagauuuacaauggcgcacagaaaaccaacguaugaacgggauguagaucuagggaccggaacacgacauguagcaguagaaccugagguagcgaaucuggauauaauuggucaacgaauagaaaauauaaaacaugaacacaaaaguacuuggcacuacgacgaagauaauccauacaaaacaugggcauaccacgggucuuacgaaguaaaaccaucgggcuccgcaucaagcaugguuaacggaguaguuaagcuacuaacuaaacccugggacguaauaccuaugguaacacaaauugcgaugacugacaccacacccuucggucaacaaaggguguucaaagagaaagucgacacacgcacaccaaaagcuaaaagagggacagcacaaauaauggaaguuacagcgcgauggcuauggggauuucuuucucggaacaagaaaccacgaaucuguacacgugaagaauuuacaagaaaaguuaggucuaacgccgcuauuggugcgguuuucgucgacgaaaaucaauggaauagugcaaaagaggcaguagaagaugaaagguuuugggauuuaguacaccgcgaacgagaacuucacaaacaaggaaagugugcaacgugcguuuauaacaugaugggaaaaagagagaagaaacugggcgaguucgguaaggcaaagggaaguagagcaauuugguauaugugguugggcgcgcgauuuuuagaauuugaagcucucggcuuuaugaaugaagaccacugguuuagcagggaaaacaguuuaagcgguguagaaggagaaggcuuacauaaguugggauauaucuuaagggauaucucgaaaauuccaggaggaaauauguacgcagaugacacggccggcugggacacaaggauuaccgaagacgaucuucagaacgaagcgaaaauuacagacauaauggaaccagaacacgcccuucucgcuaaagcaauauucaaacuaacauaucaaaacaaagucguuagagugcagagaccugcuaaaaauggcaccguaauggauguaauaagcagaagagaucaaaggggaucuggucaaguagggacuuauggacuaaacacauuuacaaauauggaagcccaacuaauccgucaaauggaauccgaagguauuuucucuccaucagaguuggaaacucccaauuuagcagagagggcauuaaauuggcuugagaaguauggcguggaaagacugaagagaauggcaaucaguggagacgauuguguaguuaagcccauugaugacagauuugccacagccuuaacagcacucaacgacauggggaaaguacguaaagacauuccgcaaugggaaccuagcaagggauggaaugacuggcaacagguaccuuucuguucgcaucauuuucaccagcuaaucaugaaagaugggagagaaauaguggugccaugcagaaaccaagacgagcuaguuggucgugcucgaguaucacaaggggcaggauggucgcuuagagaaacggcuugucuaggaaaaagcuaugcucaaauguggcaauugauguauuuucacagaagggaucuaaggcuagcugcuaacgccaucuguucagcuguaccaguagauuggguuccgaccucccgcacaacauggagcauacaugcucaucaucaauggaugacaacagaagacaugcuauccguauggaauagaguuuggauugaggagaauccauggauggaggauaaaacccacauaucaaguugggaagacgucccauaucuugguaagagagaagaccagugguguggcucccugauagguuuaacagcgagggcaacgugggcaacgaauauccaaguggcaauaaaucaaguaaggagguugauugguaacgaaaauuaucuggauuauaugacuagcaugaaacguuuuaagaacgaaucugacccugaaggggcguuaugguga

SEQ ID NO: 21556 - RNA, 9879 nt, Artificial Sequence
  derived and/or modified CDS sequence (opt6) from DENV-1__FJ547063__SS-prME
ucggugacaaugcuccuaaugcuaaugccaacugcacuagcuuuucauuuaacuacuagagggggugaaccacauaugauagucucgaaacaagaacgugggaaaaguuuauuauuuaaaacaagugcuggaguaaauauguguacuuuaauagcuauggaccucggcgaacuaugugaagauacaaugacuuauaaaugccccagaauuacugaaacugaaccggacgacgucgacuguuggugcaaugcuacggacacauggguuacguacggaacaugcagucaaacaggggaacauagacgggauaaacgcuccguagcacuugcaccucacgugggacuagguuuagaaacuagaacagaaacauggauguccucugaaggugcuuggaaacaaauucaacgaguagaaacuugggcacuaagacacccaggauuuacaguuaucgcccuauuucuagcacacgcaauagguacaucgauuacucaaaaagggauaaucuuuauccuucuaaugcuugucacaccuucgauggccaugcggugcguagggauaggaaguagggacuucguagaagggcuaucaggcgcaacguggguugacgugguauuagaacauggaaguugcguuacaacaauggcaaaagauaagcccacucucgauauagaauuauuaaagacagaaguuacaaauccugcaguuuuacgaaaacuguguauagaagcaaagauaagcaauacuaccacugauagcagauguccgacgcaaggagaagcaacccuaguagaagaacaagaugcuaauuuuguguguagaagaaccuuuguagaccgagguugggguaauggaugcggucuauuugguaaggguuccuugauuacaugcgcaaaguucaaguguguaacuaaguuagaaggaaaaauaguucaauacgaaaaucugaaguacuccgugauuguaacagugcauacaggagaccaacaccaaguugggaacgaauccacagaacacggaacuaccgccacaauaacaccacaagcaccuacaacagaaauacaacugacagauuacggagcuuuaacauuagacuguagccccagaaccggccucgauuuuaaugaaaugguuuuauuaacaaugaaggagaaaagcugguuaguucauaaacaaugguuuuuagauuugccguuaccguggacuuccggugcaaguacgagucaagagacguggaauaggcaagacuuauugguaacauucaaaacagcgcacgccaagaaacaggaaguaguuguucuagguucacaggaaggggccaugcauacagcacuaacaggagcuacggagauccaaacgagugguacaacuacgauuuucgcaggacaucuuaaauguagauugaaaauggauaaacuuacucuaaaagggaugucguacguaauguguacagggucuuuuaaacuggagaaagaacuagcggagacccagcacggaacggugcucguucaaaucaaauaugaaggaacggaugcgccuuguaaaaucccuuuuaguacccaagaugaaaaaggugucacucaaaaugggcgguugauuaccgcaaaucccauaguaacugauaaagaaaaacccgucaacauugaagcugaaccgccguuuggagaaaguuauaucguuaucggagcgggugaaaaagcauuaaaacuuaguugguuuaagaaaggguccucgauaggcaaaauguucgaggcaacagcaagaggugcgagacgaauggcuaucuuaggggauacagcaugggacuuuggaucgauagguggaguguuuacaaguguggggaagcuaguucaucaaauauucggcacagcguacggaguacucuucucaggcguaucauggacuaugaaaauaggaauaggaguccuucuaacguggcuaggucucaauucgagaucaacaucccugucaaugacguguauagcaguaggccugguaacgcuauacuuaggagugauggugcaagcagauagcgguuguguaauuaacuggaaaggucgggaacugaaaugcggaaguggaaucuuuguuacuaaugagguacacacuuggaccgagcaauauaaauuucaagcagacucaccaaaacgcuuaagugcagcuauugguaaagcaugggaagagggugugugcgguauacgguccgccacucgguuagaaaacaucauguggaaacaaauaagcaacgaacuaaaccauauucuucuggaaaaugauaugaaauucacuguugucguaggugauguagccggaauacuggcccaaggcaagaaaaugauuagaccucaaccaauggaauacaaauacucuuggaaaucaugggguaaggcaaaaaucaucggggcugaugugcaaaauacgacuuuuauaauagauggaccuaacacaccagaaugccccgaugaccaaagggcauggaauauuugggaaguugaagauuauggcuuuggaauuuucacaacuaauaucuggcugaaauugcgcgacucguauacucagguaugcgaccacagacucaugagcgcagccaucaaagacucaaaagcuguacaugcagauaugggcuauuggauagaaagugagaaaaaugagaccuggaaacuggcucgagcuucauuuauagagguaaaaacguguauauggccaaaaucacauacauuaugguccaacggcguguuagaaagugaaaugauaauuccaaagaucuauggugggccuaucagucaacacaacuaccgaccuggauauuucacucaaacagcgggccccuggcaccuugggaaacuugaacuugauuuugaucucugcgaagguacaacaguagucgucgaugaacacuguggaaauaggggucccagccugagaacgacaacaguuacuggaaaaauuauacaugaauggugcuguagaucguguacuuuaccaccauuaagauuuaggggagaagauggaugcugguacggaauggaaauccggccugucaaagaaaaagaagaaaaccugguaaaaucaaugguaagcgcaggcaguggcgaaguagauucauuuucacuuggucuuuuauguauaucuauaaugaucgaagaagugaugaggagccgcuggucaaggaaaauguugaugacagguaccuuagccguuuucuuucugcuaauaaugggccagcucaccuggaacgauuuaauacggcuauguauaaugguuggagcuaaugcgucagaccgaaugggaauggguacuacauacuuggcacuuauggcuacuuuuaaaaugcgaccaauguuugcaguggguuuauuauucagaagacugacaucuagagaaguuuuacuauugaccaucgggcucagcuuaguagcuucagucgaacuacccaauucuuuagaggaacuaggagacgggcuugcaaugggaaucaugauauuaaaauuauuaacugauuuucaaucacaucagcuaugggcuacccuauuaagucuuacguucauaaaaacaacauuuucuuuacauuacgcauggaaaacgauggcaaugauacucucuauaguaagccuauuuccguuauguuugucuacuacuucucagaaaacgacaugguugccaguauugcucgggucucuagguuguaaaccccugacuauguucuuaauugcagagaacaaaauuuggggccgucgcaguuggccgcuuaaugaagguauuauggcaguagguaucguuucuauacucuuaagcagccuucuaaagaaugacguccccuuagcaggaccgcucaucgcaggagggaugcugauugccuguuacgugauauccggaagcuccgcagaccugucauuagaaaaagcagcagaaguuucgugggaagaagaagcagaacacucaggggcgagccauaauauuuuaguggaaguucaggaugacgguacuaugaaaauuaaagacgaagaaagagaugauacgcuuacgauuuuacuaaaagccacguugcuggccguuucgggaguuuauccauuaaguauaccugcuacucucuucguaugguacuuuuggcagaagaagaaacaacgaucaggaguacuuugggauacuccuucucccccggaggucgaacgcgcaguauuagacgauggcaucuaucgaauuaugcaacgaggauuacuuggacgcucacaaguuggcgucggaguauuucaagaaaacguguuccauaccauguggcacgugacacguggagccguguugauguaccaagguaaacgacuagagccaagcugggcgucgguaaagaaagaucuuauuaguuacggaggagguuggagacuacaaggaucuuggaacacuggugaggaaguucagguaaucgcugucgagccggguaaaaacccgaagaauguccaaacagccccgggaacuuucaaaaccccugaaggggagguuggugccauugcccuugacuucaagccgggaacuuccggaucacccauaguaaauagggaaggaaaaauagucggcuuauaugguaauggaguggucacuacuucuggcacguaugugucugcaauugcgcaagcgaaggccagucaggaaggaccacucccugaaauugaggaugaaguauuuagaaaacguaaucuaacaauaauggaucuacacccugguuccgguaaaacaagacguuacuuaccggcaauuguccgcgaggcaauuaaaaggaagcuccgaacacuuaucuuggccccaacacgcguaguugcaucggagauggcugaagcccucaaaggcaugccgauuagauaucagacgacggcaguaaaaagugaacauacgggcaaagaaauaguagauuuaaugugucacgcuaccuucacaaugagauuauuaucaccugugcggguucccaauuauaauaugaucauaauggacgaggcacauuucacugauccaucuucuauugcugcaaggggcuauauuucuacccgcguagguaugggagaagcagcugccauauuuaugacugcuacaccuccaggaucugucgaagccuuuccucaaucuaaugcaguaauacaagacgaggaaagggauauccccgagaggagcuggaacucgggauaugaguggauaacagauuuuccaggaaaaaccgucugguuuguuccaucaauuaagucagguaaugacauagccaauugucuaaggaaaaaugguaaaagagugauacaguugucgcgcaaaacguuugauaccgaauaucagaaaaccaaaaauaacgacugggacuauguggucacaacugauauuagcgaaaugggagccaacuuucgagcagauagaguaauagauccacggagaugucuuaagcccguuauucucaaggacgggccagaacgcgugauuuuagcaggaccuaugccugucaccguggccucagcggcacagaggcgaggacguauugggagaaaccauaauaaggaaggugaucaauauaucuauaugggccaaccacuaaauaaugaugaagaucaugcacacuggacugaggcuaaaauguugcuggauaauauaaacacaccagaaggaauuauuccagccuuauucgaaccagaaagggaaaaaucagcagcuauagauggugaguaccgacuuagaggagaagcgagaaaaacuuuuguagaacuuaugagacgaggcgaccuacccguguggcuuagcuauaaaguggcaucggaaggguuccaauacucugauagacggugguguuucgauggagaacgcaauaaucagguucuugaagaaaacauggauguagaaauauggacgaaagagggugagcggaagaaacuaaggccaagauggcuagacgcgcgaaccuacucggauccauuagcccuucgggaauuuaaagaauuugcugcuggacgucguagugugucuggcgaccuaauauuagaaauugggaaacucccacaacaucuuacgcaacgagcacaaaacgcguuagacaaccuaguaauguuacauaacucagagcaagggggaagggcuuacaggcaugcaauggaggaauuaccugauacuauagaaacucugaugcuacuagcauuaaucgcuguauugacaggugguguaacgcuauuuuuccuaucagguagaggguuagguaaaacgucgauuggccuacuaugcguaauggccaguaguguacuuuuauggauggccaguguugaaccacauuggauagcggcuucaauuauccuugaguucuuucuaaugguauuauuaauaccagaaccagauagacaacggacgccucaagacaaucaacuggcuuauguaguaauaggauuguuauuuaugauacuuacuguugccgcaaaugaaauggggcuacuugagacuacaaagaaagacuuaggcauuggacacguagcaguugagaaccaucaucacgcggcuaugcuagauguugaucuccacccagcuuccgcauggacucuauaugcagucgcaaccacuaucauuaccccaaugaugcggcacacaauagaaaauacgacagcaaauauuucuuugacugcaauagccaaucaagcagccauacuuaugggucuugauaaaggauggccuauuucuaaaauggacauagguguuccacuauuagcacuuggguguuacucccaggucaauccacuuacuuuaacagcugccgugcuuaugcuuguggcucauuaugcaauaauuggaccaggccuucaagcaaaggcaacucgcgaagcucagaaacguacggcagcaggaaucaugaaaaacccaacagucgauggaauaguagcaauagaccuagauccaguaguauaugacgccaaauucgaaaaacaacuuggacaaaucaugcuauugauuuuaugcacgagccaaaucuuacucaugcgcacuacuugggcacuuugugaauccauaacguuagcaacaggcccuuuaacgacuuuaugggaaggcagcccaggaaaauuuuggaauacuacaauagcugugaguauggcuaacauuuuucgaggaucauaucucgcaggagcaggauuggcuuucagccuuaugaaaucgcucggaggaggucgaagaggaacgggcgcacaaggugaaacccucggcgaaaaguggaaaagacaacucaaucagcuuucaaaaagugaguuuaacaccuacaagaggucaggaauaauggaaguugauagaagugaagcaaaggagggucuuaaaagaggagaaacuacuaaacaugcgguguccagggggacagcgaaacuacgcugguucguagaaagaaaccuaguuaagccagaaggcaaagugaucgaucuagguuguggucgugggggcugguccuauuauugcgcagggcuaaagaaaguaaccgagguaaaagguuauaccaaaggaggacccggccacgaagaaccaaucccaauggcuaccuacggguggaaccucguuaaauugcauucagggaaagacguauucuuuauaccuccagaaaaaugcgacacucuccugugugauauaggugaaagcaguccuaacccaacgaucgaagaagguagaacuuuacgaguguuaaaaaugguugaaccaugguugcgggguaaccaauuuuguaucaagauauuaaaccccuauaugccaucgguuguagagacucuagaacaaaugcaacgaaaacacggaggcaugcuaguuagaaauccgcuccagcgaaauagcacacaugaaauguauugggucuccuguggaacuggaaauauuguguccgcgguaaauaugacuucacgaaugcuacucaaucgauuuacgauggcccauagaaaaccuacauaugaacgugacguagauuuaggagcaggaacacggcaugucgccgucgaacccgaaguggcaaauuuagauauaaucggacaacguauagaaaauauuaaacacgagcacaaaaguacauggcauuaugaugaggauaaucccuacaaaacuugggcauaccacgguucuuacgagguaaaaccuagcgguuccgcgucaucuaugguaaacggaguuguaaagcuacuuacaaaaccgugggaugucauaccaauggucacucaaaucgcaaugacagauacaacgccauuuggacaacaaagaguguuuaaagaaaaaguugauacaagaacuccaaaagcgaagcgugggaccgcgcagaucauggaaguaacagccaaauggcuguggggauuuuuaaguagaaauaagaagccuagaauauguacucgcgaagaguuuaccagaaaaguccgaaguaacgcugcaauaggggcaguguuugucgaugagaaucaguggaacucagcgaaagaagccguagaagaugaacgauucugggaccuaguacaccgugaacgagagcuccacaaacaaggaaagugcgcaacgugcgucuacaauaugaugggcaaaagagagaagaaacuuggagaguucgggaaagcaaagggaaguagagcaaucugguauauguggcugggagcacgauuccuagaguucgaggcuuuaggauuuaugaaugaagaucauugguucucaagagaaaauucuuugaguggaguggaaggagagggucugcacaaauuaggauacauucuaagagauauaagcaaaaucccgggugggaauauguacgcugaugacacagcagggugggauacucgcauuaccgaagacgacuuacagaaugaggcaaggauuaccgauaucauggaaccugagcaugcguuacuagccaaaaguaucuuuaaauuaacauaccaaaacaaaguaguucgaguacaaaggccagccaaaaacggaaccguaauggauguaauuagcaggcgcgaucaaaggggcucuggccaaguagguacauacggguuaaauacauuuacaaauauggaggcccaauuaauaagacaaauggagucggaagguaucuuuucaccuagcgaauuagaaacacccaacuuagcagagcguguauuggauuggcuagagaaguauggcguugaacgacucaaaaggauggcaaucagcggcgaugauuguguugugaaaccgauagacgaccguuucgcaaccgcacugacagcgcuaaacgauaugggaaaaguacggaaagauauaccgcaaugggaaccuucuaagggauggaaugauuggcaacaagucccauucuguucgcaccacuuucaucaacuuauuaugaaggacgggagagaaauaguuguaccauguagaaaccaagaugaauuaguaggaagggcgagagucagucaaggggcgggguggaguuugcgugaaacagcauguuuaggaaaaucauacgcacaaauguggcaacucauguauuuucauagaagagaccugcgauuagcugcaaacgcaauauguucugccguaccgguagacuggaucccaacaucacgaacaaccuggagcauacacgcgcaucaccaguggaugacaacugaagacauguuauccguuuggaauagaguauggauagaagagaaccccuggauggaagauaagacccauauaucaucguggggagacguaccguaucuuggcaaacgagaggaucaguggugcggcagucuuaucggauuaaccgcgagggccacaugggcaacaaauauccagguugcaauaaaucaaguucgucgacuaauugggaaugaaaauuauuuggacuauaugacaagcaugaaaagguuuaaaaacgaaagugaccccgaaggugcccucugguaa

SEQ ID NO: 21557 - RNA, 9879 nt, Artificial Sequence
  derived and/or modified CDS sequence (opt6) from DENV-1__FJ410218__SS-prME
agcguuacaauguuauuaaugcuuaugccgacugcacuugcauuucacuuaacuacaagagggggugaaccacacaugauugucacaaaacaagaacgaggcaaaucgcuacuuuuuaaaacuucugcugggguuaauaugugcacucucauagccauggacuuaggugaauuaugcgaagauacgaugacguauaaauguccacgaauaacagaagccgaacccgacgacguggacugcuggugcaacgcuacagauacuuggguaacuuauggaaccugcucacaaacaggcgaacaccgaagagacaaacgaucgguugcucuugcgccacacgucggccuaggccuugaaacaagaacggagaccuggaugucaucugaaggcgcauggaaacaaauucagagggucgaaacaugggcucucaggcacccaggcuucacaguuauugcacucuuucuugcacacgcgauaggaacaagcaucacccaaaaaggaaucauuuuuauucuauugauguuaguuacaccgucgauggcaaugaggugcguuggcauaggcucaagagacuucguugaggguuuaucaggagccacuuggguagauguaguucuggagcacgggaguugcguuaccacaauggccaaagauaaaccuaccuuagauaucgagcucuuaaaaaccgaagugacaaacccagccgugcuuaggaaacuauguaucgaggcgaaaauaucgaauacaacuacagauagucgcuguccaacccaaggagaagcgaccuugauggaggaacaggaugcaaacuuuguaugcaggaggacauucgucgauaggggcuggggaaauggauguggauuauucgguaaagguucuuuaauaacaugugccaaauuuaaaugcgucacuaaauuagaaggaaaaauaguucaguacgaaaacuugaaguauucugucaucguuacuguucacacuggagaccaacaucaaguaggaaaugagucaacggagcauggcacuacagcuacaauaacaccucaggcgccgacaucagaaauccaauuaacggauuauggagccuuaacauuagauugcaguccgcgcacuggacuagauuuuaacgagaugguauuauugacaaugaaagaaaagagcugguuaguucauaaacaaugguuccucgacuuaccacucccguggacaucuggagcuaguacaagucaggagacauggaauaggcaggaccuacuuguuacguuuaaaacugcccaugcuaagaaacaagaaguagucguucuuggcucgcaagagggagcgaugcauacggcucuaacgggcgcaacggaaauccaaacgucaggaacgacuacaauuuuugcaggucauuuaaaguguagauuaaaaauggauaaacuaacauuaaagggaaugucauauguuauguguacaggaucauuuaaacuagaaaaagaaguagcagaaacccaacacgggacuguauuggugcaaaucaaauaugaaggcacugaugcuccaugcaagauaccuuuuucuacucaagaugaaaaaggaguuacucaaaacggucgucuuauuacugcaaauccgauaguaacggauaaagaaaagccagugaauauagaagcggaaccaccguucggagagucuuauauugucauaggugcaggagaaaaagcacugaaguuaucaugguuuaagaaagggaguaguauaggcaagauguucgaagcaacagcucgaggugcacgcagaauggcaauuuuaggcgauacagcuugggauuuuggaucuaucggcgguguauuuacaucaguuggaaagcugguacaccaaauuuuugggacagcauauggggucuuauuuucggguguaagcuggacgaugaaaauaggaauaggaguucucuuaacauggcuuggauuaaacaguagaucgacgucccucucaaugacguguaucgcuguaggcuuaguuacucuauaucucggggugaugguacaggccgauagcggaugugucauuaauuggaaaggaagagagcucaaauguggaucagguauuuucguuaccaacgagguacauaccuggacugagcaguauaaauuucaggcggauagcccuaaaagguugucugcagcuaucggcaaagcgugggaagaagggguaugcgggauccguucagcaacaagguuagaaaauauuauguggaaacaaaucucuaaugagcuaaaucacauucuuuuggaaaaugauaugaaauuuacuguagucguuggugacguagucgggauucuggcacaagguaagaaaaugauucgaccccaacccauggagcacaaauacaguuggaaaagcugggguaaggccaagauuauaggugccgacgugcagaauacuacauucauuaucgauggacccaauacacccgaguguccagaugaucaacgggcauggaauaucugggaaguugaagauuaugguuucggaauauuuacaacaaauauuugguuaaaacuucgagacaguuacacacaagugugugaucacagacucaugagcgccgcaauaaaagauagcaaagccgugcaugcagauaugggcuacuggauagaaagugagaaaaacgagacauggaaacuugcaagggcauccuuuauagaaguaaaaacauguauauggccaaagagucacacucuguggaguaacggaguacuugaaucagagaugauuauucccaaaauuuauggugggccaauaagucaacacaauuauagaccggguuauuuuacacaaacagcaggaccuuggcacuuaggaaaacuugaauuagauuuugacuuaugugaagguacuacaguaguaguugacgaacauuguggaaaucgaggcccaucacucagaaccacaacagugacaggaaagauaauccaugaguggugcuguaggaguugcacccucccaccauugcgauuuaagggagaagaugguugcugguacgguauggaaaucagaccaguaaaggaaaaggaagagaauuuaguaaaaucaaugguauccgcaggaucuggagaggucgauucauucagcuuaggauuauuauguauaaguauuaugauagaagaagucaugaggucuagauggucuagaaaaaugcucaugacagguacguuggcuguauucuuacuucuuauaaugggacaauuaacauggaaugauuuaauaagauuauguauuauggugggagcaaacgcaagugaccggaugggaaugggaacgacuuauuuagcccuaauggcuacuuucaaaaugagaccuauguucgcaguuggccucuuguuucguagauugacaucgcgagagguucuuuuauuaaccauuggacucucacucguagcuuccgucgaacuaccaaauaguuuagaggaacuaggcgacggacuagcaaugggcauaaugauucuaaaauuauuaacagauuuccaaagucaucaauugugggcaacacuauuaucgcugaccuuuauaaagacuaccuuaucguuacauuaugcguggaaaacuauggcaaugguccuaaguauuguuagccuauuuccuuuauguuuaucuacgacaucacaaaagacaaccugguuaccugucuuauuaggcucacucggauguaaaccuuuaaccauguucuugauagucgaaaauaaaauaugggguagaaaaucguggcccuuaaacgaaggaauuauggcuguaggggucguaucaauucugcuaucgucauuauuaaagaacgauguaccacuugcaggcccauuaauagcaggaggaauguuaauagccuguuaugucauuagcggaucuucagcagaucucagcuuagaaaaggcggccgaagucucuugggaggaagaagccgaacauagcggugcuagucauaauaucuuaguugaaguucaggaugaugggacaaugaagaucaaagaugaagaaagagaugacacauugacaauuuuacucaaagcgacacucuuagcaguuuccggcguuuauccccuaucaauaccagcaacuuuauucguaugguauuucuggcagaaaaagaaacaaagaaguggaguccuaugggacacgccgaguccuccugaaguagaaagggcgguccuagaugacgggauauauaggauaaugcaaagaggauuguuaggaagaucucaaguuggugucggcgucuuccaagaaaacgucuuucauacgauguggcacguaacaaggggagcaguuuuaauguaucaagggaaaagacuugaaccaagcugggcaagugucaaaaaggaucuaaucaguuacggaggcggguggaggcuucaaggauccuggaauacaggugaagaaguacaaguaaucgcaguagagccaggcaaaaauccgaaaaauguacaaacagcaccggguacauuuaaaacgccagaaggagaaguuggcgcuauagcauuggacuucaaacccgggacaagcggaucccccaucguuaacagagaggguaaaauaguagggcucuacgggaauggaguagugacaaccucugguacuuaugugucugcaaucgcccaagcuaaagcaucucaggaaggaccauugccggaaauagaggacgaaguguucagaaaaaggaauuuaacaauaauggaucuacauccagggucaggaaaaacaaggagauaucuaccugccauaguccgagaggcuauaaagcgaaaauuaaggacauuaauucuagcacccaccagagugguggcuucagaaauggcugaggcucuaaaaggaaugccgauacgcuaucaaacuacagcgguuaaaagugagcacacagguaaggaaauagucgacuuaaugugccaugcaacuuucacgaugcgauuauuguccccuguaagaguuccuaauuauaacaugaucauaauggacgaggcacacuuuacagauccaucuucuauagccgcacguggguacauaagcacacgcguaggaaugggcgaagcggcagcuauauuuaugacagccacuccaccgggcuccguggaggcauucccucaaaguaacgcaguaauucaagacgaagaaagagauauuccagaacgaucauggaauaguggguacgaauggauuacagauuuucccggcaaaaccguaugguuuguuccaucgauuaaaaguggaaacgacauugcuaacugcuuaaggaaaaauggaaaaagaguaauucaacuaagcagaaaaacauuugacacugaauaccagaaaacuaaaaacaaugacugggauuacguuguuacaaccgauauaagugaaaugggcgcaaauuucagagcggacaggguuauugauccccguagaugcuuaaaaccgguuauucuaaaagauggucccgagaggguaauauuagcaggaccuaugccaguuacaguagcgucagcggcgcaaaggcgugggcgaauaggacggaaucauaacaaagaaggagaucaauauauuuacaugggucaacccuuaaacaacgacgaggaucaugcucauuggacagaagccaagaugcuuuuagauaauauaaacacccccgaagguaucauuccagcgcuguucgaaccagaaagggaaaaaucugcagcaaucgacggcgaguacagauuacgaggagaggcgaggaagacauuuguugagcuuaugagacgaggagaucucccaguguggcugaguuauaaaguugcgagcgaagguuuccaauauucagacagacgaugguguuucgauggggaaagaaauaaccaaguucucgaagagaauauggauguagaaauauggacaaaggaaggagaaaggaaaaaguuacgaccucgauggcuagacgcaagaacuuauucugauccucuagcauuaagagaauuuaaagaguucgccgcagguaggcguagugugucaggagaucuuauacuugagauaggaaaacuaccacaacacuugacccaacgggcacaaaaugcguuagauaaucuagugaugcuacacaauagcgaacaaggugggagagcuuacaggcacgccauggaagaacucccagauacaauagagacccuaaugcuguuggcauuaauugcgguacugacugguggugucacuuuauucuucuuaaguggaaggggguuaggcaaaacuucaauaggacuacuauguguaauggcaucaucuguacuguuauggauggcgagugucgaaccucauuggaucgcggccucaauaauacucgaguucuuucuaauggugcuccuuauucccgaaccugaucgucaaagaacaccccaagacaaucaauuagcuuaugucgugauuggauuacuauuuaugauacuuacgguagcagcuaacgagauggggcuacuagaaacgaccaagaaagauuuggguauuggacauguagcaguagagaaccaucaucaugcaacaauguuagauguugaucugcauccagcaucggcauggacacuuuaugcgguggcuacaaccauaauaacaccaaugaugagacacacuauugaaaauacaacggcuaauauaagccuaacggcaauagcaaaucaggcagcgauacuaauggguuuagauaaaggauggccgauaaguaaaauggacauugguguaccccuauuagcucugggguguuauagucaagucaauccacugacgcuaacugcugcaguucuaauguuaguggcucauuacgcuauaauuggucccggacuacaggcaaaagcaacuagggaagcucagaaaagaacggcugcgggaauaaugaaaaauccuaccguugaugggaucguagcaauagaccuugacccaguaguguaugacgccaaauuugaaaaacaguugggucaaauuaugcuacucauccuauguaccagucagauuuuauuaaugaggacaaccugggcauuaugugagucaauuacgcuagcaacaggcccacuaacaacgcugugggaagggucgccaggaaaauuuuggaauacaaccauagcaguaucaauggcaaacauauuucgaggaucguaccuagcaggcgcugggcuagcauucagucucaugaaaucccugggaggaggaagaaggggaacuggcgcacaaggagaaacccuaggcgaaaaauggaaacgacaacugaaucagcuaucaaaaagugaguucaacauuuacaaaagaucaggaauaauggaaguagaccgauccgaagcuaaggagggacuaaaaagaggagaaacuacgcgucaugcaguaucgcgaggcacagcuaaauugcggugguuugucgaacgcaauuuaguuaagcccgagggaaaagugauagaccuuggcuguggaagagggggauggucuuauuacugugcaggccuaaagaaaguaacagaaguaaagggauauacgaaaggaggaccaggucacgaagaacccaucccaauggcaaccuaugguuggaaccuagugaaacuucauagcggaaaagauguguucuuuacuccaccagaaaaaugugauacauuacugugugacauaggugaaucaucaccaaaccccacuauagaggaaggcagaaccuugcguguauuaaaaaugguagaaccauggcuucguggcaaucaauuuugcauaaaaauacuaaauccuuauaugccaucugucguagagacauuagagcaaaugcaaagaaagcauggaggaauguuaguacguaacccacuuucgcgcaacuccacucacgagauguacuggguaucauguggaacgggaaauauuguuucggcaguuaauaugacaagcaggauguuacuaaauagauucacuauggcgcacagaaagcccacauaugaaagagacguagauuuaggugcgggaaccagacauguagcugucgagcccgaaguagcgaaucuugauauaauuggccagcgcauagaaaauauaaaacaugaacacaaguccacauggcacuaugaugaagacaaccccuauaagacuugggcauaucaugguucauaugaaguuaagccaagcgggucagcauccaguauggucaaugguguugugaaacuacuaacaaagccaugggacgucauaccgaugguuacucaaauagccaugacagauacaacgccauucgggcagcaacgaguguuuaaagaaaaaguagauacccgaacgccaaaagcaaaacgggggacggcacagauaauggaaguuacagcacgaugguuguggggauuuuuaucacguaacaagaaaccucggauauguaccagagaagaguucacccgaaaaguaagaagcaaugccgcaauuggagcaguauucguugaugaaaaucaauggaacagcgcaaaggaagcuguagaggacgagcgauuuugggaccugguacagaaagaaagggagcuccauaaacaagguaaaugcgccaccuguguguauaauaugaugggaaaaagagagaagaaauuaggggaguucgggaaagcaaaaggcucgagagcgauaugguauauguggcuaggggcucgauuuuuagaauuugaggcgcuuggguuuaugaaugaagaucauugguucagcagagaaaauucccuaucuggaguagaaggcgaaggacuccauaaacuaggcuacauccucagagauaucucaaaaauacccggcgguaauauguacgcggaugacacagcaggcugggauacccgaaucacagaggaugacuuacaaaacgaagcaaaaaucacugacauaauggaaccagagcaugcguuauuggcgacaucaauuuucaaauuaacuuaucaaaacaaggucguaaggguacaacguccugcgaaaaacgggacaguaauggaugugauaagcagaagagaucaaagggguucaggucaagucggaacguacggccuuaacacauuuaccaacauggaagcgcaauuaaucagacaaauggaaagcgaagguauauuuucuccaagcgaauuagaaaucccuaacuuagccgaacguguucuagacuggcuugagaaauauggcguugaacgguuaaaacgcauggcgauauccggugaugacugcguaguaaaaccuaucgaugaccgauucgcaacggccuuaacggcacuaaacgauaugggaaaaguucguaaagauguuccucaaugggaaccgucaaaaggcuggaacgauuggcaacaaguaccauuuuguagucaucauuuccaccaacucauaaugaaggauggaagagagauuguaguaccauguaggaaucaagaugagcuaguaggacgugcgcguguaucgcagggugcaggauggagucuuagagagacagcaugcuuaggaaagucuuaugcucagauguggcaauuaauguauuuccaccgucgcgacuugcgacuagcugcgaacgccauuugcucagcggugcccguagauuggguuccuacaucacgaacaacguggucuauccaugcacaucaccaauggaugacaacggaggauaugcuuucaguuuggaaucggguauggauagaggagaauccauggauggaggauaaaacucacguaaguaguuggggagacguuccauaucuagggaaacgagaggaucaaugguguggcucucuaauuggacuaacagcucgagcaacaugggcuucuaauauccaaguugcgauaaaucaaguaagaaggcucauuggaaaugagaauuaucuagauuacaugacuagcaugaaacguuuuaaaaaugaaggagauccugaaggagcacuuugguga

SEQ ID NO: 21558 - RNA, 9879 nt, Artificial Sequence
  derived and/or modified CDS sequence (opt6) from DENV-1__FJ461316__SS-prME
ucuguaaccauguuacuuaugcugaugccuacugcuuuagcguuucaucuaaccacucgugggggagaaccucauaugguugugagcaaacaagaacgcgguaaaagucugcuauuuaaaacaagugcaggaguaaacaugugcacucuuauagccauggacuuaggugaguuaugugaagacacaaugaccuauaaauguccuagaaucacugaagcagaaccggaugauguagauuguugguguaacgcgacggauacuuggguaacauacggcacaugcucgcaaacuggugagcauaggcgugauaaacgcucaguagcauuagcuccgcauguuggacuuggauuggaaacgagaacggagacauggaugucaucugaaggagcauggaaacaaauacaacgaguagaaacaugggcauugcgucauccuggauuuacaguaauagcauuguuuuuagcgcaugcaauaggaacuucgaucacucaaaaagguauaauauucauccuauugaugcuagugacuccgagcauggcuaugcguugcgucggcauagggagccgcgauuucgucgaaggucuauccggugcgaccuggguggauguaguuuuagaacauggcucuugugugacuaccauggcaaaagauaaaccaacuuuagauauugaauuauuaaaaacugaaguaacaaauccugcuauacuuagaaaauuaugcauugaagcuaaaauuucuaauacaacaacugacucacguuguccaacacaaggugaagcaacacugguagaggaacaagacgcuaacuuuguuugucgcagaacauuuguagauaggggauggggaaauggaugcggcuuauucggcaaaggaucucuaauaacgugugcaaaauucaaauguguuacuaaauuagagggaaaaauuguucaauacgaaaaucucaaauauucagugauagugaccguacauacaggagaccaacaccaaguaggaaaugagucaacagaacacgggaccacagcuacaaucacgccacaggcuccaacgacagaaauacaacuaacugauuauggcgcucuuacccucgacuguucaccaagaacaggacuagauuuuaaugaaauggugcuacucacuaugaaagagaaaaguugguuaguacauaagcaaugguuccucgauuuaccccuaccguggacgucaggugcaucaaccucucaagagacauggaacagacaagacuuguuggucacuuuuaagacagcacaugccaagaaacaagaaguaguuguccugggcagccaagaaggagcuaugcauacggcguugacuggagcgacagaaauacaaacauccgggacaacaacaauauuugcagggcaucuuaaauguagauugaaaauggacaaacuaacacuaaaaggaaugucuuauguaaugugcacagguagcuuuaaacuagagaaagaaguagccgagacacagcauggaacagucuuaguucaaauuaaauaugaaggaacugaugcaccuugcaaaauuccauuuucaacucaagaugagaaagguguaacacaaaacgggagguugauaacagcuaaucccaucguaaccgauaaagaaaaaccugugaacauagaagcagaaccaccuuuuggugaaucauauauugucaucggagcaggagaaaaggcauuaaaacucagcugguucaagaaagggaguucuauagguaaaauguuugaagcaaccgcaagaggggcuaggcguauggccauucuaggugauacugccugggacuuuggaagcauugggggaguguuuacaaguguuggaaaauugguucaccaaauauuugguacggcuuauggugugcuuuuuagcgguguaaguuggacuaugaaaauaggcuuagguguauuauuaacuugguuagggcuaaauucgcgaucaacuucacuaucgaugacuuguauagcggucggacuggugacguuguaucuugguguaauggugcaggcagacuccgguugcguaaucaauuggaagggaagagagcuuaaaugcggaucugguauuuuuguuaccaaugagguccacacuuggaccgaacaguacaaauuucaagcggacaguccgaaaagacucucugcggcuauuggcaaagcaugggaagaaggaguaugcgggauacgaucagcuacuagauuagaaaauguuauguggaaacagauuucgaaugaguugaaccauauacuguuagagaacgacaugaaguucacaguugucgugggcgauguggcugggauuuuagcacaggguaaaaagaugaucaggccgcagccaauggaauacaaguacucauggaaauccugggggaaagcaaaaaucaugggagcugauguucaaaacacuacauucauuauagaugggccuaacacgccagaauguccugaugaccaaagagccuggaacauaugggaaguugaagacuacggauuugguauauuuaccacaaauauuugguuaaaauugagggacucauauacacagguaugcgaucaucgcuuaauguccgccgcuaucaaagauucgaaagcgguccacgcagauauggguuauuggauagaguccgagaaaaaugaaacuuggaagcuggccagagcuucauucauugaggugaagacuuguauauggccaaaaucccauacacuuuggagcaacgguguucuagaaucagaaaugaucauuccaaaaauuuaugggggaccaauaagucagcauaauuaccggccuggauacuuuacgcagacagcuggaccguggcaucuaggcaaauuagaacuagacuuugauuuaugcgaaggcacaacugucguuguugaugaacauuguggaaauagagggccuucacuacgaacgacuaccguaaccggaaaaauuauucaugaauggugcugccgaucauguaccuuaccacccuuaagguuuagaggugaagacgguugcugguacgggauggaaauucggccgguuaaagaaaaagaagagaaccuaguuaaaucaaugguaucagcaggaaguggagaaguagauaguuuuucauuaggguuacuguguauaucaauaaugauagaagaaguaaugagaucaagauggucaagaaaaauguuaaugaccgguacauuagcugucuuucuguugcuuauaaugggccagcuaacguggaaugaccuaaucagauuauguauuaugguuggugcaaaugcuucagaccguaugggaauggguacaaccuacuuagcuuugauggcuacauuuaagaugagaccaauguucgcagucgguuugcuguuccgaagacucaccucgcgagaaguucuacuauuaacaauaggacuaucgcuuguugcgucaguugaacuuccuaacuccuuagaggaacugggcgaugggcuagcgauggggauaaugauuuugaaacuacucacagauuuucaaucucaccaacuaugggcaacccuuuuaucguugacauuuauuaaaacaacauuuucucugcauuaugcguggaaaacuauggcaaugguacuaucgauagucagccuuuucccccuuugccucuccacgacaucgcagaaaaccacuuggcugccgguguuacuuggcucgcuaggguguaaacccuuaacaauguuccuaauagccgagaauaaaauuuggggccgcagaucguggccuuuaaacgaagguaucauggcuguggguauugucuccauauuauuaaguucuuuauugaaaaacgacguuccccuugcaggcccguugauagccggcgguaugcuaauagcguguuacguuauuucggggucgagcgccgaccuuucucuggaaaaagcagccgaaguaaguugggaagaagaagcugaacacaguggagcaucgcauaauaucuuaguugaaguccaagaugacgguacuaugaagauaaaagaugaagaaagggaugauaccuuaacaauccucuugaaggcuacucuucuagcaguuaguggaguuuauccgcuaaguauuccagcaaccuuauucguuugguauuuuuggcagaaaaagaaacagcgcucagguguucucugggauacaccaucacccccugaaguugaaagagcuguauuagacgacggaauauacagaauaaugcaacgaggucuccuaggaagaagucaaguugggguugguguguuucaagaaaauguguuucauacgauguggcacgugaccaggggagcaguauuaauguaucaaggaaaaagacucgaaccgucgugggcgagcguaaagaaggaccucauuucauacggaggaggguggcgccugcaaggaucauggaauacaggugaagaaguccaagugauugccguggaacccggcaaaaaucccaaaaauguacaaaccgcacccgguaccuuuaaaacacccgagggagagguaggagcuauugcuuuggauuucaaaccugggaccaguggcucaccuauaguuaacagggaagggaaaauuguuggccuguacgguaacgggguugugacaaccagugggaccuacguuagugcaauagcacaagcuaaagcaucgcaagaagguccucucccagagaucgaggacgaaguuuuccgaaaacgcaauuugacgauuauggauuuacauccagguagcggaaaaacaagaagauaccuaccugcaauaguuagagaggcaauuaaacguaaauugagaacgcuaauucuugcucccaccagaguagucgcuucugaaauggcggaggcacuaaaagggaugccaauccgguaucaaacaacagcggucaaaagugagcauaccgggaaagaaauaguggaucugaugugucaugcuacauucacuaugaggcugcugagcccagucaggguaccgaacuacaauaugaucauaauggaugaggcacacuuuacagauccaucaagcauugcugccagaggguacauuucaacacgagugggaaugggagaggccgcugcgauauucaugaccgcaacgccacccgguucaguagaagcguucccgcaaucaaaugcaguaauucaagaugaggagcgagacauaccagaaaggaguuggaauaguggguacgaauggauaaccgacuuuccuggaaaaacagucugguucgugccauccauaaaaagcgguaaugauauagcgaauugucucagaaagaaugguaagagagucauucaacuaucucgaaaaacauucgauacagaauaucaaaagacaaagaacaaugauugggauuacguagucacaaccgauauuucagagaugggugcaaacuuucgcgcggacagaguuauagauccucgaagguguuugaagccaguaauuuuaaaggaugguccagagagagucauucuugcaggccccaugcccgucacaguugcuagcgcagcucaaagacguggacguaucggacgaaaucauaauaaagagggugaucaauauauuuauaugggucagccacucaauaaugacgaagaucaugcucacuggacagaagcgaaaaugcuacuugauaacauuaauacaccagaagggauaauuccagcuuuguucgaaccagagagagaaaaauccgccgcuauagauggagaauacagacuacgaggcgaggcuagaaagacguucguggaauuaaugcgcagaggagaccuuccggucuggcuuagcuacaagguagcaucggaaggguuucaguauucagaucgucgcugguguuucgauggugaaagaaauaaucaagugcuagaagagaauauggauguagaaauuuggaccaaagagggggaacgcaagaaacuaagaccacgaugguuagaugcuaggacguauagcgacccucucgcuuugagagaauuuaaagaguuugcggcagggagaagaucugugagcggagaccucauuuuagagauaggaaagcuaccgcaacaucuuacgcaaagagcucaaaaugcacucgacaacuuaguaaugcugcauaacucggaacaagguggacgugcauaucgacaugcgauggaagaauugccugauaccauagaaacucugauguuauuagcgcugauagcgguccucacagggggcguuaccuuauucuuuuuaaguggaagaggcuuaggaaaaacaucaaucgguuuauugugugugauggcauccuccgugcuccuguggauggcuucgguagagccacauuggauugcagccucaauaauucucgaauuuuuccuuaugguacuccuaauaccagaaccugaucgacaaagaacuccucaggacaaccaacuggccuacguaguuaucggauugcuuuuuaugauauuaaccguagcagcgaacgaaaugggauuauuggaaacgacgaagaaagaucuugguaucggccaugccgcagucgguaaucaccaucaugcggcgaugcuugauguagaucuacacccagcuucugcauggacauuguacgcugucgcuaccacaauuauuacaccaaugaugagacauacuauagaaaacacuacggcaaauauaaguuuaacggcaaucgcaaaccaagcagcgauccuaaugggauuagauaaagguuggccaauuucgaagauggauauaggaguuccgcucuuagcacuaggauguuacucacaaguaaauccacuaacgcuaacagcagcuguccuaauguuagucgcgcauuaugccauaauaggaccgggccuacaagcaaaagcuacgagagaagcacaaaagagaacugcggccggaauuaugaaaaacccgacgguugaugggauaguagccauagauuuagauccggucgucuacgaugcaaaguucgaaaaacaguuaggucaaauuauguugcucaucuuguguacaucacagauauugcucaugagaacaaccugggcucuaugugaaucaauaaccuuagcuacaggaccauugacgacucuuugggagggaucaccuggaaaguuuuggaauacaacuauagccgugucuauggccaauauuuuuagaggcaguuaccucgcuggugcaggucuagcauucucauugaugaaaucuuuaggaggugggagacgagguaccggcgcccaaggugagacacucggggaaaaguggaagaggcaacucaaucagcucucaaaaagugaauuuaauacauauaaaagaucaggaauuauggagguugaccguucagaggcaaaagaagguuugaagcgaggagaaacaacgaaacaugccgugaguagaggcacagccaaauuaagaugguuuguagaacgaaaccuaguaaagccagaagguaaaguuaucgaucuuggauguggucgaggaggguggucuuauuauugcgcaggacucaagaaaguaacugaaguuaaaggauauacuaagggaggucccggacaugaagaaccuauucccauggcaaccuaugguuggaauuuaguuaaauugcacuccggcaaagauguguucuuuauaccuccugaaaaaugugacacacuucuaugugacaucggagaaucuucuccaaaccccacuauugaagaagggaggacccuacggguucuaaaaaugguagaacccugguugagggguaaccaauucugcauaaagauccucaauccguacaugcccucuguugucgaaacuuuggagcaaaugcaaagaaaacauggcgguauguuaguaagaaacccacuaucucggaauagcacucaugagauguauuggguaaguugcggcacaggaaauaucguuucugccguaaacaugacgucaaggauguuacuuaacagauucacgauggcgcauaggaaaccuacuuaugaaagggauguagaucuaggugcuggcacccgacauguagcaguagaaccugaaguggcaaauuuggacauaauuggacaaagaauagaaaauauaaagcaugagcauaagucaacauggcauuaugacgaggacaauccauauaaaaccugggcguaccauggaaguuaugaaguaaaaccaucaggaucugcuucaucaaugguaaaugguguggucaaacuuuuaacaaagcccugggauguuauaccgaugguaacucaaauagcgaugacagauacuacuccauucggccaacaacguguuuuuaaagaaaagguugacacgagaacaccaaaggcaaaaagagggacggcgcaaauuauggaagucacagcuaaauggcuuugggguuuucuuucuaggaacaaaaagccacggauuuguacacgagaggaauuuacaagaaaaguacguaguaaugcagcgauaggugcaguguuuguagaugaaaaccaguggaacucggcuaaagaagcgguagaggacgagcgguuuugggacuuaguucauagggaaagagaauuacacaagcaggguaaaugugcgacuuguguauacaacaugaugggaaaacgugagaagaaacuuggugaguuuggaaaagcuaagggcagucgagccauaugguacauguggcuaggugcaagauuucuagaauuugaagcacuuggguucaugaaugaggaucauugguucagccgggagaacaguuugagcggaguagaaggcgagggacuacauaaauuggguuauauacucagagauauuaguaagauaccagggggcaauauguaugcggacgacacggccggaugggacaccagaauaaccgaagacgauuuacaaaaugaggcaagaauaaccgauauuauggaaccagagcacgcgcuccuggccaagagcauauucaaacucacuuaccaaaauaaagucgugagggugcaaaggcccgcgaaaaaugguacuguuauggaugucaucuccagacgagaccaaagagggucgggacaaguaggcacauaugguuuaaacacauucacuaauauggaagcacaguuaauaaggcaaauggaaucggagggaauauuuuccccgucugaacuagaaaccccgaauuuagcugaaaggguucucgacuggcuggagaaguacggcguagagcgacugaaacgaauggccauaagcggagaugauuguguaguaaaaccuauagacgacagauuugcaacagcgcuaacggcuuuaaacgacaugggaaaaguaagaaaagacauaccucagugggaaccaaguaaagguuggaaugauuggcagcaaguuccguucuguagucaucacuuucaccaacuaauuaugaaggaugggcgagaaauagucguuccaugccggaaucaagaugaauuaguaggccgagcgcggguaucgcaaggagcugguuggagucuaagggaaacugcuuguuuaggcaaaagcuaugcacagauguggcaacuuauguauuuucaccgccgagacuuaagacuugcggcuaacgcaauauguuccgcuguaccaguagauuggaucccuacaagucgaaccacauggucaauacacgcucaccaucaauggaugacgacugaagauauguuaucagucuggaauagaguauggauugaagaaaaucccuggauggaagacaaaacacauauaucuucuuggggugauguaccauaccuuggcaaaagggaagaccaguggugcggcucacuaauuggcuugacagcuagagcaacuugggcuacaaauauacaaguugcaauaaaccagguacgacgacugaucgggaaugaaaauuacuuagauuauaugacuucuaugaaacgcuucaagaacgaaagugauccugaaggugcacuuugguaa

SEQ ID NO: 21559 - RNA, 9879 nt, Artificial Sequence
  derived and/or modified CDS sequence (opt6) from DENV-1__FJ410220__SS-prME
agugugacuauguuguugauguuaaugccaacugcauuagcauuucacuugaccacacgagguggagagccacacaugauaguuuccaaacaagaaagaggaaaaagucuuuuauuuaaaacaagugcaggaguuaacauguguacacuuauugcuauggaccuaggggaauuaugugaagacacgaugacguauaaaugucccagaauaacggaagcagaaccagacgauguagauuguugguguaacgcaacugauacuuggguuacauacggcacgugcucccaaacuggagaacauaggcgagagaaaagaucuguagcacuagcuccacauguaggucuaggauuagaaacgcguacggaaaccuggaugagcucagaaggugcuuggaaacaaauucaacggguagaaacgugggcauuaagacauccaggauuuacagugauagcauuauuccuugcacacgcuaucgguacuucgauaacccaaaaaggcauaguauuuauacuuuuaauguuagugacaccaucuauggcgaugagguguguaggaauuggaucccgggauuuuguagaaggacuuucuggcgccacgugggucgauguuguacuagaacacgguucauguguuacuacaauggcuaaagauaaaccuacuuuagauauugaauuacuaaaaacagaagugacuaacccggcuguauugagaaaauuguguauagaggcaaaaauuucaaauacuacuacugauucgagaugcccaacacaaggagaagcuacucuuguagaggaacaagaugcgaauuuugucugccguagaacauuugucgacagaggaugggguaauggcuguggucucuucggaaaagguucucuucuaaccugcgcgaaauuuaagugcgucacgaaacuugaagguaaaauaguucaauaugaaaaccuuaaauauucaguuaucguaacaguucauacaggagaccaacaucaaguugguaaugaauccacagaacaugguacuacggcgacaauuacuccacaagcaccgacaacagaaauacagcucacggauuauggggcacucacgcuggacuguucaccgcgcacgggacuugauuucaacgaaaugguauugcucacuaugaaagaaaaaucaugguuaguccacaaacaaugguuuuuggacuuaccacuucccuggacaucuggcgcaucaacuucgcaagagacuuggaacaggcaagacuuacuugucacauuuaaaaccgcacacgcaaagaaacaagaggucgucguacugggcucccaagaaggagcuaugcacacugcauuaaccggagcgacugagauacaaaccucgggaaccacaacaaucuucgcgggucaccuuaaaugccgucuaaagauggacaaguuaacgcuaaaaggcaugagcuacgucaugugcacagguagcuucaagcucgaaaaagagguugcagaaacucaacauggaacaguuuugguucaaaucaaauacgaagggacugaugcuccuugcaaaauacccuuuaguacacaggacgaaaaaggagucacacaaaacggucguuuaauaaccgcaaacccuaucgucacagauaaagaaaaacccgucaauaucgaggcagaaccgccuuucggagagucauauauaguaaucggugcuggggaaaaggcuuuaaaguugucuugguucaagaaaggaucuucuauaggaaaaauguucgaagcuacugcccgaggugcacgacggauggcaauauuaggcgacacugcaugggacuucggauccaucggcggcguauuuacaucgguaggaaaacuggugcaucaaaucuuugguacagccuauggcguccuuuucuccggggugaguuggacaaugaagauaggaauagguguacuccuaacaugguuaggacuuaacagcagaucaaccagcuuaaguaugaccuguauagccguagguuuaguuacuuuauaucuagguguaaugguacaggcugacucggguuguguuauaaauuggaaggggagggaacuaaaauguggaagcggcauauuuguuacuaaugaaguucauacauggacagagcaguauaaguuucaagcagauucaccuaaacgacuaagugcugcgauaggaaaggccugggaggaaggcguaugugguauccgaagugccacuagacuugaaaauauuauguggaagcaaauaucaaaugaacucaaucacauacugcuggagaaugacaugaaguucacaguagucguaggggauguagcaggcauuuugguacagggcaagaaaaugauuagaccacaacccauggaguauaaauauaguuggaaaucauggggaaaggcuaaaauuauaggcgccgacguucaaaauagcaccuuuauaauagacggucccaauacaccagaauguccugaugaucaaagagcuuggaacauaugggagguugaagauuacgguuuuggaauauucacaacuaacauuugguuaaaacuaagggacagcuauacacagguaugugaccaucgacuaaugucagcugcaauaaaggauucuaaagcuguucacgcagacauggguuauuggauagaaucugagaagaacgaaaccuggaaacuagcgagagcuucguuuauugagguaaagacuuguauuuggccaaaaagucauacccuguggucuaaugguguauuagaauccgaaaugauaauuccgaaaauucauggaggaccaauuagucaacacaacuaucgccccggauacuuuacucagaccgcagguccuuggcacuuaggaaaacuagaacuggauuuugauuugugugaagggacaacaguuguuguggaugagcauugugguaauagaggcccgagucuuaggacaacuacagugacagguaagauuauccacgagugguguuguagaucuuguacauuaccaccauuaagguuuaggggcgaggacggaugcugguacggaauggagauacguccagugaaggaaaaagaggagaaucuggucaaauccaugguaagugcagggagcggugaaguagauuccuuuagcuuaggacucuuauguaucucuaucaugauugaagaagugaugagaucaagguggucucgaaaaaugcuuaugaccgggacauuagcaguauucuuucuccuaauaaugggucagcuaacuuggaaugacuugauccggcuauguauaaugguuggagcaaaugcuuccgaucgcauggguaugggaacaaccuaucuugcauugauggcgacguuuaaaaugcgaccaauguuugccguagguuuguuauucagaagacuaacaaguagggaaguccuguuacuuacaaucgggcucagcuugguagcuaguguugagcucccaaacucccuugaagaacuaggugauggccuugccaugggaaucaugauuuuaaaacuacugacggauuuccaauccuaccaguugugggcgacccuauugucucuaacauucauuaaaacgacauucucgcuacacuacgcauggaaaacuauggcuaugguuuuaucgauuguaucauuauuuccacugugccuuucuacaaccucucagaaaaccacaugguuaccugucuuacuugggucucuaggguguaaaccuuuaacaauguuucuaauugcugaaaauaagaucuggggucgaaaaaguuggccuuuaaaugaaggcauaauggcaguuggcauaguaucgaucuuacugucaucuuuauugaagaacgauguuccgcuagcagggccccuuaucgcaggaggcauguugauagccuguuaugugaucagcggaagcucagcagacuuauccuuagagaaggcagcugaaguuucaugggaagaagaggccgaacauucuggugcaucacauaauauacuuguagaaguucaagaugauggaaccaugaaaaucaaagaugaagagagagaugauacguuaacuauacuucuaaaagcuacgcuauuagcaguaucaggagucuacccacuuucgauaccagcaacucuauuuguauggcauuucuggcagaagaagaaacaaagaagcggagugcuaugggacacaccuagcccaccagagguagaacgugcaguauuggaugacggaauuuaucgcauaaugcagaggggcuuguuagguagaucucaaguaggugucgguguauuucaggaaaacgucuuccacacuauguggcauguaacucguggagcaguacuaauguaucaaggaaaaagacuugaaccaaguugggccucuguuaagaaagaccuuauaucauacggagggggcuggagauuucaaggaaguuggaauacuggugaggaaguucaagucauugcggucgaaccaggcaaaaauccuaagaauguacagacggcuccgggcacauuuaaaacaccagaaggagaagugggagcuauugcccucgacuucaaaccuggcaccagcggauccccaauaguaaaccgagaagggaaaauuguugggcuguacgggaacggagucguaacgacuagcgggacauacguauccgcuauagcccaggcgaaagccagucaagaagguccgcugccagaaaucgaagaugaaguauuuagaaaaaggaaucuaacuaucauggaucuccauccagguuccgguaaaacgcgaagauauuuaccugcgauaguacgggaagcuauaaagcguaaguugcgaacauuaauauuggcaccuaccagaguuguugcaagugagauggcagaagcacuaaaaggaaugccaauucguuaccaaacaaccgcagugaagucagagcacacgggaaaggaaaucguggaccuaaugugucacgccacguuuacaaugcgucuacuaagcccaguucggguuccaaacuacaauaugaucaucauggacgaggcucauuuuacugaucccucaucaauagcagcaagagguuacauaucaacccgcgucgggaugggagaagcagcagcgauauuuaugacggcuaccccucccggcucaauggaggcuuucccucaaucaaacgcaguuauacaagacgaagaacgugauauuccggaaagguccuggaacucaggguacgaauggauaacagacuuuccuggcaaaacaguuugguucguccccuccauaaaagcagguaaugauauugcuaacugcuuaaggaaaaacgguaaaagaguaauacaauuaucgaggaaaaccuucgauaccgaauaucagaaaacuaaaaauaaugauugggauuauguagugacuacagauauaucagaaaugggcgccaacuuccgugcagauagagucauugauccacgcagauguuuaaaaccugugauacucaaagaugggccugaaagaguaauauuagcugguccaaugccugugaccguggcauccgcagcacaacguagaggacgcauuggacgaaaucacaacaaggagggagaucaguacauuuauaugggacaaccucugaauaaugaugaagaucaugcacauuggacugaagccaaaaugcucuuagacaauauuaacacccccgagggaauaauacccgcgcuauucgaaccugaacgagagaaaagcgcugcaaucgauggggaguacagauugcgaggagaagccaggaaaacuuucguagaguuaaugaggcgaggugaccucccggugugguuaucauacaaaguagcaucggagggauuucaauauuccgaccgacgaugguguuuugacggggaacgaaacaaucaaguguuggaagagaacauggauguagaaauauggaccaaagaaggcgaaaggaagaaacuccguccgcguuggcuagacgcccguacauacagugacccauuagcauuaagggaguuuaaagaauuugcagcagguagaaggagcgucagcggagauuugauuuuggagauaggcaaacuaccucaacacuuaacacaaagagcacagaaugcacuugacaacuuagugaugcuacauaauucagaacagggagggagagcauacagacaugcaauggaagaacuaccagauacaaucgaaacacucauguuauuagcacuuauagcagugcuaacaggcggaguaacccuguucuuuuuaucagggaaagguuuagguaagacaucaauaggcuuacuauguguaauggcaucaucaguacuucuauggauggcaucaguagaaccacacuggauagcagcuuccaucauuuuagaguucuuuuuaaugguacuacuaaucccagaaccagacaggcaacgaacgccgcaagacaaucaacuggcuuacgucgugauuggcuuauuauuuaugauauuaacaguagccgcuaaugaaaugggacuacuagagacaacuaagaaagaucuagguauaggacauguugcuguugaaaaucaucaccacgccgccaugcuugaugucgauuuacauccagcguccgcuuggacguuauaugcaguggcaacaacgauuaucaccccuaugaugcggcauacaauugaaaacacuacagcaaacaucagccuaacggcgauagcgaaccaagcagccauucuuaugggccuagauaaaggguggccaauaucaaaaauggauaucgggguaccccuuuuggcgcuagguuguuacucacaagugaauccucuaacauugacugcagcaguauuaaugcuaguugcgcacuacgcuaucauaggcccaggacuacaggcaaaggcuacacgagaggcacagaaaagaacugccgcagguaucaugaaaaaccccacuauugacggcauagucgcgauagauuuagacccaguuguuuacgaugcaaaauuugaaaaacaacuuggacaaauaaugcugcuaauccuuuguacgagucaaauacuacugaugcgaacuacuugggcacuaugugaaucaaucacauuagcgacuggcccucuaacaacacuaugggagggaucgccugggaaauuuuggaauaccaccaucgccgugaguauggcaaauauauuccgcggaucauaucuagcaggggcaggacuagcauucaguuuaaugaaaucauuaggugggggacgcagaggcaccggugcacaaggcgagacacuaggggaaaaauggaaaagacaacugaaucaacuaagcaaaagcgaauuuaauacauauaaacgauccgguauaauggagguggaucggucagaggcaaaagaaggucuuaagagaggggaaacuaccaaacaugccguuaguagagguacugccaaacuuagaugguuugucgaaagaaaccuugugaaaccagaagggaaaguaaucgacuuggguugcgguagagguggauggucguacuacugcgcgggauuaaagaaaguaacagaaguaaaaggauacacuaaaggagggccuggccaugaggagccaauuccuauggccacauaugguuggaaucugguaaaacuucauaguggaaaagauguguuuuucauaccaccagaaaaaugugacacccuccucugugacauuggagaaaguagcccaaauccgacgauagaagaaggucguacuuugaggguucuaaaaauggucgaaccaugguuacgcggcaaccaguuuugcauuaaaauauugaaccccuacaugccuucaguaguugaaacauuagaacaaaugcaaagaaaacacggaggaaugcuuguacgaaauccccuuagcagaaauaguacacacgaaauguauuggguaucgugcggaacgggaaauauaguaucagcagucaauaugacaagucggaugcuucuaaaccgauucacaauggcccaccgaaaaccaacuuaugaaagagauguggauuugggugccggaacgagacauguagcuguugaacccgagguagccaaucucgacauuauaggccaacgaauugagaauauaaaacaugaacacaagucaacuuggcacuaugaugaagauaauccauauaagacgugggcauaccauggcaguuacgaagucaagccaucuggaucagcuucgaguaugguuaacggagucguaaaauuacuaacaaaacccugggauguuauuccaaugguaacacaaauagcaaugacggacacgacccccuuuggacagcaacgcguuuuuaaagaaaagguagacacucgcacacccaaagcgaagcgugguacggcccaaauuauggaagucacugcacguuggcuauggggcuuuuuaagcaggaauaagaaacccagaauuuguacaagagaagaauuuacccguaaggugcgcuccaaugcagcgaucggugcaguauucguggacgagaaccaguggaacucagcaaaggaagcgguagaagaugacagauucugggauuuaguacaucgugaacgugagcugcauaaacaaggaaaaugugcaaccugugucuacaacaugauggggaaacgcgagaagaaauuaggggaauuugggaaagcuaagggaucacgugcgaucugguauauguggcugggugcgagauuccuugaauuugaagcgcuugguuucaugaacgaagaucauugguucucgagagaaaacaguuugucgggugucgaaggagaaggacuacacaaacuaggguauauacugagagacauuaguaaaauuccaggaggaaacauguacgcggacgauacggcaggaugggacaccaggauaacagaggacgaucuacaaaaugaagcgaaaauaacagacauaauggagccagaacacgccuuacuagccaaguccauuuucaaauugacuuaucagaauaaaguuguaagagugcagcgaccggcuaaaaacggaacugugauggauguaauuucgcgcagagaccaaagaggcaguggccaagucggaacauauggacuuaauacguucacaaacauggaagcccaacugauuagacaaauggaaagugaaggaaucuucuugccgaacgaauuagaaaccccaaaucuagcuggaagagucuuagauugguuggagaaauacggagucgaacguuuaaaaagaauggcaauaucuggugaugauuguguggucaaaccaauagacgauagauuugcaacggcucuaacagcguuaaaugauaugggcaaagugcguaaagacauuccacagugggagccauccaagggguggaaugacuggcagcaagucccauucugcucacaucauuuucaccaauuaauuaugaaagauggacgcgagauuguuguaccgugcagaaaucaagaugaacugguaggacgagcaaggguuagucaaggugcagguuggagucuaagagaaacagcuugcuuaggaaaaagcuaugcucaaauguggcaauuaauguacuuccauaggagagaucuacgccuagccgcuaacgcaauaugcuccgcaguaccagucgacuggguuccaacaucacgaacuacauggucuauacacgcucaucaucaauggaugacaaccgaagauaugcuaagcgucuggaauagaguauggauagaggaaaacccuuggauggaagauaaaacccgaaucaguucuugggaagauguuccguaucuaggcaagagggaggaucaauggugcggaagccucauaggacuaacugcgagggcaacuugggcaacuaacauacaaguggcuauuaaucaagucaggagguugauaggaaaugaaaacuauagugauuacaugacaucaaugaaacgguuuaaaaaugaaagugaaccugaaggugcauugugguaa

SEQ ID NO: 21560 - RNA, 9879 nt, Artificial Sequence
  derived and/or modified CDS sequence (opt6) from DENV-1__JF937649__SS-prME
ucuguaacaauguuauuaaugcucaugccuacggcucuugcauuucauuuaacgacacgaggaggcgaaccacauaugauaguaagcaaacaagagcguggaaaaagccuacuguuuaaaacaagcgcaggagugaacauguguacauuaauugccauggaucuuggagaacugugugaagacaccaugacauauaaaugcccgaggauaacagaaguggaaccagaugacguugacugcugguguaauacuacagauacguggguuacguacgguacauguucgcaaacuggugaacauagacgagauaaaagaucgguagcccuugcaccucauguaggauuaggccuagaaacccgcgcagagacuuggaugucgagcgagggugcauggaaacaaauacaaaaaguagaaacaugggcgcugcgucacccuggauucacagucauugcuuuguuucuagcucaugcgauugguaccucgaucacacaaaaaggaauaauauucauucuccucauguuaguuacuccaucaauggcaaugagauguguaggaaucggcucgagagacuuugucgagggguuaucuggagcaaccuggguagauguaguacuggaacacgguagcugugugacaacgauggcgaaagacaaaccuacucuagauauugaauuauuaaaaacagagguuacuaaucccgcaguucuaagaaaacuguguauagaggcgaaaaucucuaacacaaccaccgauucuagaugcccuacacaaggugaggccacucugguagaagaacaagacgccaauuucguuugcagaagaacauucgucgaccgugggugggggaacgguugcggacuuuuuggaaaagguucccugauaacgugcgcuaaauuuaaauguguaacuaaacuugaaggaaaaauagugcaauaugaaaaccuaaaauauucaguuauaguaacgguacauacaggugaucagcaucaaguuggaaaugaaucuaccgaacaugggacaacagcaacuauaacgccacaagcaccuacaucagaaauccaacucacagacuacggagcacuaacucuagacuguaguccaagaacuggacuggauuuuaacgagaugguccuacugacaaugaaagaaaaaucauggcuuguacacaaacaaugguuucuagaucucccguuaccguggacaucgggagccucaacgucccaagaaacauggaauagacaggaccuauugguuacguuuaaaacagcacaugcaaagaaacaggaagucgugguacuagguagccaagaaggcgcaaugcauacugcgcuuacgggagcgacagaaauacaaacaagcgggacuacaaccauuuuugcuggacauuuaaaaugccggcuuaaaauggacaaacuaacauuaaaaggaaugucauaugucauguguacuggaaguuucaaauuagaaaaagagguggcugaaacacaacaugggacaguccuaguucagauaaaguacgaaggcaccgacgcaccauguaaaauaccuuucagcacacaagaugaaaaaggaguaacgcagaacgggagacuuauaaccgccaacccuauuguuacggacaaagaaaaaccggugaauauugaggccgagccuccguuuggugaaucauacauaguaauaggagcaggagaaaaagcauuaaaacuaaguugguuuaagaaagggaguaguauagggaaaauguuugaagcuacagcuagaggggcaagaaggauggcgauauuaggagauacggcaugggacuuugggaguauugguggaguuuuuacuucuguagguaaauuaguccaucaaauauuuggaacugcauacggggucuuauuuucagguguaucauggacgaugaagauaggaauaggaguuuuacugacauggcuggggcuaaauucaagaagcacaagccuaaguaugaccuguauugcggucggauuaguaacucuuuaucuagguguaaugguacaggcagauuccggauguguaauuaacuggaaaggaagagagcuuaaaugcggaagcgggaucuucguaacgaaugaaguacauacauggacagagcaauacaaauuccaggcagacagcccaaaacgauuaagugcugcuauaggaaaggccugggaagaaggcguuugcggaauaagaucagcaaccagauuagagaacaucauguggagacagauaagcaaugaacugaaccauauauuauuagagaacgacaugaaguucacugucguugucggggauguaguugguauuuuagcucaagguaagaaaaugauuagaccgcaaccuauggaacauaaauacagcuggaaaucuugggguaaggcuaagauaauaggagcugacguacaaaacacgacauuuauaauugaugggcccaauacucccgaauguccagaugaucaaagagcauggaauauaugggaaguugaagauuacggauucggaaucuucacuacaaauauaugguuaaaacuucgggacucauauacacaagugugugaccauagguuaaugagcgcugcgaucaaagauucaaaagcuguccaugcagacaugggauauuggauugaaucagagaaaaacgaaacauggaaacuagcccgcgcguccuucauagaaguaaaaacauguauuuggccaaagucacauacauuguggucaaauggaguguuggaaagcgagaugauaauacccaaaaucuauggaggacccauaagucaacauaacuaucgaccaggguacuucacacaaacagcagggccauggcauuugggaaaacuugaacuagauuucgauuuaugcgaagguacaacgguggucgucgaugagcauuguggaaacagaggcccgucuuuaaggacgacuacagugacugguaagaucauacacgaaugguguugccgaucauguacuuuaccuccguuaagauuuaaaggggaagacgguugcugguauggaauggaaauacgaccagucaaagagaaagaggaaaaccugguaaaaagcaugguuagugcagguuccggagaaguugacuccuucucucuuggguuacuaugcauaagcauaaugaucgaagaggucaugaggucccguuggucuagaaagaugcuuaugacaggcacuuuagccguauucuuucuccuaaucauggggcagcugacauggaacgaccuuauaagaucauguauuauggucggcgcaaacgcaagcgacagaauggguaugggcacaacguaucuugcccuuauggcuacauuuaagaugaggccuauguuugccguaggauuauuauucagaagauugaccucacgagaaguacuccuacugacaauagggcuaagucuaguugcaucaguagaguuaccuaacucacuugaggaacugggcgacggacuugcgauggguauaaugauauuaaaauuacuuacugauuuccaaagcuaucaacuuugggcaacuuuguuaagccuaacauuuauaaaaaccaccuucucacugcauuaugcuuggaaaaccauggccaugguccuaucuauaguuucgcuauuaccacugugcuugucaacgacaucucagaaaacaaccugguuaccgguacuccuaggaucacuaggcuguaaacccuuaacuauguuucuaauagcugaaaacaagauauggggaaggaaaucauggccacuaaacgaaggcaucauggcuguagggaucgugucuauucuccucagcaguuuauugaagaaugaugugccauuggcaggaccuuuaauugcaggcgguauguugauagcaugcuacgucauaucggguaguagcgcugaucuaucuuuagagaaagcggcagaagugagcugggaggaagaagcugaacauuccggagcaucucacaacaucuuaguagaaguucaagacgauggaacuaugaagauaaaggaugaagaaagagaugauacuuuaacaauucuuuugaaagcaacucuauuagcaguaagcggcguuuauccccuuagcauuccugccacauuauuuguaugguacuuuuggcagaagaagaaacaacgcagugguguguugugggauacgccaucaccacccgagguggaacgcgcuguauuagaugauggaauauaccggauaaugcagcgcgguuuacuuggacgaucacagguuggagugggugucuuucaagagaauguauuccacacaauguggcauguuacgcgcggggcaguacuaauguaucaaggaaaaagacuagaaccuaguugggcauccgugaagaaggauuuaaucaguuaugggggcggauggcgauuacaggggucuuggaacacaggagaggaaguucaaguaauugcuguagaaccaggcaaaaaccccaaaaauguucaaaccgcaccgggaaccuucaaaacaccggaaggugaagucggagcuaucgcccuugauuuuaagccuggaacgucaggcucgccaauaguaaaucgugaaggaaagauagucgggcuuuaugggaauggaguuguuacuacuucgggaacguauguaagugccauagcacaggccaaagcaucucaagaagguccccugcccgagaucgaagaugagguauuucgcaaaagaaaucuaaccauaauggaccuacauccgggaucugguaaaacucguagguaucuccccgcuauaguccgagaagcaaucaaacggaaacugcgaacauuaauucuggcaccgacuagaguaguugcaucugaaauggcggaagccuugaaaggaaugccaauccgguaccaaacgacggccgugaagagugagcacacuggcagagagauagucgaccuaaugugccaugcuaccuuuacuaugcggcuauuauccccuguaaggguacccaauuacaacaugaucaucauggaugaagcacauuuuacggacccaaguaguaucgccgcaagaggguauauaucaaccagggugggaaugggagaagcagccgcgaucuuuaugacugcgaccccgccagguagcguagaggcuuuuccgcaaaguaaugcgguaauucaagaugaagaacgagauauaccggagcgcagcuggaacucggguuaugaauggaucacugauuuucccgguaagacagugugguucguacccuccauaaaaucaggcaaugauauugccaacugccuccguaaaaauggaaaaagaguaauacaauuaucaagaaaaacuuuugauacagaauaucagaaaacgaaaaauaaugacugggauuauguugucaccacagacauaagugaaaugggugcaaacuuccgcgccgaccgaguaauugacccacguagaugucucaaaccugucauauugaaagaugggccagaacgcguaaucuuggcaggaccuaugccaguaacgguagcaagugccgcacaaagaaggggucgaauaggcagaaaucauaauaaagaaggugaccaauauaucuacaugggucaaccguuaaauaaugaugaagaucaugcacauuggacagaggcuaaaauguuguuggacaauauaaauacuccagaagguaucauuccagcguuauucgagccugaaagggaaaaaucagcagcaauagauggagaauaucgucuucgaggagaggcaaggaaaaccuucgucgaauugaugagaaggggagaccuaccuguguggcuuagcuauaagguagccucggaaggauuucaguauuccgauagaagaugguguuuugacggagaacgaaauaaucagguacucgaagaaaauauggacgucgaaauuuggacuaaggaaggcgaaaggaagaaauuacgcccacguuggcucgaugcgcgaacauacucggauccucuagcguuaagggaguucaaagaguuugccgcagggcgaagaagcgucucaggggauuuaauucuggagauuggaaaguuaccucaacaccucacgcagagagcgcaaaacgcacuagauaaucugguuaugcuacauaacucugaacaaggggguagggcauacagacaugcgauggaagaacuccccgacacaauagagacccuuaugcuucucgcucuuauagccguuuugacaggcggggucacuuuguuuuucuugucuggaaaaggucuaggaaaaaccucuauuggacuauuaugugugauggcaaguucagcucuauuguggauggcgucuguggaaccccauuggaucgcugcgucuauuauauuagaguucuuuuuaaugguacuacuaauuccggaacccgauagacaacguacuccgcaagauaaucaauuagcguauguagucauaggauuacucuucaugauccucacuguagccgcaaacgaaaugggccuccuugagaccacgaagaaagauuuaggcauaggacacguagcggucgaaaaucaucaucacgccacaaugcuggacguggaucuucauccugcaagcgccuggacucuauacgcuguagccacaacuaucauuacaccgaugaugcgacacaccauagaaaauacaacagcaaacauaaguuugaccgcaaucgcaaaucaagcggcaaucuuaaugggacuugauaaaggguggccaauaaguaaaauggacauuggaguuccacuucuugcucuggguuguuauucgcaagugaauccacuaacacuuacagccgccgugcuuauguuaguagcccauuaugcuauaauaggaccaggcuugcaagcuaaagccaccagagaagcccaaaagagaacagcggcugguauaaugaaaaacccaacugucgaugguaucguggcgaucgaucucgauccgguaguguaugaugcaaaauuugaaaaacaauuaggucaaauaaugcugcuaauauuauguacaucccaaauccuguuaaugagaacaacaugggcauuaugugaaucuauuacucuagcuacuggaccacuuacaacccuaugggaaggaucuccgggaaaauucuggaauacaaccauugccguaagcauggcuaacauauuuaggggaaguuaucuggccggugcggguuuagccuuuucauuaaugaaaucuuuggguggagguagaagagggaccggggcacaaggugagacuuuaggcgaaaaauggaagcggcaauuaaaucaacuauccaagagugaguuuaauacuuauaaacgauccggaauaauggaaguugacaggucagaagcuaaggaaggacuacgacgaggagaaacuaccaagcaugcaguaaguaggggaaccgcaaaauuacgaugguuuguugaaaggaaccuaguaaaacccgaaggaaaaguaaucgaccuaggaugugggagaggcggguggucauauuacugugcagggcucaagaaaguaacugaaguaaaggguuauacuaaaggugguccaggacaugaggaaccaauuccuauggcaaccuauggauggaauuuaguuaaauuacacagcggaaaagaugucuucuuuauaccgccagagaaaugugacacucuauugugcgauauaggagagucaagcccaaaucccacaauagaagaagguagaacauuacguguauugaaaaugguagaacccuggcuacgaggaaaucaguuuuguauaaagauccucaacccauauaugccaagcguaguagaaaccuuagaacagaugcagagaaaacauggggguaugcuagucaggaauccacuaagucgaaauaguacucacgagauguauugggugaguuguggaacagggaauauuguaucugcugucaacaugacaucaagaaugcuauugaaucgcuuuacuauggcucauagaaaaccaacauacgagcgcgauguagaccugggagcugguacgcgucaugucgcagucgagcccgaaguugcgaauuuagauaucauuggccaaagaauagagaacauuaaacaugagcauaaaagcacauggcacuacgaugaagacaaccccuacaaaacgugggccuaccauggaucuuacgaaguuaaaccaaguggcucagcaucaucuauggugaacggaguugucaaauuguugacuaaaccuugggauguaauaccgauggucacucaaauagcuaugacagauaccacgcccuucggacaacaaagaguguuuaaagagaaaguggauacccgcacgcccaaagcaaagagaggaacagcacaaauaauggaaguuacagcgagaugguuauggggguuucugucacguaacaagaaaccgaggauuuguacucgugaagaauuuacacguaaaguucgaucgaaugccgcaauaggugcaguuuuuguagaugaaaaucaauggaauagugccaaagaagcagucgaagaugaaagauucugggaucucgugcauagagaaagagaauuacacaaacaagguaaaugcgccaccuguguauauaauaugaugggaaagagggagaagaaacuuggugaguuuggaaaagcaaaaggaucucgggcaauuugguacauguggcucggagcaagauuuuuagaguuugaggcauuaggauuuaugaacgaagaucauugguucagcagggaaaauaguuuaucuggaguagaaggagaaggccuccauaaacuaggcuacauccuacgggacauuucuaaaauaccgggcggcaauauguaugcugacgauacagcgggcugggacacaaggauaacugaagacgauuuacagaacgaggcaaagauuacggacaucauggaaccagaacacgcccugcuugcgacaucaauuuucaaauuaacguaucaaaacaaaguuguaagaguacaacgacccgcacgcaauggcacaguaauggauguuauaaguagaagagaucaaagggggucuggacagguugguacauacggauuaaauacguucacaaacauggaagcgcagcucauuagacaaauggaaagugaaggaauauucucaccaagugaauuagaaacaccaaacuuagccgaacgagucuuagacuggcuagagaaacacggaguggagagauuaaagaggauggcaauaagcggagaugacuguguuguuaaaccuauugacgacagauuugcaaccgcguuaagugcuuuaaacgauaugggaaaaguaagaaaggacauuccacaaugggaaccgucaaaaggguggaaugauuggcagcaaguccccuucuguucccaccauuuccaccaauuaauaaugaaagacggcagagaaauuguuguaccaugucgcaaccaagaugaauuaguagguagagccagaguuagucagggggcuggcuggucuuugcgggaaacagcauguuuaggcaaaucuuaugcacagauguggcaacucauguacuuccaucgaagagaucuucgauuagccgcaaacgccauuugcuccgcgguuccuguugacugggugccaacaagcagaaccacauggucaauucaugcacaucaucaauggaugacaacugaggauauguuaagcguauggaacagaguguggauugaagaaaacccauggauggaagacaagacccauauaaguagcuggggagauguaccuuaccuagguaagcgugaggaucagugguguggcuccuuaaucgggcucaccgcgcgggccacuugggcaacgaauauacagguggcaauuaaccaaguuagaaggcuuauaggaaaugaaaacuaucucgauuacaugacuucaaugaaacgauuuaaaaaugaaucggacccugaaggcgcauugugguaa

SEQ ID NO: 21561 - RNA, 9879 nt, Artificial Sequence
  derived and/or modified CDS sequence (opt6) from DENV-1__FJ410222__SS-prME
uccguuacgauguuacuuaugcuaaugccuacugcauuagcauuucauuuaacgacucgugguggugaaccacauaugauuguaaguaaacaggaacgcggaaaaucacuauuguuuaaaacgucggcaggaguuaauauguguacuuuaauugcuauggacuuaggagaauuaugcgaagauacaaugacauacaaaugcccuaggauaacagaaaccgaaccagacgauguagacugcugguguaaugcaaccgauacauggguaacuuacgguacaugcucacagacaggggagcaccgcagagacaaacgcucuguugcacuggccccacacguaggauuagggcuagaaacuaggacagaaacuuggaugucauccgagggagcauggaaacaaauacaaaggguugaaacuugggcccuuaggcauccgggauuuacgguuauagcauuguuucuggcccaugcaauaggcacgucgaucacucagaagggaauaauauuuauccuauugaugcucguaaccccaaguauggcuaugcgaugcgucggaauaggaucgagggauuuuguagaagguuugucuggggcgacauggguugacguaguguuagagcauggcucuugcgucacaacuauggcaaaggacaaaccuacauuagauaucgagcuauugaaaacugaaguaacaaauccggcagucuugcgaaaauuauguaucgaagcaaaaauaucuaauacaacuacugauucucgauguccaacacaaggagaagcgacccuaguugaagaacaagaugcuaauuuugucugcaggagaacguuuguggaucggggguggggaaaugguugcgguuuauucggaaaagguucacugauaaccugugcaaaguuuaaauguguaacaaagcuagaggggaagauagugcaguacgaaaaccuaaaauauucugucauaguaacagugcacacaggagaccagcaucaaguagguaacgaaagcacagaacaugggacaacagcaacgauuacaccgcaagcgcccacaaccgagauccaacuaacagauuauggggcacucacacuagacuguuccccuaggacaggucuagacuucaaugaaaugguacuauuaacaaugaaagaaaaaucaugguuaguucauaagcaaugguuucuagaccugccuuuaccuuggacaagcggugcaagcacaagucaagaaacguggaacagacaggaccuauuagugacuuucaaaaccgcucaugcgaagaaacaagaagucguaguucuugguucccaagaaggagcuaugcauacugcgcugacuggggcaacagagauucaaacauccgguacuaccacaauuuucgcugggcacuugaaauguagguuaaaaauggacaaauuaacucuaaaggguaugucauauguaauguguacaggcaguuucaaacuugaaaaggaacuagcggaaacucaacaugggaccgucuuaguacagaucaaauaugaagggacagacgcgccaugcaaaaucccauuuaguacccaggaugaaaagggaguuacccaaaaugggagacuaaucaccgcaaauccaaucguuacagacaaagaaaaaccaguaaauaucgaagcggaaccaccauucggcgagucuuacaucguaauaggcgcaggagaaaaggcuuuaaaacuuagcugguucaagaaaggaucgaguauugguaaaauguucgaagcuacagcacggggagccaggcgaauggccauacugggugacacugcuugggacuuuggaucaauugguggugucuuuacuagcguaggaaaauugguucaucaaauuuuuggaacggcauauggaguucuuuuuaguggggugagcuggacgaugaaaauaggaaucggaguacuacuaacuuggcucgguuuaaacagccgauccacaaguuuaucaaugacauguauagccguaggucuaguuacguuguacuuaggcgugaugguucaagcugauucaggauguguaaucaauuggaaaggucgagaauuaaagugcggcucaggaaucuuuguuacaaaugaggugcauacuuggacagaacaguauaaauuucaagcagauucaccuaaacggcuauccgccgcaauagggaaagccugggaagaaggaguguguggcauucguucagcaacacgcuuagaaaacauaauguggaaacaaauaucgaacgaacuaaaucauauacuucuagaaaaugauaugaaauucacgguaguugucggagauguagcagggaucuuagcgcagggcaagaaaaugauacguccucaacccauggaauauaaguauaguuggaaaagcugggggaaggcaaaaauaaucggggcagauguacaaaacacaaccuuuaucauagacggaccgaacacacccgaaugcccggacgaccaaagagccuggaacauuugggaaguagaagauuacggcuuuggaauuuuuacaacaaacaucugguuaaaacuuagggauucguauacacaggucugcgaccacagauuaauguccgccgcuaucaaagacagcaaagcaguucacgcugauauggguuacuggauugaaucugaaaagaacgaaaccuggaaauuggcaagagccucuuuuauagaagugaaaacuuguauauggccaaaaucacauacgcucuggucgaacgguguuuuagaaucagagaugauaaucccaaaaaucuacggcggucccaucucucagcauaacuauaggccagguuauuuuacacagacagcuggaccauggcaucuaggaaaguuagaacuagacuuugauuuaugugaagggacuacaguuguaguggaugaacacugcggaaauagaggaccaucacuuaggacaacgaccguaaccggcaaaauuauccacgaaugguguugccgcagcugcacacuucccccauuaagauuucgaggggaagauggaugcugguaugguauggaaauaaggcccguuaaagaaaaagaagagaaccuaguuaaaaguaugguuucagccggaucgggugaaguagacucguucucuuugggacuguuauguaucucaauaaugauugaagaaguuaugaggucacguuggagcagaaaaauguugaugaccggaacacuagcaguauuuuuccuuuugauaaugggacagcucacuuggaaugaucuaauaagacugugcauaaugguaggugcaaaugcuucugaccgaaugggaaugggcacuacuuauuuggcauuaauggcaacauuuaaaaugagacccauguucgccguaggguuacuguuucguaggcuaacaucacgugagguccuauuguuaacaauaggcuuaucucuagucgcuucaguagagcugccuaauagucuugaagaacucggagaugguuuggcuauggguauaaugauacucaaauuacuuacagauuuucaaagucaucaauuaugggccacauuauuauccuuaacuuucauaaagacaacauuuucucugcacuacgcauggaaaacaauggcuaugguuuuaucaauagugucacuccuaccacuaugucuaucaacaaccucccagaaaaccacauggcuaccggucuugcuaggauccuugggcugcaaaccucuaacaauguuucucauagcagaaaauaaaauaugggguagaagaaguuggccauuaaacgaaggcauaauggccguuggaauaguaaguauacugcuaaguagucuacuaaagaaugacguuccucuugcaggaccauugauagcaggagguauguugaucgcauguuauguuauaucaggaaguagcgcggaucugagccuugaaaaagcagcagaaguaucaugggaagaggaagcagagcacucuggggccagucauaacauuuuaguugaaguacaagacgacggaaccaugaagauuaaagaugaagaacgugaugauacacuaacaauacuacuaaaagcaacuuuacucgccgucagugggguauacccccuaucaaucccagcgacuuuguuuguaugguauuuuuggcaaaagaagaaacaaagaagcgggguccuaugggacacccccaguccuccagaagucgagagagccguucuugacgauggaauauacaggauaaugcaaagaggcuuacuaggcagaucccaaguaggugugggugucuuucaagagaauguuuuccauacaauguggcauguaacucguggggcaguguuaauguaccaagggaaacgccuugagccuucuugggcauccguuaagaaagaccuaauaagcuaugggggaggcuggcgacuacaagggaguuggaacaccggugaagaaguacaagucauugcuguagaacccgggaaaaauccaaagaauguucagaccgccccaggaacauucaaaacaccagaaggagaagucggagcgaucgcacuagacuuuaagccugggaccucuggaaguccaauuguuaauagagaagguaaaaucguaggucuauacgguaacgguguugucacaacuucagguacauaugugagugcuauugcccaagcgaaagcaagucaagaaggccccuugccggaaauugaagacgagguauuuagaaaacgaaaccucacuauaauggaucuccacccgggcuccggaaaaacgcgucgauaccuccccgcaauaguacgugaagcgauuaaaaggaaguuaagaaccuuaauacuggcuccuaccagagucguggccucagaaauggcagaagcauuaaagggaaugcccauacgcuaucaaacaacagcuguaaaaucagaacauacuggcaaagaaauaguugacuugaugugucacgcaacauucacaaugcgacucuugucuccgguaagaguacccaacuacaauaugauaaucauggacgaagcccacuucacugacccaucuaguauagcugcccguggcuauauaucaacuaggguaggcaugggagaagcagcugcuauauuuaugacggcaacacccccuggcagcgucgaagcauucccgcaaucgaaugcggucauccaagaugaagaacgggauaucccugaaagaaguuggaacucaggcuacgaguggauuacagauuuuccugguaaaacuguaugguuuguuccaaguauuaaaucgggcaaugauauugcuaauugucuacgaaagaauggcaagcgugucauccagcuaaguaggaaaacauucgacacugaauaucaaaagacgaagaauaaugauugggauuacguaguaacaacggauauaucagagaugggcgcuaauuuucgagcggauagagucauugacccaagaaggugccuuaaaccaguaauuuugaaagauggcccagagagaguaauucuagcugguccaaugccugugacaguggcaagugcagcacaacgacgagggaggauaggacgaaaucauaauaaagaaggugaucaauauaucuauaugggucaaccauuaaauaacgacgaagaccacgcgcacuggacugaagcaaagauguuauuagacaauaucaauacaccagaaggaaucauucccgcccuguuugagccagaacgugaaaaaucggcagcaauugacggagaauacagauugagaggugaggccagaaagacguucguugaauuaaugagacguggcgaccuuccaguuuggcucagcuacaaaguggcaagcgaaggcuuccaauauagugauagacgaugguguuucgauggagaaagaaacaaccaaguuuuagaagaaaacauggacguagaaauauggacaaaagaaggcgaaagaaagaagcuaagaccgagaugguuagaugcuagaacuuauagcgacccacuagcucuuagagaauuuaaagaauuugcggcagguagaagaaguguaaguggcgacuuaauauuagaaaucgggaaguuaccacaacaccugacacaacgagcccaaaaugccuuagacaauuuagucaugcuacacaacuccgagcaagguggccgggcauaccgacacgcaauggaagaacuaccagacaccaucgagacgcuuaugcuguuagcucuaauugcuguccuaacaggagguguuacacucuucuucuuaagugguagaggacuaggaaagacuucaauuggucuucuuugugucauggcgucaagcgugcuacucuggauggccucuguggaaccucacuggauagccgcuaguauaauauuagaguucuuucuaaugguguuauugauucccgaaccggaucgccagagaacaccacaagauaaccaauuagcguaugugguaauuggacuuuuguucaugauacuaacaguagcagcuaacgagaugggauuacucgaaacuacgaagaaagaccuuggaauuggucauguggccguugagaaccaucaucaugcggcgaugcuugauguugacuuacacccggcguccgcauggacacuuuacgcuguagcaacuacaauaauuacaccuaugaugagacacacuauugagaacacuacagcaaauaucucauuaacagcuaucgcaaaccaggcagcaauuuuaaugggacuagauaagggcuggccgaucucgaagauggauauuggaguaccuuuauuagcacugggauguuacagccagguuaauccucuuacuuuaacugcagcagugcucaugcuagucgcccauuaugccaucauaggaccuggacuacaagcgaaggcgacccgugaggcgcagaaaaggacugcagcgggaaucaugaaaaacccaacugucgaugguauagucgccauugaccuagacccugugguuuaugaugcaaaauuugaaaaacaacuaggucaaaucaugcuauuaauacuuuguacaagucagauauuacuaaugagaacuacuugggccuuaugugagucgaucacucuggcuaccgggccacuaacaacacuaugggaagguuccccugggaaguuuuggaacaccacuauugccguaucaauggcaaauauauuccgagggagcuaccuagccggagccggccuugcguuuucucugaugaaauccuuggguggaggucggcggggcacaggagcccaaggcgaaacacucggagaaaaguggaaaaggcaacuaaaucagcugucaaaauccgaauuuaauacuuacaaaaggucugguauuauggaagucgacagaagugaggcuaaggaaggauuaaaaagaggggaaaccaccaaacacgcggugagcagggguacugccaaguugagaugguucguagaaaggaacuuaguaaaaccagaaggaaaaguaauagaucuaggauguggaagaggagguuggaguuacuacugcgcaggucuaaagaaagugacugaagucaaagguuauacaaaaggagguccuggacacgaagaacccauaccgauggcaacauacggauggaauuugguuaaauuacauucuggaaaagacguauucuuuaucccuccugaaaaaugugauacacucuuaugugacaucggugaauccuccccaaauccaacaaucgaggaggguaggacgcuacggguauugaaaaugguagaaccaugguuaagagggaaccaauuuuguauaaaaauacuuaacccguacaugccuucagucguagagacuuuagaacaaaugcaacgaaaacacggaggcaugcuuguucgcaauccauugaguaggaacaguacucaugagauguacuggguaagcuguggaacuggaaauauagucucugcaguuaauaugaccucgcgaaugcuacuuaaccgauuuacaauggcccacaggaaacccacauaugagagagaugucgaucuaggugcagguacuagacacguagcaguagaacccgagguggcuaacuuagacauaauaggacaaagaauugagaauauaaagcacgagcacaaaaguacuuggcauuaugacgaggauaauccguacaaaaccugggcauaccacgggucauacgaaguaaaacccuccgguucugcaagcuccauggugaauggaguagucaaacuucuaacaaaaccuugggauguaauaccgauggucacucaaauagcaaugacugauacuacuccuuuuggccaacaaaggguauucaaggaaaaaguagacacaagaacgccuaaagcuaagcgaggcacagcacaaauaauggaaguaacagcaaaauggcuauggggauuccuaagccggaauaaaaagccgcgaaucugcacgcgagaggaguucacgcgaaaaguccggucuaaugccgccaucggagcuguauucguggaugaaaaucaauggaacucugcaaaggaagcaguugaagaugagagauuuugggaccucguacauagagaaagggaacuucacaaacaaggaaagugugcuacauguguauauaacaugauggguaaaagagagaagaaauuaggagaguucgguaaagccaaagggaguagggcuauuugguauauguggcuaggugccagauuccucgaauuugaagcucuaggcuucaugaaugaagaccauugguucucgcgugaaaauucgcucucgggagucgaaggagaaggacuacacaaacuaggcuauauacugagagauauaaguaaaauaccaggugguaauauguaugccgacgacacagccgggugggauacccgcauuacugaagaugaucuacaaaaugaagcacgaaucacagacauuauggaacccgagcacgcucuauuagcaaagaguauuuuuaaauuaacuuaucaaaacaaaguuguacgaguucaaaggccugccaaaaauggcacgguuauggaugugauaucgagaagggaucagagaggcagcggacagguggggacauauggguuaaacaccuuuacuaacauggaggcgcaacuuauucgucaaauggaauccgaagguaucuuuucaccaagcgaauuagaaacaccuaaccuagcaaaaagaguacucgauuggcucgaaaaguauggaguggagagguuaaaaagaauggcuauaucuggcgaugauuguguuguaaaacccauagacgauagauuugccacggcuuuaacagcccuaaaugauauggguaagguacgaaaagacauuccacagugggaaccaucuaaaggauggaacgacuggcaacaagugccauucuguagucaucauuuucaccaacuaauaaugaaagacggacgagaaauuguuguccccugccgaaaucaagaugaacugguaggacgugcuagagugucacaaggcgcagguuggucacuaagagagacugcgugucuaggaaagagcuaugcacaaauguggcaacuuauguauuuucaccguagagauuuacgucuugcugccaacgcaauaugcucggcaguuccuguagacuggauaccaacaucacggaccacauggaguauccaugcucaucaucaauggaugacuacggaagacaugcuuuccguuuggaacaggguuuggaucgaggaaaauccauggauggaggauaaaacucacauaucuagcuggggagauguccccuacuugggcaaaagagaagaucaauggugcgggagcuuaauaggccuuacagcaagagcuacuugggcaacuaauauacaaguagcaauuaaccaaguuagacgucuaauaggaaacgagaauuaucucgauuauaugacaucgaugaaacgauucaagaaugaaagugaucccgaaggggcccuuugguag

SEQ ID NO: 21562 - RNA, 9879 nt, Artificial Sequence
  derived and/or modified CDS sequence (opt6) from DENV-1__FJ461319__SS-prME
ucuguuacgaugcuuuuaauguuaaugccgacugcauuagcuuuucaccuuacgacuagagggggagaaccacauauggucguaucaaaacaagaacgagguaaaucacuacucuuuaaaacuucagcuggaguaaauaugugcacucuuauagcgauggaccuuggagaacuaugugaagauacgaugaccuauaaaugcccacguauaacugaggcggaacccgacgacguugauuguugguguaaugcaacggauacauggguuaccuacggaacaugcucgcaaacuggugagcacagaagagacaaaagaaguguugcauuggcaccucaugugggacuuggucuagaaacccguacggagacauggauguccucagaaggagcauggaaacaaauucaacgcguagaaacgugggcauuaaggcacccaggauuuacugucaucgccuuauuucuggcgcacgcaauagggacuucaaucacucaaaaaggaauaauauuuauauuacuaauguuagucacuccgagcauggcaaugcguugcgucggaauaggaagucgagauuuugucgaaggacuaucuggagccacauggguugacgucguacucgaacacgggucauguguaacaacaauggcaaaagauaaaccgacccucgauauugagcuguugaaaaccgaaguaacuaaucccgcaauacuucguaaacugugcauagaggcaaaaaucucgaauaccaccacugauucgagaugcccaacucaaggcgaagccacgcuuguggaggaacaagaugcgaauuuuguguguaggaggaccuucgucgaccgggguuggggaaacgguuguggcuuauucgggaaagggucacuaauuaccugugcuaaauucaaaugcguaacgaaacucgaagguaaaauaguacaguacgaaaaucucaaauacucgguaaucgucacagugcauacaggcgaucaacaccaaguuggaaacgaaucuacggaacauggaacaacggcgacuauuacuccgcaggcuccuacaacugaaauacaauuaacggauuauggggcucuaacauuggauugcagcccaaggacaggucuugauuuuaaugaaaugguccucuuaaccaugaaagaaaagucguggcuuguacacaaacagugguuucuugaccuaccacuucccuggaccucgggcgccucaaccagucaagaaacauggaaucgacaagauuuguuagucacuuucaaaacugcacacgccaagaaacaggaagugguaguucuagggagucaggaaggcgcuaugcauacugccuuaacaggagcgaccgaaauacaaacaucaggaacuacaaccauauucgcaggucauuuaaaaugucgccuaaaaauggauaaguugacacuaaaggggaugucuuaugugauguguacagguucauuuaaacuagaaaaagaaguugcagagacucaacauggaacgguuuuagugcaaaucaaguacgaaggaacagacgcacccuguaaaauuccguuuaguacacaagaugagaaagggguaacacaaaauggaagguuaauuaccgcaaacccuaucgucacagacaaagaaaagccugucaauauugaggccgaaccaccuuuuggggaaagcuacauugucauuggugcaggcgaaaaagcauuaaaacuauccugguuuaaaaagggaaguuccauuggaaaaauguucgaagccacugcuagaggugcaagacgaauggcaauacucggagauacagcuugggacuucggaucaaucgguggagucuuuacaaguguggguaaacucgugcaccaaauauuuggaaccgcauauggcguacuuuuuagcggaguaagcuggaccaugaagauaggccuggguguacuacucacauggcuuggacucaauucgcgauccacaucauuaagcaugacuugcaucgcaguaggccuaguaacuuuauaucuuggaguaaugguacaagcugauucaggauguguuaucaauuggaaaggacgugaacuaaaauguggcuccggaauauucguuacaaacgaaguacacacauggacagagcaauauaaauuucaagcggacucaccaaaaagacucucugcagcaauaggaaaagcaugggaagaaggaguauguggaauaaggucagcaacuagguuagagaauguuauguggaaacagauaagcaacgaacuaaaucacauucucuuggaaaacgauaugaaguuuacggucguggugggugauguagcaggaauacuagcucagggcaagaaaaugaucagaccacaacccauggaacauaaauauucguggaagucaugggggaaagcaaaaauuaucggugcugaugugcaaaacacaacguucaucauagaugguccuaauacuccagagugcccggaugaccaacgcgcuuggaacauaugggagguagaggauuacggguucggaauuuuuacuacgaauauauggcugaaacucagagacucauacacacaagucugcgaucauaggcuaaugucagcagccauuaaagauucuaaggcuguccaugcagauauggguuacuggauagaaagcgagaaaaaugagacauggaaguuggcaagagcuucauuuauagaggugaagaccuguaucuggccgaagucgcauacccuauggucaaauggagugcucgaaagcgaaaugauaaucccaaaaaucuacgggggaccaaucucgcaacauaacuacagaccggguuacuuuacacagaccgcaggaccauggcauuuggggaaauuagagcuugauuuugauuugugugagggaacaaccgucguugucgaugagcauugcggcaacagggguccaucguugagaacuacuacgguuacaggaaaaauuauacacgaauggugcugccgaaguugcacauugcccccguugagguuucguggagaagaugguuguugguauggaauggaaauaagaccaguaaaagaaaaggaagaaaaucuagucaagucuaugguaucugcgggcucaggugaaguagacucauuuucucucggacuauuaugcaucaguaucaugauugaagaaguaaugaggucacguuggagucgaaaaauguuaaugaccgguaccuuagcuguauucuuauuacuuauaaugggucaacuuacauggaacgauuuaauacgauuguguaucaugguaggugccaacgcaucggaccguaugggaaugggaacaacauacuuggcguugauggccacuuuuaaaaugagaccgauguucgcaguaggacuucuuuuucgaagacuaacaucgcgcgaaguauuauuacugaccaucggacuaagccuaguggcgucaguagaacuuccaaauagucuagaagaacuaggcgauggccuagcgaugggaauaaugauucuaaaacucuuaacggauuuucagagccaccaguugugggcuacucuauuaucauugacauuuauaaaaacuacguuuagucuucacuacgcauggaagacuauggccauggucuuaaguauagugucacuauucccauuaugcuuaaguaccacaagucagaaaacuacaugguugccgguacuauugggcucauuagguugcaaacccuugacuauguuccucauugcagaaaacaaaauuugggggcguagaucuuggccucuuaaugaagguauaauggcaguuggaaucguaaguauauuauuaucuucauuacucaaaaacgacguaccccuagcuggaccauugauugcaggagguaugcuuaucgcgugcuacguuauaaguggaucaagcgcagaucugucauuagaaaaagcugcugagguaucaugggaagaggaggcagaacauucuggcgcuucucauaauauacucguugaaguacaagacgaugguacaaugaaaaucaaagaugaggaacgugaugauacguugacaauauuacugaaagcuacacuucuagcagucucgggugucuauccacuuuccauaccugcuacacuauucgugugguauuuuuggcaaaagaagaaacaacguagugguguacugugggacaccccuucaccgccagaaguugaacgagcaguacuagaugauggaauuuaucgaauuaugcagaggggucugcuuggccgaagccagguaggagucggaguguuccaggagaaugucuuucacaccauguggcauguuacaagaggagcuguccuaauguaucaaggaaaaagacuagagccguccugggcgagcgucaagaaagaucuaaucuccuacggcggaggguggcgccuccaaggaaguuggaauacgggagaagaaguacaagugauagcgguagaacccgggaaaaaucccaaaaacguacaaaccgcaccgggaaccuuuaaaaccccggaaggagaagucggugcuaucgcauuagacuuuaaaccuggaacaucugguucuccaaucgugaauagggagggcaaaauuguaggauuauauggcaacggcguggugacuacaucgggaacguaugucagcgcaauagcucaagcaaaagcaucacaagaaggcccacuaccugaaauagaagaugaaguauucagaaaaagaaauuuaaccauaauggaccugcauccggguucaggaaaaacaagacguuacuugccugcaauaguacgagaggcaauaaaaagaaagcuaagaacauugauacuggcaccuacgaggguaguagccucagagauggcagaagcauuaaaagguaugccuaucagguaucagacuacagcaguaaagucugagcacacuggaaaggagauaguugaccucaugugucaugcaacauuuacaaugagauuacugucccccguacgagucccuaauuauaauaugauaauaauggaugaagcucauuucaccgaccccucaucaauugcugcaagaggguauauaagcaccagagugggaaugggcgaggcagcagcuauauuuaugacagcaacgccgccuggaagugucgaggccuuuccacaaagcaaugccgucauucaagacgaagaaagagauauuccggaaagaucguggaauaguggcuaugaauggauuacugauuuccccgguaaaacagugugguucgugcccaguauuaagagcggaaacgauauagcuaacugccuucguaagaaugguaaaagagucauacagcuaucaagaaaaacauuugacacagaguaucagaaaaccaaaaauaaugauugggacuauguaguaacgacggacauaagcgaaaugggagccaauuuuagggcagaucgaguaauagauccucgaagauguuuaaaaccaguaauucugaaagacggaccagaaagaguuauuuuagccgguccaaugcccguaaccguagccagcgccgcccagcggcgaggccgaaucgggcguaaucacaauaaagagggcgaucaauauauuuauaugggucagccgcucaauaaugaugaagaccacgcucacuggacugaagcuaagauguuauuggauaacaucaauacuccugagggaauaauuccagcacuauuugagccugaacgugaaaaaucagcagcaaucgacggagaauaccgacuacggggagaagcccgaaaaacuuuugucgaauuaaugcgccgaggagauuuaccagucuggcuuucauauaaaguagcuagcgaaggauuccaauauucggauagaagguggugcuuugauggugaacguaacaaucagguauuagaggaaaauauggacguagaaaucuggacaaaagagggugagcguaaaaaguuacgcccaagauggcuagacgcacgcacguauucagauccacuugcacugagagaguuuaaagaguucgcagcuggaaggagaagcguuaguggagauuuaauacucgagauaggaaaacuaccacagcaucugacgcaacgugcucaaaaugcauuagacaaccugguuaugcuacacaacagcgaacaagguggccgcgcauauaggcacgcaauggaagaacuacccgacacaauagaaacauuaaugcuucuggcgcuaauugccgucuuaacaggggguguaacguuauucuuucucagcggccgugggcuagggaagaccagcauagguuuguuaugcguuauggcaucaucaguauuauuauggauggccagcguggagccacauuggauagcugcuucgaucauauuggaguucuuuuuaaugguccuauugauuccugaaccugauagacaaagaacaccucaggauaaccaacuagcuuacguaguuauagguuugcuguucaugauuuuaacaguagccgccaaugaaaugggguuacuggaaaccacaaagaaagacuuaggaauugggcaugccgcaguagggaaucaucaucaugcggcaauguuagauguggauuuacauccagccucagcauggacacuuuacgccguagcaaccaccauuauaacaccaaugaugaggcacacaaucgaaaacacgacugcuaauaucagcuuaacggccauagccaaucaagcggcaauucugaugggucuagauaaaggguggccaaucagcaaaauggacaucggaguaccacuucuugcucuaggaugcuacagucaaguuaacccucuuacauuaacugcugcaguccugaugcuuguagcacacuaugcgauaauagggccgggacuacaggcaaaagccacuagagaagcccagaagcgcacugccgccggaauuaugaaaaauccaacagucgacggaaucguggcaauugacuuagaucccguaguauaugacgcuaaauucgaaaagcagcucggucaaauaauguuauuaaucuuauguacaucacagaucuuacucaugcgaacaacaugggcguuaugugaaagcaucacccuugcugccggaccccugacaacgcuaugggaaggcucaccgggaaaauuuuggaacacaacuauagccgugagcauggcgaacaucuucaggggcucauaucuagcaggcgcgggacuagcauucucguuaaugaaaucacuuggaggcggacgacgagguacaggugcgcagggugaaacacuaggagaaaaauggaaacgacaauugaaucaacugaguaaaucagaauuuaacacauacaaaagaagcgguauaauggaaguggacagaagugaagcgaaagagggucugaagagaggagaaacaaccaaacaugcuguauccagggguacagccaaacugcgcugguuuguugagcguaaccuggucaaaccagaggggaaagugauugaccugggaugugguagaggagguuggucuuauuacugugcaggacuaaagaaaguaacagaaguuaaaggguacacaaagggagggccuggacaugaagaaccaauuccaauggcaacuuauggcuggaauuuagugaaguuacacaguggcaaagauguguucuuuauuccaccugagaaaugugacacacuacuuugcgauauuggagaaaguaguccgaauccaacuauagaagaagggcgaacacuaaggguacucaaaaugguagagccaugguuacguggcaaccaguucugcauuaaaauuuugaauccguacaugccaaguguuguugaaacccuugaacaaaugcaaaggaaacacggcggcaugcuuguaaggaacccuuuaucgcgcaacagcacccacgaaauguauuggguauccugcggcacaggaaauauaguaagcgcaguuaauaugacuucaaggauguuauuaaaccgauuuaccauggcacaucguaaaccuacauaugaaagagauguugaccuaggagcugggacuaggcaugucgccguagaaccagagguagcuaaucucgauauaauaggacaacguauagaaaauaucaaacaugaacauaaaucaacuuggcacuacgacgaggacaauccauauaaaacaugggcauaccauggaucuuaugaagugaaaccaucugguucugcaaguaguaugguaaaugggguagucaaauugcuuaccaagccaugggauguaauaccaaugguuacccaaauagcaaugaccgauacgacuccauucgggcaacaaaggguauucaaagaaaaaguggauacacguacacccaaagcgaaaagaggaacagcacagauaauggagguuaccgcuaaguggcuguggggguuucuaagccgaaacaaaaagccuaggauaugcacuagagaggaauuuacaaggaaagugcguucuaaugcagccauuggcgcgguauuuguagacgagaaucaauggaacucggcaaaggaagccguugaggaugagagauuuugggacuuaguacacagagagagagaacugcauaaacagggaaaaugugcuaccuguguguacaauaugaugggaaaaagggaaaagaaacuuggggaauuugguaaagcaaagggcaguagggcaauaugguacauguggcuaggugcacgcuuccuagaauuugaagcacuuggguuuaugaacgaagaccacugguuuaguagagaaaauucucuuucugguguggaaggugaaggccuucacaagcuaggguauauucuaagagauaucucaaaaauaccaggugguaauauguacgccgaugauacggccgggugggauacacggauaacagaagacgaccuucaaaaugaagccagaauaacagacauaauggaaccggaacaugcuuuguuggccaaaucgauauuuaagcuaacuuaucaaaacaaaguaguacgaguacaacguccagccaaaaaugguacuguaauggauguaauaucuaggagagaccaaagggguagcgggcaaguaggaacauaugggcuaaauacuuuuacuaacauggaagcgcaauugauaagacagauggagucugaggggauauuuuccccuagugaacuugaaacucccaacuuggcugaaagaguauuggacugguuggagaaauaugggguugagcgauuaaagcggauggcuauauccggagaugacuguguaguaaagccgauugaugauagauucgcgaccgcacuuaccgcauugaaugauaugggaaagguucgaaaagauaucccacaaugggaacccucuaaaggcuggaaugauuggcagcaagugccguuuugcagucaucauuuucaccaauuaaucaugaaagauggaagagaaauaguagucccuuguaggaaccaagaugaauuagugggucgagcaaggguuagucaaggagcaggcugguccuugagagaaacagcauguuuaggaaaaucauaugcccaaauguggcaacuaauguauuuccaccggcgcgaucuuagauuggcugcaaacgcaauauguucagcgguuccaguagacuggauaccaacaucuagaacaacuuggucaauucaugcacaucaccaguggaugacuacugaagacauguuaucaguuuggaaucgagucuggauagaagagaauccuuggauggaggauaagacacacauuucguccuggggagacguaccauaucuaggaaaaagagaagaucaaugguguggaucucuuauuggauuaacagcccgcgcaaccugggcuacaaacguacaaguagcaaucaaucaaguacggagacuaauaggcaaugagaauuaccuagacuauaugacuagcaugaagcgcuucaaaaacgaaucagaccccgaaggagcacuaugguga

SEQ ID NO: 21563 - RNA, 9879 nt, Artificial Sequence
  derived and/or modified CDS sequence (opt6) from DENV-1__FJ461320__SS-prME
aguguaaccaugcugcugauguuaaugccaaccgcgcuagcuuuccacuugacaacucgaggaggugaaccucauaugauaguuacaaaacaagaacgcggaaaaucccuauuguucaaaacaagcgccgguguuaacauguguacauuaauagcgauggacuuaggcgaauuaugcgaggauaccaugaccuacaaauguccucgcauaacagaagcagaaccagaugauguugauuguuggugcaacgccaccgauacauggguuacuuaugguacguguagucaaacaggagaacacagacgugacaaaaggucuguggcacuagccccucauguagggcuagguuuggaaacaagaaccgagaccuggauguccagcgaaggagcauggaaacaaauacaacggguugaaacgugggcauuacgucauccaggauucacaguaauagcgcuauuccuagcacaugcaauaggaacaagcauaacucaaaaagguauuauauuuauacuacugaugcuagucacaccuaguauggcuaugcgcuguguaggcauaggcuccagagauuuugucgaagguuuauccggagccacguggguugauguagucuuagaacaugguagcugcgucacaacgauggcuaaagauaaaccaacccucgacauagaguuauuaaaaacagagguuacaaaccccgcgguauuaaggaaauuaugcauagaagcaaaaauaucaaauacuacaacagacucaaggugcccaacccaaggugaagcuacguugauggaagaacaggaugcaaacuucguaugucgaaggaccuuuguagauaggggcuggggaaauggcuguggcuuauucgguaaaggcucucuaauaacuugcgccaaauuuaaauguguaacaaaacucgaggguaaaauaguacaauaugaaaauuuaaaauauucuguaauugugacaguacauacaggugaucaacaucaggugggcaaugagaguaccgaacacggcaccacagcaacuauaacuccccaggcaccaacuagcgaaauccaacuaaccgacuauggagcauugacuuuagauugcucaccccguacaggccucgacuuuaaugaaaugguacuuuuaaccaugaaagagaaaucuuggcuugugcauaaacaaugguuucuagaccuaccucugccuuggacaaguggcgcgaguaccucacaggagacguggaacaggcaagaucucuuagugacguucaaaacagcccaugcuaagaaacaagaggugguagucuuagguagucaagaaggagcgaugcauacagcgcuaacuggugcaaccgaaauucagaccagugggaccacaacgauuuuugcuggccaucuuaaauguagacuuaaaauggauaaacuuacauuaaaggguaugucguacguuauguguacagguucauuuaaguuggaaaaggagguagccgaaacucagcauggaacaguacuuguacagauaaaauaugaaggcacugacgccccauguaaaaucccauucagcacgcaagaugaaaaaggaguaacccaaaaugggcgauuaaucacugcuaauccuauugugaccgacaaagagaaaccgguuaauauagaggcugagcccccuuuuggcgaaucauauauagucauaggagcuggggaaaaagcguuaaaauuaucaugguucaagaaagggucaagcauugggaaaauguucgaggcaacagcuagaggcgcuagaagaauggccauauuaggugauacugcgugggacuuugggaguguuggaggagucuucacaucuguaggcaaauuaguacaucaaaucuuuggaacggcuuauggcgucuuauuuagugguguaaguuggaccaugaaaauuggaauagguguucuauugaccugguuggggcucaacucacgaagcacuucacuaucuaugaccuguauugccgucggauugguaaccuuauaccugggcgugaugguucaagcugauucugggugugugauuaauuggaagggccgugagcuaaaaugugggucuggaauauuugucacaaacgagguacacaccuggacugaacaauacaaauuucaagccgacucuccuaaaagauuaucugcagccauaggcaaagcaugggaagaagguguuuguggcauaagaucagcgacacgucucgaaaauauaauguggaaacagauuagcaaugaguuaaaccauauccuguuagaaaaugauaugaaauuuaccguuguagugggugauguaguugggauucuugcacaagggaagaaaaugauaagaccccaaccgauggaacauaaguauucuuggaaaaguugggguaaagcaaaaauuauuggagcggacguucaaaacacgacauuuauaauugaugguccaaacacacccgagugccccgacgaucaaagagcauggaauauuugggagguugaagauuauggauuuggcauauuuacuacgaacauauggcuaaaacugcgugacucauacacacaggugugcgaccaccggcuaaugucggccgcuauaaaggauaguaaggcaguacaugcggauaugggauacuggauagaauccgagaaaaaugagaccuggaaacuugcaagagcuagcuucauugaaguaaaaacuuguauauggccuaaaucucauaccuuauggucuaauggaguacuagaaagugaaaugaucauaccaaagauauacggcgguccgauuucccaacacaauuaccggccuggauauuuuacacaaacagccggaccauggcacuugggaaaauuagaguuagauuuugaucuaugugaaggcacgacuguuguagucgacgaacauugcggcaauagaggaccuucccuacguacgacuacgguaacuggcaaaauuauacaugaauggugcugcagaaguugcacucuuccaccucuacgauucaaaggagaagaugguugcugguaugguauggaaauuagaccagugaaagaaaaagaagaaaacuuaguaaaaaguaugguaucagcagguuccggcgaaguagauucauuuucauuaggcuuauugugcauuucaauuaugguggaagaaguuaugcgaucacgcuggaguagaaaaauguuaaugacggggacgcuugccguauuucuauuacuuauuaugggucaacuaacauggaaugacuuaauaaggcuauguauaaugguuggagcaaaugcgagugaccgaaugggaauggguacgacuuacuuagcacugauggcuacauuuaaaauccgaccuauguuugcuguugguuuauuauuccguagauuaacuucaagagagguacucuugcuuacaauaggauuaucauuaguugcaucuguagaacuaccaaauagcuuagaagaacucggggacgguuuagcuaugggcauaaugauucuaaaauuacugacagauuuccaaucgcaucaauuaugggcuaccuuacuaucacuaaccuucauaaaaaccacauuaucuuuacauuaugcauggaaaacuauggcaaugguauuaucuauugucaguuuguuuccccuaugcuuaagcaccaccucccagaaaacaacuugguuacccguuuuacuagggagccucgguugcaaaccacuaacuauguuccuaauaacagaaaacaaaauauggggaagaaaauccuggccguugaacgaggguauaauggcugucggcgucguuaguauucuccuauccucguuacuaaagaacgauguuccacuagcggguccacuaauagcuggagggaugcuaauagccugcuauguaauuuccgggagcagcgcggauuuaucucuagagaaagcagcagagguaucaugggaagaagaggcggaacauucuggagccagucauaacauucuaguugaaguccaggaugauggaacuaugaaaauuaaagacgaagagagagaugacacacucacaaucuugcugaaggcgaccuuacuugccguuucaggaguuuauccucuguccauuccagccacauuauuuguuugguauuuuuggcaaaagaagaaacaacguucaggaguacuuugggauacgccuuccccuccggagguugaaagagcaguacuugacgacgguaucuacaggauaaugcagcgaggacuauuaggacgaagucaagucggaguaggcgucuuucaagaaaauguauuucauaccauguggcacguuacuagaggugcuguauuaauguaucaagguaaacgccuagaaccuuccugggcgucaguaaagaaggaccucauauccuacggaggggguuggaggcugcaaggauccuggaauacaggagaggaaguacaagucaucgccguugaaccagguaagaacccaaagaauguucaaaccgcgccggggacauuuaagaccccggaaggugaaguuggggcuaucgcauuggacuuuaagccuggaacgucgggaucgccuauuguaaaucgagaagggaaaauaguugguuuauacggcaacggagucguaacgacuucggggacauacguaagcgcuaucgcacaagcuaaagcaucacaggagggaccgcuaccagaaaucgaggaugaggucuuuagaaagcguaaccucaccaucauggaucuucacccugguaguggcaagacacgacgguaccuaccagcgauugucagagaggccaucaaacgcaaacuuagaacccugauccuggccccaacgagagucguagcaagugaaauggcugaagcucuaaaaggcaugccaauucguuaucaaacgacagccguaaaaucggaacacaccggaaaggaaauuguagaucugaugugucaugcuacauucacgaugagacuauugucgccaguaagaguaccaaauuauaauaugauaauuauggacgaagcacacuuuacagacccaucuucgauagcugcaagaggauauauaagcaccagagucggaaugggagaagcagcagcuauauuuaugacagcaaccccgcccggaaguguugaagcguuuccacaaaguaacgcggucauccaagacgaagaacgugauaucccagaaaggaguuggaauagcgguuaugaguggauaacugauuucccuggaaaaacaguuugguuuguuccaucaauaaaaucagggaaugauauagcaaauuguuuaaggaaaaauggaaaaaggguaauacaacuaucgaggaaaaccuuugacacugaauaucagaaaacaaagaauaaugacugggacuauguaguuacuacagauauaucagagaugggugcuaacuucagagcagaucgaguaauugacccgagacguugccugaaaccagugauacuuaaggacgguccagaaagaguuauacuagcagggccaaugcccguaacaguagccagugcagcucaacggagaggaagaauaggaagaaaucauaauaaagaaggugaucaauauauuuacaugggccaacccuugaacaacgaugaagaucacgcucacuggaccgaagcaaaaaugcuauuagauaacauaaauaccccugaggguauaaucccugcccuauuugagccugaaagggaaaagagugcagcaauagacggagaguaucgauuaagaggggaggcgcgaaagacauuuguagaacuuaugcgacgaggggauuuaccagugugguuaaguuacaaagucgcaagcgaggguuuccaguauuccgaucgacguugguguuucgauggagaaagaaauaaucaaguauuggaagagaacauggaugucgaaauauggacuaaggaaggagaaagaaagaaauugagacccaggugguuagacgcacggacguauucagacccauuagcauuacgagaguucaaagaauuugcagcagggcgaagaucaguaucaggagaucugauacuagaaauaggaaagcucccacaacacuugacacaacgcgcccaaaaugcauuagauaaucuagucaugcuucauaacucugagcaagguggacgggccuauaggcaugcaauggaagaacucccugacaccauagaaacacucaugcuauuggcauuaauugcaguauuaaccggcggaguaacccuauuuuuccucucaggacguggacuugggaagacgucaauaggucuauugugcgucauggcauccagcguuuuauuauggauggcaucagucgagccacacuggauugcugccucaauaauucuugaguucuuucuuauggugcuccuaauaccggaaccugacaggcaacgaacgccucaagauaaccaguuagccuacguuguuauaggacucuuauucaugauacuuacaguugcggcaaaugaaaugggacuccucgaaacuacaaagaaagaucuaggaauaggacauguagcagucgaaaaucaucaucacgcuaccaugcucgacgucgaucugcauccugcuagcgccuggacccuauacgcuguugcuacaacaauaauaacaccaaugaugaggcacacuauagaaaauaccacagcaaacaucagucuaaccgcgauugccaaccaagcagcaauauugaugggacuagacaaagguuggccuauuucaaaaauggacauagggguuccacuacuugcauuaggauguuauucacaaguuaauccacucacucuuacagcggcuguuuuaaugcucguagcucauuaugcgaucauaggccccggauuacaagcuaaagcgacucgcgaagcucagaaaagaacagcugcaggaauaaugaaaaacccuaccguugaugguauaguugcaaucgauuuagauccaguuguauaugacgcgaaauucgagaaacaacuaggccaaauaauguuauuaauucucugcaccucucaaauauuauugaugagaacaacgugggcccucugcgagaguauaacgcuagccacugggccacuuacaacccuaugggaagguucaccgggaaaguuuuggaacacaacuauugcaguuaguauggcuaacauauuccguggaucuuaccuagcuggcgccggacuugcauucucccugaugaaaucucuagggggcggucguagaggaacaggagcucagggcgagacuuuaggagaaaaauggaaacggcaacucaaccaacuaucaaaaagcgaauuuaacauuuacaagcgcagugguauaauggaggucgaccgaucggaagcaaaagaaggacuuaaacgaggcgaaacaacacgccacgcaguuagcagagguacugcuaaacugaggugguuuguggaaagaaauuuaguuaaaccagaagggaagguuauugacuugggauguggacgggguggguggucuuauuauugcgccgggcucaagaaaguaacagaaguuaaaggauauaccaaaggaggaccaggacaugaagaacccauaccuauggcuacguaugguuggaauuuaguaaaacuucacuccgguaaagauguauuuuucacaccgccugagaaaugcgacacacuacuuugugauaucggcgagucuaguccaaauccaaccauagaagagggacggacucugcggguucuaaaaaugguugagcccugguugagaggaaaucaguucugcaucaagauuuugaauccguacaugccuagugugguagagaccuuagagcaaaugcagaggaagcacggugggaugcuaguucggaacccacuaucaagaaacucuacacaugaaauguacuggguuucauguggaaccgguaauauuguaagcgcagugaacaugacaucccggauguugcucaauagguuuacuauggcucacagaaaacccacauacgaacgagauguggaccugggugccggaacuagacauguagcggucgaaccugaaguagcaaaucuagacauuauaggacagcgaauugagaauaucaaacaugagcauaaaaguacauggcauuaugaugaagauaacccguauaaaacaugggcuuaucacggaucauacgaagucaaaccauccggaagugcaagcagcaugguaaauggaguagucaaacuccugacaaaacccugggauguuauaccuaugguaacgcagauagccaugaccgauacaacaccauucggacaacaaagaguuuucaaggagaaagucgacacucgaacacccaaagcaaagcguggaacggcgcaaauaauggaaguuacggcacgauggcuauggggauuccucagucguaauaagaagccuagaauauguacuagggaggaauuuacacgaaagguaagaucuaacgcagcgauuggagcaguauucguagaugaaaaccaguggaacucggcaaaagaagcgguugaagaugaacgauucugggaucuggugcaaaaagaaagggaacuccauaaacaagguaaaugcgcuacaugcguauauaacaugaugggaaaaagagagaagaaauuaggagaguucggaaaagccaaaggaaguagggcaauuugguacauguggcuuggagcacgauuucuugaguuugaagcgcuaggguucaugaacgaagaucacugguucagcagagaaaauucucucucggguguagaaggugaaggacuacauaaauuggguuauauacuacgagacauuucuaaaauaccgggaggcaauauguaugcagacgauacagcaggcugggauacuagaauaacagaagacgauuuacaaaaugaggccaaaauuacagacauuauggaaccagagcacgcacuucuugccacgucgauauucaaauuaacauaucaaaacaaaguagugaggguacaaagaccggcuaaaaaugguacgguaauggauguuaucucucggagagaccaacgcgguucggggcaaguaggcacguaugggcuaaacacuuuuacaaauauggaggcccaauugauaagacaaauggaaucugaaggaauauuccuaccaucggaacuagaaacaccuaauuuagccgaacguguucuggauugguuagaaaaauauggaguagaacgacuaaagcgcauggcaauuucuggagaugacuguguagugaaaccaauugaugauagguucgcaacugcacuaacugcacuaaaugacaugggaaagguaagaaaagacauuccgcaaugggagccaaguaaaggcuggaaugauuggcaacaaguucccuuuugcucccaucauuuucaucaacugaucaugaaagauggucgugaaaucguugucccgugcagaaaucaagacgaauuggucggucgugcacgaguuagccaaggugcuggauggucccuuagagagacagcgugccuuggaaaaucauacgcgcaaauguggcaacugauguacuuucaccgucgagaucuacgccuugcagcuaaugccauauguagugccgugccagucgacuggguucccacaucucguacaacauggagcauucacgcccaccaucaauggaugaccacugaggacauguuaucgguauggaacagaguuuggauagaagaaaauccauggauggaagauaaaacucaugugagcaguuggggcgauguaccuuacuuagguaaaagggaagaucaauggugcggcucccucauaggguuaacggcaagggcaaccugggcaucuaacauucaaguagccauaaaccaaguccguaggcuuaucggcaacgaaaauuauuuggacuauaugacaucgaugaaacguuuuaaaaacgaaggcgacccagaaggagcuuuaugguaa

SEQ ID NO: 21564 - RNA, 9879 nt, Artificial Sequence
  derived and/or modified CDS sequence (opt6) from DENV-1__FJ410225__SS-prME
ucaguuacaaugcuguuaaugcuaaugccgacugcuuuagcauuccacuugacaacaagaggaggggaaccccauaugauaguaucaaaacaagaaagagggaaaucacugcuauucaaaacaucagcggguguuaauaugugcacauuaaucgcgauggaucuuggggaacuaugugaagacacaaugacguacaaaugccccagaauaacugaaacugaaccagacgauguagauuguugguguaaugcuacagacacguggguaaccuaugguacuuguucgcaaaccggggaacauagacgcgacaaacgaaguguagcucuggcaccgcauguagguuuaggguuagaaacaagaaccgaaaccuggaugucuagcgaaggagcguggaaacaaauacaaagaguggagacaugggcacuucgucauccagguuuuacaguuaucgcgcuauucuuagcacaugccauaggaacgucgauuacccaaaaagguauuauauucauauuguuaaugcuagugacuccuucaauggcuaugagaugcguaggaauagguucacgcgacuucguggaaggacucucaggagccacaugggucgauguaguucuagagcacggcuccugugugacaacuauggcaaaagauaaaccuacacuugacauugaauuauuaaaaacagaaguaacgaacccugcgguacuucgaaaacuuugcauagaagcaaaaauaucuaacacaacgacggauagucguuguccgacucaaggcgaagcgacccuaguagaggaacaagaugccaauuuuguauguagaagaacauuuguugauagaggcuggggcaauggcuguggccuauuuggaaaaggaucauuaauaacaugcgcaaaauuuaaaugcguaacgaaauuagaagguaaaauuguacaauaugagaauuuaaaauauaguguaauaguaaccguucacaccggagaccaacaccaagucgguaaugaaucaacagaacacggcaccaccgcaacgaucacgccgcaagccccuacaacugagauacaauuaacagauuacggugcgcuaacauuagacugcucuccaaggacuggccuagauuuuaaugaaaugguguuguuaacuaugaaagaaaaauccuggcuaguccauaaacaaugguuucuugaucuaccccuaccauggacaagcggcgcaaguacgucucaagaaacguggaauagacaagaccuauuagucacguucaaaacagcacacgcuaagaaacaggagguuguuguacugggaagccaagaaggagcgaugcauacagcauuaacgggcgcaacagaaauacaaacaagugguacuacuacuauuuucgccggccacuuaaaauguaggcuaaagauggacaaacugaccuuaaaaggcaugucguauguuauguguacggggaguuuuaaacuagaaaaagaagucgcagagacacaacauggaacgguucuaguacaaauaaaauacgaaggaacagacgcucccuguaaaauaccguuuucaacacaagacgaaaaaggcgucacacaaaacgggagauuaaucaccgcaaaucccauaguuacagauaaagagaaaccagucaacaucgaagcagaaccuccguucggagaaucuuacauaguaauuggagcgggagaaaaagcacuaaaacuuaguugguucaagaaaggcucaucgauuggcaaaauguuugaagcaacggccagaggagcacgcaggauggcgauauuaggugacacugcuugggacuuuggaaguaucggagguguauuuacguccauugguaaauuggugcaucaaauauucggcacugcguauggggucuuguuuucaggaguaucuuggacaaugaaaauaggcauugguguuuuacuuaccugguuaggacuaaauagcaggucuacgagccugucuaugacuuguaucgcuguaggcuuagucacacuuuauuuagguguuaugguacaggcagacucgggaugcguuaucaauuggaagggacgugaauuaaaauguggaucuggaauauuugugaccaaugagguccauacuuggaccgaacaauauaaauuccaggcugauaguccgaaacgucuaagugccgccauugguaaggcuugggaggaaggaguguguggaauacgaagugcaacucgacuugaaaauauuauguggaagcaaauuuccaaugagcucaaccauauuuuacucgaaaacgacaugaaauuuaccguaguuguaggugauguagcagggauauuagcgcaaggcaagaaaaugauccggccgcaaccgauggaguauaaguauagcuggaaaucgugggguaaagcuaaaaucauaggugcagauguucaaaauacaacuuuuauuauagacgggccgaacaccccugaauguccagaugaucaacgugcuuggaacaucugggaaguagaggauuauggauucggcauuuuuacaacaaacauuugguugaaguugagagauucguauacacagguuugugaucacaggcuuaugucugcugccauaaaagacagcaaagccguucacgcagacaugggauacuggauagaaagcgagaaaaaugaaacauggaaguuagccagagcuucuuucauagaaguuaaaacguguauauggccaaagagccacacauuauggucaaauggcguguuggaauccgaaaugauaauaccuaaaauauaugguggaccuauuagucaacauaauuacagacccggguacuuuacacaagcugcagguccuuggcaccuagguaaauuggaacuggacuuugauuuaugugaaggaacaaccguuguuguugacgaacauuguggaaaccgcggaccaucacugaggacaacuacaguuaccggaaaaaucauucacgaaugguguugucguaguuguacgcuucccccauugcgauuuagaggggaagacggauguugguacggaauggagauacggccaguaaaagaaaaagaggaaaaucuuguuaaaucaauggucagcgcgggaagcggagaaguagacucguuuucucuuggucuucucuguaucaguaucaugaucgaagagguaaugagaucaagguggucaaggcgaauguugaugaccgguacacuagcggucuucuuucuuuugaucaugggucaguugacauggaacgaccuaauacguuuauguauuauggucggcgcuaaugccucugaccgcaugggaaugggaacuacauacuuagcacugauggcaacguucaaaaugagaccuauguuugcagugggacucuuguuucgucgguuaacaagcagggaaguacuacuguuaacuauaggauuaagucugguagcgucuguagagcucccuaauuccuuagaagaacuuggggacgguuuagcaauggggauaaugauacuaaaacuauuaacggauuuucaaagccaucaacuaugggccacauuauugaguuuaacauuuaucaaaacaacuuucucacugcauuaugcauggaaaacuauggcaaugguguuaaguaucguaagucuguucccccuaugcuuaucuacuacgucucagaaaaccacauggcuuccaguacuauuagguucucuuggguguaaaccccuaaccauguuuuuaaucgcggaaaacaagauuugggguaggaggucuuggccguuaaaugagggcauaauggcaguuggaauagucuccauucugcuaucuaguuuacuaaagaaugauguaccucuagcugguccucuaauagcaggcggcaugcuaauugcuuguuaugugauaucuggaagcucagcagaucuaaguuuagaaaaagcugcagaaaucucaugggaagaggaagccgaacacucgggugccucucacaacauuuuaguagaaguucaagaugauggaacgaugaagauaaaggacgaagagagagacgacacguuaacaauccugcuaaaggcaacauuauuagcuguaaguggaguguauccuuuaucaauaccagccacucuuuuuguaugguacuuuuggcagaagaagaaacaacgaagugggguacuuugggauacuccuuccccuccugaagucgaaagggcaguacuugaugauggaauuuauagaaucaugcaacggggccuauuagggaggagucagguagguguaggcguuuuccaagaaaauguuuuucauacuauguggcauguuacgcgcggugccgugcuuauguaucaagguaaaagacuugagccaaguugggccucugucaagaaagacuuaauaaguuauggagguggauggagacuucagggaagcuggaauacuggagaagaaguacaagugauagcaguagaaccaggcaaaaacccaaagaauguccaaaccgccccaggcacguucaaaacuccagaaggagaagucggcgcgauugcacuagauuuuaagcccggcacaucuggaucacccauaguaaacagggagggcaaaauagucggacucuauggaaacggagucgugacaacgagugggacauauguaagcgcaauagcacaagccaaggcaucacaggaagggccuuuaccggaaauugaagaugaaguguuuaggaaacggaauuuaacaauaauggaccuucaucccgguucaggaaagacucgccgauaucuaccagcaauaguaagggaggcaauaaaaaggaaauuacgaacuuugauauuagcuccgacaaggguagucgcaucugaaauggcggaagcacugaaaggaaugccaaucagauaccaaacuacugcagucaaaucagaacacacuggaaaagagauaguggaucucaugugccaugcaacauuuacuaugcgacuccuuucaccggcgaggguaccaaauuauaauaugauaaucauggaugaagcacauuuuacggaucccagcuccauugccgcccgaggauacauaucaacuagaguagguaugggugaagcggcagcaauuuucaugaccgcuacuccaccuggcucaguggaagcguucccucaaucaaaugcagucauacaagaugaggaaagggauauuccugagcggucauggaacucaggcuacgaauggauuacagacuuuccuggaaaaaccgucugguuuguaccaucuauuaaaucgggcaaugauaucgccaacugccugaggaaaaacggaaagagagugauacaacucaguagaaaaacauucgauacugaauaccagaaaacgaaaaauaaugauugggauuacguagucacaacagauaucucugaaaugggggccaauuucagggcagaucgcguaauugacccuagaagauguuuaaaaccaguaauauuaaaagaugggccagaaagggugauauuggcagggccaaugccgguuacaguagcauccgcggcucaaagacgagguagaauaggaagaaaccauaacaaagaaggagaucaauauaucuauauggggcagccacuuaacaaugaugaggaucaugcgcauuggacagaggcaaaaaugcuccuugauaauauaaacacuccugaggguauaaucccggcacuuuucgagcccgagagggaaaaaucagccgcaaucgauggagaauauagguuaagaggugaagcuaggaaaacuuuuguugaguugaugagacguggugaucuacccguaugguuauccuauaagguagccucggaaggauuucaguacagcgauagaagauggugcuuugauggagaaagaaauaaccaggucuuagaagagaauauggauguugagauuuggaccaaggaaggagaacgaaagaagcuaagaccccgcuggcuagaugcuagaacauauuccgauccacucgcuuuacgggaauuuaaggaauuugcagccgggcguagaagcguauccggcgaccuuauucuagaaaucggcaaacuuccacaacaucucacucaaagggcgcagaaugcacuugacaaucuuguuaugcuacauaauuccgaacaaggagggcgcgcauacaggcacgcuauggaagaacuuccagauacaaucgagaccuugaugcugcuugcacucauugccgucuuaacgggaggugugacacuuuucuuucucagcgguagaggccuagguaaaacgucgauuggacucuuaugcguaauggcaaguagcguacuacuguggauggcgaguguagagccacauuggauagcagcaucuauaauuuuagaauuuuuccuaaugguacuguuaaucccagaacccgaucgccagcguacgccucaagacaaucaacucgcauaugugguaaucggacucuuguucaugauucuaacagucgcugcuaacgaaaugggacugcucgaaacuacgaagaaagaccuagggauuggucauguagcuguugagaaucaucaccaugcagcgaugcucgauguugaucuacaccccgccucugcuuggacguuauaugccgucgcuacaacaauaauuacaccaaugaugagacauacuauagagaacaccacagccaacauaagucugacagccauugccaaccaagccgcuauacugaugggauuagauaaaggauggcccauaucaaaaauggauauagggguaccccuacucgcucuaggaugcuauucccagguaaauccguuaacauugaccgcagcuguauugauguuaguagcccauuacgcuauaauaggacccgggcuacaagccaaagcaacaagggaggcgcagaaacggaccgcugcaggcaucaugaaaaauccgacaguagacgggauaguggcaauagaucuugauccaguaguuuacgacgcaaaguucgagaagcagcuaggccaaauaauguuauugauccucugcaccucacaaauacuucuaaugcgcacaaccugggcccugugcgaaaguaucacacuugccacggggccacuaacaacauuaugggaaggaagcccugguaaauuuuggaauacuacgauugcugugucgauggcaaauauauucagggguucauacuuagcgggugcuggccuagcauucucucugaugaaaaguuuaggcgggggcagacggggaacuggagcacaaggggaaacucuaggagaaaaguggaaacgucaacugaaccaacucuccaaaagugaguucaauacauauaagagaagugggauaauggaaguugaccgaagcgaagcaaaagaaggccuaaaaagaggcgaaacuacuaaacaugcaguuucaagaggaaccgcaaaauuacgaugguuuguagaaagaaaucugguaaagccugagggaaaggucauagaucuuggguguggaagaggaggguggagcuauuacugugcaggacuuaagaaaguuacagaagugaagggauauacuaaagggggcccaggccaugaagaaccuauccccauggcuaccuauggcuggaaucuaguuaagcuccauagcggcaaagauguauuuuucauuccuccagagaaaugcgacacgcuacuuugugacauuggggaaucgucuccaaauccaacaauagaagaaggcagaacacuaagaguacugaaaaugguagaaccguggcuuagaggcaaucaauuuuguauaaaaauuuuaaauccauauaugcccagcguaguugaaacgcuggaacaaaugcaaaggaagcauggagggauguugguacgaaauccauugucaagaaacaguacucaugagauguauugggucucuugcggcacuggcaauauaguuucagcaguuaauaugacaucacgaauguuacuaaaccgguuuacgauggcucauaggaaaccuacauacgagagagauguagacuugggggcagguaccagacacguagcuguugaaccagaaguagcuaaccuugacaucaucgggcaaagaauugagaauauuaagcacgagcauaaguccacuuggcauuacgaugaagacaaccccuauaagacuugggcuuaccacgggagcuaugaaguuaaaccaucaggaucggcuaguucaauggucaauggcguagucaaacuacuaaccaagccuugggaugucauaccaaugguaacgcagauagccaugacagauacaacaccauuuggacagcaacguguguuuaaagaaaaaguagacacgcggacucccaaggccaagcgaggaacggcucaaauaauggaaguuacggcaaaguggcuuuggggcuuccuuagccguaacaagaaaccuagaauuuguacgagagaagaguucacacggaaagugcgauccaaugcggcaauuggagcuguauuuguagaugagaaucaauggaacucagcaaaagaggcaguagaagaugaaagguuuugggaucucgugcauagagagagagagcuacauaaacaaggcaaaugcgcuacuugcguuuauaauaugaugggaaaaagagagaagaaauuaggagaguucgggaaagcgaaaggaagucgugcaaucugguauauguggcuuggugcaagguuuuuagaguuugaagcauuaggauucaugaacgaagaccacugguuuagucgagaaaauucauugagcggaguugagggagaaggcuuacauaaauuagguuacauauugagagauauuucuaaaauaccaggaggcaauauguaugcggaugacacggcaggaugggacacaagaauaacugaagaugacuuacagaacgaggcaagaauaacagauauuauggaaccagaacacgcauugcuagcaaaaaguauauucaaacuaacuuaccaaaauaaaguaguacgaguccaacgcccugccaaaaacggcaccgucauggauguuauaucccgaagagaucagcgaggcucaggccaagugggaacuuauggauuaaauacuuuuacaaauauggaagcacaacuaauacgacaaauggagucugaaggcauauucucaccuuccgagcucgaaacaccuaaucuugccgagagagucuuggauuggcuagaaaaauaugguguagaaaggcugaaacggauggcgauaucgggagacgauugcguaguaaagccgauagaugacagguuugcuacggcacucacagcacuaaacgacauggguaaaguaagaaaagauauaccgcaaugggaaccuagcaaaggguggaacgauuggcaacaaguaccguucuguagccaccauuuccaccaacuaauuaugaaagacgggagagaaauuguuguaccgugcagaaaucaggacgaauuaguaggcagggcuagaguaucucaaggugcggguuggaguuugcgagaaacagcuugucuuggaaaaucauacgcgcagauguggcagcucauguauuuucacaggagagaucuccguuuagcugcuaacgcuaucuguagcgcaguccccgucgacuggauaccgacgucacggacgaccuggaguauacaugcucaucaccaauggaugacuacggaagauauguuaagugucuggaacaggguuuggauagaggaaaauccguggauggaagacaagacucauauuucaaguuggggagacgugcccuaucuuggaaaaagggaagaccaauggugcggcagccucauaggauugacagcuagggcaacuugggccacaaauauccaaguugcaauaaaucaaguuaggaggcuuauuggcaacgagaacuaccuugauuauaugacaaguaugaaacgauuuaagaaugagagugacccggagggagcauugugguga

SEQ ID NO: 21565 - RNA, 9879 nt, Artificial Sequence
  derived and/or modified CDS sequence (opt6) from DENV-1__FJ410226__SS-prME
ucuguaaccauguuauugauguuaaugccaacugcccuugcuuuucaucugacuaccagaggaggggaaccgcacaugaucguuaguaaacaagaacgggggaaaagucugcucuuuaaaaccucagcugguguuaacauguguacacuuaucgcuauggacuuaggugaauuuugcgaggacacaaugacuuauaaaugcccgagaauuacggaagcagagccagaugacguggacuguugguguaaugcgacagauacguggguaacuuauggcacaugcucgcaaacaggugaacaucguagggauaaaagaaguguagcacuggcgccacauguaggauuaggucuugaaacgaggacggagaccuggauguccucagagggagcauggaaacaaauucaacgaguagaaacuugggcacugcgucauccuggauuuacugucaucgcgcuauuuuuagcacacgcuauuggaacuucuauuacccaaaagggaauaauauuuauuuuguugaugcucguaacuccuaguauggcaaugagaugugucggcaucggcagcagagacuuuguugaaggacuaucuggcgcgacaugggucgacgugguauuagaacauggaucaugcguaacaacuauggcaaaagauaaaccaacucuagauaucgagcuucuaaaaacagaggugacaaauccagccguucucaggaaacuuuguauugaagcgaaaauuucaaacacaacuacagauucccgguguccaacucaaggagaagcuacccucguagaagaacaagacgcaaacuuugucugucgaagaacauucgucgacagaggauggggaaauggaugcggacuuuucggaaaaggcucccuuauaacuugugcgaaauuuaaauguguaaccaaacuagaggggaaaauagugcaauacgaaaaccuaaaauacucaguaauaguaaccguucauacgggugaccaacaucaaguugggaacgaaucuacggaacaugggaccacggccacaauaacuccucaagcuccuucuacggagauccaacuaacugacuauggugcuuugacacuugacuguuccccaagaaccggauuagacuucaacgaaaugguacuacugacuaugaaagaaaaaucuuggcuuguccacaaacaaugguucuuggaucuuccauugccauggacuucgggagcuucuacaucacaagaaacauggaauagacaagacuugcugguaacauuuaaaacugcucacgcuaagaaacaagaagugguuguuuuagguagccaggagggcgcaaugcauacugcguuaacaggcgcgacagagauacaaaccucugggacgacaacaaucuuugcaggacacuugaaaugcaggcuaaaaauggacaaguugacucuuaaagguaugucauaugugauguguacugggucauucaaacuagaaaaagaaguugcagaaacacaacacgggacaguucuaguacaaaucaaauacgaaggcacagacgcuccaugcaaaauaccuuucaguacgcaagaugagaaaggaguaacacaaaacgggcgucuaauaacugccaauccaauaguuacagauaaagacaaaccgguaaauauugaggcggaacccccguucggggaaaguuauauaguaauaggggccggagaaaaagcacuuaaauuaagcugguuuaagaaaggauccucaaucgguaaaauguuugaagccacugcaaggggagccagaaggauggcaaucuuaggagacacagcgugggauuuuggaucaauagguggcguuuuuaccaguguaggcaaguuggugcaucagauauuuggcacagcauauggcguucuauuuucugguguaucuuggacgaugaaaauaggaaucggaguacuuuuaacauggcucggacuuaauucaaggucaaccucgcuuaguaugacaugcauugccguuggauuggucacuuuauaucuaggagucaugguucaagcagacagcggguguguuguaaauuggaaagggagagaauuaaagugugggucugguauuuuugucacuaaugaaguccacacauggacugaacaguacaaauuccaggcugacucgccaaaacgguuaucugcagcaaucgggaaggcuugggaagaagggguauguggaauacgauccgcuacacggcuugaaaacauuauguggaaacaaauuucuaaugagcuaaaccauauucuauuagaaaacgauaugaaauucacagugguuguuggagacguagcaggcauucuagcucaagggaaaaagaugauacgaccacaaccaauggaauauaaauacagcuggaaaagcugggggaaagcaaagaucauaggcgcagauguacaaaauacuacauuuauaaucgauggcccaaauacgccagaaugucccgacgaucaacgagcauggaauauaugggaagucgaggacuacgguuucggaauauuuacaacaaauauuuggcucaaacuuagggauaguuacacacaaguuugugaucaccgucuuaugucagcagcaauaaaagacuccaaggcaguucacgccgauaugggauauuggauagaaagcgagaaaaacgagacguggaaguuggcacgugcaucauuuaucgaaguuaaaaccugcaucuggcccaagucgcacacauuauggagcaacggaguuuuagagucagaaaugauaauaccuaaaauauauggaggcccuauaucacaacauaauuauagaccuggauacuucacacagacggcuggcccuuggcaucucgguaaauuggagcuugacuucgaccuaugugaaggaacaacgguugucguagacgaacauugugguaauagaggucccagccuaaggacaaccaccgugacugggaagaucauccaugaaugguguugucguucuuguacauugccgccucucagauuuaaaggcgaggacgguugcugguauggaauggagauaagaccuguaaaagaaaaagaagaaaauuuaguaaaaucaaugguaucugccgggagcggggaaguugacucauucucgcuagggcuacuaugcauuaguauuaugaucgaggagguaaugaggaguagguggagcagaaaaaugcuaaugacgggcacauuagcgguauucuuucuacuaauaaugggacaacucacauggaacgaccuuaucaggcuguguauaauggucggcgcuaacgcaagugaucgaaugggcauggguaccacuuaucucgcauuaauggcaaccuucaaaaugagaccuauguuugcuguaggucuccuauuuagaagguuaacauccagagaaguucuacuccuaacaaucggauugucgcucgucgcaucaguggaacuacccaauagcuuagaagaacucggcgaugguuuagccaugggaauaaugaucuuaaaauugcucacugauuuccaaucacaucaguuaugggcaacccuccuaaguuugacauucauaaaaacaacuuuuucauugcauuaugcauggaaaacaauggcuauggugcuaagcauagucucucuauuuccauuaugcaugucuaccaccagucagaaaacaacuugguuaccuguauuauugggaucucuugggugcaaaccacuaacgauguuuuugauugccgaaaauaaaauauggggacgaaaaucauggcccuugaaugaaggcauaauggccguagggaucgucaguauacuacuaaguagcuuacuuaagaacgauguaccguuagcgggaccacugauagcuggugguauguugauugcauguuacguaauuucaggcucaagugcagaccuaaguuuagaaaaagcagccgaagucuccugggaagaagaagcagagcauucaggggcaucacauaacaucuuaguagaaguacaggacgaugggacuaugaaaauaaaggaugaggaacgcgaugacacacuaacgauccuuuugaaagcgacuuuacucgcagucucugguguauauccgcuuucaauaccugccacucuguucguaugguauuuuuggcagaagaagaaacaacgaucuggaguacuaugggauacaccgucaccaccagaaguugagcgggcaguacuagaugauggaauauauaggauuaugcaacgagggcugcugggacgaagccagguaggaguuggcguauuucaagaaaauguauuucauacaauguggcauguaaccagaggagcaguucuaauguaccaaggcaaacgacuagagccgaguugggccucuguuaagaaagacuuaaucucauacgguggugguuggagacuucaagguucauggaauacuggagaagaaguccaaguuauagccguggaacccgguaaaaaccccaagaauguacagaccgcaccgggaaccuucaaaaccucugaaggagaagugggggcaauagcucucgauuuuaaacccggaacaucaggaaguccgauagugaauagagaagggaagauaguaggacuuuauggaaauggcguuguaacaaccucugguaccuaugucagugccauagcgcaggcaaaggcaucacaggaaggaccgcuacccgagauugaagaugaaguuuuucgcaaaaggaaucuaacgauaauggaccuacauccaggcucagggaagacuagaagauaucucccugcgauaguaagagaagcuauaaaaagaaaacuuaggacauuaauacucgcuccaacgagaguaguugcaagugagauggccgaagccuugaaaggaaugcccauucgguaccaaacaacggcagugaaaagcgaacacacagguaaagaaauaguugaucucaugugccacgcaacuuuuaccaugcgacuacugaguccuguaagaguaccaaauuauaacaugauaauuauggaugaggcucacuucaccgacccaucuucuauugcugcucgaggauacauaagcacaaggguggggaugggcgaagcggcagccaucuuuaugacggcaacaccucccgggucaguagaagcauucccacaaucaaacgcaguuauacaagaugaagaaagagacauccccgagcguucauggaauaguggauaugaguggauaaccgacuuuccagggaaaacaguaugguuugugccuucaauaaagagcggaaaugauauagcaaacugccuucguaaaaaugggaagagaguuauucaacuaucaagaaagacauucgacacagaguaccaaaagacuaaaaauaacgauugggauuaugucguaacgacugauauaucggaaaugggugcaaacuucagagcagaccgagucauagaccccagacgauguuuaaaaccaguaauuuugaaagacggaccggagcgaguaauacuagcaggaccaaugccugucacgguagcaucggccgcgcagcgacgcggaaggauaggaagaaaccauaauaaagaaggugaccaauacguauauauggggcaaccucuaaacaaugaugaagaccacgcacacuggacagaagcaaaaaugcuucucgauaauaucaauacaccugaagguauuauaccagccuuguucgaaccagaaagggagaaaagugcugcaauagauggagaauaucgucuucgcggcgaagcgagaaagacguuuguugaacuaaugagaagaggggaccuuccaguuugguugucauacaagguggccucagaagguuuccaauacucugauagaagaugguguuuugauggagagcguaacaaccaaguacuagaagaaaauauggauguugaaauauggacaaaagaaggagaacguaagaaauuaaggccgcgcugguuagaugcuaggacauauucagacccacuagcccugagggaguucaaagaguucgcugccggcagacgcucaguaucuggagauuuaauacuugaaauaggaaaacuuccucaacacuuaacucaaagagcucaaaacgcacuugacaacuuagugaugcugcauaacucagagcaaggugguagagcauaucgucacgccauggaagaauuaccagauacuaucgaaacacugauguuacuugcacuuauugcggugcucacugguggaguuacguuauucuucuuaaguggacgcggacucggaaaaacaaguauuggucuacugugugucauggcgagcagcguacugcuguggauggcaucaguugaaccacauuggauagcugccucaauaauucucgaguucuuccucaugguauuacuaauaccggaaccggauagacagcgaaccccucaagauaaucaacuugcauauguugugauuggcuugcuauuuaugauuuuaacgguggcagcaaaugagauggguuuacucgaaacuaccaaaaaggaccuagguauaggccauguugcgguagaaaaucaucaccaugcugcuaugcuugauguugaccugcaucccgcgagcgcauggacccuauacgcaguagccaccacuauuauuaccccgaugaugcgacauacgauagaaaacacgacugcuaauauaagccuaacugcaauugcaaaucaagcugccauuuuaaugggacuugacaaaggauggccaauuucuaagauggacauagggguaccucuauuagcauuaggauguuauagucaaguaaacccacuuacauugacugccgccguacugauguuaguugcccauuaugccauuauaggucccggauuacaagccaaagcaacccgggaagcucagaaaaggaccgcugcagguauuaugaagaauccgacugucgauggcauagucgcuauagauuuagacccaguaguauacgacgcuaaauuugaaaaacaauuaggccagauaaugcuucugauacugugcacgagucaaauacuauuaaugagaaccaccugggcccuaugcgagucuauaacacuggcaacuggaccacugacaacauugugggaagggucacccgggaaguucuggaacacuaccauugcgguaagcauggccaacauuuuucgggguuccuaccuagccggagcgggguuggccuuuagccuuaugaagucacuugggggcggaagaaggggaaccggugcacaaggugaaacacuaggugaaaaauggaaaaggcaguugaaucaacugucaaagucggaauuuaauacuuacaagagaucaggaauaauggaaguagauagaucugaggcuaaagaaggauuaaaaagaggcgaaaccacaaaacaugcgguaucucgagggacugcaaaacuucggugguuugucgaaagaaaccugguaaagccagaaggcaaaguaauugaccuagguugcgguagagguggaugguccuacuacugugccggacuuaagaaaguaacagaaguaaaaggguacacuaagggcgggcccgggcacgaagaaccaauuccgauggccacguacggauggaacuuagucaaacuucacuccggaaaagauguauucuuuauaccaccagagaagugugauacgcucuuaugcgauauaggggaaucaucaccuaaccccacuauugaagaagggcgcacccuacguguacuaaagauggucgaaccaugguugagaggcaaccaauuuuguauuaaaauauuaaauccauacaugccuucuguaguagagacauuggagcaaaugcagagaaagcauggcggcaugcuaguuagaaacccacuuucaagaaacucaacccaugaaauguauuggguuagcuguggaacgggaaauauaguuucugccguuaauaugacaucaagaaugcuucuuaauagguuuacaauggcccauaggaaaccgacguacgaacgagauguagacuuaggugcaggaaccagacaugucgcgguugagccagagguagcaaaucucgacauuauaggacaacgaauagaaaauauaaagcacgaacauaaaaguaccuggcauuaugaugaagauaaucccuacaaaacaugggcuuaccacgguucuuaugaaguuaaaccauccggauccgccagcuccaugguaaacgggguagugaaauuauuaacuaagccaugggacguaauuccaaugguuacucaaaucgccaugacagauaccacuccuuuuggucaacagagaguuuucaaggagaaagucgauacuagaacgccaaaagcgaaacguggaacugcacagauuauggaggucaccgcaaaauggcuauggggauuuuugucucggaauaaaaagccaaggauuuguaccagggaagaauuuaccaggaaaguacgaucuaacgcugcuaucggugccguguucguugaugaaaaucaguggaauagugccaaagaagcgguugaagaugaacguuuuugggauuuagugcauagagaaagggaauugcauaagcaaggcaaaugugccaccuguguguauaauaugaugggcaaaagagagaagaaauuaggagaguuuggaaaagcuaagggaucucgugcaauaugguacaugugguugggcgccagauucuuagaauuugaggccuugggauuuaugaaugaggaccacugguuuucuagggaaaacucuuuaucuggcguugaaggcgaaggucuccauaaauuaggguacauucuucgugacauuagcaagauuccaggagggaauauguaugccgaugauacagcaggaugggacacacgcauaaccgaagaugaucuucagaaugaagcaaaaauuacagacauuauggaaccugaacaugcguuacuggccaaaagcaucuucaaguuaaccuaccaaaauaaaguugugagggugcaaaggccagccaaaaauggcacagucauggacguaauaucaagacgugaucaaagagguagcggucaaguugguaccuacggacuuaauacauuuacgaacauggaggcacagcuaauucggcaaauggaaucugaaggcaucuuuagcccaagugaguuagagacaccaaaucucgcagggcguguccuggauuggcuagagaaacacgggguugaaaggcuaaagaggauggcaaucucaggcgaugauugcguugugaaaccuauagaugauagauuugcuacggcguuaacggccuuaaacgacauggggaaaguacgaaaagauauuccgcaaugggaaccaaguaaaggcuggaacgacuggcaacaagucccauuuuguagucaucacuuucaucaauugaucaugaaagauggaagagaaauugucgugccaugcagaaaucaagaugaauuaguugggagagcaagagugucacaaggugcugguuggagucuucgagaaacagcauguuuagguaagucuuaugcacagauguggcaauuaauguauuuucacaggcgagacuugagauuagcugcaaaugcaauaugcucagcaguuccuguugauuggguaccaacaucucguacuacauggucuauucacgcucaucaccaauggaugacuacagaagauauguuaucgguauggaacagggucuggauagaagaaaacccuuggauggaggauaaaacucauauuucaucguggggcgauguacccuaucuugguaaacgcgaagaucaaugguguggcagucuuaucggguuaacggcaagggcaacuugggccacaaauauacaaguagcuauaaaccagguaaggcguuuaaucggaaaugaaaacuacuuagacuauaugaccucuaugaaacgguuuaagaaugaaucugauccagaaggugcacuaugguaa

SEQ ID NO: 21566 - RNA, 9879 nt, Artificial Sequence
  derived and/or modified CDS sequence (opt6) from DENV-1__FJ410227__SS-prME
ucugugacgauguugcuaauguugaugccuacagcuuuagcauuucaucugacaacccgagguggggaaccccauaugauaguguccaaacaagaacgaggaaaaagccuguuauuuaaaacuucugcggguguuaacauguguacuuuaauagcgauggacuugggagaauuuugugaagauacaaugacauacaaaugccccagaauaacugaagcagaacccgaugauguggauugcugguguaaugcaacagauaccuggguaaccuacggaacauguucacaaacgggugaacacaggcgagauaaaaggucaguugcucuugcuccacaugucgguuuaggacucgaaacaaggacggaaacauggaugaguuccgaaggagccuggaaacaaauccaacgaguagaaacuugggcccugagacacccugguuuuacaguuauagcauuauucuuggcgcacgcaaucggaacuucgauuacacaaaaaggcauaauauuuauccuucugaugcucguaaccccuucgauggcuaugcguugugucggaauugguagcagggauuucgucgaaggauuaucaggcgcaaccugggucgacguaguucuagaacacggaaguugcguaacuacaauggcuaaagacaaaccgacuuuagauaucgaguuacuaaaaaccgagguaacaaacccagcagugcuucguaaacucuguauugaagcaaaaauuagcaacaccacaacagacucacgcugcccaacccaaggugaagcuacucuagucgaagaacaggaugcuaauuucguuugcagaagaacuuucguagaucgagguugggguaaugguuguggacuauuugguaaaggcucuuuaauaacgugugccaaauucaaauguguaacaaaauuggaagggaaaauaguccaauaugagaaccuaaaauacucagugauagucaccguucauaccggagaucaacaucaaguuggaaacgaaucaaccgaacaugguacaacggcgaccauaacuccucaggccccaucuacggagauccaacuuacagauuacggcgcuuugaccuuggacugcaguccgcguacgggauuagauuuuaacgaaaugguccuauuaacuaugaaagagaaaaguuggcuagugcauaaacagugguuccucgaucuaccgcuaccuuggacaaguggggcaagcacaucacaagaaacauggaaucguaaagauuuacucguaacguucaaaacagcucaugccaagaaacaagaagugguaguacucggaucacaagagggagcuaugcacaccgcguuaacuggcgcgacagaaauacaaacauccggcacgacuacgauauucgccggccaccucaaaugccguuugaaaauggacaaauuaacacuuaaagguaugucauauguaauguguacggggucauuuaaauuagaaaaagaagucgcugaaacacaacauggcacaguauuaguccagaucaaguaugaaggaacagaugcucccuguaaaauuccguucaguacgcaagaugagaaaggaguuacccaaaacggacguuuaaucacagcgaaucccauaguuacggauaaggagaagccaguuaauaucgaagccgagccaccuuuuggugaaucauacauagugaucggagcaggagaaaaagcccuaaaauuaucuugguuuaaaaaggggucgagcauaggaaaaauguuugaagcaacagcaagaggugcaaggagaauggccauacugggggacacggcaugggauuucggaucaauagguggggucuucaccagcgucggaaagcuaguucaucaaauuuuuggcaccgcuuauggcguacuguucuccgguguuaguuggacuaugaaaauuggaaucgguguacugcuaacuuggcuuggacuaaacagccgcagcacuucuuuaaguaugacauguauagccguaggucucgugacucuauacuuaggaguaaugguacaagcugauucaggguguguaauaaauuggaaaggacgugagcuuaaaugugguucugguauauucguaacgaacgagguucacacuuggacagaacaauacaaauuucaagccgauagcccuaaaagacugucagcagcgauuggaaaggcuugggaggaaggcgucugugggauucgcaguacgacgcgcuuggagaauauaauguggaaacaaauaaguaaugaauuaaaucauauacuacuagaaaacgauaugaaauucacugugguaguaggugauguugcgggcauauuggcucaaggcaagaaaaugauaagaccucaaccaauggaguauaaauacaguuggaaauccuggggcaaagcuaaaaucauaggagccgacguucaaaauaccaccuucauaaucgauggaccuaacacaccugaguguccggacgaccagcgagcuuggaauauuugggaaguagaagacuauggguuuggcauuuucacaacaaacauauggcuuaaacuaagggacagcuacacccaaguaugugaucaucgacuuaugagugcugcgaucaaggauucaaaagcaguccacgcugacaugggguacuggauugaaagugagaaaaaugaaacauggaaguuagcacgugccucguuuauugaaguuaaaaccugcauuuggccaaaaagccacacccuguggaguaauggcguucuagaaagugaaaugauuauaccaaaaauauaugguggcccaauaagccaacacaauuauagaccaggauacuuuacgcagacugccgggcccuggcaucuaggcaaacuagaacuggauuucgacuugugcgaggggacaacaguuguagucgacgaacauuguggaaauagaggaccauccuugaggacaacgacugugacaggaaagauuauacaugaaugguguuguagaaguugcacccuaccaccucucagauuuaaaggggaagauggaugcugguauggaauggagauaagacccguaaaagaaaaggaggaaaaucuugucaaguccaugguaucugcaggaucaggagaagucgauuccuuuagcuugggauuacucuguauaagcauaaugauugaagaaguaaugagguccagauggagucgaaagaugcucaugacgggcacuuuagcgguguuuuuccuacuaauaaugggacaacucacguggaacgaucuaauucggcuauguauaaugguuggcgcaaaugcaagugauagaaugggaaugggaacaacauaccuagcgcuaauggcgacauucaaaaugagaccgauguuugcgguugguuugcuauuuagacgcuuaacuagccgggaaguucuucuacuaaccauaggguuaaguuuaguagcaucaguugaauugccuaauucacuggaagaacucggugauggacuggcgauggggauaaugaucuuaaagcuccuuacagauuuucagucacaucaguuaugggcgacucuacuuucauuaaccuucauuaaaacaacguuuaguuuacauuaugcauggaaaacaauggcaaugguccuaagcauaguuagucucuuuccucuaugucuauccacuacuucucaaaagacgaccuggcucccagugcuucuugguucacuugggugcaaaccuuuaacaauguuucucauagccgagaauaagauauggggucgaaaaaguuggccacuaaaugaaggaauuauggcugugggcauuguaucuauauuacuuucaucucuacuuaagaacgaugugccauuggcggguccucuaauagcugggggaaugcugaucgccuguuacguuaucucuggauccucagcugaucuuucucuugagaaagccgccgaaguuaguugggaggaagaagcugaacacucgggagcgucccauaacauauuaguagaaguacaagacgauggaacaaugaaaauaaaagacgaagaacgcgacgacacacuuacaauacuauuaaaggcuacauuacucgcgguuaguggcguuuauccucuaucaauaccggcaacauuguucgucugguauuucuggcagaagaagaaacagaggucuggaguacugugggauacaccuaguccacccgaaguggaaagagcgguucuagacgacgguaucuacagaauuaugcagagaggacuguuaggaagaucucagguaggcguagggguuuuucaagaaaauguuuuucacaccauguggcauguuacgaggggagcagugcuuauguaucaagguaaaagacuagagccgucgugggcuucgguuaagaaggaucuaauaucauauggaggaggcuggaggcuacaaggcagcuggaauacgggcgaggaaguccaaguaauagcagucgaaccgggcaaaaauccaaagaacguacaaaccgccccaggaacauuuaagacgucagaaggggagguuggagccauugcacuagacuucaaaccgggaaccaguggaagcccaaucguaaauagagagggaaaaauuguagggcuuuacgggaaugguguugugacuacaucagguacauacgucagugcaauugcucaagcgaaagcaucucaagaaggccccuuacccgaaauagaagacgaagucuuccggaaacgcaaucuuaccauuauggacuuacauccagggucagggaaaaccagaagguaucucccggcuauaguacgagaagccauaaaaagaaaacuuagaacacuaauucuugcaccaacuagagucguagcauccgaaauggcugaagcccuuaaaggaaugccaauacgcuaucaaacaacagcugugaaaucagaacacacuggcaaggagauaguagaccuaaugugucaugcaacuuuuaccaugcguuugcuauccccgguaaggguaccaaacuauaauaugauuauuauggacgaagcucauuuuacagacccaaguucaaucgccgcaagaggauauauaaguacacgcguagggaugggagaagcagccgcaauauuuaugacagcaacuccuccagggucaguagaggcguucccacaaucuaacgcgguaauacaagaugaggaacgugacauuccagaaagaucuuggaauagcgguuacgaguggauuacagauuuuccuggaaagacaguaugguucguaccuucaauuaaaucugguaaugauauagcaaauugucuacguaaaaacggaaaaagaguuauacaguuaucccguaagacguucgauacggaauaccagaaaacaaagaacaaugauugggacuauguaguuacaacagacaucucagaaaugggagcaaauuucagggcugaucggguaauagacccuagacguuguuugaagccagugauauuaaaggauggucccgagagagugauuuuggcuggcccaaugccagucaccguugcuucagcugcacaaagacguggccguauagggagaaaccacaauaaagaaggagaucaauacauauauaugggucaaccacucaacaaugaugaagaccacgcccauuggacagaagcaaaaaugcuacuagauaauauuaacacaccugagggcauuauccccgcauuauuugaaccugaaagagagaaaagcgcugcuauagauggagaguauagguugcguggagaggcaagaaagacauucguugaauuaaugcguagaggugaccuaccugugugguugucuuacaaggucgcgagugaaggguuucaauacucagacaggagauggugcuucgauggugaaagaaacaaucagguccuugaagaaaauauggauguggaaauauggaccaaagaaggagaaagaaagaaauuaagaccacggugguuagaugcaagaaccuacucugacccauuagcacuucgagaguucaaagaauuugcugcagggaggaggucaguauccggggaucucauacuagaaauaggcaagcucccucaacaucucacucaaagagcacaaaaugcacuagacaaucuaguaaugcuacauaacucggaacaaggcggacgugcuuauagacacgcaauggaggaauuacccgauaccauagaaacauuaaugcugcuagcauuaauagccguccuaacuggcggaguaacacucuuuuuccuaucaggaaggggccuaggcaaaacuagcauaggacuguuguguguaauggcgucuucagugcuguuauggauggcaagcgucgaaccacauuggaucgcagccaguauuauuuuagaguucuuucucaugguuuugcuuauaccagaaccggaccgacagcggacuccgcaagauaaccagcuagccuauguuguaauagguuugcuuuuuaugauacuaacuguagcugcgaacgagaugggacucuuagaaacgacgaagaaagaucucggaauaggacacguagcggccgaaaaucaccaccaugccgcaaugcuggauguugauuuacaucccgcaagugcuuggacuuuguaugcaguagcgacgacaauuauuacgccuaugaugagacauacaauagagaacacuacugcgaacauaagccuaacugcgauugcaaaucaggcagcaauauuaaugggacuagauaaaggguggccaauuaguaaaauggauauaggcguuccauuacucgcgcuaggcugcuacucgcaagugaauccucuaacguuaacugcagcaguauuaauguuaguugcacauuaugccauaauagggccugggcuacaagcaaaggccacgcgggaagcccaaaaacgcacggcggcagguauaaugaaaaauccuacaguggaugggauaguugcuaucgaccuagacccuguugucuaugaugcgaaguucgagaaacaacucggucagaucauguuacugauuuuaugcacaagccaaauccuacuaaugagaacuacaugggcacugugugaaucuaucacguuagcuacuggcccccuuacgaccuuaugggaaggaaguccugguaaauuuuggaacacaacaauagcuguuucaauggcaaacaucuuccguggcucauaccuggcaggggccggauuagccuuuucucuuaugaaaucguugggaggcggucguaggggaacgggugcucaaggugaaacauuaggugagaaguggaaaagacaguugaaucaauuaucaaagagcgaguuuaauacuuauaaacgaucugguaucauggaggucgauagauccgaagcgaaggaagguuuaaagcgaggugaaacaacuaaacacgcagugucgagagguaccgcgaaacuacgaugguuuguagagcgaaacuuaguaaagccggaagguaaagugauagauuuaggcugcggucgaggaggauggagcuacuauugugcaggucugaagaaagucacagaaguaaaaggauauacuaaaggaggcccaggacaugaagaaccaauaccaauggcaacauaugguuggaauuuagucaaacuccacagcggaaaagacguguucuuuaucccgccagaaaaaugugacacgcuauuaugugauauaggcgaauccaguccaaacccaacuauugaggaaggacgaacccuucgggugcuaaaaauggucgagccuuggcuaagagguaaucaauuuuguauaaaaauacuaaaucccuauaugccaucugugguggaaacauuagaacaaaugcaaagaaaacaugguggaauguuaguuagaaauccacuuagccgcaacucaacacaugagauguauuggguaagcuguggcacuggaaauauuguaagcgcgguuaacaugacuucgagaaugcuuuugaacagguucacuauggcacauagaaaaccaacauaugaaagagauguggaucuuggagcagguacaagacacguugccguggaaccagagguagccaaccuagauauaauaggacagcgaauagagaauauuaagcaugaacacaaaaguacguggcauuaugacgaagacaaccccuauaaaaccugggcuuaucacgguaguuaugagguaaagccuagcggaagugcuucuagcauggugaauggugucgucaaacuauugacaaaaccuugggacguuauuccgaugguuacacaaauagccaugacagacacgacaccauuuggucaacaacgaguauucaaggaaaaaguugauacuagaacgccaaaagccaaaagaggaaccgcccaaaucauggaagugacagcuaaauggcuauggggauuccugaguagaaacaaaaagccgagaauuuguacgagagaggaguuuacaagaaaaguaagaagcaaugccgcaauaggggcaguauucguugaugagaaccaauggaacagugcuaaagaagcaguagaagaugaaagguuuugggacuugguucaccgggagcgagaauuacacaagcaaggaaaaugcgccacauguguguacaauaugauggguaaaagagagaagaaacuaggugaauuuggaaaggccaaaggaucuagagcaauaugguauauguggcucggagcacgauuccuugaguucgaagcccuaggcuuuaugaaugaagaccacugguuuagucgcgaaaauagcuuaucaggaguugaaggggaagggcugcauaagcuaggauauauauuacgugacauuuccaagauuccaggaggcaacauguaugcggaugauaccgcggggugggauaccaggauaacugaagacgauuugcaaaaugaagcaaaaauaacagauauuauggaaccugaacaugcauuacuagcaaagucaaucuuuaaacuaacuuaucaaaauaaaguaguacgaguacaacgaccagcuaaaaacggaacagugauggacguuauaagccgacgggaccaaagagggucaggacaaguugggacuuacggcuugaacacauuuacaaacauggaagcccaacuaauaaggcaaauggaaagugaagggauauucucuccaagugaauuggaaaccccaaaccucgcaggaagaguccuagauuggcuggaaaaacauggugucgaacgucuaaaaagaauggcaauuucaggcgacgauugcguagugaaacccauugaugauagauucgccacagcauuaacagcacuuaaugacaugggaaaaguacgaaaagacauuccgcaaugggaaccgucaaagggauggaaugauuggcagcagguaccauucuguucccaucauuuccaccaauuaauuaugaaggacggucgcgaaauuguaguaccaugcagaaaucaagacgaacucguaggacgggcgcgaguaagucaaggggcagguuggagcuuaagagaaacagcaugucuaggcaaaagcuaugcacaaauguggcaauuaauguacuuucaucggagagauuuacgccuagccgcuaacgcuaucuguucagcugugcccguugauuggguaccaaccucucgaacaaccuggucuauacaugcacaucaccaauggaugaccacugaagauaugcuuucgguuuggaacagaguauggauagaagaaaaucccuggauggaagauaaaacacacaucuccaguuggggagauguuccuuauuuagggaaaagggaagaccaauggugcggaaguuugauaggacuaaccgcgagagcgaccugggcaacaaacauacaaguggcaauaaaccaagucaggcgacuaauugguaacgagaauuaucuugauuacaugacgagcaugaaaagauucaagaaugaaucagacccagagggggcccugugguaa

SEQ ID NO: 21567 - RNA, 9879 nt, Artificial Sequence
  derived and/or modified CDS sequence (opt6) from DENV-1__FJ859029__SS-prME
agcguaaccauguuauuaauguuaaugccgacugcauuggcauuucauuuaaccacuagaggaggggaaccgcauaugauaguaucaaaacaagaacgggggaaaagccuauuguuuaaaacaagugcgggcgugaauaugugcacucugauagcuauggaucuaggugaauuuugugaagacaccaugacauauaaauguccuaggauuacagaagcagaaccagaugacguagauuguugguguaaugccacugacacauggguuacauaugggacguguucucaaacuggugaacaucgaagggauaaacgcagcguagcucuggcaccgcacguuggguuaggguuggaaacuagaaccgaaacauggaugucuuccgaaggcgcuuggaaacaaauccaaaaaguagaaacaugggcacucagacauccagguuuuacagucaucgcacucuuuuuagcacaugcaauaggaaccagcauuacacaaaaaggcauaauuuuuauucuauuaauguuaguaacuccaucgauggccaugcgauguguuggcaucggcucaagagacuucguagaggggcuuaguggcgcuacauggguggauguggugcuugaacauggguccuguguaacuacgauggcaaaagacaaaccuacacuagauauagaauuguuaaaaacagaagucaccaauccagcuguccucaggaaacuuuguauugaggccaaaaucagcaacacgacaacugauagucggugcccgacucaaggggaagcuacauugguggaggaacaagaugcaaacuuuguauguagaagaacauuugucgauagaggaugggguaaugguugugggcuguucgguaaaggcagccugaucacaugugccaaauucaaaugcguuacaaaacuagaagguaaaacaguucaacaugaaaacuugaaauauucaguaauugucacaguucauacuggggaucaacaucaaguagggaaugagucuacugaacaugggaccacagcaacaauaacaccacaagcucccagcacagaaauacaacucacagacuauggagcgcuuacccuagacuguucaccucggacaggguuggacuucaaugaaauggugcuauuaacuaugaaagaaaaaucauggcuggugcacaaacaaugguuuuuagaccucccacugccguggaccucuggggcauccacaucgcaagagaccuggaaccggaaagauuuauuagugacauucaaaacugcgcacgcgaagaaacaagaaguagucguacuagguagucaagaaggggcaaugcacacagccuuaacaggugcaaccgagauacaaacaaguggaacuacuacuauuuuugcaggacaucuuaaaugccguuuaaaaauggauaaauuaacucugaaaggcaccucauauguaaugugcaccgggucauucaaguuagaaaaagaagucgccgaaacccaacauggcacaguacuugugcaaauuaaauacgaaggcacagaugcaccuuguaaaauaccguuuuccacacaagacgaaaaagguguaacgcaaaauggacguuuaauuacugccaauccaaucgucacugauaaagagaagccaguuaauauugaagcagaaccaccuuucggagaaucauauauuguuaucggagccggagaaaaagcucuuaaguuaaguugguuuaagaaagguucuaguauaggaaagauguuugaagcuaccgcgagaggagcucggagaauggcuauuuugggagacacugcuugggauuuugggucaaucggcgguguauuuaccuccgucgggaaguuaguccaucaaaucuuugguacagcauauggaguuuuguucaguggaguaagcuggaccaugaaaaucgggaucggcgugcuucuuacaugguugggauugaauaguaggaguacaucgcuaagcaugacgugcauagcagugggucuaguaacccuauauuuaggggugaugguccaagcggacaguggauguguaaucaauuggaaagggcgcgaauuaaaaugugguucaggaauuuuuguaacuaaugagguucauacauggacugaacaguacaaauuucaggcagauagcccaaaacgauugagugcugcaauuggcaaggcuugggaagagggagucugcggaauuagaucagcgacgcguuuagaaaacauaauguggaagcaaaucucaaaugagcuaaaucacauauuacucgaaaacgauaugaaauucaccgucgucguaggagauguagcugguauauuagcgcaagggaagaaaaugauacgaccccaaccaauggaauacaaauacuccuggaaaucgugggguaaagcuaagauaauaggggcggacguucaaaauacaacguuuauuauugaugguccaaauacuccagagugccccgaugaccaaagggcauggaacauuugggaggucgaggauuacggguuuggcauuuuuacaacuaacauauggcuuaaacucagagauucauauacacagguuugugaccauagacuuaugucagcagcgauaaaggauagcaaagcaguccacgcagacaugggauauuggauagagagugagaaaaacgaaacuuggaaacuagcuagagcaaguuuuauagaagugaaaacguguaucuggccaaaaucgcacacacuauggucuaacgguguauuagaaagugagaugaucauaccuaagauauaugguggccccauaucccaacauaauuauaggccaggguacuucacucaaacagccgggcccuggcaccuugggaaauuagaacuggacuucgaucugugcgaaggaacuaccgugguuguagacgaacauuguggcaaucggggaccgucgcuacgaacuacgacagucacgggaaaaauaauccaugaguggugcuguagaucuuguacauugccuccauugcgauuuaagggggaagacggcuguugguauggaauggaaauucguccaguaaaagaaaaagaagaaaauuuaguuaagucaaugguuagcgcugggucuggagaaguagauaguuucagccuaggguuacuaugcauaucaauaaugauagaagaggugaugagaagccguuggagucggaaaaugcuuaugacgggaacguuagcagucuuccugcuccuaauaauggggcaacuaacauggaaugacuuaauaagauuauguauaaugguaggagccaaugcaucugacaggaugggaaugggcacuacguauuuagcucuaauggccacuuuuaaaaugaggccaauguuugcugucggacuucuauuucgaaggcuuacaucacgagaggugcuauuacugaccaucggccuaucucuuguagcuagcguugagcuaccgaacaguuuggaagaauuaggugacggauuagcaauggguauuaugauucuaaaauugcuuacggauuuucaaagucaccaauugugggcuacacuucuaucauuaacguuuauaaagacuaccuuuucguugcacuaugcguggaagacuauggcaaugguauuaucaauugugucucuuuuuccauuauguuuaaguaccacgucacagaaaacgacgugguuacccguacuguuaggaagucuuggaugcaaaccucuaacaauguuuuugauagcggaaaauaagauuuggggacgaaaaucauggccacuaaacgaaggaaucauggccguaggaauaguaucaauacuuuuaucaucuuuauugaaaaaugaugugccccuugcaggaccacugauagccgguggcaugcugaucgcuuguuacgugauaucaggaagcucagcugaccucagucuagaaaaagcggcggaagucuccugggaagaagaagcagaacacucuggcgccucacauaacauauuaguugagguucaagacgacggcacaaugaagauuaaggacgaagaacgcgacgacacacuaacaauccuuuuaaaagcaacuuuauuagccguuucagguguuuacccauuaucgauuccagcaacauuauucguaugguacuucuggcagaagaagaaacaaagauccgguguacucugggauacuccaaguccaccugagguagaacgugcuguuuuggaugacgggaucuaccgaauaaugcaaagagguuugcucgggagaagucaaguagguguggguguuuuccaagaaaauguuuuucacacuauguggcacgugacucggggcgcgguucuuauguaccaggggaagagauuggaaccgaguugggccucaguuaagaaagaucuuauuuccuauggaggugguuggagauuacagggaaguuggaauacaggagaagagguucaggucauagcgguggaacccggcaaaaaucccaaaaauguucagacugcuccugguacauuuaaaacaucagaaggagagguuggggccauagcacuugacuuuaaaccgggaacaucuggaucacccauugugaauagagaaggcaagauaguaggucucuaugggaacggcgugguaacgacuucaggcacauacguuucggcuauagcacaagcuaaagccagccaagagggcccauugccagaaauugaagacgaaguuuuuagaaaaagaaaccugacaauuauggaccuucauccaggaagcgguaaaaccaggcguuaccucccagcaauuguuagagaagcaaucaaacgcaaacuuaggacacuaauucuagccccuacgcggguggucgccagugaaauggcugaagcauuaaaaggcaugcccauaagguaucaaacaacagcgguaaagggagaacacacugguaaggaaauuguugaccucaugugccaugcaaccuuuacgaugcgucuguuaucuccuguaagaguacccaacuauaauaugauuaucauggacgaggcucauuuuacagacccuucaaguauugcggcucgaggcuauauaaguacucguguaggcaugggugaagcugcagcaaucuuuaugacagccaccccaccaggcuccguagaggcauuuccacaauccaaugcuguaauccaagaugaggaaagagauaucccggaaagaaguuggaacucagguuaugaauggauuacagauuucccaggcaaaacagugugguucguucccaguauaaagagcggaaaugacauagcaaauuguuuacguaaaaauggcaaaagaguuauacaauuaucacgaaaaacauucgacacggaauaccagaaaacuaagaauaaugacugggauuauguaguaacuacugauauauccgaaaugggagccaauuucagggcagauaggguuaucgaccccaggcguuguuuaaaacccgugauccuuaaagacgggccugaacgagucauccuagcuggaccuaugcccgucacgguagcguccgcugcccagaggagaggcagaauuggaagaaaucacaacaaagaaggugaucaauauauauauauggggcaaccuuuaaacaaugacgaggaccaugcucauuggacugaagcaaaaaugcuuuuagacaauaucaauacuccagaaggaauuauaccagcucucuuugagccagaacgagagaaaagugcagcgaucgauggggaguauagguuaaggggagaagccaggaagacuuuuguugaauuaaugaggcgcggugacuuaccgguuuggcucagcuauaagguugcuucagaaggguuccaguacuccgaccgcagaugguguuuugauggagaacguaauaaucaaguucucgaagaaaauauggacguagaaauuuggaccaaagaaggagaaaggaagaaauugcgaccuagauggcuugacgcucgaaccuauucagauccacuagcccuacgggaauuuaaagaauuugcagcaggaagaaggucaguaucuggagauuuaauauuagaaauagguaaacuuccacaacaucugacacagcgugcucaaaaugcauuagacaaucuaguuauguugcauaauucugaacaaggcggucgugccuaccgccaugcgauggaagaguugccggauaccauugaaacacuaaugcuccuagcucuuaucgcaguucuaacuggagggguuacccucuucuuucuaaguggacguggccuaggcaaaacuagcauuggauugcugugcguuauggccucaucagcacuacuauggauggcaaguguagagccacacuggauugcagcuagcauuauacuugaauuuuucuuaaugguccuuuuaauuccugaacccgauagacaaaggacaccacaagauaaucaacucgcauaugugguuauaggauuauuguuuaugauacuuacaguagcagcgaaugagaugggacuguuggagacuaccaagaaagacuuggggauugggcauguggcuguugaaaaccaucaucacgcagcaauguuagauguagaucuccauccagcaucagcauggacacuuuaugcaguagcaacgaccauuauaacuccgaugaugagacauacaauagaaaacacaaccgcgaauauuucacugacagcaauagccaaccaagcagcaauacucaugggacuugacaaaggauggccuauuucgaagauggauauuggcgucccccuguuggcccucggguguuauagucaaguaaacccauuaacacuaacagcagccguucuuauguuaguagcucauuaugcuauaaucggaccugguuuacaagcgaaagcuacgcgugaagcacaaaaacgcacugcggcuggaauaaugaaaaaucccacaguagauggaauagucgcuauagacuuagacccaguugucuacgaugcaaaauuugaaaaacaguuaggucagaucauguuguuagucuuauguacaagccagauccuacuuaugcgaacuacgugggcacuaugcgaaucuauaacauuagcaacggguccccugacaacuuuaugggaggggagcccaggcaaguuuuggaacacuacaauugcuguuaguauggccaauaucuuccgcggauccuacuuagccggugcgggauuagcauucucucuaaugaaaucuuuaggaggcggccgcagaggaaccggcgcacaaggagaaacauuaggagaaaaauggaagagacaacuaaaucaacuuuccaagagugaguuuaacacauauaaacgaucggguaucauggaagucgaccgcagcgaagcgaaagaggggcuaaaacgcggagaaacaacuaaacacgcuguuucacgaggaacagcaaaacuucguugguuuguagaaagaaaccucguaaagcccgaaggaaaagucauagauuuagguugcggcagagguggauggaguuauuauugugcgggauuaaagaaaguaacugaaguaaaaggcuauacgaaaggugggccuggccaugaagaaccaauccccauggccacauauggauggaaucuugucaaacuacauucgggaaaagacguuuucuuuaucccucccgaaaaaugcgauacacucuugugugacauuggagaaucuuccccaaauccaacaauugaagaaggcaggacacuucgcguucuaaaaaugguggaaccauggcuacgaggaaaucaauuuuguauaaaaauacuaaacccauacaugccauccguaguagagacgcucgaacaaaugcaacgaaaacacggagguaugcuagugcggaacccccugagcagaaauucuacacaugaaauguacugggugaguugugguacagguaacauaguaagugccgucaauaugacaucucguauguuacuaaaccgcuucacuauggcucaucgaaaaccuacauacgaacgcgacguagacuuaggugcugguacgagacauguggcaguugagccagaaguagcaaauuuagacauaauuggccaacgaauagaaaauaucaaacaugaacauaaaaguacguggcauuacgacgaagauaaucccuacaaaaccugggcguaucacggcuccuaugaagcaaaaccuucuggaucugcaagcucuaugguaaauggaguaguaaaacuauuaaccaaaccaugggauguaauuccaaugguuacacaaauagccaugacugauacaacucccuuuggacaacaacgaguuuuuaaggagaaagucgacacaagaacacccaaagcaaagcgagggacugcucagauuauggagguaacugcuaaguggcuauggggauuuuuaucuaggaacaagaagccccgaauauguacuagagaggaauuuacaagaaagguaagaaguaaugcagcaauaggggcagucuucguagacgaaaaucaguggaauagugcaaaagaagcaguggaagaugaacgauuuugggauuugguccaucgcgaaagggaauugcacaaacagggaaaaugugcaacaugcguuuacaacaugauggguaaaagagaaaagaaauuaggcgaguuugguaaagcaaagggaucacgagccauuugguacaugugguuaggagcucgauucuuggaauuugaggccuuagguuucaugaaugaagaucauugguuuucaagagaaaauucgcuuucagguguugagggugaaggccuacauaaauuaggguauauacuuagagauaucucaaagauaccuggaggcaauauguaugcagaugacaccgcuggaugggauacccgcaucacugaagaugauuuacaaaaugaagcaaagauuacugauauaauggagcccgagcacgcuuuauuagccaaaucaaucuuuaaacugaccuaucagaauaagguaguacguguucaaaggcccgccaaaaaugggaccgucauggacguaaucucucgacgcgaucaaagaggcaguggccaagucggaacuuauggucuaaauaccuuuaccaauauggaagcacaauuaauaagacaaauggaguccgaagaaauauuuaguccaucggaacuagaaaccccuaaucuggcaggcagaguccuagauuggcuggaaaagcauggcguugaaagacugaaacgaauggcaauaagcggugacgauugcguugucaaacccauagacgaucgcuucgcaacugcacucacggcucuaaacgacauggguaaaguccggaaagauauaccucaaugggaaccgucuaaaggauggaacgacuggcaacaaguccccuuuuguagucaucacuuccaucaacucauuaugaaagaugguagggaaauuguaguucccuguagaaaucaggaugaauuaguaggacgugcucgcgugucacaaggcgccggguggaguuuaagggaaacagcaugucuuggaaaaucauacgcccaaauguggcaacuuauguauuuucaccgaagagacuuacgccuagccgcuaaugccauauguucugcagugccaguagacuggguaccgacaucacguacaacauggucgauacacgcacaucaucaauggaugacaacagaagauaugcuuagugucuggaauagagucuggauagaagaaaauccuuggauggaagauaaaacacacauaucaagcuggggagauguaccauaucuagggaaacgugaagaucagugguguggaagucuaauuggacuaacagcaagagcgacaugggcgacaaacauucaaguugcuauaaaucaaguucgaaggcugauaggaaaugaaaauuaucuugacuacaugacuucuaugaaacguuucaaaaaugaaagcgauccugaaggagcgcuaugguag

SEQ ID NO: 21568 - RNA, 9879 nt, Artificial Sequence
  derived and/or modified CDS sequence (opt6) from DENV-1__FJ547065__SS-prME
agcguaacuauguuguuaauguuaaugccaacagcauuggcuuuucaccuaacaacacgagguggagagccgcacaugaucguuaguaaacaagaaagagguaaaucauuacuauuuaaaacaagcgcaggaguuaacaugugcacccuuaucgcgauggauuuaggugagcuuugcgaggauaccaugacauauaaaugcccuagaauuacugaaacugagccugacgauguugacuguugguguaacgcaaccgauaccugggugacauauggaacauguagucaaaccggggaacacagaagagauaaaagguccguagcacuagcuccucacguaggacuaggauuggaaacaagaacagaaacauggaugucaucagagggugcguggaaacagauacaacguguagaaacgugggcauuaaggcacccuggguucacagucaucgcacuauuucuugcacaugcuauaggaacaaguauaacacaaaaaggaauaauauuuauauugcucaugcuuguaacgccuaguauggcaaugcgcuguguaggaauugguucucgcgauuuuguagaagggcuuuccggagcgacuuggguugacguaguucuugaacaugggucgugcguaaccacaauggcaaaagacaaaccaacucucgacauagaacuuuugaaaacagaaguaacaaauccggcaguucuuagaaaauuguguaucgaagcgaaaauuucuaauacgacaaccgacucacgaugcccaacacagggggaggcuacccuaguggaagaacaagaugcuaauuucguauguaggaggacuuuuguagacagagguuggggaaaugguuguggcuuauuuggcaaggguucacucauaacaugcgcaaaguuuaaauguguaacaaagcuagagggcaaaauagugcaguaugaaaaccuaaaauacucagugauuguaaccguacacacuggagaucaacaucaagugggcaacgaaucgacagaacacggaacaacagcuacaauaacuccacaagcaccuaccacggaaauccaacucacagauuauggagcuuuaacauuagacuguagcccccguaccggguuagacuucaaugagaugguacuacuaacaaugaaagaaaaaucuugguuaguucauaaacagugguuccuugaucucccucucccauggaccaguggggccagcacuagccaagagacguggaauaggcaggaccuucuagucacauuuaaaacagcucacgccaagaaacaagaggucgucguucuggguucucaagaaggagccaugcacacggcuuuaacaggagcgaccgagauucagacgaguggaacuacaaccauauucgcaggucaucuuaaaugccgauuaaaaauggauaagcucacccuaaaggguaugaguuacguaaugugcacaggaucauuuaaauuagagaaagaagucgcagagacccaacacgguacuguccuuguacaaauaaaauaugaagguacagaugcgccauguaagaucccauucaguacacaagaugaaaaagguguaacccaaaauggucgccuuauaacagcaaauccaauagucacugacaaggagaagccuguaaacauagaggcggagccacccuucggagaaaguuauauaguaaucggagcuggagaaaaggcacuaaaauuaucuugguuuaagaaagguucuucaaucgggaagauguuugaggccacagcgcgcggcgccagaagaauggcuauccuuggugauaccgcuugggauuucggcaguauaggcgguguauucaccagugucggaaagcugguucaucaaauuuucggaacagccuacgggguuuuauuuucaggagucucauggacuaugaaaauagguauuggaguacuacuaacauggcuaggccucaacucaagaucaacaaguuuaaguaugacaugcauugcagucgggcuaguuacccuuuaucuaggcguuaugguccaagcugacucaggauguguuauuaauuggaaaggacgagagcugaaguguggaagcggcauauuugucacgaaugaagugcauacguggacagaacaauauaaauuucaagcugauaguccaaagagacuaucagcggcaauagguaaagcaugggaagaaggcgucugugguauaagaucggcaacaagguuagaaaauaucauguggaaacaaauaucaaacgaauugaaucauauucuucuggaaaaugauaugaaauuuaccguaguuguuggcgacguugcugguauauuggcucaagguaagaaaaugauccguccacaaccaauggaauauaaauauucauggaaaucgugggggaaagcaaaaaucaucggagcagauguccaaaauacaacauuuauuauugaugggccaaauacccccgaaugcccggacgaccugcgcgccuggaacauaugggaggucgaagacuaugguuucggaauuuuuacaacgaacauuugguuaaaauuacgagauucuuacacacaagugugugaucaucgacuuaugagcgcagcaauaaaagauucaaaagccgugcaugcggauauggguuauuggauugaaagugagaaaaacgaaacguggaaauuagccagggcuucguuuaucgaaguaaaaacuugcauauggccaaaaagccacacauuauggucaaauggcguguuggaaucagagaugauuauuccgaaaaucuacggcgggccuauaucacaacauaauuacaggccaggauacuucacacaagcugccggcccauggcaccucgguaaacuagaacuugauuucgaucuuugugagggaaccacagucguagucgaugaacauugugggaacagggguccaagucuacgaacuaccacugugacaggaaaaauaauucacgagugguguuguagaucauguacauugccaccuuuaagauuucguggagaggacggcuguugguauggaauggaaauucgaccugucaaagaaaaagaagaaaauuuaguaaagucgauggucucugcgggaucaggugaagucgauucguucucauuggggcuacucuguauaucuauaaugauagaagagguuaugcguuccagauggagucgucguauguugaugacuggaaccuuggcuguauucuuuuuauuaauaaugggacaacuaacuuggaaugauuugaucagauuauguauuaugguuggugcgaacgcaucagaccgaauggguauggguacuaccuacuuagcacugauggcaacuuuuaagaugcguccaauguuugcaguagguuuacucuucagacgacuaacaagcagagaagugcuucuucuaacgaucggcuuauccuuaguagcgaguguagaauuaccaaauagcuuagaagaacucggugauggacuagcaaugggaauuaugauacucaaacuucuaacagacuuucaaagucaccaacucugggcaacauuacucaguuugaccuuuauaaaaacuacguuuaguuuacacuaugcuuggaaaacaauggcaaugguccugucaauaguaucauuauuuccucuaugcuugagcacuacgagccagaaaacuacuuggcucccaguauuauuagggagucuggguugcaagccucuuacuauguucuuaauagcagaaaauaagauauggggcagacgaagcuggccauuaaaugaaggaauaauggccgucggcaucguuagcauucuccuaagcucguugcucaaaaacgaugugccguuagcaggaccauuaauagcuggcggaaugcuuaucgcaugcuauguuauaaguggaucgucagcggaucuaucucucgaaaaagcggcagaggucaguugggaagaagaagccgaacauucaggagcaucgcauaacauuuugguggaaguucaagaugaugguacgaugaaaauuaaggacgaggagcgagaugauacuuugacaauauuauugaaggccacguuauuggcuguaucaggaguauauccucuguccauuccugcaaccuuauucgugugguauuuuuggcagaaaaagaaacaaagaagcgggguucuuugggacacuccaaguccuccggagguagaaagagcuguuuuagacgaugggauuuacagaaucaugcaacgaggcuuacuagggcgaagucaagucggaguggguguauuccaagaaaacgucuuccacacaauguggcauguaacacggggugccguucuuauguaccaagguaagagacucgagccaucaugggcaagugucaagaaagaucuaaucucguacggaggaggcuggagguuacaagggaguuggaacacaggagaagaaguacaaguaauagccguagaaccaggcaaaaaucccaaaaauguacagacugcacccggaacauuuaaaacuccugagggagaagucggagcaauugcauuagauuuuaaaccugguacaagcgggucaccuauugugaaccgagaaggaaaaauagucggauuguauggaaacgguguaguaacaacgagcggaacauaugucucggcaaucgcgcaagcaaaagcaucacaagagggcccauuaccugaaaucgaggacgaaguauuuagaaagagaaaucuuacaaucauggaccuucacccaggaucgggcaagacccguagauauuugccagcaauaguaagagaagcgauaaagcgcaaacugaggacacuuaucuuagccccaacucgcguagucgcaucagagauggcagaagcacugaaagguaugcccauucgcuaccagacgaccgcaguuaaaagcgaacacacugguaaggagauaguagauuuaaugugucacgcuacauuuacgaugcgucuacugucaccaguaaggguucccaauuacaacaugauaauaauggaugaagcucacuuuacagauccgagcuccauagcagcccgagguuacaucaguacacggguuggcaugggagaggccgcagcaaucuucaugacugcgacaccucccgggagcguagaagcguucccucaaucaaacgccguuauacaagaugaggaacgggauauaccagaaagaaguuggaacuccggauaugaauggauaacggacuucccggguaagaccguuugguucguuccuuccauuaaaucgggcaaugauauagcaaacugccuacguaagaacggcaaacgaguaauacaacuaaguagaaagacguuugauacugaauaucagaaaacucguaauaaugauugggauuaugucguaacgacugacauaucggaaaugggugcaaauuuuagagccgauagagugauugacccacggcguugccuaaaaccggugauccuaaaagacggacccgaacggguaaucuuagcaggaccaaugccaguaacgguagcaucagcagcgcaacgucgcggcaggaucgggagaaaccauaauaaagaaggagaccaauacauauauaugggucaaccucuuaauaacgacgaagaucaugcucacuggacugaagccaagauguugcuggacaauauuaauaccccagaggguauaauaccagcccuguuugaacccgaaagagaaaagagcgcggccauagauggagaauauagauuaagaggcgaagccaggaaaacguuuguugaauuaaugagacgcggugaccuuccaguuuggcuaagcuacaaaguugcauccgagggcuuucaauacucugacagaaaaugguguuucgauggugagagaaacaaucaaguccuggaagagaacauggacgucgagauauggacgaaagaaggugaaagaaagaaauugcgaccacguuggcuagaugcccgaacauacagugacccgcuugcucuuagagaauuuaaggaguuugcagcggggagaagaucggucucaggugaucucauccuagagauaggcaaauugccacaacauuuaacccagcgagcacaaaaugcgcuagacaaucuagugaugcugcauaauuccgagcaaggaggcagagcguaucgucaugccauggaagaacugccagacacaauagaaacucugaugcugcuagcuuuaauugcgguauuaacaggcggcgugacucuauuuuucuugucagggaggggucuaggaaagaccucuauugggcuuuuauguguaauggcuucuucugugcuccuguggauggcaaguguugaaccccauuggauagcagcaucaauaauucuugaguucuuuuuaaugguauuacuuauuccagaacccgaucgucaaagaacaccccaagacaaccaguuagcuuacgucgugauaggacuguuauucaugaucuuaacaguugcugcaaaugaaaugggauuacuagaaaccacgaagaaagauuugggaauaggucauguugcuguugagaaccaucaccaugcggcaaugcuagacguagaccuacauccggcaucugcauggacacuauacgcgguggcgacgacaauaauuacaccgaugaugcgucauacuaucgagaauacuacagcuaauaucucucuaacugcaauagcaaaucaggcggcaauacugauggguuuagacaaaggauggcccauaaguaagauggauauaggaguaccccuccuggcuuuggguugcuacagccagguuaauccccucacucuuacggcagcgguucucauguuaguagcgcacuaugcgauaauagggccggguuuacaagcuaaggcuaccagagaagcacaaaaacguacagcggcaggcauaaugaagaacccaacuguagauggaaucguugcuauagaccuagacccagugguauacgacgcaaaauuugaaaaacaacuugggcaaaucaugcuauuaauacuguguacuucgcagauauuacugaugcgaacuaccugggcuuugugcgaaaguauaaccuuagcuacagguccuuugaccacgcugugggaaggaucaccagguaaauucuggaauaccacgauagccguaagcauggcuaauauuuuucgaggaucuuauuuagcuggagcugguuuagccuuuagucuaaugaaaagucuagggggcggacgucgaggcaccggcgcgcagggcgaaacccuaggagaaaaguggaagagacaacuuaaucaguuguccaagucggaauuuaauacuuauaaaagaaguggaaucauggaaguugaucguucagaagcaaaagaaggacuaaaacgaggagagaccacuaaacacgcgguaagcagaggaaccgccaaacuccgaugguucguugaaaggaaucuagucaaaccugaagguaagguaauugaucuugguuguggacgaggaggauggucauacuauugugcaggucuaaagaaaguaaccgaaguaaaaggcuacacaaaaggaggaccaggacaugaggaaccaauaccuauggccacauauggguggaaucugguaaaacuucacagugguaaagacguauucuuuauaccaccagaaaaaugugacacauuauuaugugauauaggugaaagcucacccaacccaacaauagaagaaggacggacauuaagagugcuaaaaaugguggaaccgugguuacgggguaaccaauuuuguauaaagaucuugaacccauauaugcccucaguagucgaaacucuugagcaaaugcaaagaaaacauggaggcauguuagucagaaauccucucucgagaaauagcacgcaugagauguauugggucaguuguggaaccgguaacauugucagugcgguuaacaugacuucuagaaugcuuuuaaaccguuuuacuauggcacaccgaaaaccuacauacgagcgugacguagaccucggagcugggacucgccauguagccguagaaccagaaguagccaaccuugacauaauagggcaaagaauagaaaacaucaaacacgaacauaaaagcacuuggcauuaugaugaagauaacccauauaagacaugggcuuaucacggaucauaugaaguuaaaccuagcggaagugcuucuagcauggucaaugggguagugaaacuuuuaacuaaaccaugggauguuauaccaaugguaacacaaaucgcaaugacggacacuacacccuuuggucagcaaagaguuuuuaaagaaaaaguugauacacgaacaccgaaagccaaaagagguacagcucagauuauggaagugacggcgaaauggcucuggggauuucugucaagaaacaaaaagccuaggaucugcacccgagaagaauuuacaagaaaagucaggucuaaugcagccauaggcgccguauucgucgacgaaaaucaauggaauagugccaaagaggcggucgaagacgagagauucugggauuuaguacaccgagagagagaguugcauaaacaaggaaagugcgccacuuguguuuauaauaugaugggaaaaagagagaagaaauugggagaguucgggaaagcgaaaggaaguagagcaaucugguacaugugguugggagcacgauucuuagaguucgaggcgcuggguuuuaugaaugaagaucacugguucagucgagagaauagucuuucggguguggaaggcgaaggauuacauaaauuaggauacauccugcgagacauauccaaaauaccuggcgguaauauguaugccgaugauaccgcaggaugggauacgagaauaacugaagaugaucugcaaaaugaggcgcgcauaacagacauaauggaaccagagcacgccuugcuugcaaaaagcauuuuuaaacucacauaccaaaauaaagugguacggguccaacgacccgcgaaaaacgguacuguaauggacguaaucucgagaagggaucaaagaggaaguggucaaguagguacauacggauuaaauacguucacuaauauggaagcacaacuaaucagacaaauggaauccgaaggcauuuucucaccuagugaauuagagacgccuaaccuagcagaacguguauuagauugguuagaaaaauacggcguagaacgucucaaaagaauggcuauaagcggugacgacuguguaguaaagccaaucgacgaucgcuuugccacagcuuuaaccgcccuaaaugauaugggaaaaguaagaaaggacauaccccaaugggagccaucaaaaggauggaacgacuggcagcaaguuccauuuugcucucaucauuuccaucaacuuauuaugaaagacggccgcgagauuguugucccuugucgaaaccaagaugagcuuguaggacgugcaaggguaucacagggagcugguuggucuuuacgagagacggcauguuuagggaaaaguuacgcacaaauguggcaacuaauguauuuucaucgcagggaccugcgucuugcugcaaacgcaauuugcucggccguaccaguagacuggauaccaacuucgagaaccaccuggucuauucacgcucaccaccaguggaugacgacggaagauauguuaucugucuggaacaggguuuggaucgaagagaauccuuggauggaagauaaaacucacauuucuagcuggggugacgugccauaucuagggaaaagagaagaccaaugguguggaucacuuauaggauuaacugcccgggcgaccugggcuacuaacauccaaguagcgauuaaucaaguacgacgacuaauuggcaaugaaaauuaccuugacuacaugacuucaaugaaacguuucaaaaaugaaagugauccagagggggcucucugguaa

SEQ ID NO: 21569 - RNA, 9879 nt, Artificial Sequence
  derived and/or modified CDS sequence (opt6) from DENV-1__FJ410230__SS-prME
ucaguaacgaugcuauuaaugcuaaugccaacugcguuggcauuccacuuaacgacaagaggaggugaaccacacaugauugucuccaaacaagaaagaggaaaaucacucuuauucaaaaccagugccggggucaauaugugcacguuaaucgcaauggaucuuggagagcugugugaagacaccaugacauacaaauguccccggauaacagaaaccgaaccagacgauguugauuguuggugcaaugcgacagauacaugggugacauauggaacaugcucgcagacaggggaacacagaagggauaaaagaucaguagcauuagcuccacacguuggucuaggguuggaaacgcgcacagaaacauggauguccucggaaggcgcauggaaacaaauucaacgagucgaaacaugggcuuuaagacacccuggauucacaguaauugcacucuucuuagcacacgcuauagguacaagcaucacgcaaaaaggcauaauuuuuauccuacucauguugguaaccccauccauggcaaugagauguguuggaaucggaucucgcgacuuuguggaagguuuaaguggugcaacauggguugauguuguguuagaacauggcagcugcguaaccacaauggcaaaagacaaacccacacuagauauagaauuauuaaagacugaagucacuaacccugccguacuaagaaaguuaugcauagaggcaaaaaucucaaauacuacaacagauucacggugcccuacacagggugaagcuacacucguagaagaacaagacgcaaauuucguaugucgaaggacuuucguugauagggggugggguaaugggugcggacuauuuggaaagggcucauuaauuacuugcgcaaaguucaaauguguaacaaaauuggaagguaaaauaguucaauaugaaaaucuaaaguacaguguuaucgugaccguccacacaggagaucagcaccagguaggcaacgaaaguacagaacaugggaccaccgcuacaaucacaccacaagcaccaacuacugagauucaacugacugauuauggagcuuuaacgcuugacugcucaccuaggacaggauuggacuuuaacgaaaugguacuccuaaccaugaaggagaaaagcugguugguucauaaacagugguuccuagaucuaccccugccauggacaagcggagcaaguacaucucaggagacauggaaucgccaagaucuauuaguuacuuucaagacggcgcaugccaagaaacaagagguuguuguacuugggagccaggaaggugcaaugcacacagcauuaauaggugcaaccgaaauucagacaagugggacgacaacgauauuugcuggucauuuaaaaugccgucugaaaauggauaaacuaacacucaaagggaugucguauguuaugugcacagggaguuucaaauuagaaaaggaauuggcagaaacacaacaugguacaguauuaguacaaauaaaguaugaagggaccgaugcuccauguaaaauuccauuuuccacacaggacgagaaaggaguaacgcagaacggaagguuaauuacagcuaaccccaucguuacugauaaagaaaaaccaguaaacauagaagcugaaccuccguuuggggaaucauacaucguaauuggggcaggagaaaaagcauugaaacuuagcugguuuaagaaaggaucauccauugggaagauguuugaggccacagcaagaggggcccgaaggauggcaauucucggggacacagcgugggacuuuggaaguauuggagggguauucacaaguguagguaaacuuguucaccaaauauuugguaccgccuaugguguauuguucagcggcguaucauggacgaugaaaaucgguauaggaguauuacuaacaugguuaggccugaauagccguucaacuucacuuaguaugacaugcauagcaguaggauuaguuacacuuuaucuuggaguaaugguucaagcugauuccgguugugugauaaauuggaaaggaagagaacuaaaaugcggcagcggaauauuuguuacaaaugaaguucacacauggacugagcaauacaaauuucaagccgacucaccaaagagacuaucugcugcaauagggaaggcuugggaagagggaguauguggaauaagaagugcaacacgauuggaaaauauaauguggaagcaaauaucaaaugaauuaaaucacauacuacuugaaaaugauaugaaauucacaguaguugugggagaugucgcgggcauacuagcucaaggcaagaaaaugauaagaccucaaccuauggaacauaaauauucauggaaaaguuggggcaaagcaaaaauuauaggugcugauguacaaaacacuacuuuuauaauugauggaccuaauacaccagagugccccgaugaccagagagcuuggaauauaugggagguagaggauuaugguuuugguauauucacaacuaauaucuggcuaaaacuucgagauucauauacacaaguuugugaccauaggcuuaugagcgcagcaauaaaagauuccaaggcuguucacgcugacauggguuauuggauagaaucagagaagaacgaaacauggaaauuggcaagggcgucauucauugaaguaaaaacuuguauauggccuaagucucacacuuuauggucuaacgguguacuagaaagcgaaaugaucauuccaaaaaucuauggcgggcccauuagucagcacaauuaccguccaggcuauuuuacucaaacagccgguccuuggcacuugggcaagcucgaacucgauuuugaccuaugugaaggcacaacaguaguaguagacgaacacuguggaaaucgagguccgagcuuaagaacaacuacagugacggggaaaauuauacaugaauggugcuguagauccugcacguugccuccccuaagauucagaggcgaagacggcuguugguauggaauggaaauaagacccguuaaagaaaaagaagaaaacuuaguaaagucgaugguauccgcgggaagcggagaaguagauagcuucucgcugggucuguuaugcauaagcauaaugaucgaagaagucaugcggucucgguggucccgaaaaaugcuaaugacugggacauuagcaguauuuuuccucuuaauuaugggccaacucacauggaacgaucuaaucagacucuguauuauggugggcgcgaaugcaucagaucguaugggcaugggaaccacauaucuugcguuaauggcaacauucaagaugcgaccuauguuugcuguugguuuacuguuuagaagacuaacuucgagagaggucuugcuucuaacaauuggguuaucacucguugcgagugucgaauugccaaacucacuugaagaauuaggggauggcuuagcaaugggaaucaugauacucaaguuauuaacagauuuccaaagucaucaguuaugggcgacuuugcuaagucucacauuuauaaagacaacauuuucguugcacuacgcguggaaaacuauggcuaugguguuaagcauaguuucucuguuuccccugugcuuaaguacaacaucucagaaaacuaccuggcugccgguauuauuggguucccugggauguaaacccuuaacuauguuccuaauagccgaaaauaagauuuggggacggagaucauggccucugaaugaagguaucauggcuguuggaaucguauccauuuuauugaguucacuauugaaaaaugacgucccccuugcggguccccuuauugcgggcggcauguuaaucgcaugcuauguuauauccggcuccuccgcagauuuauccuuggagaaagcugcagaaguaucuugggaggaagaagcugaacacucaggugccucacauaacauacucguugaaguacaagaugacgggacaaugaaaauuaaggacgaagaaagagacgauacgcuuacuauccuacucaaagcuacgcuacucgcagugucggggguuuauccauuaucuauacccgcaacuuuauuugugugguacuucuggcaaaagaagaaacaaagaaguggcguacuuugggauacuccguccccgccggaagucgaaagggcaguacuagaugacggaauuuauaggauaaugcaaagaggauuacugggacgaagccaaguaggagucggcguguuccaagaaaauguuuuccauacgauguggcauguaacaagaggagccguauuaauguaccaggggaaaagguuagaaccaagcugggccagugugaagaaagaucugauauccuacgguggagguuggagacuucaagggaguuggaacacuggcgaggaagugcagguuauagccguagaacccggaaagaacccuaaaaaugugcaaaccgcuccaggaacauucaaaacacccgaaggcgaaguuggcgcaauagcuuuagauuuuaaaccagguacuucaggaagcccuauagucaauagagaagguaaaauugugggauuguauggcaaugguguagugacaacaucugggacauacgucucugcaaucgcccaagcuaaggcaucacaagaagguccacugccugagauagaggaugaagucuuucggaaacgcaauuugacuauaauggauuuacacccaggcucaggcaagaccagacgauaucuacccgcgauagugcgcgaagcaauaaaaaggaaauugcgaacauugauauuggcaccaacgagagucgucgcaagcgagauggcugaagcguuaaagggcaugcccauaagguaccagacaacagcaguaaaaagugaacauaccgguaaagaaauaguggaccugaugugccacgcuacauuuaccaugcguuuauuaagcccuguacggguucccaacuacaacaugauuauaauggaugaagcacauuuuaccgacccuucgucgauagcagcgagagguuauauuagcacacgggucggcaugggugaagcagcggcgauauuuaugacugccacaccgccuggaucaguagaagccuuuccucagaguaaugcggucauacaggacgaagaaagagauauaccagaaagaucauggaacucgggauaugaguggauaacagauuuucccggcaagacugugugguuugucccgagcauuaaaucggggaaugauauugcgaauuguuuaaggaaaaaugguaaaagaguuauacaguuaaguaggaagaccuuugacacugaauaucaaaagacuaagaacaacgacugggacuacgucguaacuacagauaucuccgaaaugggugccaauuuccgagcagaccgagugauugauccacgaagaugccuuaaacccguaauucuaaaagauggcccagaacgaguuauacuggccggaccaaugccaguaacagucgcaucagcagcccaacggaggggucgaauaggaagaaaccauaauaaagaaggagaccaauacauauacaugggacagccauuaaauaaugaugaagaucacgcccauuggacagaggcaaaaauguugcuggacaacauuaauacaccugaaggaaucauaccagcccuauucgaacccgaaagagagaagucggccgcaaucgauggggaauauagauuaaggggagaagcuagaaagacuuuuguggaacucaugaggcguggggaucuacccgugugguuaucauauaaagucgcaucggaaggauuucaauacucugacaggagauggugcuuugauggugaacgcaauaaucaaguccuggaggagaauauggauguugaaaucuggacgaaagaaggcgagcguaagaaauuaagaccgagguggcuagaugcgagaacuuacucagauccacuagcacuucgugaauuuaaagaauuugccgcaggaagaaggaguguuucuggcgacuuaauucuagaaauagguaaguuaccucagcauuugacccaaagagcucagaaugcuuuggauaaccuugucaugcuccacaauucagaacaaggaggucgggcuuaucgucacgccauggaagaacuaccggacacaauagagacauugaugcucuuggccuugaucgcaguauuaacgggaggagucaccuuauucuuuuuaucuggcagaggguuaggcaaaacaaguauuggacuuuuauguguuaugaguucuucugugcuauuauggauggccagcguugaaccacacuggauagcagccucuauaauacuagaauuuuucuuaaugguauuacuaauaccagaaccggaucgucaaaggacaccucaagauaaccaguuagcauauguaguaaucggacuauuauuuaugaucuugaccguggccgcaaaugaaaugggacuuuuagagacaacaaagaaggacuuggguaucggccacguagcuguggagaaucaccaucacgcugcaauguuagauguugaucuacacccugcaagcgcauggacgcuauacgcgguugcgacuacaauaaucacuccuaugaugcgacacacuauugaaaacacgacagcaaacauuucccuaacugcaauagcuaaccaagcugccauauuaauggguuuagauaaaggauggcccauaucgagaauggauauuggaguuccccuucuugcauuaggauguuauucucaaguuaauccccuuacccuaacagcagcaguucucauguuaguugcacauuaugccauaauugggccgggacuacaggcuaaagcgacucgagaagcccagaaaaggacagccgcaggaauuaugaaaaauccaaccguugacggaauaguugcgaucgacuuagacccugugguuuaugaugcaaaguucgaaaaacaauugggccaaaucauguuauuaauacuguguacuucccaaauacuauugaugaggacgacaugggcauugugcgaaagcauaacauuggcuacaggaccacuaacgacacuaugggaaggaaguccuggaaaguucuggaauaccaccaucgcugugaguauggcaaauauauuuagagggagcuacuuagcaggagcuggauuggccuuuucauuaaugaaaucacuuggaggaggucguagaggaacaggagcucaaggggagacauuaggugaaaaauggaaacgacaacuaaaucaauuaagcaaaucugaguuuaauaccuacaagcguucagggauaauggaagucgauagaagcgaagcuaaggaagguuuaaaaaggggagagacgacuaaacaugcuguaagucgaggcacugcuaaacugaggugguuuguagaacgcaaccuuguaaaaccagaagggaagguaauagacuuaggaugcgguagaggaggauggucauauuacugugccggacuaaagaaagugaccgaaguuaaaggauauacaaagggugguccgggccacgaggaacccauuccaauggcuacauauggcuggaaucuaguuaaauuacacagcggaaaagacguauucuuuauacccccagaaaagugcgauacacuuuuaugcgauauuggagaaaguucgccaaauccaacgaucgaggagggccggacauuaaggguuuuaaagauggucgaaccauggcuaagagggaaucaauuuugcauuaaaaucuuaaaccccuauaugccuagugugguagagacgcuagaacaaaugcaacguaagcauggaggaaugcuugugagaaauccccucucaaggaauaguacucaugaaauguauuggguuucaugcgguacagguaauauuguaucggcgguuaacaugacaucaaggauguuacuaaaucguuugaccauggcacauagaaaaccaacguacgaacgggauguagauuuaggugcaggaaccagacauguagcgguagaaccagagguugcgaaccuugauauuaucggacaacgaauagagaauauaaagcaugagcauaaaagcacuuggcacuacgaugaagacaauccguacaaaacaugggcauaucaugggucuuaugaaguuaaaccaucgggaucugcaucuaguauggugaaugguguaguuaagcuguuaacuaaaccuugggacguaauaccaaugguaacccaaauagcgaugacggacacaacaccguuuggucaacaaagagucuuuaaagaaaaaguggacacacguacaccaaaggccaaacgaggcacagcacaaauuauggagguaacagcuaaaugguuauggggcuuucuaagucguaacaagaagccacgaauuuguacuagagaggaguucacucggaagguccguucgaaugcagccauaggagcagucuucguugacgagaaccaauggaacagugcaaaagaagcgguggaagaugaacgguucugggauuuaguccaucgugaacgagagcuacauaaacaagggaaaugugcaaccuguguauauaauaugauggggaaacgugagaagaaauuaggugaguuuggcaaagcuaaaggcucaagggcuaucugguacauguggcugggagcuagguuucuagaguucgaggcacucgguuucaugaacgaagaucauugguucucccgggaaaauucauuaucgggaguggaaggagaaggacuucacaaacucggauauauccuaagagauauaagcaaaauaccgggaggcaacauguaugcagacgacacagcagggugggauacgcguaucacugaagaugacuugcaaaaugaggcucguauuacugauauaauggaaccugaacaugcgcuacuagcgaaaaguauauuuaaacucacauaucaaaacaaaguuguuagagugcaaagaccugcaaagaaugguacugugauggaugugauaagccgacgggaucaacgagguagcggacaaguaggcacuuacggguugaauacuuucaccaauauggaagcccaauuaauuagacaaauggagucggaagggauauucaguccgucagaacucgaaacgcccaaccuagccgaaaggguauuagauuggcuagaaaaauauggagucgaacgacuaaaaaggauggcgauuaguggagaugauugcguugucaagccaauagacgacagguuugcaacugcucuaacugcauuaaaugacauggguaaaguaaggaaagacaucccucaaugggaaccuaguaaagguuggaaugauuggcaacaagugccuuuuugcagucaccauuuccaccaguugauaaugaaagauggaagagaaauuguuguaccaugccgaaaucaagaugaauuaguagguagagcucgcguuagucagggcgcgggauggucauuacgugaaacagcgugucuuggcaagucuuaugcgcaaauguggcaacuuauguauuuccauaggcgugaucugcgacuugcagcuaaugcuauuuguagugcggugcccgucgauuggauaccuacuucgaggacgacuuggagcauacacgcgcaccaucaauggaugacaaccgaagacaugcucaguguauggaacagaguauggauagaagagaacccauggauggaagauaaaacacauauaucgucuuggggagacguuccauacuuggggaaacgagaagaucaguggugugguucucuuauaggauuaacggcucgugcaacaugggcaacgaacauacagguagcuauaaaucaagucagaagacuaauuggaaaugaaaauuauuuagauuauaugacauccaugaagcgauuuaaaaacgaauccgauccggaaggggcguuaugguag

SEQ ID NO: 21570 - RNA, 9879 nt, Artificial Sequence
  derived and/or modified CDS sequence (opt6) from DENV-1__FJ410231__SS-prME
agugucacuauguuacuaauguugaugccuacggcgcuggcauuccauuuaacuacucgaggaggcgaaccucacaugauaguaaguaaacaagaaagaggcaaaagccuguuauuuaaaacgucugcaggcguuaauauguguacauuaauagcaauggaucuaggugaacuuugcgaagauacaaugacuuacaaaugcccgagaauaacggaagucgaaccggaugacguagauuguugguguaacacgaccgacacauggguaacuuaugguaccugcagccaaacuggagaacauagacgugacaaacguucuguagcacuugcaccucauguaggauuggguuuggaaacuagagcagaaacauggaugucuucagaaggagcauggaaacaaauccaaaaaguagaaaccugggcacuuagacacccuggauuuaccgugauagcacuauuuuuggcacaugcaauugguacgaguaucacgcaaaaaggaauaauauuuauacuacuaauguuaguuacuccuagcauggcaaugcggugcguuggaaucggcaguagagacuucguagaaggcuuauccggugccacuuggguugacguagugcuagaacauggcuccuguguuacaacuauggcaaaagacaaaccaacccuugacauagagcuacugaaaacugaaguuaccaacccugcaguauuacguaaacuauguaucgaagcaaaaaucaguaacacgacaacugauucuagguguccuacacaaggugaggcuacgcuuguagaagaacaagacgcgaacuucguaugucgccgaacauucguagauagaggauggggaaacggguguggccuuuuuggaaaaggcucauuaauaacgugcgcgaaauuuaaaugcgugacuaaacuggaagguaaaauuguucaauacgaaaaccuaaaauacaguguaauagugacuguacacacaggcgaucaacaccaaguuggaaacgaaucgaccgaacauggaacaacugcaacgauuacgccucaagccccaacaagugagauucaauuaaccgauuauggagcacuuacucuagauuguucaccuagaacaggacuagauuucaaugaaaugguucuuuuaacuaugaaagaaaaauccugguuggugcacaaacagugguuuuuggacuugccccugccauggacgucaggcgccagcacaagucaggaaacuuggaauaggcaggaucuauuaguuacuuuuaaaacagcccaugccaagaaacaagaaguaguuguguuagguucccaagaaggggcuaugcacaccgccuuaacaggggcgacagaaauccaaacaagugguacaacaaccaucuuugcuggccaucuaaaaugucgacuuaaaauggauaaauuaacauugaaaggaaugucuuacguuauguguacugggaguuuuaaauuagaaaaagaaguagcggaaacucaacaugguacgguccuaguucaaaucaaauacgaaggaacugacgcuccuugcaaaauacccuucucaacacaagaugaaaaaggggucacucaaaauggaaggcuaaucacggcaaacccaauuguuacugauaaagaaaaaccaguaaauauugaagcagagcccccauuuggagaauccuauauuguaaucggggcgggagaaaaagcccugaaauugucuugguucaagaaagguucguccaucggcaaaauguucgaagcaaccgcucgcggagccagaaggauggcaauccucggagacaccgcaugggauuuugguuccauagggggaguauucaccuccguugggaagcuaguacaccaaauauuuggaacagccuauggaguuuuauucucuggaguguccuggaccaugaaaauaggaauuggaguguuacuuacgugguuaggauuaaacucgagaucuacaucauuaucaaugaccuguauagcaguuggauuaguaacauuauacuuagggguuaugguucaagcggauucaggauguguuauuaacuggaaagggcgagaacucaaauguggauccgguauauucguaacuaaugaaguucauacuuggacugagcaauacaaauuucaggcagauucucccaaacgcuuaagugcggcuauaggcaaagccugggaagagggagugugcggaauaagaagcgcgacacgcuuagaaaacauaauguggagacaaauaagcaacgaguugaaucacaucuuacuugaaaaugacaugaaauucacaguagucguaggagacguaguaggaauauuagcccaggggaagaaaaugauaaggccucagcccauggaacauaaauacucuuggaaauccuggggaaaagcaaaaauaauuggggcggaugugcagaauacuacguuuauuauugacggacccaacacaccugagugcccagaugaucaaagagcuuggaauauaugggagguugaagauuacggcuuuggcauauucacaacuaacauauggcuaaaacuacgagauucuuauacgcaagugugugaccacagacucauguccgcagcuauuaaagacaguaaagcaguacaugccgacaugggcuauuggauugaaagcgaaaagaaugaaaccuggaaauuagcucgggccaguuucaucgaaguaaaaacuuguauauggcccaagucucacacucucuggucaaacggcguacuugaaucggagaugauaaucccaaaaauauaugguggaccaauuagccaacauaacuaccguccaggauacuucacgcaaacagcaggucccuggcaucuaggaaaauuagagcuggauuuugaucuaugcgaagguacaacgguaguaguggaugaacacugugggaaucguggcccuucauuaagaacaacaacaguuacaggaaagaucauacacgaaugguguugcagaucuugcacacucccaccuuuacguuuuaaaggagaagauggaugcugguauggcauggagauacgaccagucaaagaaaaggaggagaacuugguuaaaagcaugguaagcgccgggucuggagaaguagacucuuucucucuaggcuugcuguguaucucaauuaugauagaagagguuaugcgaucacguuggucucgaaaaaugcugaugaccgguaccuuggccguauucuuuuuauugauaaugggacaacucacguggaacgaucuuauacgaucuugcauuaugguaggagcaaaugcgucugaccgaauggguaugggcacuacuuaccuagcacuaauggcgacauuuaaaaugagaccaauguuugcggucgggcuauuguuuagaagguuaacgaguagagaaguguuacuauuaacuauaggucugucgcuaguagcuaguguagagcuaccaaauucauuagaggaauuaggcgacgguuuagcuauggggauaaugauucuuaaacuuuuaacagauuuucaaucauaucaacuaugggcgacucuuuugucacugacuuucauuaaaacaaccuucucauugcauuaugcuuggaaaacuauggcaaugguacuuaguauuguuagcuuauuaccacugugucucuccacuacaucacagaaaacuacaugguuaccaguauuacuaggcagucuuggaugcaaaccgcugacaauguucuuaauagccgaaaacaaaauauggggcagaaaaucuuggccuuugaacgaaggcauuauggcagucgguaucguuucuauacuccuauccagccuucucaaaaaugacguuccuuuggccgggccguuaaucgccgguggcauguuaauagcaugcuauguuauuuccggcaguucugcagaccuaucacuugagaaagcggcagaaguaucaugggaggaagaagcugaacauucaggagccagccacaacauauuaguugaaguccaagaugacggaacaaugaaaaucaaagaugaggaacgcgaugauacauuaacuaucuuacuaaaagcuacacuccuggcuguuaguggagucuacccucuauccauaccggcgacgcuauucguaugguacuucuggcagaagaagaaacaaagaucuggaguuuuaugggacacaccuucaccuccggaaguagaaagagcaguauuggaugacggaaucuacaggauaaugcaacggggacuccuuggaagaucgcaagugggagucgguguuuuccaagagaaugucuuucauacaauguggcacgucacucgaggagcaguucuaauguaccagggaaaacgacuggaaccaucaugggcaucagugaagaaagaccucauauccuacgguggaggauggaggcugcagggcaguuggaacaccggggaggaaguacaaguuauugcgguugaaccaggcaaaaacccuaaaaaugugcagaccgcgccagguaccuuuaagacaccggaaggcgaaguaggugcaaucgcccuugauuucaaaccuggaacaucgggaucacccauaguuaaucgagaggggaaaauagucgguuuguauggaaauggaguaguuacaaccucgggaaccuauguaucagcuauagcacaagcaaaggcuucucaagaagggccacugccagaaauugaagaugaaguuuuuagaaagaggaauuuaacaauaauggauuuacauccugguuccggcaagacuagaagauaucuaccugcgauaguuagagaagcaauuaagcgaaaacuuagaacgcugauauuggcaccuacucguguaguagccucugaaauggcagaggcuuuaaaaggaaugccuauccgauaucaaaccaccgcaguuaaaagugagcauacaggaagggagauaguggauuuaaugugccaugcgacuuuuacaaugaggcugcugucccccguuagagucccgaauuauaauaugauaaucauggacgaggcccauuucacugacccaaguucaaucgcugcccgagguuacauuaguacaagaguuggaaugggagaggcugccgccaucuucaugacugccacgccuccaggaagcguggaagcguucccgcaaaguaacgcagucauacaagaugaggaacgagauaucccugaaaggucuuggaauagcggcuaugaauggaucacagacuuuccaggcaaaaccgucugguucguaccuucaauaaaaucugguaaugacauagcuaacugccugcguaagaacggaaaaagaguuauacaauuaucgagaaaaacuuucgauacugaguaucagaaaacgaaaaacaacgacugggauuacguugugacaacugauauuuccgaaaugggcgcaaauuuucgagcugauaggguaaucgauccuaggagaugucuaaagccaguaauauuaaaagaugguccagaaagagucauauuagcuggaccaaugccagugaccguggcaucagccgcccaaagaaggggaaggauaggcagaaaccacaauaaagaaggggaucaauacauuuacaugggacagccgcuaaauaaugaugaagaucaugcgcacuggacagaggccaaaauguugcuugauaauaucaauacgccggaaggaaucaucccagcucuuuucgaaccugagagagagaaaagugcagccauagauggggaauacagguuacgaggugaggcaaggaagaccuuuguggaauugaugagaagaggugaccuaccagucugguuaaguuauaaggucgcaagugaagguuuccaguauucugaucguagauggugcuuugauggagaaaggaauaaucagguuuuagaagagaauauggacgucgaaauuuggacgaaggagggcgagaggaagaaacuucggccccguuggcuugaugcuagaacuuauucagauccgcuagcguugagagaauuuaaggaguuugcagcggguaggaggaguguuuccggagacuuaauuuuggagauuggaaaacuaccccaacauuuaacccaaagagcgcaaaacgcucuugauaaccuuguaauguuacacaacagugaacaagggggcagagccuacagacaugcgauggaggagcuacccgauaccauugaaacucucaugcuacucgcccuuauugcgguccuuacgggcggcgugacucuguucuucuuaagcgggaaaggccuuggcaaaacaaguauugguuuacuuugcgucauggcuaguagcgcuuuacuauggauggcaucagucgaaccucauuggauugccgcaagcaucauccuugaguuuuuccuuaugguucuauugauacccgaaccugacaggcaaagaacaccccaagauaaccaauuagcguaugucguuauaggauuacuuuucaugauccuaacuguagcagcaaacgaaaugggauuguuagaaacuacgaaaaaggacuugggcauaggucaugucgcuguagagaaccaccaccacgcuacgaugcucgacguugaccuccauccggcaucagcauggacucuauaugccguugcgacaacgauaaucaccccgaugaugcgucauaccauagaaaacacaaccgcaaauauuaguuuaacugcaauagcaaaccaagccgccauucucauggggcuagauaaaggcuggccaauaagcaagauggauauaggcgucccuuuauuagcauugggaugcuauagucaaguaaauccuuuaacacuaaccgcugcaguacucaugcuagucgcucacuaugcuauuauaggucccggucuacaagcaaaagcuacaagagaagcucagaaaagaacagcugcaggcauuaugaaaaauccuaccguagaugguauaguagcuauagaucuagauccugucguauacgaugcaaaauuugaaaaacaacuaggacagauaauguugcuaauccuauguacaagccaaauauugcuaaugagaacgacgugggcacucugcgaauccaucacucuagcuacaggucccuuaacaacacugugggaaggaucaccaggcaaauuuuggaacacaacgauugcaguaucaauggcaaauauauuucgaggaucauaucuugcuggagcgggguuagccuuuaguuugaugaaaucacuaggugguggcaggcguggaaccggugcacaaggggagacuuuaggagagaaauggaaacgccaauuaaaccaguugucuaaaagcgaauuuaauacuuauaaaagaagcgggauaauggaaguugaucgaucugaggccaaagagggccucagaaggggagaaacaacaaaacacgcaguaucaagaggcacugcaaaguuacgaugguuuguugagaggaaucuugucaagccagaggguaaaguuaucgauuuaggaugcggaagagguggauggucuuacuauugugcuggucuuaagaaaguaacagaaguaaaaggguauaccaagggaggaccaggucaugaagaaccaauaccgauggcuacauauggguggaaucugguaaaacugcacagugguaaagaugucuucuucauaccgccggaaaaaugugauacauuguuaugugacauuggggagucaaguccaaauccaacaauugaagagggucgaacauuaagaguccuuaaaaugguagaaccauggcuuagaggaaaucaauuuuguauaaaaauacuuaaccccuacaugccgucggucguagaaacuuuagagcagaugcagaggaaacacgggggcaugcuugugagaaacccauuaucaagaaacaguacacaugaaauguacugggugucuugcggaacagguaacauagucucugcaguuaacaugacaaguagaaugcuguuaaauagauuuacaauggcacauaggaaaccaacauaugaacgagacguagaccucggcgcgggaacaagacauguggcaguagaaccggaaguagcgaaucuagacauuaucggacaacgcaucgaaaacauaaagcacgagcauaagucaacauggcauuaugaugaagauaauccauauaaaacuugggcuuaucauggcuccuaugaggucaaaccuagcgguagcgcaaguagcaugguaaauggaguaguaaaacuuuuaacuaagccaugggacguaauaccaaugguaacucaaaucgcuaugacagauacgacaccuuuugggcaacagcgaguauucaaagaaaaaguagauacuaggacacccaaagcaaaaagaggcacggcucagauaauggaagugaccgcaaaauggcugugggguuuccuaagucgaaacaagaaaccacggauauguacuagagaagaguucacgcgaaaaguaagaucgaaugcagcaauaggagcaguauuuguagaugaaaaucaauggaacucagcgaaggaagcaguggaagacgaaagauuuugggaccuaguccauagagaacgagaacuccauaaacaagggaagugcgccacaugcguauauaacaugaugggaaagcgcgagaagaaacuaggugaguucggaaaagcaaaaggcucacgugcuaucugguauauguggcuaggcgcuagauuuuuagaauuugaggcuuuaggauucaugaaugaggaccacugguuuagccgcgaaaacucccuaagcggaguagaaggagaaggauugcauaaguuagguuauaucuugcgagauauaaguaagaucccaggagguaauauguaugcugaugauacggcgggcugggacaccagaauaacagaagaugaccuccagaaugaagccaaaauuacagauauaauggaaccagagcacgcguuacucgcuaccaguauuuucaaacucaccuaccaaaacaaaguuguuagaguacagaggccagcgaggaauggcacuguaauggauguuauuucacggagagaccagaggggaucuggacagguugguacauauggauugaacacauuuacuaauauggaggcccaauuaauacgccagauggagucagaaggaaucuucagcccaagugaacuagagacaccaaaccuugcggaaagaguauuggauuggcuagaaaagcauggcguagagcgcuuaaaaaggauggcaaucucaggggaugacuguguaguuaagccaaucgaugauagguuugcuacugcacuaagcgcucuaaacgacaugggaaaaguccguaaggacauaccucaaugggaacccucaaaaggauggaacgauuggcaacaagugcccuuuuguucacaccauuuccaucaauugauaaugaaagaugggcgggaaaucguagucccaugucggaaccaagaugaguugguuggaagggccagaguaagucaaggagcaggguggaguuuacgagaaacugcuuguuugggcaagagcuacgcacaaauguggcagcuuauguauuuccaucgccgagacuuaagguuagcugcaaacgcuauuuguagcgcuguaccaguagauuggguuccgaccagcagaacuacauggucgauucaugcacaucaucaguggaugacaacagaagauaugcucucagucuggaaucgggucuggaucgaagaaaauccauggauggaagauaaaacgcauauaucuucauggggagacguuccguaucuaggaaaaagagaggaccaguggugcgguucacugauuggccugacggcucgagccacgugggcgacuaauauucaaguggccaucaaccaagucagacgacuaauuggaaaugaaaauuacuuagauuauaugaccucaaugaagagguucaaaaaugaaagcgacccagaaggagcgcucugguga

SEQ ID NO: 21571 - RNA, 9879 nt, Artificial Sequence
  derived and/or modified CDS sequence (opt6) from DENV-1__FJ461323__SS-prME
agcguaacuauguugcucauguuaaugccaacugcauuagcauuccauuuaacuacuagagguggagaaccacauaugauaguaucaaaacaagaacgggggaaauccuuauuguuuaaaacuagcgcgggaguuaacaugugcacuuuaauugcaauggaucucggagaacuaugcgaagauacgaugacuuauaaauguccacggauaacagaagcagaaccugacgauguagauuguugguguaaugcuacagacacguggguuacuuacggaacauguucucaaacaggggaacaucgaagagauaaaagaucgguagcauuagcgccacauguugguuugggucuugaaacgagaaccgaaacauggaugaguucagaaggcgcguggaaacaaauucaaagagucgaaacauggguauuacgccaccccggcuuuacagucauagcucuauuuuuggcacacgcaauagguacaaguaucacccaaaaaggaauaauauucauccuacuuauguuaguuacgccuagcauggcuaugcguugcguugguauaggauccagagauuuuguggaaggguuaucaggagccacaugggucgauguugugcuugagcaugggaguugcgucacgacaauggccaaagauaaaccuacccuagauauagaguuguuaaaaacagaaguuaccaauccagcaguucuccgaaaacuguguauagaggccaaaauaaguaacaccacaacagacucaagauguccgacucaaggagaagcgacacuuguggaagaacaagaugccaauuucguuugccgcagaacguucguggaucguggauggggaaacgggugugguuuauuuggaaaaggaucacuuauuaccugcgcgaaauuuaaaugcguaaccaaauuagaagggaaaauuguacaauacgaaaacuugaaauauucaguaaucguuaccguacauacgggugaucaacaucaaguggggaaugaaucaacagaacauggaacaacugcaaccauaacaccccaagcaccgaccaccgagauacaacuaacagauuauggugcauuaaccuuagauuguucuccaagaacaggucuagauuuuaacgagaugguacucuuaacaaugaaggagaaaaguugguugguucacaaacaaugguuccuggacuugccacuaccauggacaucaggugcgaguacaucacaagagacuuggaaccgucaagaucuauuaguaaccuuuaaaacagcucacgcgaagaaacaagagguagucguuuugggaucccaggaaggugccaugcauacagcauugacaggagccacagaaauacaaaccucgggaacaacuacaauuuuugcuggucacuugaaauguagauuaaaaauggacaagcucacucucaaagguaugaguuaugugaugugcacagguaguuuuaaacuagaaaaagaaguggcggagacacagcaugggaccguauugguucagauaaaauacgaaggcacugaugcgcccuguaagauuccauucucgacgcaagaugaaaaaggcgugacccaaaacggucgguuaauaacggccaauccuauaguaaccgauaaagagaaaccgguaaauauagaagcagaaccuccuuucggugaaucuuacaucguuauuggugccggugaaaaagcauuaaaauuaucaugguucaaaaagggcucaucaauagguaaaauguucgaagcuacugcacgcggugcaagaaggauggcuauuuuaggugauacagcaugggauuuugggucuaucggaggaguauuuacaaguguaggaaaacucguacaccaaaucuuugggacugcguauggcguucuuuucucuggugucucauggacuaugaagauuggaauuggaguucuacugacaugguuagguuuaaauagccgaagcaccucacugucuaugacuugcauagcaguaggauuaguuaccuuauacuuaggcgucaugguacaagcugauucugguugcguuauaaacuggaagggaagagaauuaaaaugcggcucaggcaucuuuguaacaaaugaaguacacacuuggaccgaacaauacaaauuucaagccgauagcccaaaaagacucucagcugcuauuggaaaagcaugggaggaaggcguaugcggaauacgaucagccacucgcuuagagaacauuauguggaaacaaauuuccaaugaacuaaaucauauauuacucgaaaaugauaugaaauuaacuguuguaguuggugacguugcugguauucucggacaaggaaagaaaaugauaagaccacaaccaauggaauauaaauacucauggaagucuuggggcaaagcuaaaauaauaggagcagacgcacagaauaccacauuuauuauugaugggccuaauacacccgaaugucccgacgaccaaagggcauggaacauaugggaaguugaagauuauggauuugguauauucaccacuaauauuugguuaaaacuaagagacuccuacacccaagucugcgaucacagacuaaugagcgcugccauuaaagacaguaaggcaguacaugcagauaugggcuacuggauagaaucugagaaaaaugaaacauggaaacuugcacgcgccagcuuuauagaagugaagacgugcauuuggccaaagagucauacacuauggucaaacggaguuuuagagagcgaaaugauuaucccaaaaauuuauggaggucccauuucccaacacaacuacaggcccggauauuucacgcaaacagcaggaccauggcaccucggcaaguuagagcucgacuuugaucuuugcgaaggcacgacugucguuguagaugagcauuguggaaauagaggaccuucucuccgcaccacaacuguaaccggcaaaauuauacaugaaugguguuguagaucguguacauuacccccauugagauuuagaggcgaagauggguguugguauggaauggaaauccguccaguaaaggaaaaagaagaaaaucuagugaaaucaauggugucagcaggcucuggagaaguggauuccuucucguuaggccuauuauguauuucaauuaugauugaggaggucaugcgcucgcgauggucaagaaaaaugcucaugacaggcacgcuggcagucuucuuuuuguuaauaaugggacaauuaacauggaacgaucucauaagacuguguaucauggugggugcaaaugcaagcgacaggaugggaaugggcacaacauaucuugcacuuauggcuacauuuaaaaugagaccuauguucgccguugggcuauuauuucgucgucuaacaagcagggaaguccuacuacuaacgauuggguuaagccuaguugcaucaguagagcuaccaaacucucucgaagaacuuggugauggacuagcuaugggcauaaugauauugaaacuucuuacggauuuccaaucccaccaauuaugggcuacguugcuuagcuugacguucauaaagaccacauucucucuacacuaugcuuggaaaacaauggccaugguucugucuauuguuaguuuguuucccuuauguuuaucuacaacaagucaaaagacuacaugguuaccuguauuauuaggcuccuuggguuguaaaccauuaacaauguuucuuauugccgagaauaaaauuuggggucgaaaaucuuggccucucaacgaagguauaauggcaguuggaaucguaucaauacuuuuaucguccuuacuaaagaaugauguaccuuuagcaggaccuuuaauugccgggggaauguugauugcuuguuaugucauaagcgguucaucagcagaccucagccuagaaaaagcugcugaaguaucaugggaagaagaagcagagcacucaggugccucacacaacauucuuguagaaguucaggaugauggaaccaugaaaauuaaagaugaagaaagggacgauacccuaacuauacuucuaaaagcaacccuuuuagcugugucgggcguauauccccuaucuaucccugcaacacuauuuguaugguauuuuuggcagaaaaagaaacaaagaucgggaguuuuaugggauacacccucgccuccagaagucgaaagagcgguucuggaugaugguauuuacaggauuaugcaaagggguuuauuaggaaggagccaaguuggagugggugucuuucaagaaaauguauuucauacaauguggcacgugacacgaggagcaguuuuaauguaucaagggaaaagauuagaaccaucaugggccucuguuaagaaagauuuaaucaguuacggaggaggguggagacuaagagggagcuggaauacaggugaagaaguucaaguuauagcgguagagccaggcaaaaaucccaaaaaugugcaaacagcaccagguacguuuaaaacuccggagggagaaguuggggcgauagcacuggauuuuaaaccugguacuuccgguagccccauagugaaucgcgaaggcaaaauugugggauuguacggaaaugguguagucacuacaaguggaacuuacgugucagccauagcacaagcuaaagcaucccaagaagguccauugccagaaauagaagaugagguuuuccgaaaaagaaauuugacaauaauggaccuccacccagguagcggcaaaacacggagauaccuaccagcaauaguuagagaagcuaucaaacgaaaauugcgcacacuuauacucgcaccgaccagagucguagcaucggaaauggcugaagcccugaagggaaugcccauacguuaucaaacgacggcagugaaaagugaacauaccgggaaagagaucguagacuuaaugugucaugcaacauuuaccaugcgucugcuaucuccuguccguguucccaauuacaauaugauaauaauggacgaagcccauuucacugaccccaguaguaucgcugcuagaggguacauuucaacacgaguagggaugggugaggcagcugcaauauuuaugacugcuacaccgccgggaucuguugaagcguuuccgcaaaguaaugcuguaauucaagaugaagaacgcgauauaccugaacguucguggaacucugguuaugaguggauaaccgauuucccaggcaaaaccguaugguuuguaccaucgauaaaaucuggaaacgauauagcgaacugucuuaggaaaaacgggaaacgcgucauacaauuaucucggaagacauucgacacugaguaccagaaaaccaaaaacaaugauugggauuaugugguaacaacggauauaucagagaugggagcaaauuuccgagccgaccgaguaauugauccacggcgauguuuaaagccaguuauacuuaaagauggaccggaacgugucauuuuagcugggccgaugcccguaaccguugccagcgcagcccaacgaagaggacguauugggaggaaucacaacaaagaaggagaccaauacauauauauggggcaaccacuuaacaaugaugaagaucacgcucacuggacugaagcuaagaugcuccuugacaauauaaauacgcccgaagguauaaucccagcuuuauuugaacccgaacgagaaaaaucagcagccguugacggagaauaccgauugagaggugaagcacguaaaacuuuuguggaguuaaugcguagaggagaccuaccaguaugguugucauacaaaguugcuucagagggauuucaguacagugauagaagauggugcuuugauggcgaacguaauaaucaaguacuagaagaaaauauggacguagaaauuuggacaaaggaaggugagaggaagaaacuaagaccaaggugguuggaugcccgaacguauuccgaucccuuagcucuacgagaauuuaaagaguucgccgcagguagacggucagugaguggagauuugauauuagaaaucggaaaacuuccacagcaucuaacacaaagagcacaaaacgcuuuagauaaucucgucaugcuacacaauuccgaacaaggagggagagcauauagacacgcaauggaagaacugccagauacaauagaaacacuaauguuauuagcauugauagcaguacuuacaggaggggucacacuuuucuuucuaagugggagaggauuagguaaaacuucaauaggacuacuuugcguaauggcuaguaguguauuauuauggauggccuccguagaaccacauuggaucgcggcaucaauuauuuuagaguucuuucuaaugguacucuuaauuccggaaccggauagacaacgaacgccucaagacaaccaauuggcuuacguugugauaggcuuacuauucaugauuuuaacaguugccgcuaaugaaaugggcuuauuagaaacaacuaagaaagaccucggaauuggacacgucgccguagagaaccaccaucacgcagcgaugcuagaugucgaucuacauccagccagugcauggacacuauaugcggucgcuacaacuauuauuacaccgaugaugagacauacaauugaaaacacgacagccaauauaucauuaaccgcuauugcaaaccaggccgcaauacuuaugggucuggauaaaggauggccgauaucaaagauggauauagggguaccccuauuagcguuaggguguuacucacaaguuaacccacuuacucucacugcugcuguauugauguuaguggcacauuacgcaauaaucggaccgggacuucaagcaaaagcgacaagagaagcccaaaaacguacagcagcaggaaucaugaaaaaucccacaguagacggaaucguugcgauagaucuggacccgguagucuacgaugcgaaauucgaaaaacaacuaggccaaauaaugcucuuaauuuuguguaccucccagauucuccuaaugcguacaaccugggcguuaugugaaagcaucacgcucgcuacaggaccauuaacaacacuuugggaagggaguccuggaaaguucuggaacacuacaauagcaguaagcauggcgaacauuuucagggguaguuaucuugcaggggcaggauuagcuuucucucuaaugaaguccuuaggcgguggaaggaggggaacuggugcgcagggggaaacuuuaggcgaaaaguggaaaaggcaacucaaccagcuuagcaaaucugaguucaauacguauaagagaucaggaaucauggagguugauagaucugaggcgaaggaaggguugaaaagaggggagacaaccaaacaugcggucagcagaggcacugcuaaauuaagaugguucguugagaggaaccugguaaaaccggagggaaagguuauagaccuagguuguggucgcggugguuggaguuacuacugcgcuggacuuaagaaagugaccgaaguuaaaggauacacuaaaggagguccaggucaugaggaaccuaucccaauggcaacauauggcuggaacuugguaaaacugcauucaggaaaagauguauucuucauaccuccggaaaaaugugacacauuguugugugauauaggagaaucuaguccgaauccaacuaucgaagaaggaagaacacuacgcguucugaaaaugguagaaccgugguuaaggggaaaccaauuuuguauuaagauacucaauccuuauaugccuucaguuguugaaacuuuggaacaaaugcaaaggaagcauggcggaauguuaguacgcaauccuuugucacgaaauucaacccaugaaauguauuggguaucaugugggacagguaauauagucagugcaguuaacaugacaucgagaauguuauugaaucguuuuacaauggcucacagaaagcccacuuaugaacgagacguugaucugggcacgggaacgagacacguagcaguugaaccagaaguagcgaaucuagacaucauaggacagcgcaucgaaaacauaaagcacgaacauaagagcacauggcacuaugaugaagauaacccauacaagacgugggccuaucauggaucauaugaagucaaacccagcggaagcgcuaguagcauggugaacgggguaguaaaacuauuaacaaaacccugggauguaauaccuaugguuacgcagauagcgaugacagacaccacgcccuuuggacaacaacgaguauuuaaagaaaaaguggacacccgaacucccaaggcuaaacgagguacugcacagauaauggaagugaccgcaagauggcuuuggggauucuuaucaagaaauaaaaagccaaggaucuguacgagggaagaguucacaagaaaaguuagaucaaacgcugccaucggagcugucuuuguggaugaaaaucaauggaacucugcaaaggaagcgguggaggacgaaagauucugggaucuuguacauagggagagagaguuacacaaacaaggcaaaugugcuaccugcguauauaauaugaugggaaaaagagagaagaaauugggagaauuugggaaagcuaagggaucgagagcuauuugguacauguggcuuggcgcgagguuccucgaguucgaagcauugggauucaugaaugaagaccauugguuuucaagagaaaauucguuaagugguguagagggggaaggacuccauaaacuaggauauauuuuaagggauauuucuaaaaucccuggugggaauauguaugccgacgacacagcaggcugggauacacgcaucaccgaagacgaucuacaaaacgaagcaaagauaacggauaucauggaaccagagcacgcgcuucuugcuaaggcuaucuuuaaguugacuuaccaaaacaaaguagugcguguacaaagaccugccaaaaacgguacgguaauggaugucauaucucguagagaccaaaggggaucaggacagguuggcacauauggucugaauacuuucacaaauauggaagcgcaacuuauaagacaaauggaaagcgaagguauauucucaccauccgagcuagaaaccccuaauuuagcggaaagggccuuagauugguuggaaaaauauggcguugaacguuugaaacgcauggcgauuucgggugaugauuguguaguuaaaccaaucgaugauagauuugcuacagcacuuacagcacuaaaugacaugggaaaaguucgaaaagauauaccgcagugggaaccaucuaaaggauggaaugacuggcagcagguacccuucugcagucaucauuuucaucaauuaauaaugaaagauggccgagaaauagucgucccguguagaaaucaagaugaacugguaggcagagcgcgaguaucacaaggggcggguuggagccuaagagaaacggccuguuuaggaaaaaguuaugcucaaauguggcaacugauguauuuccaucgacgcgacuuacggcuggcggcaaacgccaucugcucugccguaccaguagacuggguaccaacaucaagaacgacauggucuauacacgcucaccaucaguggaugacgacugaggacaugcucagcgucuggaaucgaguauggauagaagaaaauccuuggauggaagauaagacccacauuaguucgugggaggauguuccauaucuaggaaaaagagaagaccaauggugugguucucucaucggauuaaccgcaagagcuaccugggcuaccaacauccaaguggcaauuaaucaagugagaagacuaauaggaaaugaaaacuaucuagauuacaugacgucuaugaaacguuuuaaaaaugaaacugauccagaaggagcgcucugguga

SEQ ID NO: 21572 - RNA, 9879 nt, Artificial Sequence
  derived and/or modified CDS sequence (opt6) from DENV-1__FJ461325__SS-prME
agcgucacuaugcuacuaauguugaugcccaccgcacuggcauuccacuugaccacucgggguggugaaccccacaugaucguaucuaaacaagaaagaggcaaaaguuuacucuuuaaaacaagugccggugucaauauguguacauuaauagcaauggaucuaggugaacuuugcgaagauacaaugacguacaaaugccccagaauaacggaaacggaaccagaugauguugauuguugguguaaugcaacugacacaugggucacauacggcacauguucacaaacgggggaacauagacgcgacaaacgaagcguggcgcuugcuccccacgucgggcugggguuagaaacuagaacggagacuuggaugucuucagaaggagcauggaaacaaauacaaagaguagaaacaugggcauuaaggcacccaggguuuaccguaauagcacuauuuuuggcucaugcgauaggaacguccauuacacaaaagggaauaauauuuauauuguugauguuagugacaccaucaauggcaaugcggugugugggaauugggucgagagacuuugucgaaggucuaucaggggccacguggguugacguaguguuggaacacgguaguugugucacaaccauggcaaaagacaaaccaacuuuggauauugaauugcuaaaaacagaaguaacgaacccagcggugcuaagaaaauuauguauugaagcuaaaauaaguaacacaacaaccgauucaagaugcccgacccagggagaagcuacuuuagucgaggagcaagacgcgaacuucguaugcagacgcaccuuuguagauagagguuggggaaaugguuguggacuguucggcaaaggaucucuaauaacaugugcaaaauuuaaauguguaacuaaauuagaaggaaagauuguucaguacgaaaaucugaaauauucuguaauuguaacuguccauacaggugaucagcaucaagucggaaacgaaaguacggaacaugguacaaccgcgacaauaacuccucaagcaccgacuacagagauacagcuuacagauuauggugcucuaacauuagauuguagcccucguacaggccuggacuucaacgaaaugguauuguuaacgaugaaagaaaaaucaugguuaguacauaagcaaugguuuuuagacuuaccgcugccuuggacaucuggggcgagcacaagucaggaaacauggaaucgacaagauuuauuagucacguuuaagacagcucaugcuaagaaacaagagguaguaguuuuggggucccaagaaggugccaugcacacugccuuaaccggagcuacagagauucagacuucugguacgacgaccauuuuugcuggacacuuaaaaugucgacuaaaaauggauaaacugacauuaaaaggaaugucguacgucaugugcacaggaucguuuaaacuagaaaaagaaguugcagaaacgcaacauggaacgguauugguacagaucaaauacgaggguaccgacgcuccuuguaagauaccauucaguacacaagacgaaaagggggucacacagaauggaagauuaauaacagccaacccaauuguuacagauaaagaaaaacccgugaauauagaggcagaacccccauucggugaaucauauauuguaauuggagccggcgaaaaggcauuaaaacuaucgugguuuaagaaagggagcaguaucggaaagauguuugaagcaacagcaaggggagcgcgaagaauggcgauauuaggagauacagcaugggauuuuggcucgauaggagguguguuuacaaguguagguaaauuaguucaucaaaucuuugguacugccuauggagucuuauuuaguggugugaguuggacaaugaagauaggaauaggaguauugcugacauggcuugguuuaaacucgaggaguacaucauugucgaugacaugcauugcgguuggguuaguaacacuuuauuuaggagugaugguacaagcagauucaggcuguguuauuaauuggaaggggcgggaauuaaaauguggaagcggaauauucguaacaaacgaaguacauacauggacggaacaguacaaauuucaagccgacucaccuaaaagauuguccgcagccaucggaaaggccugggaggaagguguuuguggaauaaggagcgcaacaagacuggaaaacauaauguggaagcaaauuaguaaugaguuaaaccauauauuacuagagaacgauaugaaauucacagucguaguaggcgacguugccgguauuuuagcccaggggaagaaaaugauaaggccccaaccaauggaguacaaauacagcuggaaauccugggguaaagcaaaaauaauaggugcggacguucaaaacacaaccuuuauaauagacggccccaauacaccagaauguccagaugaucagcgcgcauggaauauaugggaaguggaagauuacggguuuggaauuuucacuacuaacauuuggcuaaaacuacgggacucauauacacaaguaugcgaccaucgacuaaugucagcagcaaucaaggacucuaaagccgugcaugcggauaugggguauuggauagaauccgagaaaaaugaaaccuggaaguuagcgagagccucauucauagaaguuaaaacguguauauggccaaaaucgcacacacuuuggucuaaugggguucuagaaucagaaaugauaauaccaaagauuuacggaggcccgauaagccagcauaacuaucgaccggguuacuucacacaagcggcaggcccuuggcaucucgggaaacucgaguuagauuucgacuugugugaagguacaacaguaguaguagaugagcacugcgggaaucggggcccgagucucagaacaacaacgguaacggggaagaucauccaugaaugguguuguagaaguugcacauuaccaccgcuccgcuuuagaggggaagauggcugcugguacgguauggaaauucgcccugugaaagaaaaggaagaaaauuugguuaagucaaugguuagcgcagguucuggugaagucgauaguuuuucauugggacuacugugcauuucaauaaugauagaagagguaaugagaaguagauggucucguaggauguuaaugaccggcacauuagcggucuuuuuccuucuuauuaugggacaacucaccuggaacgacuuaauaagacuuugcauuaugguaggagcgaacgcgucugaucgaauggggauggggacaacuuacuuagcucuaauggcuacuuuuaaaaugaggccgauguuugcgguugggcucuuauuuagacgacucaccaguagagaaguuuuauuguuaacaauuggucucucgcuuguagcaaguguagaacuuccgaacucacuagaagaguuaggagaugguuuagcuaugggaaucaugauacuaaaacuuuugaccgauuuucaaucccaccaguugugggcuacuuuguugaguuuaaccuuuauuaaaacaacauuuagccuacacuacgccuggaagacuauggcaaugguuuuaucgauaguaucuuuauucccgcuuugcuuaagcacuacaagucagaaaacuacaugguuacccguauuacugggguccuuaggguguaaaccguuaacuauguucuuaauuacggaaaacaaaaucuggggccggagaagcuggccacugaacgagggaauaauggcgguggguaucguaucaauacuuuuaucuucucucuugaagaaugauguaccguuagcugggccccuuauagcuggaggaaugcucaucgcauguuauguuauuucagguucgucggcagaucuaagucuggagaaagcagccgaagugagcugggaagaagaagcagaacauaguggagcgagccacaauauauuaguugaaguacaagacgauggcacuaugaagauaaaagaugaagagagagaugauacucugacaauucuauuaaaggcgacgcuccuugcaguuuccggaguuuauccguuaaguauccccgcuacgcuguuuguaugguacuucuggcaaaagaagaaacaaagaagugguguguugugggacacccccaguccacccgagguagaaagagccguauuagaugauggaaucuacaggauaaugcaaaggggccugcuaggaagaagucagguaggaguaggaguguuccaagagaaugucuuccacacgauguggcacgucacaaggggugcaguacuuauguaccaggguaagagauuggaaccaaguugggcgucuguuaagaaagaucuaauuucauauggaggcgguuggcgucuucaaggcaguuggaauacgggagaggagguccaaguaauagcaguggagccaggaaagaacccuaaaaacgugcaaaccgcaccgggaaccuuuaaaacaccagaaggggaaguaggagcgaucgccuuggauuuuaaaccaggaacaucaggaagccccauaguuaaccgugaagggaaaauugugggacuuuacggaaauggcgucguaacaaccucgggaacuuacguaucagcaaucgcucaagcaaaagccucccaggaaggaccccuuccugaaaucgaggaugagguuuuuagaaaacgaaauuugacuauaauggaccuccauccugggucagguaaaacucgaagauauuuaccagcuauaguccgugaggcaauaaaaagaaaacugcggacccugauccuagcgccaacgagaguuguagccucugaaauggccgaagcccuaaaaggcaugccuauuagauaucaaaccaccgcaguaaaaagugaacacacuggcaaggaaauuguggaccugaugugccaugcaacauuuacuaugagguuacuaucacccguacgagugccaaauuauaacaugauaaucauggaugaagcacauuucacugaucccucgaguauugccgcgcguggcuauauaagcacaagaguaggaaugggcgaagcggccgcgauauuuaugacggcgacaccacccgguaguguugaagcguuuccacaaaguaaugcugugauacaggaugaagaacgugacauaccugaaaggucauggaacagcggauacgaauggauaaccgauuucccuggaaaaacagucugguucgugccaucuauaaagagcgguaaugacaucgcuaauuguuuaaggaaaaacgguaaaagagucauacaauuaucuagaaaaacauucgacacagaauaucagaaaacgaagaacaaugauugggacuauguaguaacaacugacauuucugaaaugggagcgaauuuccgugcggauagaguuauagauccuaggcgaugccucaagcccguuauccugaaggaugguccagaacguguuauccucgcaggaccgaugccagucacuguagcaagugcggcccagaggcguggucgcauagggcggaaucauaauaaagagggagaucaauauauauacaugggucaaccguuaaauaaugaugaagaccaugcgcauuggacggaggccaagauguuguuagauaauauuaauacucccgaaggaauaaucccagccuuauuugaacccgaaagagaaaaaucagcugcaauagauggagaauaucguuuaaggggagaagcaagaaaaaccuuugucgaauuaaugagacguggagaucucccaguauggcugucauauaaaguagccucggaaggauuucaauauucagacagaagauggugcuucgauggugaaagaaauaaucaaguucucgaagaaaauauggauguagagaucuggacgaaagaaggagaaaggaagaaacucagaccucgaugguuagaugcucgaacauacucugauccuuuagccuuaagggaauuuaaagaauuugcagcuggacgacggagcgucucuggagaccuuauauuagaaauuggcaagcuaccacagcauuuaacacagagggcgcagaaugcucucgauaaucuuguaaugcuacauaauagugaacaaggggguagggcauaucggcaugcuauggaagaauuaccagauacuauagaaacacuuaugcuauuagcucuuauugcuguccuaaccgggggcguuacacuauucuuuuugucaggaagagguuuagggaaaaccucaauuggguuacuaugcguuauggcaagcucaguauuguuauggauggcuuccguugaaccucauuggauagcggcgucaauuauacuagaguucuuuuuaaugguacuucucauacccgagccggaucgacagagaacuccacaagacaaccaguuagcuuauguugugauuggucugcuguuuaugauuuuaaccguugcagcaaaugaaaugggacugcuagaaacaacgaaaaaggaccuugguauagggcauguagcagucgaaaaccaucaccaugccgcaauguuagacguugaucuacacccggcuagugcauggacuuuguacgcaguagcaacaacaaucaucaccccuaugaugaggcauaccauagaaaacacuacagcaaauauaaguuugacagcgauugcaaaucaagcggccauauugaugggccucgauaagggguggccaauaagcaaaauggauauaggcgucccuuuacuugcacucggaugcuauucacaagugaauccguuaacacucacagcugcgguuuugaugcugguggcccacuacgcuauaauagguccuggcuuacaggcaaaagcuacgagagaagcgcaaaaacgaacagccgcggguaucaugaagaacccuaccguagaugguauagucgccauagaucuggauccaguaguauaugacgccaaauucgaaaaacaauuaggucaaauaauguuacucauacuaugcaccucacaaauucuguugaugagaaccacgugggcucugugcgagucaauaacucuggcaacggguccucuaacuacuuugugggaggggucaccaggaaaguucuggaauacaacaaucgcggucagcauggcaaacauauuccgcggaucuuaucuugcaggcgccggacuugcguuuucucuaaugaaaucauuaggagggggcagaagaggaacuggugcacaaggagaaacucuaggugagaaauggaagcggcaacuaaaucaauuguccaaaagcgaguucaauacauauaagagaagugggauuauggagguugaccgaucagaagcuaaggaaggguuaaaaagaggcgagacaacaaaacacgccgugagucgugguaccgcgaaauuacgaugguuuguagaaaggaaccucguuaaaccagaggguaaagucauugauuuagguugcgggagagguggcuggucuuauuauugugccggucugaagaaagugacagaaguaaaaggauauacgaagggcggaccuggccacgaagaaccuauucccauggccacauacgguuggaaccuaguaaaacuacauuccgguaaagauguauucuuuauaccacccgaaaaaugugauacacuacucugcgacauaggcgaaucgagcccuaacccaacaauagaggaaggaagaacguuacguguauuaaaaaugguugaaccgugguugcgaggaaaucaauucuguaucaaaauccuuaauccuuauaugccuucgguuguugaaacguuagagcagaugcaaagaaagcacggcggcauguuaguuagaaauccucuuucuagaaauucgacgcaugagauguacuggguaaguugcggcacggggaauauuguaagcgcaguaaauaugacgagccgaauguugcuuaauagguucacuauggcgcacagaaaacccacauacgaaagagacgucgaccuuggugcagguacuaggcauguagcugucgaaccggaaguagccaaucuugacauaauagggcaacggauugaaaauauaaaacaugaacacaaauccacuuggcauuacgacgaagauaaucccuauaagacaugggcuuaccaugguucguaugaagucaagccuucagggagugcuucaaguaugguaaacggagucguaaaguuguugacaaaaccaugggauguuauaccgaugguaacccaaauugcaaugacggauacaacccccuucgggcaacaacgaguuuuuaaagagaagguagauacaagaacacccaaagccaagcgaggaacugcucaaauaauggagguaacugccaaauggcuauggggauuuuugucccggaauaaaaagccuaggauuugcacgcgagaagaguucacaaggaaaguucgaucuaaugcagcaauaggagcagucuuuguugaugagaaucaauggaacucagccaaagaagcaguagaagacgaacgauuuugggaucugguacacagggaaagagaauuacacaaacaggguaaaugcgccacaugcgucuauaacaugauggggaaaagggagaagaaauuaggcgaauuugggaaagcaaagggaaguagagcgauaugguauaugugguuaggagccagguuccuagaauuugaagcguuaggauucaugaacgaagaucauugguucaguagagagaauagcuuaucgggaguugaaggugaaggucuacauaaauuaggcuauauuuuaagagauauaaguaaaauaccaggaggaaauauguaugcagaugacacagcaggaugggauacacggauaacagaagaugaucuacaaaaugaagcacgaauuacagacauaauggagccagaacacgcauuauuagcaaaaagcauauuuaaguuaacauaucaaaacaaaguagugcgaguccaaaggcccgccaaaaauggaaccgugauggauguaauuagcagaagagaccagagaggaagcggacaaguuggcacguauggucugaauacguuuaccaauauggaagcucaauugauuaggcaaauggaaagcgaagggaucuuuucaccgucagagcuggaaaccccaaauuuagccgaaagaguccucgacugguuagaaaaguacggaguugagagacucaaaaggauggccauuaguggugaugacuguguaguaaaacccauugacgaccgcuucgcuaccgcacucaccgcccuaaacgacaugggcaaaguaaggaaagauauuccacagugggaaccaucaaaaggauggaacgacuggcaacaaguuccguuuuguucucaucauuuucaucaauuaauuaugaaagauggcagagaaauaguagugccaugcaggaaucaagacgaauugguugggagggcuaggguuagucagggugcaggauggaguuuaagagaaaccgcguguuugggcaaaucauaugcacaaauguggcaauuaauguauuuucauagacgggaccugaggcuugcugcgaaugcaauaugcucagccgugccagucgauuggaucccaaccucgagaacaacauggaguauucacgcucaucaccaguggaugacgacggaagauaugcugucuguuuggaaucgcgucuggauagaagaaaauccauggauggaagauaagacucauauaucaagcuggggugacguuccuuaccuaggaaagcgagaagaucaaugguguggaucgcuaauagguuugacagcaagagcgacaugggcaacaaauauacaagucgcaauaaaucaagugagacgauuaauagguaacgagaauuaccuagauuauaugacaucgaugaaacgauuuaagaacgaauccgauccugaaggagcauuaugguag

SEQ ID NO: 21573 - RNA, 9879 nt, Artificial Sequence
  derived and/or modified CDS sequence (opt6) from DENV-1__FJ410232__SS-prME
ucgguuacuauguuacugauguuaaugccuacggcucuugcauuccaucuaacaacacgugggggagaaccgcauaugauaguaucaaaacaagaacgagguaaaaguuuacucuuuaaaaccucggcuggcgucaacauguguacccugauugcaauggaucugggcgaacuaugugaagacaccaugacuuacaaauguccccgaaucaccgaggcggaaccggacgacguugacuguuggugcaacgcuacugauaccuggguaacauaugggacguguucgcaaacaggugaacauagaagagauaaaaggucaguggccuuggcgccacaugucggcuuaggacuagaaacucgaacugagacauggaugucgagugagggugcauggaaacaaauacaaagaguugaaacaugggcucugagacacccaggcuuuaccgucacagcccuauuucucgcacacgccaucggaacaagcauuacucaaaaaggcauuauauucauauuauuaauguuagugacaccgucuauggccaugagaugcgucgguauugguucuagagacuuuguagaaggucugucaggcgcaacauggguagauguaguacuagagcauggcuccugugucacaaccauggcgaaagauaaaccgacucucgacauagagcugcugaaaaccgaagucacuaauccagccguacuuagaaaauuguguauugaagcaaaaauuaguaauacaaccacagauaguaggugcccaacacaaggagaggccacucuaguggaagaacaagacgcaaauuucguuuguagaaggaccuucguagacaggggaugggguaacggguguggacucuucggaaaagguucguuaauuacaugugcgaaauuuaaauguguaacaaaauuagaagggaaaauaguucaauacgaaaacuuaaaauauucaguaauagugaccguucauacaggcgaucaacaccaaguuggcaaugaaucgacagaacacgguacuaccgcaacuauaacaccucaagcuccaacaacggaaauucaacuaaccgauuauggagcucuuaccuuggauugcagcccucgaaccggauuggauuuuaaugaaaugguacuucuaacgaugaaagagaaaucgugguuaguacauaagcaaugguuucuagaucuuccauugccauggacaucuggagccucaacuucacaagagacguggaaucgccaagaucuccuuguuacauucaaaacggcucaugcuaaaaagcaagagguaguaguauuaggaagucaagagggagcaaugcacacagcacucacuggagcaacagaaauacaaacgucagguacaacuacaauauuugcaggucaucuaaaguguagacuuaaaauggauaaauuaacgcuuaagggcaugucuuauguaauguguacggggucauuuaaguuagagaaagaaguugcugaaacgcaacacgguacugucuuaguacaaauaaaauacgaagguaccgacgcacccugcaagauaccguuuaguacccaagacgagaagggaguaacgcaaaacggucgcuuaauaacugccaauccgauagucacagauaaagagaagccuguaaacauagaagcagaaccaccauuuggugaaaguuacauaguaauaggagcaggcgaaaaagcacuaaaacuuagcugguuuaaaaaggguaguucgauagguaaaauguuugaggccacagcuagaggugcucgacguauggcgauacuuggagauacugcaugggacuucggaucuauagggggagucuucacgucugucggaaaguugguccaucaaauauucgguacagccuacggcguguuauuuuccggcguaaguuggacgaugaaaaucggaauuggcguucuuuuaaccuggcuaggacuaaauuccagaucgacaucauugucaaugacguguauagcuguugguuuaguaacguuguauuuggguguuauggugcaagcagacucaggaugcguaauuaacuggaaaggucgagaauuaaaguguggaucaggaaucuuuguaaccaaugagguccacaccuggacggaacaauacaaauuucaggcagacucaccaaagcgacugucugcugcaaucggaaaggccugggaagaaggagugugcggaauacgaucagcaaccagacuagaaaauauuauguggaaacaaauaucaaacgaauuaaaucauauuuuguuggaaaaugauaugaaauuaacaguagucguuggcgaugucgccgguauccuaggucaagggaagaaaaugauacgaccucaaccuauggaauauaaauauucauggaaauccugggguaaagcuaaaauuauuggagcugaugcgcaaaauacaacuuucauuaucgacgguccaaauacacccgagugcccugaugaucagagagcuuggaacauaugggaagucgaagacuacggauuuggaaucuuuacuacaaauauaugguugaaacuacgagacagcuauacucaaguuugcgaucaucgauugaugucagcagcaauuaaagauagcaaggcuguccacgcagauaugggauacuggaucgaauccgaaaagaaugagacauggaaacuagcuagagccucguuuauugaaguaaaaacauguaucuggccaaaaucgcacacacuguggucaaaugggguccuagaaagcgaaaugauaauuccaaaaauauauggggguccaauuagccagcacaacuacaggccagguuauuuuacacaaacugccgguccauggcaucucggcaaacuugaauuagauuuugauuugugcgaagguacaacagugguugucgacgaacauuguggaaaccgcggaccaucacuacgaacaacaacuguaacagguaagaucauccacgaguggugcugccggucauguacccuuccaccgcuucgguuccguggggaagacggaugcugguauggaauggagauucgcccgguaaaagagaaagaggaaaaucucguaaaaaguaugguuucagcaggcucaggugagguagacagcuuuagucuaggucuacucuguauaucuaucaugauagaagaggucaugcgaaguagauggucacguaaaaugcuuaugaccggcacuuuagcuguguucuuuuuauuaaucaugggacaauuaacauggaacgaccucauacgacuauguaucaugguuggagcgaaugcaagcgacagaaugggaauggggacuaccuaccucgcacuuauggcaacauuuaaaaugcgacccauguucgcugugggacuauuauucagaagacuaacuuccagggaagucuugcuacugaccaucggacucucauuaguagcuucuguugaauuaccuaacuccuuagaagaauuaggagacggucucgcaauggguauaaugauauuaaaauugcucacugacuuucaaucucaccaguugugggcuacacucuuaaguuuaacuuuuauaaaaacgacauucagccuacauuaugcauggaagacaauggcaaugguccuauccauaguaagucuuuuuccuuuaugucucucaacgaccucacagaaaacaacguggcuacccguauuacuaggaagccuaggcugcaaaccacuaacaauguuuuuaaucgccgaaaauaagauauggggaagaaaaagcuggcccuuaaaugagggaauaauggcggucggaaucguaaguauauuacuuaguucccuauuaaagaaugauguaccucuagccggaccauuaauugcaggaggcauguuaaucgcgugcuaugucauaucaggauccagugcagauuuaucauuagagaaggcugcagaagucagcugggaagaagaggcagaacauuccggugcaucccauaacauauuaguugaaguucaggaugacgguacuaugaaaauaaaagacgaagaaagggaugacaccuugaccauccuauuaaaagcuacccuccuagcagugagcggaguauauccuuuaucuaucccugcuaccuuauuuguaugguauuucuggcagaagaagaaacaacguaguggagucuuaugggacacaccgagcccaccagaagucgaacgugcuguuuuagaugacggcauauacagaauaaugcaaagagggcuuuuagggagaucacaggucggcgugggaguguuccaagaaaacguauuccauacgauguggcacguaacucgcggcgcagugcugauguaccaaggaaagcgucuagagccaagcugggcuagcgugaaaaaggaucuaauuuccuaugggggaggauggagauuacgagguagcuggaauacuggagaagaagugcaaguuauagcaguagaaccagguaaaaaccccaaaaauguacagacagcuccagguacauuuaaaacuccagaaggcgaaguaggugcaauugcguuagacuuuaaaccuggaacuucaggaucuccgaucgucaaccgggaagguaaaauaguaggccuauauggaaacggcguaguaacaacauccgggaccuauguuagcgcaauagcacaagcuaaggcuucccaagaagguccccuacccgagauugaagaugaagucuuucguaagcggaaucuaacuauaauggaucuucaucccggcucgggaaagacaagaagguaucuuccggcaauaguaagagaagcaauuaagcguaaauuacgcacgcuaauacuggccccuacuagaguaguggccuccgagauggcugaagcguugaaaggcaugccaauaagauaucaaacaacagcuguaaagucagagcacacaggaaaagaaauaguugaccuuaugugucacgccacauuuacaaugagguuauuauccccagucagagugccuaacuacaauaugauuaucauggaugaggcucacuuuacggacccaucuuccaucgcggcaagaggguauauaucgaccagagugggcaugggagaggcagccgcuauauuuaugacagcaacaccaccagguucaguagaggcuuucccgcaaagcaaugccguaauucaagacgaagaaagggacauacccgaacgcucauggaauagcggauacgaauggaucacagacuuucccgguaagacagucugguucguaccgaguauaaagagcgguaacgacauagcuaauuguuuaaggaaaaaugggaagcgugugauacaauugagccguaaaacguucgauacagaguaucagaaaacuaaaaauaaugacugggauuacguaguaacaacggacauuucagaaaugggagcuaacuuccgagcagacagaguaaucgauccgagaagauguuuaaaaccaguuauauuaaaagauggaccagaaagagugauucuggcugguccgaugccaguuaccguagcuagcgcggcacaacgacguggccgaauuggaagaaaccauaacaaagaaggugaucaauauaucuauaugggucaaccacuaaacaacgacgaagaucaugcucacuggacagaagcaaaaaugcuauuagacaacauaaauacaccagagggaauaauaccugcucucuuugagccugaaagagaaaagucugcggcugucgauggagaauacagacuaagaggugaagcacgaaaaacauuugucgaacuaaugagaagaggagaccuaccgguaugguugucauacaaaguagcaagcgagggauuucaauacagcgaucgucguugguguuuugauggagaacgaaauaaccaagucuuagaagagaacauggauguugaaauauggacaaaagaaggugaacguaagaaacuaagacccagauggcuagacgcaagaacauacucagacccacuugcacuccgugaauuuaaggaguucgccgccgggagaagaagcguaaguggagacuugauacuagaaauaggaaaacuaccgcaacaucugacgcagagagcccaaaaugcucuagauaaccuuguaaugcuucacaauucugaacaaggaggucgagcguacagacaugcaauggaagaacuuccagauaccauagagacacugaugcuacucgcgcucauugcaguacuaacuggagguguuacacuauucuuucucaguggaagaggauuggguaagacaucaauuggguuguuaugcguuauggcauccucugugcuauuguggauggcaaguguagaaccgcauuggauagccgcaucgauaauauuagaguucuuucuaaugguguugcuaauaccagaaccagaucggcaaagaacaccgcaagauaaucaacuugcuuauguaguaauaggacuacuguuuaugauacuuacuguggccgcaaaugaaaugggacuacuugagaccacuaaaaaggaucugggaauuggacacguagcuguagaaaaucaccaucaugccgcuauguuagauguugaccuacauccagcaagugcuuggacccucuacgcaguggcaacaacgauaauuacgccuaugaugagacacacgaucgaaaacacaacggccaacauuucccuuaccgcaauugcaaaucaggcugcuauacuaaugggauuagauaagggauggccuaucuccaaaauggacauaggcguaccauuacuagcccuaggauguuauucacaagucaauccauuaacacuaacagccgccguacugauguuaguagcucauuacgcaauaauaggaccaggacuucaagcuaaagcgacuagagaagcucagaaacguacagcggcaggcauaaugaaaaacccaacagucgaugguauaguugccauagacuuagauccugucguguaugaugcgaaauucgaaaaacaauuaggacagaucaugcuccugauauuaugcacuucacaaauuuuacugaugagaacgacaugggcacuaugcgaaagcaucacccuagccacaggcccauugacuacauuaugggaaggaucaccagggaaauucuggaacacaacuauugccguuucuauggcuaauauuuuccgcggaucguaucuggcaggagcgggacuagcuuuuucccugaugaaaucacugggagggggaaggaggggaaccggugcacaaggagaaaccuuaggagaaaaguggaaaagacaauuaaaucagcuuagcaagucggaauuuaauaccuacaaaagaucagguaucauggaaguugacaggucagaagcaaaagagggacugaaacgaggagaaacuacuaaacaugccguaagucgcgggaccgccaaacuacgaugguucguggagagaaauuuaguaaaaccggaaggcaaaguaauugauuuaggaugcgggcggggcgguuggagcuacuauugugcuggucuaaagaaaguaacggaagugaagggauacacaaaaggugguccaggacaugaagaaccgauaccaauggcuaccuacgguuggaaucuugucaaauuacauagugggaaggauguguucuuuauacccccggagaagugcgacacucuacugugugauauaggcgaaagcucaccaaaucccaccauagaagaagggcgaacauuacgaguucuaaaaaugguggaacccuggcuucguggaaaccaauuuuguauaaaaauucugaaucccuauaugccgucaguagucgaaaccuuagaacagaugcaacgcaaacauggagguauguugguaaggaacccacuaagcagaaacucaacacaugaaauguauuggguaaguuguggaacgggaaauauagucucggccguaaacaugacgucucgaaugcuucuaaaucguuuuaccauggcucaccggaaacccacauaugagcgugacguugacuugggaacagggacucggcacguagccguagaacccgagguggcuaaucuagacauaauaggacaaagaauagaaaauauuaaacacgaacacaaaucaacauggcacuaugaugaagauaauccuuauaaaacuugggcauaccauggcaguuaugaggucaaaccaucagggagcgcaaguaguaugguuaacgguguaguuaagcuauuaacaaaaccgugggacguaaucccuaugguaacccaaaucgcaaugacugacacuacaccuuuuggacaacaacgaguauucaaagaaaagguagauacaagaacgccaaaagcuaagagagguaccgcgcaaauaauggaaguaacagcucgcuggcuguggggauuuuuaagccggaauaagaaacccagaauuuguacaagagaagaguucacacgaaaaguacgcaguaacgcggcaauaggagcgguguuuguagaugagaaccaauggaacucugcuaaagaagcgguagaggacgaacguuuuugggacuuaguccauagagaaagagaacuucauaaacagggcaagugcgcuacauguguuuauaauaugaugggaaaaagggaaaagaaguugggagaguucggcaaagcuaaagguucacgugccauaugguauaugugguuaggcgcuagauuuuuagaauuugaagcucugggcuuuaugaaugaagaccacugguucucgcgggaaaauucacuauccggaguggaaggugagggacuacacaaacuaggauauauuuuaagagauauuucaaaaauaccaggaggaaauauguaugccgaugauaccgcuggcugggauacaagaaucaccgaggaugaucuacaaaacgaagcuaagauaaccgauaucauggaacccgaacaugcacuauuagcaaaagcgauauuuaaauuaacuuaccaaaacaaaguugucagaguccaacgacccgcuaaaaacgggaccgugauggaugugauaucaaggagagaucaacguggcucgggucagguagguacauacgguuuaaauacuuuuacgaacauggaagcucaacugauacgacaaauggagucagaagggauauucaguccaucagaacuugaaacaccgaauuuagcugaacgggcacucgauuggcuagaaaaauauggugucgagcgcuuaaaaagaauggcgaucucaggagaugacugugugguuaaaccuauugacgaccgcuucgcaacggcccuuacugcacuaaaugacaugggcaaagugcggaaagauauaccucaaugggagccgaguaaaggauggaaugacuggcagcaaguacccuuuuguucccaucacuuucaccaacucauuaugaaagacggucgugagauaguagugccaugcagaaaucaagacgagcuuguggggagagcacgagugucacaaggcgcaggcuggucgcuacgcgaaacagcgugucugggaaaaucauacgcacagauguggcaacuaauguauuuucaucguagggaucuacgcuuagcagccaacgcgauaugcagugccguaccagucgauuggguuccgaccucccgaacuacguggaguauucacgcucaucaucaauggaugacaaccgaggacauguuaagcguauggaaucgaguuuggauagaggaaaauccuuggauggaagauaagacgcauauaagcaguugggaggauguaccguauuuaggaaaaagagaagaccaaugguguggaagucuuauaggauuaaccgcucgagcaacaugggcuacuaauauucaaguagccauuaaucaaguaaggagauuaauuggaaacgagaacuaucuagauuauaugacuucuaugaagcguuucaaaaaugagagcgaucccgaaggugcacuaugguaa

SEQ ID NO: 21574 - RNA, 9879 nt, Artificial Sequence
  derived and/or modified CDS sequence (opt6) from DENV-1__FJ461327__SS-prME
ucagucacgauguugcuuaugcuaaugccgacagcauuagcuuuucaccuaacaacgagaggaggagaaccucacaugauuguaucaaaacaagaacgaggaaaaucucugcuauuuaaaaccagcgcuggaguaaauaugugcacccuuauugcuauggacuuaggcgaauuaugugaggauacgaugacauacaaauguccucgcauuacagaaaccgagccagacgaugucgacugcuggugcaaugccacugauacauggguaacauauggcacgugcucacagacaggugaacauagacgugauaaaagaagugucgcacuagcuccacaugugggacuaggucuugaaacgagaacagaaacuuggaugucuucagaaggugcauggaaacaaauucaaaggguugaaacaugggccuuaaggcauccagguuucacaguaauagcgcuuuucuuagcacacgcaauaggaacuucgauaacucaaaaaggaauuaucuucauacuacuaauguuaguuacaccauccauggcgaugagguguguaggaaucggcucacgugacuucgucgaaggacuaaguggugcaacauggguggacguuguucuggaacaugggagcugcguaacaaccauggccaaagauaaaccaacguuggacauugaacuacugaaaacagaagucacaaauccagcuguauuaagaaaacuauguauugaagcuaaaaucucuaauacuacaacggauucaagaugcccuacgcagggugaggcuacauuaguggaagaacaagaugcuaauuuugugugccgacguacauuuguagaucguggcugggguaauggaugcggguuauucggaaaaggaagccuaauaacgugugcuaaauuuaaaugcguaacaaaauuagaaggcaaaauaguacaguacgaaaauuuaaaauacagugucauugugacaguucacaccggugaucaacaucaagucgguaacgaaagcacugagcacgggacaacugcuacaaucacaccacaagcaccaacuaccgagauacaauuaacugauuauggcgcauuaacuuuagacugcucaccacggacaggacucgauuucaaugaaaugguucuccuaacaaugaaagaaaaaucgugguuaguacauaaacagugguuuuuagaucuuccucuuccuuggacgagcggugcaagcacuucgcaggaaacuuggaacagacaagauuugcuuguaaccuucaaaacagcacaugccaaaaagcaagaggucguaguucuuggcucacaagaaggagcaaugcauacggcgcuaacaggugcgacggaaauucaaacaagugguacaacaacuaucuuugccggacaucuaaagugucgguugaaaauggacaaacuuacuuuaaaaggaaugucuuacgugauguguacagguucauuuaaacuugagaaggaaguagcugaaacgcaacauggaacagucuuaguucagauaaaauaugaaggaaccgacgcgccaugcaagauaccuuuuucgacccaagaugaaaaagguguaacacaaaacgggcguuugauuaccgcaaauccaauaguuacugacaaagaaaaaccugugaacauagaagcugaaccucccuucggugaaagcuauaucgucauaggagcaggggaaaaagcgcucaaguugucaugguucaagaaagguagcaguaucggaaaaauguuugaagcaaccgcccgaggggcgagaagaauggcaauuuugggagacacugcaugggacuuuggauccauaggagguguauuuacaucaguaggcaagcuagugcaccaaaucuuugguacugcauauggcguauuauuuaguggaguuuccuggacgaugaaaauuggaauuggugugcuacucacuuggcuugguuuaaacagccggaguacaucgcuaagcaugacuuguauagccgucgguuuaguaacucuauauuugggaguuaugguacaggcugacagcgguuguguaauaaauuggaaagggcgagaauuaaaaugcggcagcgggauauuugugacuaaugaaguucacacuuggacggaacaauauaaauuccaagcggauuccccuaagcgccuaucggcggcuaucggcaaagcaugggaagaaggagucuguggcauucguagugcuacccgucuagaaaacauaauguggaaacagaucaguaaugaauuaaaccauauacuauuagaaaacgauaugaaguucacuguuguaguaggcgaugucgccggaauacuggcacaagggaagaaaaugauuaggccccagccuauggaauauaaauauuccuggaagaguugggguaaagcaaagauuauaggugcagauguccaaaacacgacuuucauaauagacggucccaacacgccugaguguccagaugaucagcgcgcuuggaauauaugggaaguugaggauuacggauucggcauauuuacaacaaauauaugguugaaacuaagagacucguauacacagguaugcgaccauagauuaauguccgcagcaauaaaagauagcaaagcuguucacgcagacaugggauauuggauagaauccgaaaagaaugaaaccuggaaguuggcgcgagccaguuuuauagaaguaaaaacauguauauggcccaagagucauacccuuugguccaacggaguucucgaaagcgaaaugaucauaccgaaaauuuacggggguccaauaagucaacacaacuacagaccugguuacuuuacacaggcagcaggacccuggcacuuagguaaacuugaguuagauuuugaucuuugcgaaggaaccacugugguaguagacgagcacugcggcaauagaggaccaucacucagaacuaccacaguuacagggaaaauuauacacgaauggugcugccggaguuguacccuaccuccacuaagauuuagaggagaagacgggugcugguacgguauggaaauuagaccuguuaaggaaaaagaagaaaauuuaguaaaaaguaugguaucagcuggaucaggagagguagauucauucucgcuaggacuccuguguauaucgauuaugauugaagaaguuaugagaagucgauggucacgacguaugcuuaugacagggacccuagccguguucuuucuucuaaucaugggacaauuaaccuggaacgacuuaauacgacucuguauaaugguaggcgccaacgcaucugacaggaugggaauggguacaacauaccucgcucuaauggcgaccuuuaaaaugagacccauguuugcugucggccuccuauuuagaagacucaccagucgagaaguguugcuacuaacgauaggauuaucguuaguugcuagcguugaacuuccaaauucauuagaagaacuaggugauggauuagcaaugggcauaaugauacuaaaacugcuaacugauuuucaaucucaccaacuaugggcuacacuacuuagucucaccuuuauaaaaaccacauucucacuacauuaugccuggaagacuauggcaaugguauuaaguauaguauccuuauucccuuuaugucuaagcacaacgucccagaaaacuacuugguuaccaguacuucuaggaagccucgguugcaaaccucuuaccauguuucuuauugcugagaauaagauauggggacggagaaguuggccacuuaaugaaggcauuauggccguaggaauuguuagcaucuuacucucaucauuacucaaaaaugauguaccuuuagcagggccccuuauagcuggagguaugcuuaucgcuuguuauguaaucucuggcaguagcgcugauuuaucuuuagagaaagcugccgaaguaagcugggaggaggaagcugaacacaguggagccucucacaauauucuuguagagguacaagaugaugggacaaugaagauuaaggaugaagaaagggacgauacacucacaauacuccuaaaggcgacacuacucgcgguuucuggcgucuauccuuuaagcauaccugcuacgcuuuuuguaugguauuuuuggcaaaagaagaaacaaagaucuggagucuuaugggauaccccaucaccaccugaaguugagcgagcuguauuagaugaugggauauaucguauuaugcagaggggauuacuuggaaggucacaaguuggaguagguguauuccaggaaaacguauuccacacgauguggcauguaacaagaggagcaguccuuauguaucaagggaaacgacuagagcccucuugggcaucuguuaaaaaggaucucauuaguuacggagguggcuggaggcuccagggaucuuggaacacuggugaagaaguucaagucaucgcaguugaacccgguaaaaacccaaagaaugugcaaacugccccugguacauuuaagacaccagagggggaaguuggagcuauugcacuugauuuuaagccagguaccucuggaucaccaaucgugaacagagagggaaaaauaguggguuuauacgguaacggggucgugacaacaaguggcacauauguuucagcaaucgcccaagcuaaagcaucccaggaagggccucucccugaaauugaagacgaaguguuucguaagagaaacuuaacaauaauggauuuacacccagguaguggaaaaacccgaagauaucucccugcaauuguuagggaagcaauuaaacgcaaguuacgcacacuaauucuagcccccacuagggucgucgcaucggaaauggcagaagcauugaaaggaaugccgauucguuaucaaacuacagcuguuaaauccgaacauaccggaaaagagauuguugauuuaaugugucacgcgacauuuaccaugagacuauuaagcccaguucgggugccgaacuauaauaugaucauuauggaugaagcucacuucacagauccuaguaguaucgcagcacguggauacauaagcacgcgcguaggaaugggagaagccgcugcuauuuuuaugacagcuacaccaccagguaguguagaggcuuuuccucaguccaacgcaguuauccaagaugaagagagagauauaccugaaagaagcuggaacucaggauacgaguggauaacagauuucccaggaaaaacuguaugguucgugccuuccauaaaaucagguaaugauauugccaauuguuuacgaaagaaugguaaacggguuauacaacuaagccggaaaacauucgauacagaauaccaaaagacaaagaauaaugacugggauuauguaguaacaacagacauaucagaaaugggcgccaauuuccgggcggaccgugugauagacccaagacgaugccuuaaaccaguaauacuuaaagacgguccggagcgaguaauuuuagcaggaccgaugccaguaacggucgcaagugccgcucagagacggggacgaauaggacggaaucacaauaaagaaggugaccaguauauuuacaugggucaaccccugaacaaugaugaagaccacgcacauuggacagaggcgaaaaugcuucuagauaacauaaacacaccugaagguauaaucccagcucuguuugagccugagagagagaaaagugcagcuauagacggcgaauaccguuuacguggcgaggcacgcaaaacauuuguagaguuaaugcguagaggggaccuaccaguguggcuaucauacaaggucgcaagcgaaggauuucaguacagcgauagacgauggugcuuugacggugaacgcaacaaucaaguuuuggaagagaacauggauguugagauuuggacaaaagaaggugaaaggaagaaauuaagaccuaggugguuggaugcaaggacuuauucagacccucuagcguugcgagaguuuaaagaauuugcggcaggcaggaggucugucuccggagaccucauauuggagaucgguaagcuaccacaacaucuaacacagagggcacagaacgcgcuagacaaucuaguaaugcuucauaauucagaacaaggcgguagagcuuauagacacgcgauggaagaauugcccgauacaauagaaacacuuauguuauuggcccuuaucgcaguacugacuggcgguguaacccucuucuuuuuaaguggacgggguuuagguaaaacaucgauaggacuauuauguguaauggccaguagcguacuguuauggauggcgucaguugaaccgcauuggauugcagcauccauaauuuuagaguucuuucugaugguguuacuaauaccagaaccagauagacaaaggacaccucaagauaaucaauuagcauacguaguuauuggauuguuauucaugauucuaacagucgccgcaaacgagaugggucuuuuggaaaccacaaagaaggauuuagggauagggcauguggcuguugagaaccaccaccacgcagcuauguuagacguggaucugcaccccgcaucagcauggacacuuuaugcuguggcuacgacaauaauaacccccaugaugaggcauacaauagagaacacaaccgcaaauauuucauuaacugcaauugcaaaccaagcugcgauucuaaugggauuagacaaagguuggcccauaucaaaaauggauaugggaguuccucucuuagcgcuagguugcuacucacaggucaauccuuuaacucuuacagcggcuguacuaauguuaguugcacauuaugcaauaauaggaccgggucuucaagcaaaagcgacaagagaggcacagaaaaggacugcugcaggaaucaugaagaauccaacuguggacggcauaguugccaucgaucucgacccaguugucuaugacgcuaaauuugagaagcaguuaggacaaauaaugcuccuaauacuuugcacaagucaaauucuucucaugcggacuacaugggcacuuugcgaaagcaucacucuugcaacgggucccuuaaccacauugugggaagggagcccaggcaaauucuggaacacgacaauagcuguaaguauggcaaacauuuuuagagguucguacuuggcgggagcaggauuagccuuuucucucaugaaaucguuaggaggcgguagacgcggaacuggggcccaaggugaaacgcuaggagaaaaauggaaaagacaauuaaaccaauuaucaaaguccgaguuuaacacguacaaaagaucuggcauaauggagguagaucgcagugaagcuaaagaaggucuaaagcgaggugaaacaacgaagcaugcugugucaagaggcacugcuaagcugagaugguuuguagaacggaaucuggucaaaccagagggaaaaguaauugauuugggcugcggaagaggaggauggucauauuacugcgcuggacucaagaaagucacugaaguaaagggcuauacaaaagguggccccggccaugaggaaccuauuccaauggcgacguaugguuggaauuuagugaaguuacacuccggaaaggauguguuuuucauaccgccugaaaaaugugauacguuacuaugugacauaggcgaguccucaccgaauccaaccauugaagagggucgaacucuacggguacuuaaaaugguugagccuugguuacgagggaaccaauuuuguauaaaaauauuaaacccguacaugccuucugucguagagacguuagaacaaaugcaacguaagcauggagggauguugguuagaaacccgcuuucacgcaauaguacacaugagauguauuggguaagcuguggaacaggaaacauaguuagugcaguuaacaugacuucuagaaugcuauuaaaucguuuuacuauggcucaucguaagcccaccuaugagagggauguugauuuaggggcuggaacuagacauguagcugucgaaccagaagucgcgaaucuagacaucauaggacagagaauagagaacauaaagcacgagcacaaaucaacauggcacuacgacgaagacaaccccuauaaaacgugggcuuaccaugguuccuaugaaguuaaacccaguggauccgcaucuuccaugguuaauggcguaguaaaacuccucacaaagccgugggacguaauuccaauggugacccaaauagccaugacugauacuacaccuuucggccaacaaagaguuuuuaaagaaaaagucgauacacgaacacccaaagcaaaacgagggacagcacagauuauggaagugaccgcaaagugguuguggggcuuucuaagucgaaacaagaaaccucguauaugcacuagagaagaauuuacgcgaaaaguacgcagcaacgcagcgauaggugccguauuuguagaugaaaaucaauggaacuccgcaaaagaagcaguagaagaugaaagauuuugggauuuaguacaucgggaacgagaacuucacaagcaaggaaagugcgcuacuuguguguauaauaugaugggaaaacgagagaagaaacucggagaauuuggcaaagccaagggcucgcgugcaauaugguacauguggcuuggggccagauuuuuagaauuugaagcauuaggauuuaugaacgaggaucauugguucucaagagaaaauucacucagcgguguagaaggagagggacuacauaaacuaggauacauacucagagauauaaguaaaauaccaggagguaauauguacgcugacgauacugcaggcugggauacucgcaucaccgaggacgauuuacaaaaugaagcacguauaacagauauuauggaaccugaacaugcacuacuugcaaaaucgauauuuaaacugacauaucagaauaaaguagugcggguccaacgaccugcgaagaauggaacggugauggacguaauaucuagaagggaucaacgaggcaguggccaaguagggaccuauggacuaaauacauuuacuaacauggaagcgcaauuaauaagacaaauggaaagugaaggaaucuucucuccgagugaguuggaaaccccuaauuuagccgaacguguacucgauuggcuugagaaauacgguguagaaagauuaaagaggauggcaauaaguggggaugauugcguaguaaaaccaauagaugauagguuugcuacagcacuaacugcgcuuaacgauauggguaagguaagaaaggauaucccucaaugggaaccaucaaaaggauggaaugauuggcaacaaguucccuucugcucgcaccauuuccaccaacuuauaaugaaagauggccgcgaaaucgugguuccaugccgcaaccaagacgagcuaguagggcgggcgagagugucacaaggugcaggcuggagccuaagggaaacugcuugcuugggcaagucuuaugcacaaauguggcaacuuauguacuuucaccgcagggaccuacgccuugcagcuaaugccaucuguucagcaguuccaguggauuggauaccaacaagucgaacaacuuggucuauccaugcgcaccaccaguggaugaccaccgaagauaugcuuucgguauggaauagaguauggaucgaagagaauccuuggauggaagauaaaacucacauuucgucuuggggagauguuccuuauuuaggcaaaagagaagaccaaugguguggaucucugauuggucuuacugcgagggcuacuugggcaacaaauauacaaguugcaauaaaucaagugaggagauuaauaggaaaugaaaacuaccuugacuauaugacgucaaugaaaagauuuaagaaugaaagugacccagaaggagcgcuaugguaa

SEQ ID NO: 21575 - RNA, 9879 nt, Artificial Sequence
  derived and/or modified CDS sequence (opt6) from DENV-1__FJ461328__SS-prME
ucagugacaauguuauuaaugcuuaugcccacugcccucgcguuucauuugacuacccggggcggagaaccccauaugauaguaucaaaacaagaacgaggaaaaucccucuuguuuaaaacuucugcaggaguuaauauguguacacuuauagcaauggacuuaggagaauuaugcgaagauacaaugacuuauaaauguccacgaaucacagaagccgaaccugacgacguagacuguugguguaaugcaacagacacguggguuacauacggaacaugcagccaaaccggggaacacaggagagaaaagcgaagcguagcauuagcaccgcauguggguuuaggguuagaaacuagaacugaaacauggaugagcagcgagggagcuuggaagcaaauacaaagaguugaaacaugggcauuaagacacccagguuucacugugauugcacucuucuuagcacacgcuauaggaacuucuauaacacaaaaggggauaauauuuaucuuacuuaugcucguaacuccaaguauggcuaugaggugcguaggaaucgggaguagagacuuuguagaaggauuaaguggagcaaccuggguagauguuguuuuagagcacggaucguguguaacaacgauggcuaaagauaaaccuacauuggauaucgaauuguuaaaaacagaggucacuaacccagcuguacuuagaaaacuguguauagaagcgaaaauuagcaauaccacaacugacaguagauguccuacacagggcgaagcgacauugguggaagaacaggacgcuaacuuugugugucguagaacuuucguagaucgcgguuggggcaauggcugcggauuauuuggaaaagggucucuucugacaugcgcaaaguucaagugcguuacaaaacuagaagguaagauaguccaauaugaaaauuuaaaauauaguguuauuguaaccguccauacaggugaccaacaccaaguugguaacgaaaguacugaacacggaacgacagcuacgauuacaccgcaagcaccuacaaccgaaauccaacucacggacuacggggcacuaacuuuggauugcuccccuagaacuggauuggauuuuaacgaaauggucuugcuuacaaugaaggaaaaaucuugguuaguacauaaacagugguuccucgauuuaccguuaccauggacgagcggagcuagcacuucucaggaaacauggaaccggcaagauuuguuaguaacauuuaagaccgcgcaugcgaaaaagcaagaaguagucguauuaggcucacaagaaggugcgaugcacacagcguuaacaggugcaaccgaaauucaaaccucagguacaaccaccauauucgcgggucaucuaaaaugucgucuuaaaauggauaaacuuacccuaaaaggaaugaguuauguaauguguacgggcucuuucaaauuagaaaaagagguggcagagacgcaacacgguacuguauuaguacaaauuaaauaugaaggcacggacgcucccuguaaaaucccauuuucaacgcaagacgagaaaggaguaacucaaaacgguagacuaauuacagcaaauccaauaguaacggauaaagaaaaaccgguuaauauagaggcugaaccgccauuuggagagucuuacauaguaaucggagcaggcgagaaagccuugaaacuuaguugguucaagaaagguaguagcauuggaaaaauguucgaggcgacugccagaggagccagacgaauggcaauccuaggggauaccgcgugggauuucgguucgauugguggcguguucacguccguagggaagcuaguccaucaaauauuuggaacagcuuacggaguacuauuuucaggagucagcuggacuaugaaaauuggaauagguguguuauuaacgugguuaggacuaaauucuagaucaacuucucucucuaugacauguaucgcuguaggacuugucaccuuauaccucggaguaaugguucaagcagauaguggcuguguaauuaauuggaaaggcagagaguugaaaugugggaguggaauuuucguaacgaaugaaguccacacauggaccgaacaguauaaauuccaggcugacucgccgaaacggcugucggcugcgauugguaaagcaugggaagagggcguaugugggauucggagugcaacuagguuagaaaauaucauguggaaacaaauaucgaaugagcuaaaucacaucuuacuugagaaugacaugaaauuuacggugguuguuggugauguagccggaauccuaguccaaggcaaaaagaugauaagaccucaaccaauggaauauaaguauucauggaaauccuggggaaaagcaaagauaauaggggccgacguccaaaacucuacuuucauaauagacggaccaaauacaccugaaugcccggaugaucaaagggcguggaacauuugggaaguagaagauuaugguuucggcauauuuacaacgaauauauggcuuaaacugcgagauucauauacucagguaugugaccacaggcugaugucggcagccauaaaagacaguaaagcaguccaugccgacaugggauauuggauagagagugaaaagaaugaaaccuggaaauuagcacgggcgucuuuuauugaggugaaaacaugcauuuggccaaaaucgcacaccuuguggagcaacggaguauuagaaucugagaugauaauucccaagauacaugguggcccaauuagucagcauaacuaucgaccggguuauuuuacgcagacugcaggaccuuggcaccucgguaaacuagaacuggauuucgacuuaugcgaggguacaacagucguggucgacgaacacugcggcaaccgaggaccgagccuaagaacuaccacuguuacugggaagaucauucacgaauggugcugucgaucuuguacccugccaccacuaagguuuaggggcgaagaugguugcugguaugguauggaaauucggccagucaaggaaaaggaggaaaacuugguuaaaaguaugguaucggcagguucaggagaagucgauagcuuuagcuuaggucugcuauguauuucuauaaugaucgaagaagucaugagaucaagauggucgcgaaaaauguuaaugacugguacacuagcuguauuuuucuuacuaaucaugggacagcugaccuggaaugaucuuauacgccuaugcauuaugguaggugccaaugcaucggaucgaaugggaaugggcacaacauacuuagcacuaauggcaaccuuuaaaaugagaccaauguuugccgucggauuauuauucagaaggcuaacauccagagaaguccucuugcuaacaauaggauuaucuuuaguagcuagcguggaacugccaaauucacucgaagaguugggagacgggcuagcaaugggcauaaugaucuuaaaacuucuaacagacuuucaaucguaucaauuaugggccacauuacuguccuuaaccuucauaaagacgacauuuucacuacacuacgcauggaagacaauggcuaugguauuaaguauuguaucgcuuuuuccacuuugucuaucgacaacaagccagaagacuaccuggcucccugugcuauuaggcagucuugguuguaaacccuuaacuauguuuuuaauagcugaaaacaaaaucuggggcagaaaaucuuggccauuaaaugaagguaucauggcaguugguauagugucgauucuucugucuucacuucucaaaaaugacgucccccuagcgggaccauuaauugccggagggaugcucauugcaugcuauguaauaagugggucgagugcagacuugucuuuagaaaaagcagccgaaguuucuugggaagaagaagcagaacauucaggagcuagccacaauauauugguagaaguacaagaugacggaacaaugaaaauaaaggaugaagaaagagacgauacauuaacuauuuuauuaaaagcaacauuauuagcaguaucugguguauauccacuuaguauuccagcgacgcuguucguguggcauuuuuggcagaaaaagaaacagagaucagggguuuuaugggacacuccuucuccuccggaaguagaacgcgcaguacucgacgauggaauuuaucggauaaugcagagagggcuauuaggucguucacaagucgguguuggcguuuuccaagaaaauguauuccauacuauguggcacguuacgagaggggcaguacuaauguaucaaggaaaaagauuggagccaucgugggcauccgucaagaaagaucucauaaguuauggaggugguuggagauuucaagggaguuggaauaccggagaagaaguccaaguuauugcaguggaacccggcaaaaaccccaaaaacguucaaaccgcgccagggacuuucaaaacgccagaaggggaaguaggagcaauagcccuagauuuuaaaccaggaacauccggaagcccuauugugaauagggaagguaaaauaguuggacucuauggaaacggagucgucacaacgucuggaacuuauguuagcgcaauagcgcaagcgaaagcaucacaagaaggaccucuaccagagauugaagacgaaguuuuuagaaaaagaaaccuaacaauuauggaucuacauccagguagcggaaaaacaagacgcuaucuuccggcaaucguucgggaggcaauuaaacggaaauuacgaacauugauacuagcaccgacuagaguagucgccagcgaaauggcagaagcguuaaaaggaaugccgauacgguaucaaaccaccgccguaaagucggaacauacuggcaaagaaauaguggaucuaaugugccacgcgacauuuacaaugcggcugcugaguccaguacgaguacccaauuauaauaugauuaucauggacgaagcacacuucacugacccaaguucgauagcagcgcgagguuacauaucaacacgcgugggaaugggagaagccgcagcaauuuucaugacagcaacuccgcccgguagcauggaagccuuuccucaaucaaaugcuguaauacaagacgaagagagggauaucccugaacgcaguuggaacagcgguuaugaguggauaacugauuucccaggaaaaacuguaugguuugucccgucuauuaaagcugggaaugauauagccaauugucuucgcaaaaacgguaaaagagucauucaauugucaagaaaaacguuugauacagaauaccagaaaacuaaaaauaaugacugggauuauguaguuacgacugauauaucagaaaugggugcaaauuucagagcggacaggguuauagauccaagacgcugcuuaaagcccguuauuuuaaaggauggcccggagcgcguuauuuuggcuggaccuaugccugucacaguugcaucagcugcccaaaggcgaggacgaaucggaaggaaccauaauaaggagggcgaucaauauauauacaugggacaaccuuuaaauaaugaugaagaucacgcacacuggacagaagcgaaaaugcucuuagacaauauaaacacaccagaaggcauaaucccugcacuauucgagccagaacgugaaaaaucggcagcaauagauggcgaauaccgacuacguggggaagcuaggaaaacauuuguagaacuaaugcgccguggagaucuaccagugugguuaucguauaagguggcaagcgaaggguuccaauacucugauaggaggugguguuucgauggugaacgcaauaaccaaguuuuagaggaaaacauggacguagaaauauggacaaaagagggcgagagaaagaaauuacguccacggugguuggaugcacgaacauacucugacccauuggcacuacgagaguucaaagaauuugcagcaggaagaaggagcgucuccggagauuuaauucuagaaauugggaaacuuccucaacaccuaacacaacgagcccagaaugcccucgacaaccucguaauguuacacaacagcgagcaaggggguagagccuaucgccaugcaauggaggaauugccggacacuauagaaacgcucaugcuucuugcacugauagccguacuaacaggcgggguaaccuuguuuuuccuaucuggaaagggacuuggaaaaacaucuauaggacuacuuuguguaauggcuucuaguguauuacucuggauggcgucuguggaaccucacuggauugcagcgaguauaauccuagaguucuuuuuaauggugcuccuaauuccagagccggacagacaacgaaccccucaagacaaccagcuggcuuaugucguuauagggcuacuauucaugauacugaccguggcggcgaaugaaaugggacuuuuagagacaacuaagaaagacuuaggaauaggucacguagcuguagaaaaccaucaccacgcagcaauguuagacgucgaucugcauccggcuucagcauggacacuauacgcaguugcuacuacgauaauaacuccaaugaugaggcauacaauugaaaacacaacagcaaacaucagcuuaacagcuaucgccaaucaagcagcaauauuaauggguuuggacaaaggauggccaauuuccaaaauggauauaggcguaccauuauuagccuuggguugcuauucacaagucaauccucucacuuugacagccgcaguacuaauguuaguugcacacuacgcuaucaucgguccaggguugcaagcuaaggcgacaagggaagcacaaaaacgaacugcagcuggaaucaugaaaaauccuacuauagauggcauaguugcgauugaucucgauccuguaguauaugacgccaaauuugaaaaacaacuagggcaaauuaugcuuuugauccugugcacgucgcagauuuuacuuaugaggacuacuugggcacugugugaaaguauaacuuuagcuacuggcccacuaacaacacuuugggaaggcaguccagguaaauucuggaacacuaccauagcgguaucaauggcaaacauuuucagagggucuuaucuagcuggagcagguuuagcauuuucauuaaugaaaucccuuggcgguggaagacgaggaacaggagcgcaaggugaaacgcuaggagaaaaguggaaacgacaacuuaaucaauuaagcaaaucagaauuuaauaccuauaaacguucaggaauuauggagguagauagaagugaagcuaaagaaggucuaaaaagaggagaaaccacuaaacacgcaguuucacguggaacagccaaacuccgaugguucguugaacggaaucuggucaagccagaaggaaaagucauagaccuaggauguggcaggggcggcuggaguuacuauugcgcggggcucaagaaaguaacugaaguaaagggauauaccaagggagggcccgggcacgaggagccgaucccaauggcaacauacggauggaauuuaguuaagcuacauagcgguaaagauguguucuuuauuccgccugaaaagugcgacacuuuauuaugcgauauaggugaaaguuccccgaauccuaccauugaagagggaagaacauugaggguacuuaaaaugguugaaccguggcucagagggaaucaauuuuguauaaaaaucuuaaauccauacaugccauccguggucgaaacccuagagcaaaugcaaagaaaacaugguggaaugcuaguuagaaauccacuuagucguaauaguacgcaugaaauguauuggguuuccuguggaacuggaaauaucgucagcgcaguuaauaugacuucgagaaugcuacucaaucgguuuacaauggcucaccggaaaccuacauacgaacgcgacgucgauuuaggagcaggaacccgacauguagcuguagagccagaaguagcaaauuuagacauaauuggucaaagaaucgaaaacauaaagcaugaacacaaaucuaccuggcauuaugaugaagauaauccuuauaaaaccugggcauaucacggaaguuacgaaguaaaaccaaguggaucugccaguagcauggugaaugguguaguaaaauuauuaacgaaaccgugggacguuauaccaauggugacucaaauugcaaugacggacacuacgccauuuggccaacaacgaguguuuaaagaaaaaguugauaccaggacaccaaaggcaaagcgcgguacugcacagaucauggaaguaacagccagaugguuauggggcuuuuuaucuagaaauaagaaaccaagaauauguaccagagaagaguucacaagaaaaguccgaucuaacgcagccaucggugcgguauuuguggacgagaaccaauggaauagcgcuaaggaagcagucgaagaugauagauucugggacuuagugcauagggaaagagaacuucauaaacaagggaaaugugcuacuuguguguauaauaugaugggaaaacgagagaagaaacuaggugaauuugguaaagccaaagguucuagggcaauaugguauaugugguuaggugcaagguuccuagaguucgaagccuuaggauuuaugaacgaagaccauugguucuccagagaaaauagucugucuggaguugaaggggaaggauugcacaaacuagguuacauucuuagagauauuaguaaaauaccaggaggaaauauguaugcugaugauacagccggaugggacacccguaucacagaggacgacuuacaaaacgaagcuaagaucacugauauaauggaaccggaacacgcucuacuugcaaaaaguauuuuuaaacucacuuaucaaaauaaaguaguaagaguacaaagaccagccaaaaacgguacaguuauggacguuauaagucgaagggaccaacgagggucggggcaagugggcaccuauggucuaaauacguuuacaaauauggaggcgcaacucauaaggcaaauggagagugaagguauauuuuuaccaaacgaacucgaaacucccaaucucgcuggcagaguacuugauuggcuggaaaaauauggaguggaacgccuaaaacgaauggcgauaagcggugacgauugcguuguuaaaccaauagacgaucgguucgccacggcauuaacugcuuuaaaugauauggguaaaguaaggaaggauauaccucaaugggagcccagcaaaggauggaaugauuggcagcagguaccuuucugcucgcaccauuuucaccaacugauaaugaaagacggacgugagauugucgucccuugccguaaccaagaugagcuagucgggagagcacgcgugagccaaggugcuggauggaguuugagggaaaccgcaugucucggaaaaucauacgcucaaauguggcaacuaauguauuuucacagacgcgaucuuagacuugcugcaaaugcaauauguagugcuguaccuguagacugggugccgaccagucgaacuacguggucaauacacgcacaucaucaguggaugacgaccgaggacauguuaucgguauggaauagaguauggauagaagaaaauccauggauggaggacaaaacaaggaucaguaguugggaggauguccccuaccuaggaaaacgagaagaccaaugguguggaucacuaauaggacuaacagcuagggcaacaugggcgacaaauauccaaguagcgaucaaucaaguucgaagacugauaggaaaugaaaacuacagugauuauaugacaucuaugaaaagguuuaagaaugagucugaaccggagggagcacuaugguaa

SEQ ID NO: 21576 - RNA, 9879 nt, Artificial Sequence
  derived and/or modified CDS sequence (opt6) from DENV-1__FJ410234__SS-prME
aguguaacuauguuauuaauguuaaugccgacagcucucgccuuccauuugacaacaagaggaggagagccucauaugauaguuucaaaacaagagcguggcaagucucuguuauuuaagacaagcgcagguguuaauaugugcacgcuaaucgcuauggacuuaggugaacugugcgaagauacuaugacauauaaaugccccagaauaacugaagcagagccagaugauguagauuguugguguaacgcaacggacacuuggguaacguauggcacuugcucccagaccggggaacauaggagggacaaaagaucuguggccuuagcaccucauguuggacuaggcuuggaaacacggaccgaaacuuggauguccucagagggagcguggaaacaaauucagagagucgaaacaugggcuuuacggcacccaggauucacaguuauagcguuauucuuagcacaugcuauagguacgucgauuacgcaaaaaggaauaauuuucauucuacuaaugcucguaaccccuucaauggcuaugcguugcgucggcauaggaagcagagauuuuguagagggccuaucgggagcaacauggguugaugucguccucgaacacggauccugugugacgacuauggcuaaagauaaaccuacauuagacauagagcucuuaaaaaccgaggugacaaauccggcaguuuuaagaaaguuaugcauugaagcuaagaucaguaauacgacuacggacaguagaugcccaacgcaaggugaagcaacacucguagaagagcaggaugcuaauuuuguuugucguagaacuuucguugaccgaggcuggggaaauggcugcggccuguuugguaaaggaucgcucauuacgugugcuaaguuuaaaugcgucacgaaacuggaaggcaaaaucguucaguaugaaaaccuaaaauauagugucauaguaacuguacacacaggggaccagcaccaaguuggaaaugagagcaccgaacauggaacgacagcgacaauuacaccgcaagcuccuacuacagaaauacaauugacagauuauggugcgcuuacuuuagauuguucaccgagaacuggacucgauuucaacgaaaugguucugcugacuaugaaagaaaagaguuggcuaguucauaagcaaugguuucuagaccugccauuaccauggacuagcggcgcuagcacuagucaggagacuuggaacagacaagacuuacucgugacuuuuaaaacugcgcacgcgaagaaacaggaaguaguaguucucggaucgcaggaaggagcaaugcauacagcauuaacuggugccaccgaaauacaaacuucaggaacuacaacuauauuugcggggcauuuaaaauguagguuaaagauggauaaacuuacccugaaagguaugagcuacguaauguguacgggaucuuuuaaguuagagaaggaaguggcagagacacagcauggaacuguacuaguacaaauaaaauaugaaggcacagaugcacccugcaagauucccuuuaguacacaagacgagaaaggcgucacucaaaacgggagauuaauaaccgcuaaucccauuguuaccgacaaagagaagccugucaauauugaagcugaaccuccauucggagagaguuauauuguuauaggggcgggugaaaaagcucugaaauuauccugguucaagaaaggaaguucuaucggaaagauguuugaagcuacagcaagaggagcgcgaagaauggcaauacuaggcgauaccgcaugggacuuuggaaguauaggcggaguauucaccucaguggguaaauuaguacaccaaauauuuggaacagcauauggaguauuauuuaguggaguaagcuggacgaugaaaaucgggauagggguucugcuaacgugguuaggguugaauucaagaucuacaagccugagcaugacuugcauagcugucggauuaguaacccuuuacuuaggcgugauggugcaagccgauagcggguguguuauaaacuggaaaggccgagaacugaaguguggcucgggcauuuuugugacuaaugagguucacacauggacggaacaauauaaauuccaagcugauucgccaaaacgauugagugcggcuauaggaaaagcuugggaagaggguguauguggaauaagaagcgcuacucgauuagagaacaucauguggaaacagaucucaaaugaauuaaaccauauccuauuagaaaaugauaugaaauuaaccguagugguuggagaugucgcagggauauugggacaaggcaaaaaaaugauaagaccacaaccaauggaauauaaauauagcuggaaaucauggggcaaagcaaaaauuauuggagcugacgcccaaaauacaacauucauuauagaugguccuaacacuccggaauguccagaugaucaaagagcguggaauauaugggaaguagaagacuauggauuugguauuuuuacgacgaauauauggcuuaaacugcgggauucuuauacacagguuugugaucaucgacuaaugucagcagcaauuaaggauucgaaggcaguacaugcggacaugggauacuggauugaaucggaaaaaaaugaaacauggaaauuagcacgcgcuaguuuuauagaaguaaaaacuuguauauggccgaaaucacauacacuauggucaaacgguguacucgagucagaaaugauaauaccaaaaauauacgggggcccaauaagccagcauaauuauagaccgggauauuucacgcaaacagccggcccuuggcaccucggcaaacuugaacuggauuucgauuuaugugaagguaccacggucgucguagacgagcauugcgguaaccgaggaccuucucuucgaacuaccacuguaacagggaagauaauacaugaguggugcugcaggucauguaccuugccgccuuuacgauucagaggugaggaugguuguugguacggcauggagauaagaccuguuaaggagaaagaagaaaacuuggucaagucaaugguuucugcagggagcggcgaaguugauucauucuccuuaggacugcugugcaucaguauuaugaucgaagaggucaugcgaaguagauggagucgaaagauguuaaugacggguacguuagcaguguuuuuucuauugaucaugggccagcugacuuggaacgauuuaauuaggcuauguauuauggucggcgcgaacgccucugaccgaaugggcaugggcacaaccuauuuagcacucauggccacguuuaagaugcgaccuauguucgcuguaggucuguuauuuagacguuuaacaucaagagagguacuucuccugacgauagguuuaucacuggucgcgagcguagaacuccccucaagucuugaagaauuaggagaugggcuggcaaugggaaucaugauccugaagcugcuuacugauuuccaaagucaucaacugugggcaacucucuuaucacuaacuuuuauuaaaacagcauucagcuuacauuaugcauggaaaacgauggcuaugguauuaagcauugugucauuauuuccccuaugucucucgacaacaagccaaaagacaacuugguuaccuguuuuauuagguucucuaggcugcaaaccauuaacuauguucuuaauugcagagaauaaaauuuggggacgcaagucauggccauuaaaugaaggaauuauggcuguaggaauuguaucgauauuguugucuucacuguuaaaaaaugacguccccuuagcuggcccguuaaucgccggaggaauguuaaucgcguguuaugugauaagugguucaagugcugaccuaucacuugaaaaagccgcagaaguuaguugggaagaggaggcugaacauaguggugcuagccauaauauccuuguagagguccaagacgauggaacaaugaaaaucaaagaugaagaacgcgaugacacacuuaccauacuucucaaagcgacgcuuuuagccguuagugguguuuacccguuaaguauaccagcaacacuauuugucugguacuucuggcaaaagaaaaaacaaagaagcggagucuugugggacacuccaaguccuccggaaguagaaagggcagucuuagacgauggaauuuaucguaucaugcaaagaggcuuauuaggacguagccaaguagguguagggguuuuccaagagaauguauuccauacaauguggcacgugacacgcggugcgguccucauguaccaagggaaaagauuggagccaucaugggcaagcguuaaaaaagaucuuaucaguuacgguggugguuggagauugcgcggaucauggaauacuggagaagaaguccagguaauagcaguagaaccgggaaaaaauccgaaaaacguacagacugcaccuggaacuuucaagacgccagaaggggaagucggagcgauugcucuugacuucaagccuggcacaucgggaucaccgauuguaaauagagaagguaagauaguuggauuauauggaaacggaguagugacaacgucggguacauauguuucggcaauagcgcaagcuaaagcuagucaagaaggaccacugcccgagauagaggaugaaguauuccgaaaacgcaacuuaacgaucauggaccugcauccuggaagugguaaaacgagacgauaucuucccgcgaucguuagagaagcaaucaaaaggaaguuacggacauugauccuagcgccaacaaggguuguggcaucugaaauggcagaagcauuaaagggaaugccgauuagauaucagacaaccgcaguuaaaagugaacacaccgguaaagagauugucgacuuaaugugucaugcgacauuuaccaugcgccuacuaagucccgucagagucccgaacuauaauaugauaaucauggaugaagcacacuuuacugauccgucgaguauagcugcuagaggguauauaaguacuagaguagggaugggugaagcggcggcuauauucaugaccgcuacuccuccagggucaguggaggcauuuccucaaucgaaugcgguaauacaagaugaggaaagagacauuccagaacgaucauggaauucaggauacgaguggauuacugauuucccugggaaaacuguaugguuuguuccaagcauaaaaucuggaaaugauaucgcaaacuguuuaagaaaaaacgguaaaagaguuauccaauugucgagaaaaacauuugauacagaguaucagaaaacgaaaaacaacgauugggacuauguaguaacaacagacauaagcgagaugggggcaaauuuccgcgcggacaggguaauagacccucgcagaugcuugaaaccaguaauauugaaagauggacccgaaagagugauauuagccggacccaugccaguuacgguggcaucggcugcacaacgaagaggaagaaucggaaggaaccacaacaaagagggggaucaauacauauauaugggacaaccgcuaaauaacgaugaagaucaugcacacuggacagaagcaaaaaugcuacuagauaauauaaauacuccagagggcauuauaccagcuuuauuugaaccggaacgugaaaaaagcgcagcgguagacggggaguaccgacuacgcggagaagcgagaaagacauuuguagaguuaaugaggagaggagaccuaccugucuggcugucauauaaaguugcaucagaaggauuucaauacucagauagaagauggugcuuugacggugaacgaaauaaccaagugcuagaagaaaacauggacguagaaauauggacaaaggaaggagaaagaaaaaaacuacguccgcgauggcucgacgcaagaacguacagugauccguuagcgcugagagaauuuaaagaauuugcagcggguagacgaaguguuucgggagaucuaauauuggagaucggaaaacuaccccaacauuuaacucaaagggcgcaaaaugcauuagauaaucuagucaugcuacauaacagugaacaaggagguagagcauauaggcaugccauggaagaguugccagacaccauugagacuuugaugcuauuagcgcuaaucgccguccuaacaggaggaguaacacuguucuucuuaagcggaaggggguuaggcaaaacuucaaucgguuuguuaugcgugauggcaucaucaguccuacuguggauggccucaguugagccccauuggaucgcagcaaguaucaucuuagaguuuuuucuuaugguacucuuaauaccugagcccgauagacaaagaacuccacaggauaaccaacuugcuuacgugguuauaggccuacuauuuaugauacuaacuguagcagcgaaugaaaugggauuauuagaaacaacaaagaaagacuuaggcaucgggcauguagcaguagagaaccaucaucaugcagcgaugcuugacguagaucuacauccagcguccgcauggacauuguacgcagucgccacuacuauaauuacuccgaugaugcgucauacuauagaaaauacgaccgcuaauauuagcuuaacagcaauagcuaaccaagcggcaauauuaaugggacuagauaaggguuggccaauaucaaaaauggacauaggcgucccucuucuugcacugggauguuacucacaaguuaacccauugacuuugacagcugcuguauuaauguuaguagcgcacuacgcuauuaucgguccaggauugcaagcaaaagccacucgagaagcucaaaaaaggacagcagcaggcauaaugaaaaauccaacaguagauggaauuguagcaauagaccuagaucccgucguauaugacgcgaaguuugagaaacaacugggacagauaauguuauuaauucuuuguaccucacaaauauugcuuaugcgaacaacuugggcguuaugugaaaguaucaccuuggccacaggaccuuuaacaacauuaugggaaggaagcccaggaaaguuuuggaauaccaccauagcaguaaguauggcaaacauuuucaggggaucauacuuggcaggugcuggcuuagcuuuuagucuaaugaagagccugggaggaggacgacgcggcacaggcgcccagggagaaacuuuaggagaaaaauggaagcggcaacuaaaucaacugucgaagucagaauuuaauacuuauaaaagauccggaaucauggaaguggauagaucagaggccaaggaggguuugaagcggggagagacgacaaaacacgcaguaaguagaggaacggcaaaacucagaugguucguugagcgaaauuuaguaaagcccgaggguaaaguaauagaccugggauguggaaggggugguuggagcuacuacugugcugggcuuaaaaagguaacagaaguaaaagguuacacgaaagggggaccaggacacgaagaaccaauacccauggcuacauauggguggaauuuggucaaacuucauucaggcaaagacguauucuucauaccgcccgaaaaaugcgacacucuucuuugcgauaucggggaaucaucuccaaaucccacaauagaagaagguagaacacuacgugucuuaaagaugguagagcccuggcuucguggaaaucaauucuguauaaagauacugaauccauauaugccauccgugguggaaacccuagaacaaaugcagagaaaacauggaggaauguuagugagaaauccacuaucccgaaauaguacacaugaaauguacuggguaaguugcggaacagggaauauuguuucugcaguuaauaugacuuccaggaugcuacuaaaucgauucaccauggcccacagaaaaccgacuuaugagagagauguggauuuaggaacaggcacccggcacguagcaguugaaccggagguugcaaaucuagauauuaucgggcaacggauagaaaacauuaagcaugagcacaagucaacuuggcauuaugaugaagauaauccguacaagacaugggcauaccacggcagcuaugaggugaaaccaucaggaagcgccaguaguauggucaaugguguuguaaagcuacuuacuaaaccuugggaugucauuccaaugguuacacaaauugcaaugacagauacaacaccauuuggccagcagcgaguauuuaaagaaaaagucgacacuaggacgccaaaagcgaaaagagguacugcacaaauaauggaagugacugcuagauggcuuuggggauuccuaucgaggaauaagaaaccaagaauuugcacuagagaagaguucacuagaaagguuagaagcaaugcagcuaucggagccguguucguagacgaaaaucaauggaacucagccaaggaggccgucgaggaugaaagguuuugggacuuagugcaucgugagagagaguuacacaagcaggggaaaugugcaacgugcgucuauaacaugaugggaaagagagaaaaaaaacuuggugaauuugggaaagcgaaggggaguagagccauaugguauauguggcugggugcacgauuccuggaguuugaggcauugggauucaugaaugaagaccauugguucaguagagaaaacaguuuauccggcguggaaggcgaaggacuacacaagcuagguuauaucuuaagggauauaaguaaaauaccuggaggaaacauguaugccgaugacacugcgggcugggacacaagaauaaccgaagaugauuugcaaaaugaggccaagaucacagauauuauggaaccagaacaugcucucuuggcaaaagcuauauuuaaacuaacuuaccaaaauaaaguugugagaguacaaagaccugcuaaaaacggcacuguuauggacgugauaucacgaagagaccaaaggggaaguggacaagugggaacuuauggcuuaaauacauuuaccaacauggaggcucagcucauacgucaaauggagucggaagguauuuuuucaccuucagaauuggaaacuccaaauuuagcagaaagagcacuagauugguuagaaaaauacggaguugaaagauuaaaaagaauggcgauaaguggugacgauugcgucgucaaaccaaucgacgaccgauuugcaacagcucuaacagcacugaacgauaugggaaagguuaggaaagauauaccacaaugggaaccauccaaagguuggaaugacuggcaacaagucccauucuguucacaucauuuccaccaacugauuaugaaagacgggagggagauugugguaccaugccgcaaccaagaugaacucguagguagagcacgaguaucgcaaggagcuggcuggucauuaagagaaacggcgugccuugggaagucauaugcacagauguggcagcuuauguacuuucauaggcgagaucuaagguuggcugcaaacgccaucuguagugcuguuccaguggauuggguaccaacaucacgaacuacuuggucaauacacgcucaccaucaauggaugacgaccgaagacauguuaucuguguggaauagaguuuggauagaagaaaaccccuggauggaggauaaaacacauauaaguucgugggaagaugugccuuaucuggggaagagagaagaucaauggugcgguucauugauaggacucacagccagagcuacaugggccacgaauauucagguagcaauaaaccaaguccgucgccuaaucgguaacgaaaacuaucuugauuacaugacaucuaugaaacgguuuaaaaaugaaucagaccccgagggagcacucugguaa

SEQ ID NO: 21577 - RNA, 9879 nt, Artificial Sequence
  derived and/or modified CDS sequence (opt6) from DENV-1__FJ410235__SS-prME
ucagugacaauguuacuuaugcugaugcccacagcuuuggccuuucauuuaacgacuagagggggugaaccucacaugauuguguccaaacaagaacgagguaaauccuugcucuuuaaaacaagugccggggucaauaugugcacacuuauagcgauggauuuaggagaguuuugcgaagauacaaugacguacaaaugcccuagaauaacagaagcugaacccgaugacguugauuguugguguaacgcaaccgauacauggguuacauauggcacaugcagccaaacaggagaacauagaagagauaaacgaucuguugcacucgcuccucacguuggucuuggcuuagaaacucguacugaaacuuggaugagcagcgagggugcauggaaacaaauacaacguguugaaacaugggcuuuacgacauccuggauucaccguuauagcacuuuuucuagcacaugcaauaggcacguccauaacucaaaaggguauuauauuuauauuacuuaugcugguuacaccuaguauggcuaugagaugugucgguauagguucuagggauuuuguagaaggucuaucgggagcaacuuggguugacgucguacucgaacacggaucauguguaaccacaauggcaaaagacaagccuaccuuagauaucgaacuucucaaaacggaaguaacaaacccggcaguacuacgaaaacuauguauugaggcgaaaauaagcaauacuaccaccgauucgagauguccuacacaaggugaggccacacucguggaggaacaagaugcuaauuucguauguagacgaacuuuuguggauagaggauggggaaaugguugcggcuuauucggcaaaggaucucugauaacuugcgcuaaauucaaaugcgucaccaaacuagagggaaaaacaguacaauaugaaaaucuaaaauauagcguaauaguuaccguucacacuggugaucaacaccaaguagguaacgaaucuacagagcaugguacaacugcaaccauaacgccccaggcuccgucuaccgaaauacaauugacagacuauggggcuuugacauuagauugcucaccucgaacagguuuggauuuuaaugaaaugguacuguuaacaaugaaggaaaaaucauggcuuguucauaaacagugguucuuggaucuaccucuaccguggacaaguggggcaucuaccucucaagaaacauggaauaggaaagaucuccuaguuacuuuuaaaacagcacaugcgaaaaagcaagagguagugguacuggggucacaagaaggggcuaugcauaccgcacuuaccggggcgaccgaaauccaaacaagcggcacaacuacuaucuucgcgggucauuugaaaugucgauuaaagauggauaagcuaacucuaaaaggcaugagcuaugucaugugcaccggcagcuucaaacuugagaaagaaguugcagagacccaacaugguacuguguugguacagauuaaguaugaggggacagacgcucccuguaagauaccguucaguacgcaagaugaaaaaggaguaacgcaaaaugguagauuaauaacuacaaacccuauaguaacggauaaagaaaagccaguaaacauagaagcggagccuccauuuggggagaguuacaucgugauaggagcuggugaaaaggcucuaaaauuaucuugguucaagaaagggaguaguauuggaaagauguuugaggcuacggcgcguggggcacggagaauggcaauauuaggggauaccgccugggauuucggaaguaucggagggguauuuacaagcguaggaaaauuggugcaucaaauauuugguaccgcauaugguguacucuucagugguguguccuggacaaugaaaaucggaaucgguguacuucucacuugguuaggcuugaacagccggagcacgagucuuaguaugacaugcauugccguugguuugguaacauuguauuuaggaguaaugguucaagcugacucaggaugcguuauaaacuggaaagguagagaauuaaaauguggaagugguauauucguaacuaacgaaguacauacauggacagagcaauacaaauuucaagcggauucacccaaaaggcugucagcggcaauaggaaaagccugggaagagggcguuuguggaaucagauccgcaaccagauuagagaacauaauguggaaacagauaaguaacgaacuuaaccauauuuuacuugaaaaugacaugaaguuuacagugguaguuggugacguagcuggcauuuuagcgcagggcaagaaaaugauucgaccacaaccuauggaauacaaauacucguggaagaguuggggcaaagcuaaaauuauuggagcagacguucagaauaccacauuuauuauugacggcccaaauacacccgaauguccagacgaccaaagagcguggaauauuugggagguagaagacuauggguuugguauauuuaccaccaauauuugguugaaauugagggacucauauacacaaguuugugaccacaggcuaaugagcgcagcuauaaaagauuccaaagcaguacacgcggauaugggguauuggaucgagucagagaaaaaugagacuuggaagcuggcccgcgcgucguucauagagguaaaaacaugcaucuggccaaaaucccauacucucugguccaacggaguguuagagagugaaaugaucguuccaaagauauauggagggccaauaagucaacauaacuacagaccaggcuacuucacacaaacugcuggcccuuggcaccucgggaaauuggaacuagauuuugaucuuugugaagggacuacagugguaguggacgaacacugcggaaauaggggaccuucauuaagaacaacaacuguaacaggcaaaauuauacaugaguggugcuguagaagcugcacauuaccaccauuaagguucaagggagaagauggauguugguauggaauggagauacggcccgugaaggaaaaagaagagaauuuagugaaaaguauggugucagcagggaguggagaaguagacucauucaguuuaggccuucuauguauuucuauaaugauagaggagguaaugcgauccagguggagucguaagaugcucaugaccggaacuuuggcuguauucuuuuuacuuauuaugggucaguuaacauggaaugaucuaauucguuuguguaucauggugggcgcaaaugcuagugauagaaugggaaugggaacuacauaucuugcucuaauggcaacuuucaaaaugagaccaauguucgccgucggucuauuguuucgacgauuaacaucaagagagguucugcuguugacaauaggucucucucucguugcgucgguagaacugccuaauaguuuagaagaacuaggugauggucuagcaaugggaauuaugauucuuaaacuccuaaccgauuuucagagccaucaacuuugggcaacacuucuuagucuuacauucauuaaaacaacuuucaguuugcauuacgccuggaaaaccauggcaaugguauuaaguauagugagcuuauucccauuaugucuguccacaacaucacagaaaacgacauggcuaccgguacuacuggggucgcucggauguaaaccucugacuauguuuuuaauagcggaaaacaaaaucuggggaagaaagucauggccccucaacgaaggaaucauggccguaggaauaguuucaauacucuuaaguucucuacuaaagaaugauguaccccuagcuggaccacuaauagccggagguauguuaauagcauguuaugucauaaguggaaguucagccgauuugucacuugaaaaagcggcugaaguuucgugggaagaggaagcugagcacucuggugccucacauaauaucuuaguggaaguccaagaugacggaaccaugaaaauuaaagacgaagagagagacgauacauugacaauucuucucaaagcgacccuccuggccguuucaggaguauauccucuuucaaucccugccacauuauuuguaugguauuucuggcagaagaagaaacaacgaaguggaguucuaugggacacuccuaguccacccgaagucgaaagagccguauuagacgacggaauuuauagaauaaugcaacgcgguuuacuuggcagaagucaaguuggaguaggggucuuucaagagaauguguuccacaccauguggcauguuacaagaggggcuguacuaauguaccagggaaaacggcucgaaccguccugggcuagugugaagaaagauuuaaucucauauggaggaggauggagacuacaaggaucauggaauacuggugaagaaguccaggucauugccguagaaccaggcaaaaacccuaaaaacguacagacagcacccggaacauuuaaaacaucagagggggaaguaggugcaauagcccuugauuuuaaaccugggacgucgggcagcccgauagugaaccgagaagguaaaauugugggacuuuacggaaauggcgucgugacaacuucggggacuuauguuagugcuauagcgcaagccaaggcuucacaagaaggaccuuuaccagaaauagaagaugaaguguuuagaaaacgaaaccuuacuauuauggaucuacauccagguucaggaaaaacccggcguuacuuacccgcaauagucagggaagcuauaaaaagaaaauugcguacucuaauuuuagccccaacuagagugguugcgucugaaauggcagaagcucucaaaggaaugcccauacgauaucagaccacugcuguuaaaucugaacacacaggaaaggaaaucguggacuugaugugucacgcaaccuuuacuaugagauuacuaaguccaguaagagucccaaauuauaauaugauaaucauggacgaagcacacuucacagaucccucuaguauugccgcccgagguuauaucucaacgagaguaggcaugggagaagcugcggcaauauucaugaccgcaacgccgccuggcaguguugaagcauuuccacaaagcaaugcaauuauucaggaugaagaacgagauauacccgaacgauccuggaacagugguuacgaguggauaacugauuuccccgguaaaacuguuugguucguaccuucgauaaagucagguaaugauauugcuaauugccuuagaaagaacggaaagaggguaauacaauuaucacgcaaaacguuugauaccgaauaucagaaaacuaagaacaaugacugggauuacgucgucacaacggauauaagugagaugggagcgaacuuuagggcagauagagugauagauccacgaagguguuugaaaccagugaucuuaaaagaugguccagaacgaguaauacuggccggaccuaugccaguaacuguggcgagcgcagcacaacgacgcgguaggaucgguaggaaucacaauaaagaaggagaucaauauauuuauaugggccaaccuuuaaauaacgaugaagaucaugcucauuggacagaagccaagauguugcuagacaauaucaacacaccggaaggaauaauuccagccuuauuugaaccugaacgagaaaagagugcggcaaucgauggagaguaucgacuaagaggggaggcucgaaaaacuuuugucgaacuuaugcguaggggugaucuacccgucuggcuaucauauaaaguugccagcgaggguuuucaauacucugauagaagaugguguuucgauggagaaaggaauaaccaaguacucgaagaaaauauggacguagagauauggacgaaagaaggagaaaggaagaaauuaagaccaaggugguuagacgcaagaacguacuccgacccccuagcacuaagagaauuuaaagaguuugccgccggaagaaggucgguaagcggagauuuaauuuuagagauaggaaaauuaccucaacaucucacucaaagggcacagaaugcacuugauaaccucgugaugcuucauaacucggaacagggagggagggcauauaggcaugcaauggaagaacuuccggacacgauagaaacuuuaaugcuguuagccuuaauugcugucuuaacagguggugucacucuguucuuucucucagggcgaggucuuggcaaaacgucuauaggauuguuaugcguaauggcaaguagcguucuacuauggauggcaucuguagagccccauuggauagcagcuuccauaaucuuagaauuuuuccuaaugguucuucugauuccggaaccagaccgacaaagaacaccccaggauaaccaauuagccuacguagucaucggcuuacuuuuuaugauucuaacaguggcugccaaugaaaugggauugcuagaaacaacaaagaaagaccuagguauaggucacguugccguugaaaaccaucaccaugcagccaugcucgacguagauuugcauccggccagugcauggacucuuuacgcuguagccacaacgauuauaacaccaaugaugcggcauacaaucgaaaacacgacugcuaauauaagucugacagcuaucgcaaaucaagcagcgauucuaaugggucuggacaaagguuggccaauuucuaaaauggauauagguguaccuuuauuagcacuaggguguuauagucaaguuaauccacuuacacucacagcggcaguauugauguugguggcacauuaugcaauaaucgggccuggauugcaagcaaaagcgacgagggaagcacagaaaaggacagcagcaggaaucaugaaaaaucccacgguagauggaauuguugcaauagacuuggacccuguuguuuaugacgcuaaauuugaaaagcaauuaggacaaauaaugcucuuaauauuaugcacgucucaaauacuacugaugaggacaaccugggcauuaugugaaagcauaacucuagcaaccggcccauuaacuacccucugggaaggaucaccggguaaauuuuggaauacuaccauagccguaagcauggcuaauauuuuuagaggaucauaucuagcgggagcugguuuagcuuuuagccuaaugaaaucauuaggaggaggccgaagagggacaggugcccaaggugaaacauuaggggaaaaauggaagagacaacucaaccaguuaggaaaaagugaauuuaauacauacaagaggagcgguauaauggaaguagacagguccgaagcgaaagaaggguuaaaacgaggcgagaccacuaaacaugcgguuucacgaggaaccgcgaaauuaagaugguucguugaaaggaaucuagucaagccugaagggaaaguaauagauuuagggugcggacgaggaggguggucauacuacugugcgggacuaaagaaaguaacggagguaaaagguuauacgaaagggggucccggacaugaagaacccauuccgauggcuaccuauggauggaauuugguaaaauuacauagcgggaaagaugucuucuuuauuccuccugagaagugcgacacuuuguuaugugauauaggagaaucgucaccgaauccaacgaucgaagaaggcagaacacucagaguccugaaaaugguugagcccuggcucagaggcaaucaauucuguauaaaaauauugaaccccuacaugcccuccguaguugagacauuagaacaaaugcaacguaaacacgggggaauguuggugagaaauccacugucgcgaaacucaacccaugagauguauuggguaucguguggcaccgggaacauaguaucagcaguuaauaugaccucuaggaugcuacuaaaccgguuuacaauggcacauaggaagccuacuuaugagagagauguggaucucggugccgggacgcgucauguagcaguugaaccagaaguugcuaauuuagacauuauugggcaaagaaucgagaauaucaaacaugaacauaaaucaaccuggcauuacgaugaggauaauccauauaaaaccugggcauaccacggaaguuacgaagugaaaccaucggguagugcuucuagcaugguaaacgguguaguuaaauuauuaacuaaaccgugggaugucauucccaugguuacacagauagcaaugaccgauacuacaccauucggucaacaaagaguguuuaaagaaaaaguagauaccaggacaccgaaggccaaacgugguacagcgcaaauaauggaagugacggcaaaguggcuauggggauuuuuaaguagaaauaaaaagccaagaauauguacgagagaggaauuuacuagaaaaguaaggaguaaugcagcuauuggagcaguuuucgucgacgagaaccaguggaacucggcaaaagaggcuguagaagacgaaagauuuugggaccugguacauagggaacgagaguugcacaagcaagggaaaugugcaacuugcguguacaauaugaugggaaaaagggaaaagaaauugggugaauuuggaaaagcgaaaggaagccgagcuauuugguacauguggcuaggagcaagguuccuugaauuugaagcucuugguuucaugaacgaagaucauugguuuagcagggagaauaguuuaucaggaguugaaggugaaggacugcacaaguuaggauauauuuugcgugacauaucaaaaauaccuggaggcaacauguaugcagacgauacagccggaugggacacacgcauaaccgaagaugaucugcaaaacgaagcuaagaucacugauauaauggaaccagaacaugcacuucucgcgaaaucuaucuuuaaacuaaccuaucagaauaaagugguaagaguacaacgcccagcuaaaaacgguaccguuauggauguaaucaguaggagagaccaaagaggaucuggccagguuggaacuuaugggcugaauacauucacuaacauggaagcgcaacugauaagacaaauggagucugaaggaauauucagcccaagcgaguuagagaccccaaaucuagcaggaagaguacuagauuggcuagagaaacauggggucgaaagauuaaagagaauggcaauaucgggagaugacuguguaguaaaacccauagacgacagauuugccacagcuuuaacugcauuaaacgauauggguaagguacgaaaagauauaccccaaugggaaccaucuaaaggguggaaugauuggcaacaagugccauuuugcucucaucacuuccaucaacuuauuaugaaggaugguagagaaauaguaguccccugcagaaaccaagacgagcucgugggacgugcacgaguaucacaaggagcuggauggagcuugcgagaaacggcauguuuagggaaauccuaugcucagauguggcaacuaauguauuuucacagacgugaucuacgacuagcugccaacgccauuuguagcgcgguaccuguagauugggucccaaccagcaggacaacuuggagcauacaugcacaccaccaguggaugacuacggaagauauguugucuguauggaauagaguguggauagaagaaaauccauggauggaagauaaaacacauauaucaucguggggagauguacccuaucugggaaagagagaggaccaaugguguggaucauuaauaggacugacugcucgagcaacuugggcuacuaacauacaaguagccauaaaccaggugcguagacuuauagguaaugaaaauuaucucgauuacaugaccagcaugaaacgauuuaaaaaugaaucugacccagagggugcauuaugguaa

SEQ ID NO: 21578 - RNA, 9879 nt, Artificial Sequence
  derived and/or modified CDS sequence (opt6) from DENV-1__FJ410236__SS-prME
agcgucacgauguuauuaaugcuuguaccaacagcacuugcguuucaucucacuacucgcggaggagaaccgcauaugauuguuaguaaacaagaacgagguaaaucacucuuauucaaaacuucagcgggaguaaauauguguacacuuauagcgauggauuuaggagaauuaugugaagacacaaugacauacaaauguccgagaauaacagagacagaaccagacgauguugauuguugguguaacgcaacugacacguggguuacuuaugggacguguagucaaacgggugagcaucgaagagauaaacguucaguugcauuagcuccucaugucgguuuaggucuagaaacaagaacagagacauggaugagcucagaaggggcuuggaaacaaauccaacgaguugaaacaugggcauuacgacauccagguuucacggucauagcacuguuccuugcacacgcaaucgguacuagcauaacgcaaaaagggauaaucuuuaucuuacuuauguuagugacucccagcauggcgaugagauguguagguauuggaucucgugauuuuguagaaggacuaagcggggcaacguggguggauguuguucuugaacacgguagcugcguuacaaccauggcaaaagacaaaccuacucuagacauugaguuguuaaaaaccgaagugacuaacccagcggucuuaaggaaauuaugcauugaggcaaaaaucucaaacaccacaacggauaguagaugccccacucagggggaagcuacauugguagaggaacaagaugccaauuucgucugucgacguacauuugucgaucgagguuggggaaauggaugcggauuauucgguaaagguucgcucaucacaugcgcaaaauuuaaaugcgugacgaaacucgaagggaagauaguucaauacgagaauuugaaauacagcgucauaguaacuguacauacuggggaccaacaccaaguuggaaaugaaagcacagaacaugggaccacugcaacaauuacuccucaggcaccgacaacagaaauccaacuaaccgauuacggugcacuuacauuagauugcucgccuagaacagggcuagauuuuaacgaaaugguguuacugacaaugaaggagaaaucauggcugguucacaaacaaugguuuuuagaucuuccguuaccuuggacaucaggggccaguaccucucaagaaacauggaaucgccaagaucuauuaguaaccuucaaaaccgcucaugcuaagaaacaagagguuguuguucucggaucccaggaaggagccaugcacacagcacucacuggagcuacggagauccaaacgagcggaacuacaacgauauuugcaggacaucuaaagugcagauugaaaauggacaaguugacauuaaaggggaugagcuauguaauguguacgggaucuuuuaaguuagaaaaggaggucgcagaaacgcagcauggaacgguuuugguacagauaaaguaugaaggaacugacgcgccuugcaaaauuccguuuucuacucaagacgaaaaaggggucacacagaaugguagacuuaucacugcaaaucccauagugacagauaaagagaaaccuguuaauauugaagcagaaccgccauuuggggaaaguuacauuguaauuggggccggugagaaagcuaugaaacuauccugguucaagaaaggaaguucgaucggaaagauguucgaagcaacggcaagaggugcgcggagaauggcgaucuugggagacacagcaugggauuuuggaucuauugguggaguguuuacaagcguaggaaaauugguacaccaaauauuuggaacugccuacggaguucuguuuagugguguuaguuggacaaugaagauaggaauagguguguuguuaacauggcuaggccuuaauucgagaaguacaagccuuucuaugacauguaucgcaguuggccuagucaccuuguauuugggugucaugguacaagcagauucaggcugcguaauuaacuggaaagguagagaacuuaaauguggcucagggauuuucguuaccaaugaaguacauaccuggacagaacaauauaaauuccaggcagacucgcccaaacgacuuagugcagccaucggaaaggcaugggaagaaggggucugcggaauccgaagugcaacacgguuagaaaauauuauguggaagcaaauuucuaacgaacuaaaucauauucuauuagaaaaugauaugaaauuuacagucgugguaggagacguagcgggcauacuugcacaagggaagaaaaugauacggccccagccaauggaauauaaauauucauggaaaaguugggguaaagcuaaaauaauuggagcagacguccagaauacuacuuucaucaucgauggaccgaauacacccgaaugcccagacgaucagcgggccuggaacaucugggaggucgaagauuacggguucgggauauuuacuacgaauauaugguugaaauuacgcgauucauauacucaaguaugcgaucaucgccuuaugucugcagcaauaaaagacucgaaagcgguucaugcugauauggguuacuggauagaaucggagaaaaaugagacauggaagcuagcuagggcuucauuuauagaagugaaaacaugcauauggccgaaaucacauaccuuguggucaaacggaguccuagaaagcgaaaugaucauccccaagauauauggagggcccauuucacagcauaacuaccguccaggauacuuuacacaaacugcaggcccauggcauuugggcaaacuggaguuagauuucgacuuaugcgaggguacaacagucguaguugaugagcauuguggaaauagagggccaucacucagaacaacuacaguaacgggaaaaaucauccaugagugguguugccgaaguuguacacugccuccauuaagguuccgaggagaggacggaugcugguacgggauggagauuaggccaguaaaggaaaaagaggagaaucuugugaaaagcaugguaucggcggggagcggugaaguagauucauuuagccuaggauugcuaugcauaaguauaaugauagaagaggucaugcguucuagauggucucgaaaaaugcucaugacaggcacauuggccguauucuuucuacugaucaugggacagcuaacauggaaugacuugauuagacuaugcauaaugguaggagcaaacgccucggauagaaugggaaugggaacgacuuauuuggcccuuauggcuaccuucaaaaugcguccgauguucgcuguaggcuugcucuuuaggagauuaacaaguagagaaguguugcuacucacaauagguuuaucauuagucgcaucaguggaauuaccaaauucgcuggaagaacucggggauggguuagcuauggguauaaugauacuuaaacuucuaacugauuuccaaagccaucaacuuugggccacacuacuaucguuaacuuuuauaaagacaacauucagucuacacuaugcuuggaaaacgauggcaaugguccuauccauaguuucucuauuuccucuaugucuuaguacaacgucacagaaaacaacuuggcugccuguacucuuggguucucuagguugcaaaccucugacaauguucuugaucgcagagaauaaaauauggggucggagauccuggccucuaaaugaagguauuauggcaguuggaauaguuucaauacuucuuucuucucuacuuaaaaaugacguaccccucgcaggaccuuugauugcgggcgggauguuaaucgcuugcuauguuauaaguggcagcagugcagaucuaagucucgaaaaggcagcggagguuuccugggaagaagaagcagaacacucuggagccucacacaacauuuugguggagguacaagacgaugggacgaugaagauaaaagaugaggagagagaugauacucuuacaauacuauuaaaagcaacauuguuagccguuucggguguauacccccuaucgauccccgcaacacuauuuguuugguauuuuuggcaaaagaagaaacaacgaaguggcguacuuugggacacaccaucuccgccagaaguagagagagcuguccucgaugacgguauuuacagaauuaugcaaagaggacuauuaggucgaagucaaguaggcguuggagucuuccaagaaaacguuuuucauacgauguggcauguaacccguggugcuguacuaauguaccaggggaagcgcuuagagccaucaugggccaguguaaagaaagaccuuauaaguuacggaggcggguggagguugcaaggcucauggaacacuggagaagaaguccaagucauagcaguugagccuggcaaaaaucccaaaaacguucaaacagccccagggacauucaaaacuccugaaggcgaagugggugcaauagcuuuagacuuuaaaccugguacgucggguucaccaauaguuaaucgcgagggaaaaaucguuggauuauaugggaacggaguggugacaacuucgggaacguauguaucagcaaucgcucaagcaaaagcgucgcaagaagggcccuuaccagaaaucgaagaugaaguuuuuaggaagaggaauuuaacaauuauggaccuccaccccggaucugguaaaacuagacgauaucuuccagcuauaguaagggaagcaauuaagagaaaauuacgaacccuuauacuagcaccuaccagagucgucgccagugagauggccgaagcccucaaagguaugccuauaagguaucaaacuacugcuguaaaaagcgagcauacaggcaaagaaauuguagauuuaaugugucaugcgacauuuaccaugaggcuacuaagcccugugcguguaccaaauuacaauaugauaauaauggacgaagcccauuucacagacccaagcagcauagccgcaagaggauauauaagcacccgagugggcaugggagaagcagcggcaauuuuuaugacagcaacaccaccggggucugucgaggcuuuuccacaaagcaaugcggugauccaagacgaagaacgagacauuccagagcgcaguuggaacucugguuaugaauggauaacggauuuuccagguaaaacaguuugguuuguaccuucaauuaagaguggaaaugacauugcuaauuguuuaaggaaaaauggaaaaagggugauccagcuuagcaggaaaaccuuugauaccgaauaucagaaaaccaaaaauaaugacugggacuaugugguuacgacagauauuucugaaaugggcgcaaauuuuagggcagauagaguaauagauccacgacgaugucugaagccaguaauauuaaaggacggaccugaacgaguuauauuggcuggaccaaugcccgugacagucgcuagugcugcgcaacgccggggacggauaggcagaaaucacaacaaagaaggcgaccaauauauuuacaugggucagccuuugaauaaugacgaagaucaugcucauuggacggaggcaaaaauguuauuagauaacauaaauaccccggaaggcauaauaccugcauuguuugaaccugaaagagaaaagucagcagcaauagacggagaauaucgucuccguggugaagcaagaaaaacauuuguagagcuuaugagacgaggagauuuaccuguguggcucucauauaaaguagccucagaggguuuucaauacucugaucgcagaugguguuucgauggugaacguaauaaucagguuuuagaggagaacauggauguugaaauuuggaccaaggaaggggaaaggaagaaacuaagaccacguuggcuggaugcuagaacuuauucugauccuuuagccuuaagggaguucaaggaguucgcugcugguagaagaucaguauccggagaccugauacuagaaauuggaaagcuaccacagcaccuuacacaacgugcacagaacgcuuuagauaaccuagugaugcuccacaauagcgaacaaggaggcagagcuuaucgacaugccauggaagaauuaccagacaccauugaaaccuugauguugcuagcacugaucgcaguauuaacaggaggaguaaccuuauucuuuuuaagcggacgugguuuaggcaagacaucaauaggucuauuauguguaauggcuucaucgguuuuacuauggauggcauccguagaaccacacuggauugcggcaucuaucaucuuagaauuuuucuuaaugguauuguugauaccugaaccggauagacaacggacaccacaagacaaccagcuugcauauguggugauaggacuacuuuuuaugauauuaacaguagccgcuaaugagauggguuuacuagaaacgacaaagaaagacuuagggauuggccacguagcgguggaaaaccaucaucaugcagcaauguuagacguagauuugcauccagccagugcuuggacacuauacgcugucgcuacuacuauuauaacaccgaugaugcggcauacaauugaaaauacgacugcuaacauaucauuaacggcuaucgcaaaccaggcugcaauccucaugggucuugauaaaggauggccgaucucaaaaauggauauaggaguaccucuauuagcacuuggguguuauucucaaguaaacccauuaacuuuaacggcugcuguucuaaugcuggucgcgcauuacgcaaucauugguccaggacuacaggcaaaagcaacgcgggaagcacaaaagcgaaccgccgccggcauaaugaaaaauccaacaguugauggaauugucgcaaucgacuuagauccaguaguauaugacgccaaguuugaaaagcaacuuggccaaauuaugcuacucauauuguguacgagccaaauccuacucaugagaacgacaugggcucucugcgaaucgaucacgcuagcaaccggaccccucacaacauugugggagggaucgccuggcaaauucuggaauacaacaauagcagugucaauggcaaacauauucagggguucguauuuagccggugcagguuuagcauuuucuuuaaugaaaagccuuggagggggacgacgaggaacgggggcacaaggagaaacccuaggcgaaaaauggaaaaggcaauuaaaucaacuaagcaaguccgaauuuaacacuuauaaaagaagugguauuauggaagucgacaggucugaggccaaagaaggguugaaaaggggagaaacaaccaaacacgcuguaucccgugggacagcuaaauuaaggugguuuguagaaagaaaccuaguuaaaccagaggggaaaguaauugaucugggguguggacgaggcgguuggucuuacuacugcgccggucuuaagaaaguaacugaagucaaaggcuauaccaagggagggccaggccacgaagaacccauuccgauggcaacauacggcuggaacuuagucaagcuacacucagggaaagacguauuuuucaucccaccagagaaaugugauacgcuuuugugcgauauaggggaaaguucgccaaacccaaccauugaagaaggccgcacauugagaguucuuaaaauggucgaaccuuggcucagaggaaaucaauuuuguaucaagauccuaaauccuuacaugcccuccguaguggaaacccuugagcaaaugcaaagaaaacacggagggaugcuuguaaggaauccgcuuaguagaaauagcacgcaugaaauguacuggguaucauguggaacgggaaauauagucagugcagugaauaugacaucuagaauguuauuaaaccgauuuacaauggcccaucgcaagccaaccuaugaaagagacgucgaccucggggcgggcaccagacacguggccguagagccagaaguagccaaccuugauaucaucggccaaagaauagaaaauauuaaacaugagcacaaaucaaccuggcacuaugacgaagauaacccauacaaaacaugggcauaucacggaucuuaugaagucaaacccagugggucugcuucaucaaugguaaacggaguuguaaaauugcucacaaaacccugggacgucauuccaauggugacgcaaauagcaaugacagauacaaccccauucggucagcaaagaguauucaaagagaaaguugauacaagaacaccaaaagcaaaacgaggaacggcacaaaucauggaaguaacugcuaaauggcucuggggguuucuuucaagaaacaaaaagccuaggauaugcacgagggaagaauuuacucguaaagugagaucaaaugcagcaauaggagcgguauuuguagacgaaaaucaauggaacucagcuaaagaggcuguagaggacgaacguuucugggaccuuguacacagagagagagaauuacauaaacaagguaaaugugcgacauguguauauaacaugauggguaaacgugagaagaaauuaggagaauuuggaaaagcaaaaggauccagagccauuugguauaugugguuaggugccagauucuuggaauuugaagcacuuggauucaugaacgaagaucauugguuuagccgagagaacucacuuagcgguguugaaggagaaggacuacacaaacuaggauauauacuacgagacauuuccaagauccccggcgggaauauguaugcagaugacacagcgggaugggauacccgaauuacugaggaugacuuacaaaaugaagcgagaauuacugacauaauggagccugaacaugcauuacuugcaaaaucaauauuuaaauuaacauaucagaacaaaguugucaggguucaaaggccggcaaagaaugguaccgugauggacguuaucaguaggagagaccaaagaggcucgggccaaguugggaccuacgguuugaauacuuucacaaauauggaggcacaauugauacggcaaauggagagcgagggcauauuuucuccgucagaacuagagacgccuaaccuggcggaaagaguauuagauugguuggaaaaguacggcguaaaacgacucaagagaauggcaauuucgggagacgacuguguggugaagccgauugaugacagauucgcuaccgcccuuacugcacuaaaugauaugggaaagguucgaaaagacauaccccagugggagcccaguaaggguuggaaugacuggcagcaaguaccauucugcagucaucauuuccaucaauuaaucaugaaagauggacgugaaauaguagucccuugcaggaaucaggaugaacuuguagguagagcaaggguaagccaaggugcuggcuggucccugagagaaacagcaugccuugggaagucguacgcucaaauguggcaauugauguauuuucaucgccgcgaccuaagacuagccgcuaaugccauauguucugcgguacccguggacuggauaccaacgagccguacaacguggagcauacaugcgcaucaucaauggaugacgaccgaagauauguuaucaguauggaauagaguauggaucgaagagaaucccuggauggaagauaaaacacauauaucaagcuggggugacguaccguaucucggaaagcgagaggaccaauggugcggcaguuuaauaggccucacugcaagggcaacaugggccacaaauauacaaguagcuauaaaccagguucggcgacuaauaggaaacgagaauuaccuugauuauaugacguccaugaagcgauucaaaaaugaaagcgacccagagggagcccuuugguga

SEQ ID NO: 21579 - RNA, 9879 nt, Artificial Sequence
  derived and/or modified CDS sequence (opt6) from DENV-1__FJ410238__SS-prME
ucaguaacuauguuauugaugcuuaugccaacagcucuggcuuuucauuuaacaacgcggggaggggaaccucacaugauuguuuccaaacaagagagggguaaaucuuuacuuuuuaaaaccucagccggugugaauauguguacacucaucgcuauggauuuaggggaguucugcgaggauaccaugacauacaaauguccucgcaucacggaagcagaaccagaugacguagauuguugguguaacgcuacggacacguggguaacuuauggaacaugcucacaaacgggcgaacacagaagagacaaacgcaguguagcuuuagcuccgcauguuggacuaggacuagagacuagaacagaaacuuggaugucuagugagggugcauggaagcaaauccaaagaguagaaacaugggcucucagacacccuggguucacgguaauugcgcuuuuccuugcgcacgcgauuggaacaaguauaacucaaaaaggaauaauuuuuauauugcuaaugcuagucacacccagcauggcuaugagaugcguuggaauuggcucaagagauuucgucgaaggauuaucaggugcgacauggguagacguuguacuugagcauggaucuugugugacaaccauggcaaaagauaagccuacccucgauaucgaauuguugaaaacugaaguaacgaauccagcaguauugcgcaaacuauguaucgaagcgaaaauaucaaacacuacaaccgauagcagaugcccuacacaaggugaggcgacucuaguagaggaacaagacgcaaacuucguuugucgaagaaccuuuguugauagaggaugggguaacggcuguggauuguuuggaaaagggucgcuaaucacgugugcuaaauucaaauguguuacaaaauuagaaggaaaaauuguucaauaugaaaaucuaaaauacagcguuauugucacaguccauacgggagaucaacaucaaguaggcaaugaguccacagaacauggaacgaccgcaaccauuacaccgcaagcuccaucgacagagauccaacuaacagauuauggagcauuaacauuagauuguaguccccgcacgggccuggauuuuaaugaaaugguacuauuaaccaugaaggaaaaaucauggcucgugcacaaacaaugguuucucgauuuaccuuugccuuggacaucaggugcaaguacuucucaagaaacauggaauagacaagaucuauuaguaacuuucaaaacugcacaugcgaagaagcaagaagugguuguacugggcagccaagaaggagcuaugcauacagcacugacaggagcgacagagauacaaacaagugguacaacaacaauuuuugcuggccaucuuaaguguagguuaaaaauggacaaacuuacguuaaagggaaugucguaugucauguguacuggcaguuucaaacuagaaaaagagguugcagaaacacaacaugguacaguauuaguucaaauuaaguacgaggguacagaugccccauguaagauuccuuuuuccacgcaagaugagaaaggugugacacaaaacgggcgcuuaaucaccgcaaacccuauuguaacugauaaagaaaaaccugugaacaucgaagcagagccaccguucggcgaaagcuauaucguaauaggagcgggagagaaagcacuuaaacugucaugguuuaagaaaggaaguuccauuggaaagauguucgaagcgacagcaagaggagcuaggagaauggccauucuaggcgacacagccugggauuuuggaucaauaggaggcgucuucacuuccguuggaaaguuaguucaccaaaucuucgggacugccuacgggguucuauucaguggagugaguuggacuaugaagauagguauaggcguauuguuaaccuggcuggggcuaaauucgcgcaguaccagucucucaaugacgugcauugcugucgguuugguuacauuauaucuugguguuaugguacaagcugauagcggcuguguuauuaauuggaaagguagggaauuaaaaugugggucggggauuuucgugacaaacgaaguacacacauggacagaacaauauaaauuucaagcugauucaccuaaaagauuauccgccgccauagggaaggccugggaggagggagugugugguauuaggucugcuacuagacuugaaaauauuauguggaagcaaauuagcaaugaacuaaaucacauccuacuagaaaacgauaugaaacugacagucguuguaggggauguggcagggauacuagcacagggcaagaaaaugauaaggccacaaccuauggaauacaaauauucguggaaaagcuggggaaaggcaaaaauaauaggugcagauguucaaaauaccacauuuauuauagauggaccaaauacgccagaaugccccgaugaccaacgugcguggaacauaugggaaguagaagauuaugguuuuggcauauuuacgacuaacaucuggcucaaacuucgagauucauauacucaaguaugcgaucauagauuaaugucugcagccaucaaggauaguaaggcaguacaugcagauaugggauacuggauugaauccgaaaagaacgagacuuggaaacuugcuagggcuuccuucauugaggucaaaacaugcauauggccaaaaucacauacucuauggagcaauggaguccuagaaucugagaugauaaucccuaagaucuaugguggcccgauaucucagcauaacuauaggccagguuacuucacgcaaacagcgggaccuuggcaccuaggcaaacucgaacucgacuuugauuugugcgaaggcacuacaguuguaguagaugaacauuguggaaacagagguccaucucucaggacuacaacgguuacuggaaagauaauucacgaaugguguugccguaguugcacccuuccgccuuugagauucaaaggcgaagacggguguugguacggcauggaaauucgaccuguaaaagagaaagaggaaaacuuaguaaaaucgaugguaagugccggaucgggugaaguugauaguuucagccuaggauuauuauguauuucuauuaugaucgaagaaguaaugcguuccagauggucuagaaagauguugaugacagguacauuagcgguuuucuuucuauuaauaauggggcaacuaacuuggaaugaucuuauaagacucuguauuaugguuggagcaaauacuuccgaccgcauggggaugggaacaacuuauuuggcauugauggcaacauucaaaaugcgaccaauguuugcgguaggacuacuauucagaagauuaacaaguagagagguauuacuacugaccauaggauugagccuagucgccagcgcugagcugccaaauagccuagaggaacuuggcgauggucuagcaaugggaaucaugauauuaaaacuucuaacggacuuccaaucccaccaacugugggcaacccuuuuaaguuuaacguucauuagaacuacuuuuagucuucauuacgcauggaaaacaauggccauggugcucucgaucguuagucuauucccauuaugucuaucuacgacaucgcagaaaacaacuugguuaccuguauuacuggguagucuuggcuguaagcccuugacaauguucuuaauagcugaaaauaagaucuggggacgaaaauccuggcccuuaaacgaaggaauaauggcaguuggaauuguaaguauucuccuaaguucacuccugaaaaaugauguaccccuugcgggaccuuuaaucgcuggcggcauguuaauagcuugcuauguaauuucuggaucuucggcagaccuuagcuuggagaaagcagcugaaguaucaugggaagaagaggccgaacauuccggcgcaucacauaauauacuuguagaaguacaagaugaugggacgaugaagaucaaagaugaagaaagagaugacacacuuacaauauuacugaaggcuacacuauuagcagucucgggggucuauccauugucuaucccagcaacucuuuuuguuugguauuucuggcagaagaagaaacaacguuccggaguuuuaugggauacaccuaguccgccugaaguugagcgagcugucuuggaugauggaauauaccgaaucaugcaacggggucuucuaggaagaagucaaguugguguuggaguuuuccaggaaaauguauuccacacuauguggcauguaacuagaggugcaguccucauguaccaagguaaaagacuggaaccaucgugggcuagugucaagaaagacuugauuucuuaugguggagguuggagacuacaagguucauggaauaccggagaagaaguacaagugauugcaguagaaccaggcaaaaauccuaaaaacgugcaaacugcuccuggaacuuuuaaaacgagugagggggaagucggcgcgauagcgcuugauuucaaacccgggacauccgggucuccaauagugaaccgugaagguaagauaguaggacuuuaugggaauggcguaguuacuacuucagguaccuauguaucugccaucgcucaggcuaaggccagccaagaagggccacuuccagaaauagaagacgaaguauuuaggaaacguaaccuuacaauuauggacuuacauccgggaucgggaaagacccgacguuaccugcccgcaaucguacgagaggcuauaaagagaagauuaaggacccuaauacuagcacccacucgaguaguagccagugagauggcugaagcucugaaggguaugccaaucagauaucaaacaacagcagugaaaagcgaacacacggggaaagaaaucguggaccuaaugugccaugcaacauucacaaugagacuuuuaucaccagugcguguaccaaacuacaacaugauaauaauggacgaggcacacuuuacggauccaucuucgauugcggcgaggggauauauauccacuagaguggguaugggagaagcagcugccaucuuuaugaccgcgacaccgccuggaaguguagaggcuuuuccucagucuaaugcaguuauacaagacgaagaacgugauauaccggaaaggucauggaauagcgguuaugaauggauaaccgacuuuccgggaaagacuguaugguuugucccaagcauaaaaucugggaaugauaucgcgaacugucuucgaaagaacgguaagcgugugauacagcucucucgaaaaacuuucgacacugaguaucaaaagaccaaaaauaaugacugggauuauguaguaacuaccgauauaagugaaaugggagcgaauuuucgagccgacagaguuauagauccucguagaugccucaaaccaguaauuuuaaaagauggaccagagcgaguuauccuugcuggaccuaugcccgucacugucgcuagugccgcccaacgaaggggucguaucggaagaaaccauaacaaagagggugaccaauauaucuauauggggcagcccuuaaauaacgaugaggaucaugcgcacuggacagaagcuaagaugcuucuagauaacaucaacacaccugaagggauaaucccagccuuguucgaaccggaacgcgaaaaguccgcugcaaucgauggggaguaccgauuaagaggugaggcaagaaagacauuugucgaguugaugaggagaggagaccucccuguauggcuaaguuauaaagucgcgucggagggcuuucaguauucagaucggcgauggugcuuugauggagaaagaaacaaccaaguccuggaagaaaacauggauguagagauauggacaaaagaaggcgaaagaaagaaguugcgaccaagauggcuugaugcaagaacguauucugauccauuagcacucagggaguuuaaagaauuugcagcgggccgaagaagcguuagcggagaccuuauucuagagauuggaaaauuaccucaacaucuuacucaaagagcacaaaaugcuuuagauaaucuugucauguuacacaauagcgagcaggguggaaggguuuaucgccacgcaauggaagaacuuccugauacgauugaaacacuaauguuguuagcucuaauugcaguauuaacgggaggaguaacucuuuucuuccugaguggccgaggacuaggaaaaaccagcauuggauuauugugcguaauggcaucuaguguuuuguuauggauggcgucaguagaaccccauuggauagcagcaucuaucauccuagaguucuuucuuaugguucuauugauaccagaaccagaccggcaacgaacgccgcaggauaaccagcuagccuauguugucaucggguuacuauucaugaucuuaacuguagcagccaacgagaugggacuacuagaaacgacaaagaaagauuuaggaauuggacauguagcaguugaaaaucaccaucaugcugcuauguuagauguugauuuacaucccgcauccgcuuggacuuuauacgcuguggcuacgacaauuauaacgccaaugaugcgacacacaauugaaaauacuacggccaauauuucacugacagcaaucgcgaaucaagcagcaaucuugaugggacuugacaagggcuggccuaucucgaaaauggacauuggcguuccguuacuggcuuuaggaugcuacagucagguaaacccguuaacacuaacagcugccgucuuaaugcucguagcacauuacgcaauaauagguccuggacuacaagccaaagcgacacgggaagcacagaaaagaacagcugcagguauuaugaaaaaucccacaguggacggcaucguagcaaucgaucuugauccagugguuuaugaugcuaaauuugaaaaacaacucgggcaaauaaugcuauuaauucuuugcacuucgcaaauacuacuuaugcgaacaacgugggcuuugugugaaucgauaacgcucgcgacgggaccccugacuacccuuugggaaggaagcccggguaaauuuuggaacaccacaaucgccguaagcauggcuaauauuuuuagaggaaguuaccuggcgggggcuggcuuagccuuuucuuugaugaagucucuagggggaggaagaagaggaacaggcgcgcaaggcgaaacguuaggcgaaaaauggaaacggcaguuaaaccaacugaguaaaagugaguuuaacacguauaaaagauccggaauaauggagguggauagaucagaagcaaaggaaggacuaaaacgaggcgagacaacaaaacacgccgucuccagggguaccgcuaaacuaaggugguucguugagcguaacuuagucaaacccgaagggaaaguuauugauuuagguugcggaaggggagguuggaguuauuacugugccggucuuaagaaagugacagaaguuaaaggcuacacaaaagguggacccggccaugaagaaccaauuccuauggccacauauggauggaauuuaguaaaacuacauucagguaaagauguauucuuuauuccacccgaaaaaugugacacauuacuaugcgauaucggagaaucaagcccaaauccuaccauagaagaaggucgaaccuuacguguacugaaaaugguagaaccaugguuaagaggaaaucaauuuuguauaaaaauuuugaacccauauaugccuuccguuguagaaacuuuggaacaaaugcaaaggaaacauggugggaugcuaguacguaacccuuugaguagaaacagcacccacgaaauguauugggugucauguggaacuggaaacauagucucagcaguaaauaugacgagucgaaugcugcuaaaucguuuuacaauggcccacaggaaacccacguaugagagagacguggaucuaggagcuggcacccgacauguagcugucgagccugaaguagcaaaccuugacauaauaggacaaaggauagagaauaucaaacaugaacacaaauccacguggcacuacgacgaagacaacccguauaagacaugggcauaucauggaucauacgaaguuaaaccauccggcagcgccucgucaauggucaauggugucguuaaacugcuuacaaaacccugggauguaauaccuaugguaacgcaaauugcgaugacugacacaacaccauucggucaacagaggguauuuaaagagaagguagacaccaggaccccuaaagcgaaaaggggcacugcccaaauaauggaaguaacugccaaauggcuauggggguuucuaucacguaauaagaaaccgcgaauuuguacaagagaagaguucacuagaaagguccguucuaaugcugcuauaggagccguauuugucgacgagaaccaguggaauagugcaaaagaagcuguugaagacgaaagauuuugggacuuaguacacagagaaagagaauugcacaaacaagggaaaugugcaacauguguauauaacaugaugggaaaacgagagaaaaaguuaggagaguucggcaaggcgaagggaucucgugcaauaugguauauguggcucggagcacgguucuuagaauuugaggcuuuaggguuuaugaacgaagaucacugguuuuccagagaaaauucauuauccgguguagaaggagaaggucuacauaaacuaggcuauauacucagagauauuagcaaaauccccgggggaaacauguaugcugacgauacggcagguugggauacgagaauaacugaagaugaccuacaaaacgaggcuaaaauaacagauaucauggaaccggaacaugcauuacuagcuaaaaguaucuuuaaacuaaccuaccaaaacaaaguaguucgaguacaaaggccagccaaaaacgggacagugauggauguuauuaguagaagagaucaaagagguucaggacaaguggguaccuacggucuuaauacauuuacaaauauggaggcccaauuaauacgacaaauggagagcgagggcauauuuucacccucagaguuggaaacuccaaaccuagcuggacguguucuggauugguuggagaaacauggaguagagcggcuuaaaagaauggcuauuucuggagaugauugcguaguaaaaccuauugaugacagauucgcuacugcacuuacagcucugaaugauaugggaaaaguuagaaaggauauaccacaaugggagccgagcaaaggauggaacgacuggcagcaaguaccauucuguucgcaccauuuucaucaauuaauaaugaaagaugguagagaaaucguugugccuuguagaaaccaagaugaauuaguagggagagcgcgaguaucccaaggggcuggauggagucugagggaaaccgcuuguuuaggaaaaaguuaugcccaaauguggcaguuaauguauuuucacagacgggacuuacgccuugccgcaaaugcaauuuguagcgcaguacccguagauuggguuccgacaucacggacgacauggagcauacacgcucaucaccaguggaugacgacggaagauaugcuaucaguauggaaucgaguuuggauagaagaaaacccauggauggaggacaaaacacacguuucuaguuggggcgauguuccuuauuuagggaaaagggaggaucaauggugcggaagccucauaggucuaacugcuagggcgacgugggcuacaaauauacaaguugcaaucaaucaaguccgacgguuacuggggaaugaaaacuauuuagauuacaugacuucaaugaagagauucaaaaaugaaagcgauccugagggggcuuuaugguaa

SEQ ID NO: 21580 - RNA, 9879 nt, Artificial Sequence
  derived and/or modified CDS sequence (opt6) from DENV-1__FJ410239__SS-prME
ucaguaacaauguuacugauguugaugccgacugcacuagcguuucaccuuacgaccagaggaggagaaccacauaugaucguuucuaaacaagaaagaggaaaaaguuuacuauuuaaaacguccgccgguguuaauaugugcacauuaauugccauggauuuaggugaacuuugcgaagauacaaugacauauaaaugcccacggauuacagaaacagaaccggaugauguagacugcugguguaaugcaacagauacgugggugacauacgguacauguagucaaacuggggaacauagacgggacaaaagaaguguagcuuuggcaccacauguaggacuuggauuggagacacguaccgagacuuggaugaguucugaaggagcauggaaacaaauacaaagaguggaaacaugggcauugcgacacccugguuuuaccguuauugcucuuuuucuugcacacgcaauuggaacaucgauuacccaaaaaggaauaauauucauacuacucauguuggugaccccgaguauggcaaugagauguguaggaauuggaucaagagacuuuguagagggacugaguggagcgacauggguugacguuguacucgaacacggaucuuguguaaccacuauggcaaaagacaaaccaacgcuagacaucgaacuucuuaaaacugaaguaacgaacccagcuguucuccguaaauuauguauugaagcaaaaauauccaacacuaccacagauagcagaugucccacccaaggcgaagcaacacugguugaagaacaagaugcuaauuuuguaugcagaaggacauucguggauagaggauggggaaauggaugcggacuguucgguaaagguucuuuaauuaccugugccaaauuuaaauguguaaccaaauuagaaggaaaaauagugcaauaugaaaacuuaaaauacucaguuauagugacuguccauacuggcgaccaacaucaagucggcaacgaaaguacagagcaugguacaacugccacaauaaccccucaagcaccaacuacagagauacaacuaacagauuauggggccuuaacacuggauugcucaccgagaacuggauuagauuuuaacgaaauggucuuauuaaccaugaaagaaaaaucuugguugguucauaaacagugguuucuggaccuacccuugccauggaccagcggugccucuacuucccaagaaacuuggaauagacaagauuuauugguuacauucaaaacugcacacgcgaagaaacaagaagucguugugcucgggagccaagagggugcaaugcauacugcacugacaggagcaacggaaauacaaacaagugggacaaccacaauuuuugcaggccaucucaaaugccgucuuaaaauggauaaacucacucuaaaaggcauguccuauguaauguguacaggcuccuucaaauuggaaaaagaauuagcggaaacacaacacgguacaguucugguacaaaucaaauacgaagggacggaugcacccuguaagauaccauucaguacacaggaugaaaaaggaguuacucaaaauggaagacucauuacugcgaauccgauuguaacagauaaggaaaagccugugaauaucgaagcagagccaccguuuggagaaucauauauuguuauaggagcuggggaaaaagcucuaaaacuaaguugguucaagaaagguagcagcauuggaaaaauguuugaggcgacugcuaggggagcaaggagaauggcaaucuuaggggacacugcaugggacuuuggauccaucgguggcguguucacaucugcgggaaaacucguccaccaaauauuugggacagccuauggaguuuuauucuccgguguuaguuggacgaugaaaauagggauuggaguacuucuaaccugguuaggacuuaauucaagaaguaccucuuuaagcaugacauguauagcgguagguuuaguuacacucuauuuaggagucaugguacaagcagacuccgggugugugauuaacuggaaagggagggaacuuaaguguggaucaggcauuuucguuacaaaugagguacauaccuggaccgaacaguauaaguuucaagcugauucgccuaaaaggcuuagcgccgcuauaggaaaagcaugggaagaggggguaugugguauacggucagcaacacgccuagagaacauaauguggaaacaaauuucaaacgaauugaaucauauacuauuagaaaacgauaugaaauuuacugucguaguuggagacguagcaggcauucuagcccaaggcaagaaaaugauaagaccacagccaauggaauacaaauauucauggaaauccuggggcaaagcuaaaauaauaggagcagaugugcaaaacacaaccuucaucauugacgggccuaauacaccugagugucccgacgaccaacgagcuuggaacaucugggaaguugaggacuacggauucggcauauucaccacaaacauuugguuaaaauuaagagacagcuacacacaagucugcgaccacagacuaaugagcgccgcaaucaaagauagcaaagcaguucaugcugacaugggauacuggauagaaucagaaaagaaugaaacauggaaauuggcaagagcaucuuuuauugaaguaaagacauguauauggccaaaaagucauaccuuaugguccaauggaguuuuagaaucagaaaugauuauaccaaaaaucuacggcgggccuaucucacaacauaauuauagacccggauacuuuacacagaccgcgggaccauggcaucucggcaaacuagaauuagacuucgacuugugugaaggaacuacgguggucguugacgaacauuguggaaauagaggcccaucacuaaggacaacaacagucacgggcaaaauuauccacgaaugguguuguagaagcuguacacuucccccacugagauuuagaggcgaagauggauguugguauggaauggaaauuaggcccguaaaagaaaaggaagagaauuuaguaaagaguaugguaagugcggguaguggugaggucgauagcuuuagccuuggacuccuaugcauaucuauuaugauagaagaagugaugcgaucccgguggucacgaaaaaugcucaugacaggcacuuuagcgguuuucuuucuacuaauaaugggccaauuaacauggaacgaucuuauacgacugugcauaauggugggagcuaacgcaagugaucgaauggguaugggaacgaccuauuuagcacugauggcaaccuucaaaaugagaccaauguucgcugucggguuauuauuuagacgccuaacaucucgcgaaguucuacuguugacuauagggcuaucauugguagcuucuguagaacucccaaauucucuugaagaauuaggagacggcuuagccauggggauaaugauucuaaaguuacugacugacuuucaaagucaucaauuaugggcgacgcuauuaagccuuacauuuauuaaaacuacauuuaguuuacauuacgcauggaaaacuauggcaaugguauuaagcauuguuucgcuuuucccauuaugccuuuccacuacuucucagaaaacaaccugguuaccagucuuucuaggaagccucggauguaaaccacuaaccauguucuuaaucgccgaaaauaaaauauggggaagaagguccuggccucuuaacgagggaauaauggcagucggaauaguaucaauacuacuuagcucacuauugaaaaaugacguaccauuggcaggucccuugaucgcuggagggaugcuuauagcauguuacgucauaucagguucaagcgccgacuuaagucuagaaaaagcagcagagguaagcugggaagaagaagcagagcacagcggugcaucucauaauauccuaguugaaguccaagaugaugguacaaugaaaaucaaagaugaagaacgcgaugacacgcuaacaaucuuacucaaagcgaccuuacuagcagugaguggaguauauccguuaucaauuccugcaacuuuguuuguaugguauuuuuggcagaagaagaaacaaagaucaggaguccuaugggacacuccaucaccucccgagguagaaagagcuguucuagaugauggaaucuaucguauuaugcaacggggacuguugggucgcagccaaguuggggucgguguauuucaagaaaacguuuuucauaccauguggcauguaacucguggcgcuguucuuauguaccaggggaaacgccuggaacccucuugggcauccgucaagaaagaccucaucucauauggaggcggguggcgucuccaggguaguuggaauacaggagaagaaguacagguaauagcaguugaaccagguaaaaacccaaagaaugugcaaacagcccccggaacauuuaaaacaccugaaggcgaggucggcgcaauugcacuagauuuuaaaccugguacauccggcagccccauuguuaaucgagaaggaaaaauagucggucuauauggcaacggagucguuacaacgaguggaaccuauguuucagccauugcucaggccaaagcaucacaagaggguccccuuccagaaaucgaagaugaagucuucagaaaaagaaauuuaacaauaauggaucuucacccagguucggguaaaacucggagguaccuuccagccauugugagagaggcaaucaaacgaaagcuaagaacgcuuauacuggcucccacacggguaguggcaucugaaauggccgaggcuuuaaaaggcaugcccauucgauaccaaacgacugcaguaaaaucagagcauacuggcaaagagauaguagaccuaaugugucaugcaacauucacaaugcguuuauuaagcccaguuagaguccccaacuauaauaugauaauuauggaugaagcgcacuucacugauccaagcaguauagcggcuagagguuacauaaguacuagaguugguaugggcgaagcugcggccauuuuuaugacugcaacgccacccgguuccguagaagcauucccccaaagcaaugcaguaauccaggacgaagaacgagacauaccagagcgaucuuggaacaguggauacgaguggauuaccgacuuuccaggcaaaacgguuugguuugucccaucaauuaaauccggaaacgacauugccaauugccuaagaaagaauggaaagagagugauacaacuaagccgaaaaacauuugauacagaguaccagaaaacuaaaaacaacgacugggauuauguuguaacaacagauaucucugaaaugggggcaaacuuucgagccgaucggguuaucgauccuaggcgauguuuaaaaccgguaauauugaaagaugguccugaacgaguuauauuagcuggaccaaugcccguaacaguagccagugcggcccaacgucgggguagaauagggagaaaccauaauaaagagggagaucaauauauauauauggggcagccacuaaacaacgaugaggaucacgcucacuggacagaggcgaaaauguuacuagacaauauuaacacgccugaaggaauuauaccugcuuuauuugaaccagagagggaaaaauccgcugcaauugacggcgaauaccgacuaagaggagaagcgagaaagaccuuuguugaacuaaugcgaagaggugaucuaccgguuuggcuuucauauaagguugcaucugaaggauuccaauacucagauagaagguggugcuuugacggagaacguaauaaccaaguacuagaggaaaauauggauguggagauauggacgaaagaaggugaaaggaagaaacuuaggccacgaugguuagacgcgaggacauauucagauccacuagccuugagagaauuuaaagaguuugccgccggucgaaggucuguaagcggcgaucugauuuuggagauaggaaagcuaccacagcaucuuacacagcgagcgcaaaaugccuuagauaaccuagugauguugcauaacagcgaacaaggagggcgugcguauagacaugcaauggaagaacuaccagauaccauagaaacacuaaugcuccuugcuuugauugccguacugacuggugggguaacgcuauucuuucuuucagguagagggcucggaaaaacuucuaucgggcugcuuugugugauggcuucaucuguacuauuauggauggcaucaguagaaccccacuggauugcagcuuccauuauuuuagaguucuuuuuaauggugcuucuaauuccugaaccugauagacagagaacuccgcaagacaaccaauuagccuacgucguuauaggcuuacuauucaugauacuaacagucgccgcaaaugaaaugggauuguuggaaacgacaaagaaagaucugggcauaggucacgucgcuguagaaaaucaucaccacgcugcuaugcuugacgucgaucuucauccugccagcgcuuggacauuauacgcaguagcaacgacaaucaucacaccaaugaugcgacauacaauugaaaacacaacggcgaauaucagcuuaacagcgauagcaaaucaagcugcaauauuaaugggauuagauaaaggauggccuaucucuaaaauggauauuggagugccauugcuugcuuuagguuguuauucgcaaguaaauccguuaacucugacugccgcaguguuaauguuaguagcccacuaugcaaucauaggaccaggacuacaagcaaaagcaacacgagaagcacagaaaagaacggcagcgggaauaaugaaaaacccgacaguugauggaauuguagccaucgaucuagacccugugguuuacgaugcgaaauuugaaaaacaauuaggacagauuaugcuacuaauacucugcacaagccaaauuuugcuaaugagaacaacuugggcccucugcgaaagcauaacccuagcuacaggaccgcuaacaacucucugggaaggaucuccagguaaauuuuggaauacaacuaucgcuguaucaauggcgaauauuuuuaggggaucguaccuugcgggagcugggcuagcuuucucauuaaugaaaucgcuagggggaggacgucgugguaccggugcgcaaggugaaacccucggagagaaguggaaaagacaguugaaucaauugucuaaaucagaauuuaacacauacaaaagaucaggcauaauggaaguugaucgaagugaagcuaaggagggcuugaaaagaggugaaacuacgaaacaugcuguuaguagagggaccgcaaaacuuaggugguuuguagaacguaaucuugugaaaccugaagggaaagucauugacuugggcugugggaggggaggauggucauacuauugcgcuggucugaagaagguaacggaaguaaaagguuacacaaaagggggaccuggucacgaagaaccgaucccaauggccaccuaugguuggaacuuagucaaacugcacagcggaaaagauguuuucuuuauaccgccugagaaaugugauacacuuuugugcgauauaggggaaaguuccccgaauccaacaauagaagaagggaggacgcugaggguacuaaaaaugguggaacccugguuacgagguaaccaguuuuguauaaagauacucaacccauauaugccauccgugguagagaccuuggaacaaaugcaaaggaaacacggaggaaugcuugugcguaauccauuaagucgaaacucgacacacgaaauguauugggucaguugcggaaccgggaauauuguuagcgcugucaauaugaccucuaggaugcucuuaaauagauuuaccauggcacauaggaaacccacguacgaacgagauguagaccuaggagcgggcacccgccauguagcuguugaaccagaaguugcaaaccuagauaucauaggacaacgaauagaaaauauaaaacaugaacacaaaucgacuuggcauuaugaugaagauaacccuuauaaaaccugggcuuaucauggcucuuacgaggugaaaccaucuggaagcgcuuccuccauggucaauggugucgugaaguuacuaacgaaaccuugggacgucauaccaauggugacacagaucgcaaugacagauacaacgccuuuuggucaacaaaggguuuuuaaggagaagguugauaccagaacucccaaagccaagcgcgguaccgcgcagauaauggaaguuaccgcgaaaugguuauggggauuucucucucggaauaagaaaccccggaucuguacaagagaagaguuuacacggaaggugcgaucgaaugcagcaauuggggccguauucguagacgaaaaucaguggaauagugcgaaagaagcaguggaagacgaacguuuuugggaccugguacacagagaacgggaacuacauaaacaaggaaaaugcgcaacuugugucuauaacaugauggguaagcgagagaagaaacucggggaauuugggaaagcaaaagggucuagagcuauaugguauaugugguuaggagcaagauucuuggaguuugaagcacuaggguuuaugaacgaagaucacugguucagucgugaaaauaguuugagcgguguagaaggagaaggguuacacaaguuagguuacauucuucgcgauauuaguaaaauucccggugggaauauguacgcagacgacacugcagguugggacacuagaaucacagaagaugaccuacagaaugaagcaagaauaaccgauauaauggaaccggaacaugcucucuuggcaaagagcauauuuaaauuaaccuaccagaauaaaguggucagaguacaaaggccugcgaaaaacgggacuguaauggauguuauuagcagacgagaucagaggggcucuggacaagucggaacauauggauuaaauacuuuuacaaauauggaggcccaacuaauucgacagauggaaagcgaggguauauuuagucccucugaacuggaaacacccaacuuggcugaaagaguccuagacugguuggaaaaguacgggguagaaagacucaaacguauggcuauaaguggugacgacuguguagugaaaccaauugacgaccgauuugcaaccgcuuuaacugcucuuaaugauaugggaaagguaagaaaagauauuccacaaugggaaccuucuaaaggauggaaugauuggcaacaagugccauuuuguucccaccauuuucaccaacuaauuaugaaagacggccgagagauuguuguaccgugccgaaaucaggaugaauuagucggcagagcuagagugagccaaggggcaggguggagucuacgugagacugcuugccuagggaaaaguuacgcacagauguggcaacuuauguauuuccauaggagagacuugcgcuuagccgcuaaugcgaucuguucggccguaccggucgacuggaucccuacaucacgcacaacauggucaauucaugcacaucaucaauggaugacaaccgaagauaugcucucaguguggaaccgggucuggauagaagaaaaucccuggauggaagauaaaacgcauauaagcaguuggggagacguuccuuauuuggggaaaagagaagaccaauggugugggucccugauaggccucacggcucgagcuacuugggcaaccaacauacaaguagcaaucaaucaaguacgacgcuuaaucggcaacgaaaacuauuuggauuauaugacuucaaugaaaagguuuaaaaaugaauccgauccagaaggagcacuaugguag

SEQ ID NO: 21581 - RNA, 9879 nt, Artificial Sequence
  derived and/or modified CDS sequence (opt6) from DENV-1__FJ410240__SS-prME
aguguaaccauguuguuaauguuaaugccaaccgcguuagcauuccacuuaacgacuagggguggagaaccacauaugauagucucaaaacaagaaagagguaaaucauugcuuuucaaaacuucugcggggguaaauauguguacccucauagcaauggaccuaggugaauuuugugaagauaccaugacauauaaauguccccgaauaacugaagcggagccugacgauguugauugcuggugcaaugcaacggauacguggguuacauauggaacuugcucgcaaacaggagaacacaggagagauaaacguucaguugcccuagcuccacacgugggacuaggacuagagacgagaacugaaacauggaugagcucugaaggagccuggaaacaaauucaacguguugagacaugggcauuacggcacccaggauucacgguuaucgccuuauuucuagcucaugcaaucggaacuucuaucacgcaaaaaggcauaauauucauuuuauuaauguuaguaacaccaagcauggcuaugagguguguaggaauagggucacgugauuuugucgagggcuuaucgggcgcuaccuggguagacguugugcuagagcauggaucaugugugacuacgauggcaaaagauaaaccuacccuugacauagaauuguuaaaaaccgaaguaaccaauccagccguauuaagaaaacugugcauagaagccaaaauaaguaauacuacaaccgacucgcgcuguccaacccaaggagaggcaacacuggucgaagaacaggaugcuaauuuuguaugccggaggacguuuguugaucgugguuggggcaauggauguggacuauucggaaaaggcagcuuaauuacuugcgcaaaauuuaaauguguaaccaaauuagaaggaaaaacugugcaauacgaaaaucuuaaauauucugucaucguaaccgcucauacaggagaucaacaucaagucgggaaugaaaguacagaacacgggaccacagcgacaauuacaccacaggcuccaaguacugaaauucaacugacugacuacggagcgcucacauuagauugcaguccgcgcaccggacucgacuucaaugaaaugguauuauuaacgaugaaagagaaaucauggcuuguccauaaacagugguuucuagauuuaccuuuacccuggacaucaggugcuucaacaagucaagaaacauggaauagaaaagaucuacuuguaacauuuaaaaccgcacacgcuaagaaacaagagguuguuguacuggggucucaagaaggagcuaugcacacagcauuaaccggagcaacagaaauacaaacgaguggcaccacaacaaucuuugcaggccaccuaaaauguagacuuaaaauggauaaacuuacauuaaaaggaaugaguuauguaauguguaccggguccuuuaaauuagaaaaagaggucgcagaaacacaacauggaacaguguuaguucaaauuaaauacgagggaacugacgcaccauguaagauuccuuucucaacucaggaugagaaggguguuacccaaaauggacgccuaauuacugcuaauccuauuguaacagauaaagaaaaaccgguuaacaucgaagccgaaccuccauuuggagaaaguuacauagugauuggugccggugaaaaagcauuaaagcuaucaugguuuaagaaagggagcagcaucgguaaaauguucgaagcuaccgcccgaggagcucguaggauggcaauauuaggugauacggcgugggacuuugguagcauaggagggguuuucacaaguguagggaaguuaguacaucaaauuuucgguacagcuuacgguguauuauucucaggaguaucauggacgaugaaaauugguauagguguucugcucaccuggcuuggacuuaauucaagaucgacaagccucuccaugaccuguauagcaguaggucuagucacucuauaucucggugucaugguucaagcagauucaggcugcguaauaaacuggaagggacgagaauuaaaaugcgguucgggaauauuuguaacuaaugaaguacacacguggacggagcaauauaaauuucaggcagauucaccuaaacgacucagcgcggcuauuggaaaagcgugggaggaaggcguuugcggaauacgaagcgcuacacgucuugaaaacaucauguggaaacaaauuucaaaugaauuaaaucauauauugcuugaaaaugauaugaaauuuacuguaguagucggugauguugcagguauuuuggcacaaggcaagaaaaugauccgaccucagccaauggaauacaaguacuccuggaagaguugggguaaagcuaaaauaauuggggcagauguacaaaauaccacauuuaucaucgacggaccuaauacacccgaaugcccugaugaucaacgagcguggaacauuugggagguugaggacuauggauuuggaaucuuuaccacuaauaucuggcuuaaguugcgugauaguuauacacaaguaugcgaucacagacuaaugucagcagccaucaaagacucaaaagcagugcaugcggauaugggauauuggaucgaauccgagaagaaugaaacauggaaguuagcucgggcaaguuucauugagguaaaaaccugcaucuggccgaaaagucacacccuauggucaaacggaguguuggagucugaaaugauaauucccaaaauauauggugggccuauuucucaacacaauuaucgcccuggauacuuuacgcaaacagcaggcccguggcaccuuggaaaacuagaacuagacuuugacuuaugcgaagguacuacaguaguuguugaugagcauuguggaaaccgaggaccaucucuucggacaaccacagugacugguaagauaauucaugaaugguguugucgcagcuguacacuuccaccuuuaagguucaagggugaagaugguuguugguacggcauggaaauccgaccagugaaggaaaaggaagaaaauuuaguaaaaucuauggucucagcggguucaggggaaguagauucuuuuucacugggauuacuuugcauaucaauuaugauagaagaaguuaugagaucaagauggucaaggaaaaugcuaaugacggguacacucgccguauucuuucucuuaauuaugggacagcuaacuuggaaugaucucauaagacuaugcauuauggugggagcgaacgcgagugauagaauggggaugggaaccacauaucuagcucugauggcgacauuuaagaugcggccaauguucgcaguaggucuccuauucagaagauugacaaguagagagguguuacuuuuaacaauaggacugagccugguagcuagcguugaauuaccaaacucuuuagaggaauuaggagaugguuuagcaauggggauaaugauacucaaauuacuuacugacuuccagagccaccaguuaugggcuacccuacuaucccuaacauucauuaaaacuaccuuuuccuugcacuacgcguggaaaacuauggccaugguacuaucgaucgucucacuguucccccuuuguuugaguaccacaucccaaaagacuacgugguuaccuguguuacuggggaguuuagguugcaaacccuuaacgauguuccuuauagcugaaaacaaaauauggggacgcaaaagcuggccauuaaaugagggaauuauggcgguaggaauagugagcauauuacuuucaucuuuauuaaagaaugauguuccgcuggcagguccacugauugcagggggcauguuaauagccuguuauguuaucaguggaucaucagcagaucuaucacuugaaaaagcagcggaaguuagcugggaagaggaagcagagcauucaggcgccucccauaauaucuuaguagagguccaagacgauggaacaaugaagauuaaagaugaagaaagagacgacacauuaacuauauugcuuaaagcgacccuauuagcugugucgggcguauauccgcucucuauaccugcaacccucuucguaugguauuuuuggcagaaaaagaaacaaagaaguggaguacuuugggauacacccaguccuccggaaguggagagagcgguguuagacgacggaauauauaggaucaugcaaagaggauuacuaggaagaucacaagugggaguaggaguguuccaagaaaacguguuucauaccauguggcauguuacucggggugcuguuuuaauguaucaaggaaaaagguuagaaccaagcugggcgucggucaagaaagacuuaauuucuuauggcggaggauggagauuacagggcucuuggaacacuggugaagaaguacaagugauagcgguagaaccuggcaaaaaucccaagaacguccaaacagcaccugguacguucaaaaccagcgaaggugaaguuggggcgauugcgcuagauuucaaacccggaacuucaggaucaccaauugugaacagagaagggaaaauaguuggauuauacgguaacggaguaguuacuacgucagggacuuaugucucagcaauugcacaagccaaagcaucacaggaaggcccacuaccagaaauugaagaugaaguauuccgaaagcggaaucucacaauaauggacuuacacccgggaucuggaaaaacccgaagauaccugccugcaauaguaagggaggccauuaaaaggaaauugcguacguugauuuuagcccccacacgagucguagcgucagagauggcagaagcucugaaagguaugccuauccgcuaucaaacuacagccguaaaaagugaacauacugggaaagagauaguagaucuuaugugccacgccaccuuuacaaugagauuacugucacccgucagaguacccaacuauaauaugauuauuauggaugaagcucauuuuacggacccaaguucuaucgcagcuaggggguauauaagcacucgcguaggcaugggagaagcagcagcaauuuucaugacugcuaccccuccugggagcguugaagcauucccacaauccaacgccguaauucaagacgaagaacgagauauaccugaaagauccuggaacucaggauaugaguggauuacggauuuuccggguaaaacagugugguuugugccaucaauaaaaucuggaaaugacaucgcaaauugucuaaggaaaaaugggaaacggguaauccagcuaucaagaaaaacauuugauacugaauaccagaaaaccaagaacaaugacugggacuauguaguaacaaccgacauuagcgaaaugggugcaaacuuucgagcggauaggguuauagauccucgaagaugccugaaaccaguuauauuaaaggaugggccagaaagggugauacuggcaggcccgaugccaguuacaguugcauccgccgcacaacgacgaggaagaauuggcagaaaucacaauaaagaaggcgaucaauacaucuacaugggucaaccccucaauaacgaugaagaucaugcacacuggacagaggcuaagaugcuacucgauaauauaaacacuccagaggguauuauaccagcgcuauuugagccugaaagggaaaaaucagccgcaaucgauggugaauacagacugcgaggugaagcuaggaaaacauuuguagaacugaugagacguggagaccugccaguuugguuaucguauaaaguagcauccgagggauuucaguauuccgauagaagauggugcuuugacggugaaagaaacaaccaaguacuagaagaaaauauggauguagagauauggacgaaagaaggagaaagaaagaaacuucgcccucgauggcuagacgcgcgcacauauucugacccacuugcacuaagagaauuuaaagaguuugcggcagguaggcguucaguuagcggcgacuuaauccuagaaauaggcaaacuuccccaacaucucacacaaagagcacagaacgcuuuagacaacuuaguaaugcuacauaacagcgaacaaggaggccgagcuuauagacacgcaauggaagaacuaccagacaccauagagacucuaauguuguuagcauugaucgcugucuuaacagguggaguaacccuauucuuuuuaagcggacguggucuuggcaagacgaguauuggcuugcuguguguuauggcaucauccguacuucuuuggauggcaagugucgagccucauuggauagcagcaaguauaauuuuggaguucuuccuuaugguguuguugauccccgagccugauagacaaagaacaccccaagauaaucaauuggcuuauguaguaaucgguuuacuauuuaugauucuaacgguagcagcaaacgaaauggguuuguuagagacuaccaagaaagaucucgguauagggcauguagcuguagaaaaccaucaccaugcagcaauguuagauguggaucuacauccagcuucugccuggacacuguaugcaguagcuaccacgauuaucacgccuaugaugaggcacacuauagaaaauacuacggcaaauauuagcuuaacugcuauugcgaaccaagccgcaauauugauggguuuagacaaagguuggccaauuucgaaaauggacauuggggucccacuccuagcacuagguuguuauucccaaguuaauccauugacuuuaacagcugcaguauugaugcuaguagcccauuaugcgaucaucggaccgggucuacaagcaaaagcaacgcgugaagcucaaaaacguaccgccgccggaauaaugaaaaacccgacgguagauggaauaguagcaauagacuuagauccaguaguauaugaugcaaaguuugaaaagcaacuagggcaaauaauguuauugaucuuaugcacaucacaaauucuccuaaugaggacgacuugggccuuaugcgagucuauaacuuuagcaaccgggccucucaccacacuuugggaaggaucuccuggaaaauucuggaauaccacaauagcaguaaguauggcaaauaucuuccgaggaucauauuuagccggggccggcuuagcguuuucucugaugaagucccuaggaggaggaagacguggcacaggagcucaaggagaaacacucggagagaaauggaaaagacaguuaaaucaacuaucaaaaucagaguucaauacguauaaaagaucuggcauaauggaaguagaccgauccgaagcuaaggaaggguuaaaaagaggagaaacuacgaaacacgcugugucaagaggcacugcaaaauuacgaugguucguggaacggaauuuaguaaaaccugaagguaaaguaauagaucucggcuguggaagaggggguuggagcuauuauugugcaggcuugaagaaaguaacagaaguaaaagguuacaccaaaggugguccaggucaugaagaaccaauacccauggcuacuuacgguuggaacuuaguuaaacugcacucuggcaaagacguauucuuuauuccaccggaaaagugugauacguuacugugcgacauaggugaaucaucucccaauccaacaauagaagaagggagaacucuaagggugcuuaaaaugguugagccauggcuuagggguaaccaauucuguauaaaaauucugaacccauauaugccgucgguagucgaaacauuggaacaaaugcaacgaaagcacgguggaaugcuuguaagaaacccguugucgcgcaacucaacacaugagauguauuggguaaguuguggaacaggaaacauaguauccgcugugaauaugaccucacguaugcuacugaaccgauuuaccauggcacaccgaaaaccgacauacgaacgugauguagacuuaggagcugggaccagacauguagcuguagaaccagaaguugcaaacuuggauaucauuggucagagaauugagaauauuaaacacgaacauaaaucgacguggcauuaugacgaggacaauccuuacaaaaccugggcguaucacgggucauaugaaguaaagccaucaggaucagcuagcaguaugguaaacgguguugucaaauugcuuacgaagcccugggacgugauacccaugguuacacaaauagccaugacagauacaacaccuuucggacaacaaagggucuucaaggaaaaaguagauacaagaacgccgaaagccaagagagguacagcccagauuauggaaguuaccgcuaaauggcuuugggguuuccugucaaggaauaagaaaccacggauauguacuagagaggaguucacucgcaagguaagaaguaaugccgcaaucggggcaguauuuguggaugagaaccaguggaacucugcaaaagaagcgguagaagaugaaagauuuugggauuuagugcacagagaaagagaacuccacaaacaaggcaaaugugcuacuuguguguauaauaugaugggcaaacgagagaagaaacucggugaauuugguaaagcaaagggcucacgagcuauaugguauaugugguuaggcgcacgcuuuuuagaauuugaagcguuaggauuuaugaaugaagaccacugguucagccgcgaaaauagcuuaagugggguagagggagagggccuccauaaacuaggguauauucugagggacauuucgaaaauaccagguggaaauauguaugcugaugacacagcagguugggacacccgaauuacggaggaugauuuacaaaaugaagcgaagauaacugauauaauggagccugaacaugcguugcuugccaaaagcauauucaaacucacauaucaaaacaagguuguaagaguacaaagaccagccaaaaacggcacuguuauggacguuauuaguagaagggaccaaagaggaucaggccagguaggaacauauggacuaaacacauucacaaacauggaggcacaacuaauaaggcaaauggaaucagaaggaauauucucuccgucugagcuagagacaccuaaucucgcaggaagaguguuagauugguuagagaaacacggaguugaacguuuaaagcguauggcaauaucaggagaugacugcguuguaaaacccauagaugauagguuugccacagcgcugacugcccuuaacgacaugggcaaaguccgcaaagauaucccacaaugggaacccaguaaaggauggaaugauuggcagcagguuccauucuguucucaccauuuccaucaauuaauuaugaaagauggaagagagauagucgugccuuguagaaaccaagacgagcuaguugggagagcacggguuagucaaggagccggauggucauugagagagacagcuugcuuaggaaaaaguuaugcacaaauguggcaauugauguacuuccaccgccgggacuuaagacuugcugcgaaugcuauuuguucugccguaccaguagauuggguaccaaccagccggacaacguggucuauacaugcacaucaucaguggaugacuacugaagauaugcucuccguauggaaccguguauggauagaagaaaauccauggauggaggacaagacucauauaucuucuuggggcgacguaccauaccuaggaaaaagggaggaccagugguguggcaguuuaauaggauugacagcccgagcaacgugggcuacgaauauccaaguagccauuaaucaagugaggcgacuaauugggaaugaaaauuauuuagauuacaugacuucuaugaaaagauucaagaaugaaagcgauccugaaggcgcccugugguaa

SEQ ID NO: 21582 - RNA, 9879 nt, Artificial Sequence
  derived and/or modified CDS sequence (opt6) from DENV-1__FJ410242__SS-prME
uccgugacaaugcuauuaaugcucaugccgacugcauuagcauuucaucuuacgacucgaggaggcgaaccacacaugauaguaucuaaacaagaaagagguaaaagucuccuuuuuaaaacgucugcuggaguuaauaugugcacuuugauagcaauggaucucggagaauuuugcgaagacacuaugacguacaaauguccacguauuacagaagcagaaccugaugauguagauugcugguguaaugcgacagauacauggguuaccuaugguacuugcagucaaacaggcgaacacagacgagauaaaagaagugucgcucucgcuccacaugucggauugggcuuagaaacaagaacagaaacauggaugucgagugaaggagcuuggaaacaaauacaaagaguggaaaccugggcucuacggcacccuggauuuacuguuauagcucuauuuuuagcucacgcaauaggcacguccauuacacagaaaggaaucauauucauauuguuaaugcuuguaacuccuucaauggccaugcgaugcguggggauaggaucuagagauuuuguagaaggacugucaggggcaaccuggguagaugucguauuagaacacggauccuguguaacaacgauggcaaaagacaaaccgacacuugacauagaacuacuaaaaacagaaguuacuaacccagccguccuaaggaaacuaugcauagaggcuaaaauaucuaacacgacaacugacucgcgguguccgacccaaggagaagcaacauuaguagaagaacaagacgcuaauuuugucugcaggaggacauuuguggauagaggcuggggaaaugggugcggucucuucgguaaagggaguuuaauaaccugcgcuaaauuuaaauguguaacaaaauuggaagguaagauaguacaauaugaaaaucucaaauauuccguaauaguuaccguacauacaggagaucaacaucaaguagguaaugaaucgacugaacacgguacaacagcaaccauuacaccucaagcuccaucgacggaaauucagcucacugauuauggagcccugacacuagauuguucaccuagaacuggacuagacuucaacgaaaugguacuacuaacuaugaaagaaaaaucaugguugguccacaaacaaugguuucuagaucuaccacuuccauggacauccggagcgucaacgucucaagaaaccuggaaccgaaaggaucuccuaguuaccuuuaaaacggcgcacgcgaagaaacaagaaguaguaguacuugguagucaagagggagcuaugcacaccgcacuaacaggagcuacugagauccaaaccucuggaacaaccacuaucuucgcaggacaccuuaaaugucgacuuaaaauggacaaguugacgcugaaagggaugucauauguaaugugcacagguagcuuuaaacuggaaaaagaaguggcugaaacgcaacacgggacaguuuuagugcaaaucaaauacgaaggcacagacgcaccauguaaaauaccuuuuagcacacaagacgagaaaggaguaacacaaaaugggcgcuugauuacagccaauccaauagucacugacaaagagaagccagugaauauugaggcagaaccaccuuuuggagagucauacauagucauaggcgcaggagaaaaagccuuaaagcuaucgugguucaagaaaggaaguaguauagguaaaauguucgaggcuacagcgaggggagcucgacgaauggcuauccugggcgacaccgccugggacuuuggcucaaucggcggagucuuuacaagcguagguaaauuaguacaucaaauauuugguacugcauauggaguauuguuuucugguguuucauggacgaugaaaaucggcaucggcgucuugcuuacgugguuagguuuaaauaguaggagcaccucauuaagcaugacuuguaucgcuguagggcucguuacacuauaccuugguguaaugguacaggcagauucaggguguguaauaaauuggaaaggacgagaauuaaagugugggagcggcaucuuuguuacaaaugaagugcacaccuggacagaacaauauaaguuucaagccgacucccccaaacgguugucggcugccaucggcaaagcaugggaggaaggaguguguggaauacgcucuacgacgagacuggaaaacauuauguggaaacaaauuaguaaugagcuaaaucauauacugcuugaaaacgacaugaaguucacaguaguuguaggugaugucgcuggaauauuagcccaaggcaagaaaaugauuagaccucaacccauggaauauaaauauucuuggaaaagcuggggaaaagccaaaauaauaggcgcugauguccaaaacacaacguuuauaauagauggcccgaacacccccgaaugcucugaugaucaacgagcuuggaauauaugggaaguugaagauuauggcuucggaaucuuuacgacaaauauauggcuaaaauuaagggacucauacacacaaguaugcgaccaccgcuuaaugagcgcugcgauuaaagauagcaaagccguucacgcagauaugggcuacuggauagagucugagaaaaacgaaacuuggaaauuagcaagggccucauucauagaaguaaagacuugcauauggccaaaaagccauacucuauggucaaaugggguucuagaaagcgaaaugauaauaccgaaaauuuaugguggcccaauuucgcagcauaacuaccguccaggauacuucacccaaacagccggucccuggcaccucggaaaacucgaacuugacuuugaucuaugugaaggcacaacuguaguagucgacgaacacugugguaaucgaggaccgagcuugagaacuacaacggugacagguaaaauaauacacgagugguguuguagaucuuguacucuuccaccucuaagauuuaaaggugaagauggaugcugguaugggauggagauuagaccaguaaaagagaaagaagagaaucucgucaaaucaaugguaagugcagguucgggcgaagucgauucuuuuucauugggacugcuauguauuucaauuaugauagaggaaguaaugcgaaguaggugguccagaaagaugcuaaugacaggaacauuagcaguauuuuuccuguuaauaaugggacaguuaaccuggaacgacuugauacgacuaugcaucauggucggcgcaaacgcaagugauagaaugggcaugggaacuaccuaucuagcauuaauggcaaccuuuaaaaugaggccgauguuugcggucgguuuacuauuucgaagauuaaccagcagagagguauuauuguuaacaaucggcuuaucacucguagcgucaguagaacucccaaauucucuugaggaacucggugacggucuugcuauggguauuaugauuuuaaaacuguuaaccgauuuucaaagccaucaauuaugggcaacccuacuuucauuaacguucauaaaaacaacuuuuagccuccauuaugcauggaaaacaauggcaauggugcuaaguauaguaucuuuguucccauuaugcuuaucgacaacgagucagaaaacgacuuggcuacccguauuacuaggcucucugggauguaaaccacuaaccauguuucuuauagcagagaauaagauauggggaagaaaaucauggccacuuaaugaggggauaauggcgguagguaucguaucaauucucuuaucaucauuguugaaaaacgaugugccucuagcaggcccucucauugcaggaggcaugcuuaucgcauguuauguaaucagcggaucaucagccgauuuaucucuagaaaaagcagcagaaguaucgugggaagaagaagccgaacauuccggggcaucacauaauauccuagucgaaguacaggacgauggcaccaugaagauaaaggaugaggaacgggacgacacauuaacuauacuauuaaaagcuacauuauuggcuguaucgggagucuauccacucucaauccccgcaacccuuuuuguaugguauuucuggcagaagaagaaacaaaggagugguguacucugggacacaccaucacccccagaaguggaaagagcaguacuagaugaugggauuuauagaauaaugcaacguggguuguugggcagaagccaagugggaguaggcguguuccaagaaaauguauuucacacaauguggcauguaacccguggugcaguguuaauguaccaagggaaacguuuagaaccaagcugggcgaguguaaagaaagaucucauuaguuacggaggaggauggagacugcaaggauccuggaauaccggagaggaaguucaaguaauugcgguugaacccgggaaaaaucccaaaaauguccagaccgcuccagguacuuuuaaaacaagcgaaggagaaguuggagccauagcccuagauuuuaaaccagggacauccggaagcccuauaguuaaccgcgaaggcaaaauagucggauuguauggaaacggaguagugacuaccucagguacuuacguaucggcgauugcacaagcaaaagcaucucaagaagggccgcuaccggagauagaagacgagguuuuuaggaaacgcaaccuuacaauaauggaucuucaucccgguagugguaaaacaagacgguauuuacccgcaauagugcgagaagcaaucaagcgaaaguuaagaacacugauacucgcaccaacucggguuguggccagcgagauggcugaggcuuuaaaggggaugccaauuagauaccaaacaacugcuguuaaaagcgagcacaccggaaaagagauuguggauuugaugugccaugccacauucacgaugcguuuguuauccccuguucgaguaccgaacuacaacaugauaauaauggaugaagcucauuuuacggauccuucaagcauugccgcccguggcuauauaucuacacgcguggggaugggagaagcagccgcaaucuucaugacggccacucccccagggucaguggaagcauuuccccaaaguaacgcgguaauacaagaugaagagagagacaucccagagcgaucauggaauaguggauaugaauggauaacggacuucccaggaaaaacuguuugguuugugccaucaauaaaaucaggaaacgauaucgcgaauugcuuaagaaagaacggcaaaagaguuauacaauuaucucgaaagacauucgauacugaauaucagaaaacuaaaaacaaugauugggauuauguggucacaacagauauuucggagaugggugccaacuuucgcgcagacagagucaucgaucccagacggugucugaagcccguaauauuaaaggaugguccggaaagagugauccuugcuggccccaugccuguaacaguggcgagugcugcccaacgucgaggaaggauaggcaggaaccauaauaaagagggagaucaguauauuuauaugggccaacccuuaaauaaugaugaggaucaugcucauuggacugaagcaaaaaugcuacuugauaacauaaacacuccagaaggcauaauaccagcuuuauuugaacccgaacgagagaaaagcgcagcuauugauggagaguauaggcuaagaggcgaagcacguaaaacguucguagaauugaugcggaggggugacuuacccguguggcuaucauacaagguagcgagugaggguuuccaauauucagacagacgaugguguuucgacggcgaacgaaauaaucaaguauuagaggaaaauauggauguugaaauauggacaaaagagggagaaagaaagaaacugcgaccuagguggcuagaugcuagaacauacucugauccauuagcucucagagaguucaaagaauuugccgcugguagacgauccgucucaggcgauuuaaucuuggaaauuggcaaauuaccacaacaucuuacccaacgagcgcaaaaugcccuagacaauuuagucauguuacauaacucggaacaaggcggucgcgcuuaccgucacgcaauggaagaauugccagacacaauagaaacguuaaugcuauuggcucuuaucgcaguauuaacaggugguguuacgcuguucuuucuuucgggaaggggguugggaaaaacuuccauugggcuauuaugcgugauggcuucuaguguuuugcuuuggauggcaucaguugagccacacuggauagccgcgaguaucauuuuggaguucuuucucaugguuuugcuuauuccagaaccugaucgccagagaacaccucaagacaaucagcucgcuuacgucguaauagguuugcuguuuaugaucuugacaguugcugcuaacgaaauggguuuauuagaaacuaccaagaaagauuuaggaauuggacauguggccgcugaaaaucaccaccacgcugcaaugcuagacguagaucuacacccagcaagugccuggacccuauacgcugucgcuacaacaauaauuacacccaugaugagacauacaauugagaacacaacagcuaauauaucacuaaccgcgauugcgaaccaagcugcaauuuuaaugggacuugauaaaggauggccaauuucgaagauggacaucggugugccauuacuggcgcucggaugcuauagccaagucaauccccuaacuuuaacagcagcgguacuaauguuagucgcccauuacgccaucauagguccuggucuacaagcuaaagcgacgcgagaagcacaaaaacgaaccgcagcggggauuaugaagaauccuacuguagauggaaucguagcaauugaccuggauccugugguauacgaugcuaaauuugagaaacagcuaggacaaauaaugcucuuaauccuauguacgucgcaaauauuacuuaugagaacaacaugggcacuaugugaaaguauuacauuagcaacugguccacuaaccaccuuaugggaggggagcccgggcaaauuuuggaauacgacuaucgcaguaaguauggcuaauauuuuuagaggaagcuaccuugcgggugccggacuagcuuuuucuuuaaugaaaagccucggugggggccgccgcggaacaggugcacaaggagagacucugggugaaaaauggaagcgacaguuaaaccaauuaaguaaaagugaguucaauacuuacaagaggagugguauuauggaaguggacagaucggaagcaaaggaagguuuaaagcguggagaaacaaccaaacaugcaguaagucguggaacggcuaaauuacgaugguucguagagcgaaaccuaguaaaaccagaaggaaaagucaucgaccuugguuguggaagaggcggauggucauacuacugugccgguuuaaagaaggugacagaagucaaaggguauacuaaaggaggucccggacaugaagaacccauuccuauggccacauauggauggaaucuuguaaagcuacacaguggcaaggaugucuucuuuauucccccagaaaaaugcgacaccuuguugugugacauaggagaaucgagccccaauccuacaaucgaagaagggcguaccuuacggguauuaaaaaugguggagccguggcuccggggaaaucaguucuguauaaaaauuuuaaauccauauaugccgagcguaguagagaccuuagaacaaaugcaaaggaaacacggagguaugcuaguaagaaauccauuauccagaaauucaacgcaugaaauguauuggguaucgugcggcacuggaaauauaguuagugcagucaacaugacaaguagaaugcugcugaaccgcuuuacaauggcgcaucgcaaaccaacguacgaaagggauguagaucucggggcagggacaaggcacguagcgguggagcccgaaguggcaaauuuggacaucauuggccaaagaauagagaauaucaaacaugagcauaaaagcacauggcauuaugacgaagacaauccauauaaaaccugggccuaccacgguucauaugagguaaagcccucagguagugcuucuagcauggugaauggaguagucaaacuucucaccaagccaugggacgucauaccaaugguaacucaaauagcaaugacagauaccacaccuuuuggucaacagcgaguauucaaagaaaagguugauacacgaacaccaaaagcgaaaagaggcacagcccaaauaauggaagucacugcuaaauggcuuuggggguuuuugagcagaaauaagaaaccaagaauaugcacacgggaagaguucacacguaaaguucgaaguaaugcugcuauuggugcgguguucguggaugaaaaucaauggaacuccgccaaggaagcuguugaagaugaacgguuuugggacuuaguccaucgagagcgcgagcuacauaaacaaggcaaaugugcuacauguguauacaacaugaugggaaaaagagagaagaaauuaggagaauuugguaaagccaaagguucacgggcaauuugguauaugugguuaggggcacgcuuccuagaguuugaagcacuaggauucaugaaugaagaccacugguucaguagagaaaauucuuuaucaggagucgaaggagaaggucuacauaaacuagguuacauacuaagagauauaagcaagauaccagguggcaacauguacgcagaugauacggcagggugggauacgcgaauuacagaggaugauuugcaaaacgaagcaaagauaacugauauaauggaaccagagcaugcacuccuugcaaaaaguauauuuaagcuaacauaucaaaacaaaguaguaagaguacaacggccagcuaagaacggcacaguuauggacgugauaagucgaagagaucagcgggggagcggucaaguggguacuuacggucuaaacacauuuacaaacauggaggcgcagcuaauucgucaaauggagagugaaggcauauuuagccccucagaacuugaaacaccuaacuuggcgggaagaguacuagauuggcuagaaaagcauggaguagaacgccuuaagcgcauggcaauaucaggagacgauugugucgucaaaccuauagacgaucgcuucgccaccgcgcuuacagcuuuaaaugacauggguaaaguuagaaaggauauuccacaaugggaaccgucuaaaggguggaaugacuggcaacaagucccguuuuguagucaucacuuccaccaauuaauuaugaaagauggcagagaaauaguuguaccuugcagaaaucaagacgaauuagucggccgagcccgaguaucacagggcgccggauggucgcuacgugaaacggcaugcuuggguaaaaguuacgcccaaauguggcaacuaauguauuuucaccguagagauuuacgacuagcagcaaacgcaauuugcagcgcuguuccuguugauugggucccaacaucucgaacaacauggaguauucaugcccaccaccaauggaugacaacugaggacaugcuaucaguauggaaucguguauggauagaagagaauccauggauggaagauaagacacacauuagcucauggggcgauguuccauaccuaggaaaaagggaagaccagugguguggcucgcuaauaggauuaaccgcaagagcaacuugggcgacuaauauucaaguagcuaucaaucaagugcggaggcuuauaggcaacgaaaauuaucuggauuauaugacaucgaugaagcguuucaaaaaugaaucagauccugaaggagcacucugguaa

SEQ ID NO: 21583 - RNA, 9879 nt, Artificial Sequence
  derived and/or modified CDS sequence (opt6) from DENV-1__FJ410243__SS-prME
ucaguuaccauguugcuaauguugaugccuacggcccuagccuuccaccuaacaacccggggaggggaaccucauaugaucgucucaaaacaagaaagaggaaaaucacucuuauuuaaaacaucagcgggaguaaauauguguacguuaauagcaauggauuuaggagaauuuugcgaagacacuaugacauauaaauguccuagaauuacagaggcugagcccgaugacguugacugcuggugcaacgcgacggauacauggguuacuuacggaacaugcucucagacuggagaacacagaagagauaaaagauccguggccuuggccccacauguaggauuaggauuggaaacgagaacagaaacauggaugucuucugagggagcauggaaacaaauacagcguguggaaacuugggcucuuaggcauccugguuucacggucauugcauuauuucucgcucacgcaaucgggacgaguauuacacaaaaaggaaucaucuuuauauuauuaauguuaguaacaccuucuauggcaaugcguugcguugggaucgguucuagggacuucguggaaggauuaucaggagccacauggguagaugucguuuuagagcacgguaguugcgucaccacaauggcgaaagacaaaccaacuuuggauauugaauuacugaaaacggaagugacuaauccagcaguucuaagaaaacuaugcauugaggcgaaaauaucuaauacgacaaccgauaguagauguccaacucaaggugaagccacacuuguggaggagcaagaugcaaauuuugucugcagacggaccuuuguagauagagguugggguaaugguuguggacuguuuggaaaagguucuuuaauaaccugcgcaaaauuuaaauguguuaccaaacuugaaggaaaaaccguacaguacgagaauuuaaaauacagcgucauuguuaccguccauacgggugaccaacaccaaguuggaaaugaaucgacggagcauggaacgacagcuacuauuacgccacaagccccaucaacagagauacagcuuacugauuacggagcuuuaacauuagauuguucuccgaggacuggacuagauuuuaaugaaaugguguuacuuacaaugaaagaaaaagcgugguuaguucauaaacaaugguuuuuagaucucccccuccccuggacaucaggugcaucgacaagucaagaaacauggaauagaaaagaccuacuuguaacauuuaagacagcucacgcaaagaaacaggaagucgucguguuagguucccaagagggggcgaugcauacagcauuaaccggcgcaacagaaauacaaacgagcgggacaacgacgaucuuugcggggcaucuuaaaugccgguugaaaauggauaaauuaacgcuaagagggaugucguauguaaugugcaccggguccuuuaaacuugaaaaagaaguugcagaaacccaacauggaacaguucuugugcaaaucaaguacgaagguaccgaugcuccuuguaaaaucccauuuucaacacaagaugaaaaagguguaacgcaaaacgguagauugaucaccgcuaaccccauugugaccgauaaagaaaaacccguaaauaucgaagcggagcccccguuuggagagagcuauauuguaauaggcgccggugaaaaagcacuaaaauuaagcugguuuaagaagggaucaucaauagguaaaauguuugaagcaacagcacguggagcacgaaggauggcaauauuaggagacacagccugggauuuugggucuaucgguggugucuucacaucggugggcaagcuaguucaucaaaucuuuggcacugcauauggcguauuauucucgggcgucaguuggacaaugaaaauagggauaggaguccuauugacuuggcuuggauugaacucgcguucuacaagccuuucuaugacaugcauagcaguaggucuagucacucuuuaucuaggaguaaugguccaggcggauagcggcugcguaauuaauuggaaggggagagaauuaaaaugcggaucugguaucuuuguaacgaaugaaguacacacauggacggaacaguacaaauuucaagccgacucuccuaaaagauuaagugcugcuauagguaaggcuugggaggaaggaguguguggaauaagauccgcgacucguuuagaaaacauuauguggaagcagauaucaaacgaauugaaccauauauuguuagaaaaugacaugaaauuuacugugguuguaggugacguggcugguauauuagcacaaggcaagaaaaugauacggccucaaccgauggaauauaaauauuccuggaaaucauggggcaaagcaaaaauuauaggggcagaugugcaaaaugcgacguucaucauagauggaccaaauacuccugaauguccugacgaucaaagagcuuggaauauaugggagguugaagauuacggauuugggauuuuuacgacuaacauaugguuaaaacuccgcgauucauacacgcagguaugugaucaccgauugaugucagcugcuauuaaagacagcaaggcgguacaugcggauaugggauauuggauugaaucggagaaaaaugaaacauggaaguuagcccgggcaucguuuauugaaguuaagacaugcaucuggccgaaaucucauacgcuauggucuaauggaguccuggagucggaaaugauuauaccaaaaauauauggaggcccaauuagccagcauaacuacagaccagguuauuucacacagacagcagggccauggcauuuaggaaaauuagaguuagauuuugaucucugcgaaggaacaacgguaguaguugacgagcauugcgguaauagagguccgaguuugcgaaccacaacugugacgggaaagauuauucaugagugguguugcaggucgugcacccugcccccgcuuagauuuaagggggaagacgggugcugguacggcauggaaauuagaccuguaaaggaaaaagaggaaaaccucguaaaaaguaugguaagcgcaggaagcggggaaguagacagcuuuuccuuaggauuauuaugcauaucaauaaugauugaggaaguaaugaggaguagauggagccguaaaaugcuuaugacagggacacuugcaguauucuuucugcuaauuaugggacaacuuacuuggaaugaccuaauucgacuuugcaucaugguuggcgcaaacgcuagcgacaggaugggaauggguacuaccuaucuugcuuuaauggcaacuuuuaaaaugagaccaauguucgcgguaggauugcuauuuagacgcuugacuucucgcgaaguacuacuacuuacaauaggguuaagccucguagcaucgguggaauugccaaauucauuggaagaacuaggggauggucucgccaugggcauaaugauacuuaaacuacuaacagauuuucagagucaucagcuaugggccacguuacuuucucugacuuucaucaaaaccacauuuaguuugcauuaugcuuggaaaacuauggcgaugguuuuaucaauagugucuuuauucccacucugccuaagcacuacaagucagaaaaccacuugguuaccaguauuauuagguucuuuagguugcaagcccuuaacgauguuucugaucgcagaaaacaaaauaugggggcgaaaaucuuggccuuuaaacgaagggaucauggcaguaggaauagucucaauauuacuuaguagcuuacugaaaaacgacguuccucuugcagggccauugauagcaggcgguaugcuaauagcguguuaugugauaaguggaagcucagcagacuuaucccuagaaaaagccgcugagguuucuugggaagaggaagcugaacacucaggugcaucacauaauauucuaguagaaguacaagacgaugguccaaugaaaauaaaagaugaagagagagaugauaugcuaacgauacuuuugaaagccacguuacuagcugucaguggaguuuauccccuaaguauaccagcuacacucuucgucugguacuuuuggcagaagaagaaacaaagguccggaguguuaugggauacaccuaguccuccggaaguggaaagggcaguguuagaugacggaauauaucgaauaaugcaaagaggacuauuagggagaucccagguaggaguuggcguuuuccaggaaaauguguuucauacaauguggcacguaaccagaggugcgguacugauguaccaggguaagcgucuugaaccgagcugggcgucaguuaagaaagaucuaauaaguuauggagguggauggagguuacaaggcagcuggaacacaggagaagagguucaagucaucgcagucgaacccggcaagaaucccaaaaauguacaaaccgcaccuggaacauuuaaaacaagugagggagagguaggugcaauugcucuugauuuuaaaccugguaccucagggaguccaauaguaaaccgggaggguaaaauaguugggcuguauggaaauggcguuguaacuacaucgggaacguauguuucagcaauagcccaggcaaaggccucgcaagaagggccuuugccagagauagaagaugagguauucagaaagcgaaaucuuacaauaauggaccuacacccaggaucuggaaaaaccagacgguaucuaccagcaauaguucgggaagcaauaaagcguaaacuacguacguuaauuuuagcacccacaagaguggucgcgagugagauggcagaagccuuaaaaggcaugccaauaagauaucaaacgaccgcgguuaaaagcgagcauacgggcaaagagauaguagacuuaaugugccaugcgacguucacaaugagauuacuaagcccgguaagaguaccuaacuauaacaugauuauuauggacgaagcacauuucacggauccaaguucaauagcagcaagaggguauauuuccacacgcguugggaugggggaagcugcugcaauauuuaugaccgcaacaccaccggggaguauggaagcguuuccacagucaaaugcggugauacaagacgaggagcgagauaucccugaaagaucauggaacucagguuaugaguggaucacagacuuuccuggaaaaacggucugguuuguacccucuauaaagucuggaaaugauauugcgaacugcuuaaggaaaaauggcaagagagucauacaauuaucuaggaaaaccuuugauacggaguaccaaaagacgaagaacaaugacugggacuacguugucaccaccgauauuucagaaaugggcgcgaauuuuagagcagaucguguuauagacccaaggcgcuguuugaagccaguaauccuaaaagacgguccagaacgugugauacuagcaggcccuaugccagucaccguugcaucagcggcccaaagaagaggaaggauuggcagaaaccauaauaaggaaggugaucaguacaucuacaugggucaaccucuaaacaaugacgaggaccaugcacauuggaccgaagccaaaaugcuucuagauaacauaaauacuccagaaggcauuauuccggcuuuguuugaaccagaaagggaaaagucagcggcgauagacggcgaguauagguuaagaggagaagcucgaaaaacguuuguagaauuaaugagacggggugauuuaccagugugguuaaguuacaaaguugcaagugaaggauuucaguauucugacagacgaugguguuucgauggugaaagaaacaaccaaguccuugaagaaaauauggacguagaaaucuggacaaaagagggcgaaaggaagaaauuaagaccgcgcugguuggaugcaaggacauauucugauccauuagcuuuacgcgaguucaaagaguuugcagcagggaggcgaucagugaguggagaucuuauauuggagauaggaaaauuaccgcaacacuuaacacaacgggcacagaacgcguuagauaaccuagucauucuacacaacagcgaacaaggaggucgcgcauacagacacgcuauggaagaguuaccagacacaauagaaacccucauguuauuagcacucauagcaguucuaacgggcggaguuacgcucuuuuuccuguccggacgaggguuagggaaaacaucaauaggccuccuauguguaauggcuucaagugucuuauuauggauggcgaguguagagccccacuggauugcagcaagcauuauucuagaguuuuucuugaugguacuacuaauuccggagccugacagacaaagaacaccccaagauaaccaauuagccuauguuguaauaggccucuuguuuaugauauuaacaguugccgccaaugaaaugggccuuuuggaaacaacuaagaaagacuuagguauaggacacguagcagucgagaaucaucaucaugcagcaaugcuagacguagaccugcacccagcaucagcuuggacauuauaugccgucgcaacuacaauaaucacuccuaugaugagacacacaaucgagaauacaacagcaaauauaucgcucacugcaauagcaaaucaagcagccauauuaaugggucuagacaaagguuggccuauaaguaaaauggacauuggugucccauuguuagccuuaggauguuauagucaaguaaauccauuaacauugacagcugcuguuuugauguuggucgcccauuaugccaucauagguccuggguugcaggcaaaagcgacgagagaagcucagaagaggacagcagcgggaaucaugaaaaacccgacuguagacggaauaguagcaaucgauuuagauccggucguauaugacacaaaguuugaaaagcagcuaggccaaaucauguuauuaauauuauguacuucgcaaauucucuugaugagaacuacgugggccuugugugaaaguaucaccuuagcuaccgggccauuaaccaccuugugggaaggaucaccugguaaauuuuggaauacaacaauugcuguuaguauggcaaauauuuuuaggggcucauaucuugcuggugcuggcuuagcguucucgcucaugaagucuuuaggaggcggacgacgaggaaccggcgcacaaggugagacauuaggugaaaaguggaaaagacaauuaaaccagcuuucgaaauccgaguuuaauacuuauaagcgaagugguauaauggagguagaucguucggaagcuaaagaaggauugaagcguggagaaacaacuaaacaugcagucucuagaggcacagcgaaguugagaugguuugucgagcgaaaccuagugaagccagaaggcaaggucauugaccucggaugcggaagaggaggauggaguuauuacugugcuggguugaagaaaguuaccgaaguuaaaggcuauacuaagggcggaccaggacaugaagaaccaauucccauggcaacuuacggauggaacuuaguaaaacuacacucuggaaaagacguauucuuuauuccaccugagaaaugugauaccuugcuaugugauauaggagaaagcucaccaaaccccacuauagaggaggggcgcacauuaagaguucuuaaaaugguagaaccuuggcuacgaggaaaucaauuuugcauuaaaauacuaaacccuuacaugcccucuguuguggagacucuagagcagaugcaacgaaaacacgggggaaugcuaguacgaaauccuuugucaagaaacucaacacaugagauguacuggguaucauguggcacagguaacaucguaagugcagugaauaugaccucuagaauguuauuaaaccguuuuacaauggcacacagaaaacccacguaugaaagagacguggaccugggagccgggacaaggcauguagcagucgagccugaagucgcaaaucuugacauaauuggucaacguaucgaaaauauaaaacacgagcauaaauccacuuggcacuaugaugaggauaacccauauaagacaugggcguaucauggaucguacgagguaaaaccaucugggagugcaucaaguaugguaaauggcguaguaaaacuucuaacaaaaccaugggacguaauuccuauggucacucaaauagcaaugacggauacuacccccuuuggacaacaacgaguuuucaaggaaaaaguagacacaagaaccccuaaagccaaacguggaacagcccagauaauggaagucacggccaaauggcuauggggcuuucuaucucguaauaagaaaccucgcaucuguaccagagaagaguucacacguaaggugagaucuaaugcugccauuggugcuguauuuguugacgagaaucaauggaacucagcuaaagaagcaguggaagacgagcguuucugggacuuaguacacagggaacgagaauugcauaagcaagguaagugugcaacaugcguauauaacaugaugggaaaaagagagaagaaacugggagaauuuggaaaagcuaaaggaagucgagcgauuugguauauguggcucggggccagauuuuuggaguucgaagcacuugguuucaugaacgaagaucauugguucaguagagaaaacagucuaaguggaguagaaggcgaaggacugcacaaacuuggcuauauacucagagauauaucuaaaauuccugguggaaauauguacgcggacgauaccgcagggugggacacacgaauaaccgaagaugaucuucagaacgaggcaaagauaacagacauaauggaaccagaacaugcacuauuagcaaagaguauauucaaauugacuuaccagaauaaaguaguaagaguacaacgaccagcuaaaaaugggacuguuauggacguaauaagcagaagggaccagaggggaucaggacaaguagguacguaugguuuaaacacguucacuaauauggaagcacaacuaauaagacaaauggaaucagagggcauauuuucacccuccgaacuggaaacgcccaacuuagcuggaagaguauuggauuggcuugaaaaacauggaguagaaagacugaaaagaauggcgauaaguggcgaugauuguguugugaaaccgaucgaugauagauuugcaacagcucuaacagcgcuaaaugacauggggaaaguccguaaagacauaccgcaaugggagccaucgaaaggauggaacgauuggcaacagguaccauucuguucacaucacuuucaccaauugauaaugaaagauggacgcgaaauaguaguuccauguagaaaccaagaugaauuagucgguagagcaagaguaagucaaggagcagguuggucauuaagagagaccgcaugucuugguaaauccuacgcccaaauguggcagcucauguauuuccaucgacgagacuuaagauuagcagcuaaugccauaugcagugcgguucccguggauuggguaccaacuucacguacgaccuggaguauacacgcacaucaucaauggaugacuaccgaggacauguugucaguauggaauagagucuggaucgaggagaauccuuggauggaggauaaaacucacauauccucauggggcgauguuccauaccuaggcaagcgcgaagaccaguggugcgguucuuuaauaggcuuaacagcacgugcgacaugggcaacaaauauucaaguagccauuaaucaaguacguagguuaaucgguaacgaaaauuaucuugauuacaugacuucaaugaaaagauucaaaaacgaaauagacccggaaggcgcucugugguaa

SEQ ID NO: 21584 - RNA, 9879 nt, Artificial Sequence
  derived and/or modified CDS sequence (opt6) from DENV-1__FJ410244__SS-prME
ucugugacuaugcuuuuaauguuaaugccgacugcacuagcauuucaucuuacaaccaggggaggagaaccacauaugauaguguccaaacaagaacgggguaaaucccuucuauuuaaaacauccgcuggcguuaauaugugcacauuaauugcaauggauuuaggagaauuuugcgaagauacaaugaccuauaaaugcccacguaucacggaagcagaaccagaugauguagacuguuggugcaaugcaacagacacaugggugacuuauggcacguguagucaaacuggcgaacaucgaagagacaaaagaucgguagcgcuugcaccacaugugggacugggauuagaaacucgaacagagaccuggauguccucagaaggcgcauggaaacaaauucaacguguagaaacaugggcacuuagacacccaggauucaccgugaucgcauuguuuuuagcacaugcaaucggaaccucuauuacacaaaaagguauaauauuuaucuuacuaaugcuggugacgccaucgauggccaugaggugcgugggaauagggagucgagauuuuguagaaggauuauccggagcaaccuggguugacgugguauuagaacauggaucguguguuaccacgauggcaaaagauaaaccaacauuggauauagagcuauuaaaaacagaaguaacuaauccggcgguauuacgcaaauuaugcauagaagcaaaaaucucuaacacaacgacugauucacggugcccuacgcaaggagaggccacgcuaguugaagaacaagaugcaaacuuuguaugucggaggacguucguagaccgugggugggggaacgguugcggcuuguuugguaaaggcucauuaauaacuugcgcuaaauuuaaaugcguaacaaaacuugaagguaaaacgguacaguaugaaaaucucaaauauuccguaauaguaacaguucacaccggagaucagcaucagguaggcaaugaaaguaccgaacacgguacuacagccacaauaacuccacaagcaccaucaacugaaauacaacugaccgauuauggugcuuuaacacuugacuguaguccaagaacaggcuuagacuucaaugaaaugguuuuacugacaaugaaagaaaaaucguggcugguucauaaacagugguuccuagaucuaccguugcccuggacaaguggagcaucuacaucucaggaaacauggaacaggaaagaccuucuaguaacuuuuaaaacggcucaugccaagaaacaagaaguuguagucuuaggcucgcaagaaggagcaaugcauaccgccuuaacaggugcuacagaaauucaaacaaguggaacgacuacgauuuuugcuggacaccuuaaauguagguuaaaaaugaauaaacuaacauuaaaaggaaugucauauguaauguguaccgggucauuuaaacucgaaaaagaaguugcggaaacccaacauggaacaguauuggugcaaauuaaauacgaaggcacagaugcgccauguaaaauccccuuuaguacgcaagaugaaaaagguguuacccaaaauggaagguuaauaacagcuaaucccauaguuacagauaaagaaaaacccgugaauauagaagccgagccaccuuucggcgaaaguuacaucgugauaggggcuggagaaaaagcauuaaagcuauccugguucaagaaaggaucuaguauaggaaagauguucgaagcaacggcaagaggagcaagacguauggcaauucugggugauaccgccugggacuucggaagcauagggggcguuuuuacaagcguagggaaguuaguucaccaaauauuugguacagcguacggaguauuauuuucgggugugucauggacgaugaagauagggauaggugucuuacuuacauggcuaggacuaaauaguagaagcacgaguuuaagcaugacaugcauagccguaggauuggugacacucuauuuaggaguuaugguacaagcugacucaggaugcguaauuaacuggaaggguagagaguuaaaaugcgggucagguauauuuguuacaaaugaaguccacaccuggacugaacaguacaaauuccaggcugauaguccaaaaagacugucggcggcuauaggaaaagcaugggaagaaggaguaugugguauuagguccgcaacacggcucgaaaauauuauguggaaacaaauaucaaacgaguuaaaccauauucuauuagaaaacgauaugaaauuuacaguaguagucggggauguagccgguauacucgcccaagguaagaaaaugaucagaccacaaccaauggaauauaaauauucuuggaaaucuuggggaaaggcuaaaauuaucggggccgauguacaaaauacuacauuuauaauugauggaccgaacacaccggaaugcccagacgaccaacgagcuuggaacaucugggaaguggaagauuaugguuucggcauuuuuacaacaaauauaugguuaaaucuaagagauaguuauacacagguaugcgaccacaggcuuaugagugcggcaauuaaagauaguaaggccguacaugcagauauggguuauuggaucgagagugagaaaaaugaaacauggaaacuugcaagagccucauuuauagaaguuaagacauguauauggccuaaaucccauacucuauggucuaacgguguauuagaaagcgaaaugauuauuccgaaaaucuauggggguccgauaucgcaacacaauuaccggccaggauacuuuacccaaacggccggaccauggcaucuugggaaguuagaacuugauuucgaucuaugugaagggacuacagucguaguugaugaacacugugggaacagggguccaucauugcggacaacuacagugaccgggaaaaucauccacgaaugguguugcaggaguugcacauuaccgccucuucgauucaaaggggaagaugguugcugguacgggauggagauuagacccgugaaggaaaaagaggaaaacuuagucaaaaguaugguaagugcuggaaguggggaaguugauucauucucucucggguugcucugcaucucuauaaugaucgaagaaguaaugagaagccgcuggagucgcaaaaugcugaugaccgguacguuagcaguuuucuucuugcucauaaugggacaauuaacuuggaacgaccuuauuagacuauguaucaugguaggggccaacgcaucagaucgaaugggaaugggcacuacauauuuggcauuaauggcuacuuuuaaaaugagaccaauguucgcagucggacuucuauucagaagacuaacaucccgugagguauuacuccugacaauaggucuaucuuuaguagcauccguugaauuaccaaauucuuuagaagaacuuggugauggauuagcaauggguauaaugauccugaaacuauuaaccgauuuccaaagucaucaacuaugggcuacacuacuaaguuugacauuuauuaagacuacuuucucguugcacuacgcauggaaaacgauggcaaugguucuaucaauagucagucucuuccccuuaugucuaaguaccaccucucagaaaacuacgugguuaccgguacuacucggaucgcuuggaugcaagccuuuaacaauguuuuuaauagcugaaaacaagauuuggggaagaaaaucguggccacugaacgaagguaucauggcaguggggauaguaucaauacuuuuaaguucuuuguugaaaaacgauguuccacuagcagggccucuuauagcgggugguaugcuaauugcgugcuauguuauaucuggaucaucagcugacuuaagucuagaaaaggcagcagaaguuucuugggaagaagaagccgaacacuccggugcaagucauaacaucuugguagaaguacaagaugauggcacgaugaagauaaaggacgaagaacgugaugacacauuaacaauuuuauuaaaagcuacacuauuagccgucucuggaguuuauccccuuagcauaccagccacacuuuucguuugguauuuuuggcagaagaagaaacagcguaguggaguauuaugggacacuccaaguccuccagaaguugaaagggcaguccucgaugacggaauuuauagaauaaugcagcgggggcuacuuggaagaucacaaguugguguaggagucuuucaagagaaugucuuccacacaauguggcacguuaccagaggggccguauuaauguaccaaggcaaaagacuagaaccaucaugggcgucagucaagaaagacuuaaucucauacggaggcggauggcgucuucaaggaucauggaacacaggagaagaggugcaagucauugccguugaacccggcaaaaaccccaaaaacguccaaacagcaccaggaaccuucaagacaucggaaggggaaguuggcgcaauagcccuugacuuuaagccugguacaagugguagcccuauaguaaacagagaggguaaaauaguaggauuauacgguaauggagucguuacuacaaguggaacauauguuagugccauugcucaagcuaaagcgucacaggaaggaccccuaccagagauugaggacgaagucuuucgaaaaagaaauuuaacgauaauggaccuccauccugggagugggaaaacuaggagguacuuaccugcgauaguccgagaagcuauuaaacguaagcucagaacacucauacuagcucccacgcgugugguagccucggagauggccgaagccuuaaaagguaugccuauuagauaucagaccacagcugucaaaucggagcacacggguaaagaaauugucgauuuaaugugucaugcaacuuuuacaaugagauugcuaucgcccguaagaguaccaaauuauaacaugauuauuauggaugaagcacauuuuacagauccaucaaguauugcggcgcgaggauauauuagcacccgaguaggcaugggugaagcggcagccauuuucaugacagcuaccccuccagguucaguagaagcauucccacaauccaaugcgauaauccaagaugaagagagagacauaccggaacguucauggaacuccggcuaugaauggauaacagauuucccaggaaagacuguaugguuugugccgaguauaaaaagugggaacgauaucgcuaauuguuuacguaaaaauggaaaaagaguuauacaauuaucuagaaaaacauuugauacggaauaccagaaaacuaagaauaaugauugggacuauguuguuacuacugacaucuccgaaaugggagcaaacuucagggccgaccguguuaucgacccucgacgauguuugaaaccaguaauacuaaaagacggaccugaacgagucauauuggcagggccuaugcccguuacgguugcaucugccgcacagagacgggguagaauaggacgaaaucauaacaaagaaggugaccaguauauauauaugggucagccucuaaauaaugaugaggaucacgcacauuggacugaagccaaaaugcuuuuagacaauaucaacacgccugaaggaauuauaccugcguuauuugaaccagaaagggaaaagagugcggcaaucgacggugaguaucgauuaaggggagaagcacguaaaacauuuguugaauuaaugaggagaggagaucuaccaguauggcuaagcuacaaaguggcuucugaaggcuuccaauauuccgacagaagaugguguuuugacggagaacgaaauaaucaagucuuggaagaaaauauggauguagaaauuuggacaaaagaaggugaacgaaagaaacuuagaccaagaugguuagaugccagaacauauagugauccuuuagcuuugagggaauuuaaagaauuugcagcaggcaggcggucuguuucgggagauuuaauauuagaaauaggcaagcuaccccaacaucuuacacaaagagcacaaaacgcacuggauaaucuagucauguuacacaauucagagcaaggcggccgggcauauagacaugcaauggaagaacuuccagauacgauagaaacauuaaugcuauuagcuuuaauagcuguuuugacgggaggcguaacacuauuuuucuuaucgggcagaggauuaggcaaaaccagcaucggguugcucuguguaauggcuagcucagugcuacuuuggauggcaucaguugaaccacauuggauugcugccucuauuauacuugaguucuuuuugaugguuuuauuaaucccagagccggacaggcaaagaacuccacaggacaaccaauuagcguauguuguaaucggucuccuauuuaugauauuaacaguagccgcaaaugaaaugggccuucuagaaacaacgaagaaagaccuuggcauaggucacgucgcaguugaaaaucaucaucacgcagccaugcuggauguugaccuucacccugcuucugcauggacgcuauaugccguagcgacuacaauuauaacuccgaugaugagacauacuauugagaacacaacugccaacauuucacucacugcgauagcaaaucaagcugcaauauuaaugggucuagacaaaggcuggccuaucuccaaaauggauauaggcguaccuuuauuagcuuuaggauguuacagucaaguuaauccacugaccuuaacagcagcaguucucauguuaguagcucacuacgcuaucaucgguccuggacuucaggcuaaagcaacaagagaggcacaaaaacguaccgcggccgguauuaugaaaaaccccacaguagaugguauaguugcaauagacuuagauccggucguauaugaugcuaaguucgaaaaacaacuuggucaaauaauguuacuaauacuaugcaccucucaaauacuacuuaugcguacaacuugggcuuuaugcgaauccauaacguuagcgacuggcccgcucacuacucucugggaaggaucacccggaaaguucuggaauacaacaauagcagucuccauggcuaacauuuuuagaggcaguuaccuggccggugcagggcuagcauuuucucugaugaagucacuuggaggaggaagaaggggaacaggugcacaaggugaaacauuaggcgaaaaauggaaaagacaacucaaccaauuaagcaaaucggaauuuaauaccuauaaacgaaguggcauaauggaagucgaccguucugaagcuaaagagggauuaaaacgcggagagacuacaaagcaugcaguuucucgugguacugcaaaacuacgaugguucguugaacguaauuuagugaagccagagggcaaaguuauagaucuuggaugcggucguggaggauggagcuacuauugugcuggacuuaagaaaguaacugaagugaagggcuacacuaaaggagggcccggucacgaggaacccauaccuauggcaacauacggauggaacuuaguaaaacuucacaguggaaaggacguauucuuuauaccaccagaaaagugugauacucuacuaugugacauuggagaaucaucuccaaacccuacaaucgaagaaggaaggacucucagagugcucaaaaugguugaaccuuggcuucgugguaaucaguucugcauaaaaauucuaaacccuuauaugccaagcguagucgaaacccuugaacaaaugcagagaaaacacggagguaugcucguaagaaauccgcuaaguagaaauuccacccaugagauguauugggucuccugcggaacugggaacaucguaucggcuguaaauaugacaaguagaaugcuacucaaucgauuuacaauggcacacagaaaacccaccuacgaacgggauguagauuuaggagcagguacuagacauguagcaguugagccugaagugccuaaucuagauaucauuggccaaaggauagaaaacauuaaacaugagcacaaaucaacauggcacuaugaugaagacaauccguauaagacaugggcguaucacggaucguacgaagucaaaccaucaggaucugcaagcaguaugguuaacggagucgucaagcuauugacuaaaccuugggaugucauaccgauggugacucaaauugcaaugacagauacuacgccuuuuggccagcagcgggucuucaaagaaaaaguagauacaagaacaccaaaagcaaaaaggggcacagcucaaauuauggaaguuacugcuaaguggcuauggggauuuuuauccaggaauaagaaaccacggauauguacuagagaagaguuuacacgaaaaguucgaucaaacgcugcaauaggcgcuguauuugucgaugaaaaucaguggaacucugcaaaagaggcagucgaagacgaaagauuuugggaucucguacacagagaaagagaauuacauaaacagggcaaaugcgcaacuugugucuacaauaugauggggaaaagagagaagaaacuaggagaguucgguaaagccaaaggaucuagagcgauuugguacaugugguugggagcccguuucuuagaauuugaggcuuuaggauucaugaacgaagaucauugguuuuccagagaaaacucacugucuggcguagaaggcgaaggucuucauaaauuaggcuauauuuuacgugauauuucuaaaauacccggagguaauauguaugcggaugauaccgcaggaugggauacaaggauuacggaagaugacuugcaaaacgaagcuaagauuacagacauuauggagccagaacacgcauuauuagccaaaucgauauuuaaacuaacguaucaaaauaagguaguucguguacaacggccugccaagaaugguacgguuauggaugugauaagucguagggaucagcgagguucaggccaaguaggaacauacggacuaaauacauuuacaaacauggaagcccaacugaucaggcagauggaaucugaaggcauauucagcccaucagaauuagaaacuccaaaucuggcaggcagaguccucgauugguuagagaaacauggagucgagagguuaaaacggauggcuaucaguggcgaugauuguguaguaaaacccauagacgauagauuugcaaccgcucuaacugcgcuuaaugauauggguaaaguaagaaaagacguaccacaaugggagccauccaaaggauggaaugauuggcaacaaguaccuuuuugcagucaccauuuccaucaauuaauuaugaaagauggcagggagauagucguaccuugccgaaaccaagaugaauuaguaggacgcgcgcgugucagucagggagcagguuggagucuucgugagacugccugccuagguaaaucuuacgcccaaauguggcaacuuauguauuuucauaggagggaccuuagacuugcagcgaacgcaauauguucagcuguuccugucgauugggucccaacgucgcggacaaccuggagcauucacgcccaucaucaguggaugacaacugaggacaugcuaagcguauggaaccgggucuggauagaagaaaacccauggauggaggauaaaacgcauauaucaucauggggcgacgugcccuauuuaggaaaaagagaagaucaauggugugggagcuuaauuggacucaccgcccgcgccacuugggcuacgaacauacaagucgcuauaaaccaaguaaggcgacuuauaggaaaugaaaauuaccuagauuauaugacaucgaugaaacguuucaaaaacgagucagauccggaaggugcucuaugguag

SEQ ID NO: 21585 - RNA, 9879 nt, Artificial Sequence
  derived and/or modified CDS sequence (opt6) from DENV-1__FJ410245__SS-prME
ucgguuacuauguuacucauguugaugccgacugcucuagcuuuucauuuaacuacuagagguggugaaccacauaugauuguaucuaaacaagaacgcgguaaaucguuauuguuuaaaacuagcgcugggguaaacauguguacauuaaucgcaauggaccuaggggaauuaugcgaagacacaaugacuuacaaaugucccagaaucaccgaaacugaaccagacgaugucgacugcugguguaacgcaaccgauacuuggguaacauaugggacguguucgcaaacaggugaacauagaagagacaaaaggucaguagcauuagcuccacacguaggacuaggacuugaaacaagaacagaaacauggaugaguagugaaggagcauggaaacaaauacagcggguagaaacgugggccuuaagacauccaggguucaccguaauugcccuguuuuuggcacacgccauugguaccaguaucacacaaaaagguauuaucuuuauacuacuuaugcuuguuacgccaaguauggcaaugcguuguguaggaauaggcagucgcgacuucguagaaggccuuagcggggcaacuugggucgauguaguauuagaacauggcagcuguguuacgaccauggccaaagacaaaccuacccuagacauugaacuacucaaaacagaagugaccaauccggccguacuccgaaaacuuuguauagaagcaaaaauuucaaauacaacaacugacagcagauguccgacgcaaggagaagcgacauugguggaagaacaagaugcaaauuucgucugucgaagaacauuuguagacagaggcugggguaauggcuguggauuguuuggcaaaggaaguuugauaacaugugcgaaauucaaaugcgugacuaaacuagaaggaaaaauuguucaauacgaaaaucucaaauacucaguaauaguuacaguucacacaggagaucaacaucaagucgguaaugaguccaccgagcacggaacaacggcuacaaucaccccgcaagcuccuacuacagaaauacaacugacagauuauggugcuuugacauuagauugcuccccaagaacuggacuugauuuuaaugagaugguauuacuaacaaugaaagagaaaagcugguuaguucacaaacagugguuccucgacuuaccauuaccauggacaucuggagcuucuacgagccaggaaacguggaaucggcaggacuugcucguaaccuucaaaacagcacacgcuaagaaacaagaaguagucguuuuaggaucacaagagggugcaaugcacacagcacucacaggagcaacggagauucagacuagcgguaccacgacuauuuuugcaggccaccuaaaaugcagguuaaaaauggacaaauuaacauuaaaaggcaugaguuauguuaugugcacaggaucauuuaaauuagagaaagaaguagcagaaacgcaacaugguacgguuuugguucagauuaaguaugaagggacugacgccccauguaaaauaccauuuucuacacaagacgagaaaggaguaacucaaaauggacgauuaauaacagccaauccgauagugacagauaaagaaaagccaguaaauauagaagcagaaccacccuuuggugaaucguacauuguuauuggagcaggagaaaaggcacucaagcucuccugguucaagaaaggaucaaguauugguaagauguuugaagcuacggcacgaggcgcuagacguauggcuauacuuggagacacagcaugggacuuugguaguauuggaggagucuuuacgaguguuggaaagcuaguccaccaaauauucggcaccgcauauggcguucuauucuccgguguuucauggacuaugaaaaucggcauagggguccuacuaacuuggcuaggauugaacagucgaucgacuagcuuguccaugacaugcauagcugugggucuagugacccuauauuuaggaguuaugguucaagcagacucagggugcguaauaaacuggaaaggucgagagcucaaaugugguagcgggauauuuguuacaaaugaaguucauacuuggacggaacaauauaaauuccaagcugacaguccuaaacggcuaucugccgccauagggaaagcaugggaagaaggaguauguggcauaagaucagcaaccaggcuugaaaauauaauguggaaacagauaaguaacgagcuuaaucacauacuuuuggaaaacgacaugaaauuuaccgucgucgugggugacguggcgggcauccuggcccaggguaaaaagaugauuagaccgcaacccauggaauauaaauauucguggaagucauggggaaaagcgaagauuauuggcgcagaugugcaaaauaccaccuuuaucaucgacggcccuaacaccccggaaugcccugacgaucagcgagcauggaauauaugggaggucgaagacuacgguuuuggaauauuuacgacaaacauuuggcuaaaacuuagagacuccuacacacaggucugugaucaccgacuaaugagcgccgcaaucaaggauagcaaagcuguacacgcggacaugggauacuggauagaaucagagaaaaaugaaaccuggaaacuugcacgagcuagcuucaucgaagucaaaacaugcauauggcccaagucccauacucuguggaguaaugggguacuugaaagugagaugauuauuccuaagauuuacggagggccuauaagccagcauaauuauagaccagguuauuucacucaggcagcgggaccuuggcaucucgggaaauuagaacuugauuucgaccuaugugaaggaaccacaguaguaguagacgaacauugcggaaaucgcgguccuucauuacggaccacuacaguaacaggcaagauuauccaugaguggugcuguaggucaugcacguuacccccauuaagauucaaaggggaagauggguguugguacggaauggaaauaagaccagugaaagagaaagaggaaaauuuaguaaagucaauggugagugcaggaucaggagaaguagauucguucagcuuaggguuacuauguaucaguauaaugaucgaagaaguaaugcgaaguagauggaguagaagaauguuaaugacgggaacguuggcgguauucuuucuacucauuauggggcaguugaccuggaacgacuugauacgucucugcauuauggucggugcuaaugcgagugacaggaugggaaugggaacgacauauuuggcacuaauggcgaccuuuaaaaugcgcccuauguucgcaguaggcuuguuauuuagaagacuuaccucaagagaaguccuuuuauugaccauaggcuuaucauuaguagcaaguguggaacuuccaaacucuuuagaggaacuuggcgacggucuugccauggggauuaugauccuuaaacuuuuaacggacuuucagucacaucagcucugggcgacacuacucucccugacauucauaaaaacgacguuuucacuacacuaugcuuggaaaacaauggccaugguauuaaguaucguuagucuauuuccccuauguuuauccacaacaagccagaaaacuacuuggcuaccaguacucuuggguucucuuggauguaaacccuuaacaauguucuuaauagcugaaaauaagauuuggggacgacggucauggccacuaaaugaaggaauuauggccgugggaauaguaucaaucuuguuaaguucauuacuaaagaacgacgugccacucgcaggaccacugaucgcaggcggaaugcuaauagcguguuacguaaucaguggaucaucggcugaucuuagcuuagaaaaagcagcggaggucucaugggaagaagaagcagaacacagcggggcuagccauaacauauuaguugaaguacaggaugauggaaccaugaaaauaaaagacgaagagagagacgauacgcuaaccauuuuguuaaaagcaacucuauuagcuguaucuggcguauauccacugucuauaccugcuacuuuguucgugugguacuucuggcagaagaagaaacaacggucaggcguguuaugggauacccccucaccaccagaaguugaaagagcgguccuagaugaugggauauaccguauaaugcaaagaggucuacuuggucgcagccaaguuggaguagguguauuccaagaaaauguauuucacacaauguggcauguaacacguggggcuguccuuauguaucaagggaaaagauuagaaccgucuugggcaaguguuaagaaagaccuaauuucuuauggaggggguuggcgacuacaggguuccuggaacauaggcgaagaaguacaaguaauugcgguagaaccagggaaaaauccuaaaaacguacagacugcuccggguaccuuuaaaacaccggaaggagagguaggugcuauagccuuagauuuuaaaccugguacaaguggaaguccuauaguaaauagagaaggaaaaauuguaggacuuuauggaaauggagucgucacaacguccgguacauauguguccgcaauagcucaggccaaagcgucacaggaggguccuuuaccugaaauagaagaugagguguuuagaaaacggaacuuaacaauaauggauuuacaccccggaucggguaaaacaagaagauaccucccagcaaucguuagggaagcuauuaagaagaaauuaagaacacugauuuuggcaccgacuagagugguagcaagcgaaauggcagaagccuuaaaagguaugccaauccgguaucagacaacugcaguuaaaagcgaacacacaggaaaagaaauuguugacuuaaugugccaugccacauuuacaaugcggcuuuuaaguccaguucguguaccuaacuauaauaugauuauuauggaugaagcucauuucacugauccuucaucuauugccgcccgagguuauauaucaacaaggguaggaaugggagaagcggccgcuauauuuaugaccgcuacuccaccaggaaguguugaggcuuucccacaaucaaaugcaguuauccaagacgaagaacgcgauaucccggaacguucuuggaacucaggauaugaauggauaaccgauuuuccuggaaagacgguaugguucguacccucaauaaagucugggaaugauauagcuaacugccuaagaaagaacgguaagcgggugauacaacuguccagaaagacauuugauacagaauaucagaaaacuaagaacaacgauugggauuacguaguuacuacagauauaucagaaaugggugcgaacuuuagagcugaucgcguuauagauccuagaagaugucuaaaacccguuauuuugaaagaugguccagaaagagugauacuugccggaccaaugccgguuaccguagcgagugccgcccaaagaagggguagaauagguaggaaucacaauaaagaaggggaccaauauauuuacaugggucagccacucaauaaugacgaagaccaugcccacuggacagaagccaaaauguuacuagauaauauaaauacuccagaaggaauaauucccgcucuauuugaaccagaacgagaaaagagcgcagcuauugacggagaauacagauuaagaggagaagcuagaaaaacauuuguugaacuuaugcgucguggugaucuacccguuuggcuaaguuauaaaguugcuucggaaggauuucaguacucagauaggagaugguguuucgauggugaacgaaacaaccaaguauuagaagagaauauggauguagaaauauggaccaaagaaggugagcguaagaaacuaaggccuagauggcuagacgcgcgaacuuauucagacccgcuggcacugcgggaauuuaaggaauuugcagcgggaaggagaagcguauccggagaccuaauacuugaaauagguaaguuaccucagcaucugacucaaagagcucaaaaugcgcuagauaacuuaguaaugcuccacaauucagaacagggcgguagagccuaccgucacgcaauggaggaacuaccugacaccauagagacauuaaugcuauuagcucuuauugcaguucuaacuggaggggugacauuauucuuccuaagcggacguggcuuaggaaagacaucaauuggacuauuaugcguuauggcaagcucagucuugcucuggauggcaagcguagagccacauuggauagcggccucuaucauucuagaguucuuccuuauggucuugcucauccccgaaccugauaggcaaagaacuccacaagauaaccaauuagccuacguuguuauaggauuacuguuuaugauauuaacaguggcggccaacgaaaugggccuguuagaaacuaccaagaaagauuuaggaauaggacauguugccguugagaaucaucaucacgcagcgauguuagauguagaucuucacccagcaucugcauggacauuauaugcuguagcaacuacuauaauaacgccgaugaugcgacacacaaucgagaacacgaccgcaaauauaucuuugacagccauagcaaaucaggcugcaauccucaugggacuugacaaagguuggccgauuaguaaaauggauauuggagucccccuauuagcgcuaggauguuauagucaaguaaacccccuaacacucacugccgcagugcuuauguugguggcacauuacgcaauaauagguccaggguuacaagcuaaggcuacacgagaagcacagaaaaggacagcggcgggaauuaugaaaaauccgacuguugacgguauuguugcaaucgaucuagauccagucguuuaugacgcgaaguuugaaaaacaauuaggucaaauaaugcucuuaauauuaugcacgagucaaauauugcucaugaggacgacuugggcauuaugcgagucaaucacccuagccacggguccauuaacuacacugugggaaggaucacccggaaaauuuuggaauacuacuauagcaguaucuauggcaaacauuuuuagaggcucguaccuagcaggagcuggacuugcauucucccucaugaaaucauuaggagguggucgcagaggaacgggcgcacagggagaaacgcuaggcgaaaaauggaaacgccagcugaaccaguugaguaaaagugaguucaauaccuacaaaagaucagguauuauggaaguggacaggucggaagcgaaggaagguuuaaaaaggggcgaaacgacaaagcaugcaguaucacgaggaacggcaaaauuaagaugguuuguagaaagaaauuuagucaagccugaaggaaaaguaauagauuuaggauguggucgcggagguuggucauacuauugugcaggccuuaagaaaguuacggaagugaaaggauauaccaaaggagggccaggacaugaagaaccuauuccaauggcuacuuacggcuggaaccuaguaaaacuucauagcgguaaggacguuuucuuuauuccaccggaaaaaugugacacacuguuaugugauauaggagagagcagcccgaauccaaccaucgaggagggacgaacuuuacgcguauuaaagaugguggagccauggcucaggggcaaucaguucugcauuaaaauuuuaaacccuuacaugcccucaguuguagaaacucuugaacagaugcaaagaaaacacgggggaauguuaguccgaaauccauuaagcagaaauuccacacacgaaauguacuggguuaguugcggaacaggaaauaucgucucugccguuaauaugacaaguaggaugcuacuaaaccgauuuacaauggcucaccgaaaacccacauacgaacgagauguugauuugggcgccgguacgcgacacguagcaguagaacccgaaguagccaauuuagacauaauaggucaaagaaucgaaaacauaaaacaugaacacaagagcacuuggcacuacgacgaggauaaccccuauaaaacuugggcuuaucacggaucuuaugaagugaaaccgaguggguccgcgucaaguaugguaaacggcguaguaaaguuacugacaaagcccugggauguaauaccaaugguuacccagauugcaaugacagauacaacgccguuugggcaacaaaggguuuucaaagaaaaagucgacacuaggacaccaaaagcgaaaagaggaacggcgcaaaucauggaaguaaccgcaaaaugguuguggggauuucuaucaagaaacaagaaaccuaggauuugcacccgagaggaguuuacaagaaaaguaagaucaaacgccgcaauaggggcgguauucgucgacgagaaccaguggaacuccgcaaaggaagcuguagaagacgaaagauucugggauuuaguucauagagaacgagaauuacauaaacaagggaaaugcgcgacaugcguuuauaauaugaugggcaaacgcgagaagaaauugggggaguucggaaaagcuaaaggcucacgggcaauaugguacaugugguuaggcgcgcgauuccuugaauuugaggcuuuaggcuuuaugaaugaagaccauugguuuucaagagaaaacucauuaaguggcguagagggagaagggcuacacaaauuaggauauauacuaagggacauuucgaagauaccugggggaaacauguacgccgaugauacugcugguugggauacccguaucacugaagacgaucugcaaaaugaagcacgaauaaccgauauuauggaaccggaacacgcauuauuagcaaaaucaauauuuaaauugacauaucaaaauaaaguaguaagaguacaacgcccugcaaagaacgggaccguuauggacguuauuucaagaagagaucaacgagggucaggucaaguaggcaccuauggauuaaauacauucacuaacauggaagcccagcugauaagacagauggaauccgaaggcauauuuuccccuagcgaauuagagacacccaaccuagcugaaagaguucuagauugguuagaaaaauauggaguagagcguuuaaagagaauggcaauaaguggcgaugauugcgucguuaaaccuauugaugaccgguuugcuaccgcccuuacagcuuuaaacgauaugggcaaaguuaggaaagacauuccucaaugggaaccaagcaaaggauggaacgacuggcaacagguuccuuuuugcagucaccauuuucaccaacugauuaugaaggaugguagagaaauagucguuccaugucguaaucaggaugaauugguggggcgagcacgcguaagccagggcgccgguuggucguugagagaaacagcuugucuggggaaaaguuacgcacagauguggcaacuaauguauuuccaccggagagaucuuaggcuagcagccaacgccauauguucggcgguuccaguagacuggaucccaacgucaagaacaacgugguccauucaugcucaccaucaauggaugacuacagaagauaugcuaucuguguggaauaggguauggaucgaagaaaacccauggauggaggauaaaacucauauuucaucuuggggcgacguaccauaucuugguaaaagagaggaccaguggugugguucgcugauuggauugaccgcuagagcgacaugggcaacaaauauccaaguagcgauaaaccaggugagaaggcucauaggaaaugagaauuauuuagauuacaugaccucuaugaagagauucaagaaugaaagugauccagaaggagcgcucugguga

SEQ ID NO: 21586 - RNA, 9879 nt, Artificial Sequence
  derived and/or modified CDS sequence (opt6) from DENV-1__FJ410246__SS-prME
uccguaacuauguugcuaauguuaaugccaacugcuuuagcauuccauuuaacaacgcguggaggugaaccucauaugauaguuucuaaacaagaaagaggaaaaucacuacuauuuaaaacuuccgcgggagucaauaugugcacucuuaucgcuauggaucuaggggaguucugugaggacaccaugacauauaaauguccaagaauuacagaggcagaaccugacgauguagauuguugguguaaugcgacugacacuugggucacauacggaacguguucgcaaacgggagaacauagaagagauaaaagguccguagcauuagcaccacacguaggucuaggucuggaaacccgcacugaaacuuggaugucuuccgaaggugcauggaaacaaauucaacgaguggaaacuugggcacugcggcauccuggauucacaguaauagcauuguuuuuggcucaugcuauuggaacgucaaucacccaaaaaggaauaaucuuuauacuacuaaugcugguaaccccuucuauggcuaugcggugcguagguauaggaucacgggauuucgucgaaggacuuucgggagcgacguggguggauguaguucucgagcauggaaguugcguaacaaccauggcaaaagacaaaccgacuuuagauauagaacuccuuaaaacagaaguuacgaauccagcaguucuucgaaaauuauguaucgaggccaaaaucagcaauacaacaacagauaguagauguccaacucaaggagaagcuacacuuguugaggaacaagaugcuaauuucguauguagaagaacauucguagauaggggauggggaaaugguuguggauuauuuggcaaagggucucugauaacuugugcaaaauuuaaaugcgucaccaaauuagaaggcaagauuguacaauacgaaaaccuuaaguauagcguuauagucacgguacauacaggggaucaacaccagguugguaaugaaucaacagagcauggcacgaccgcgaccauuacgccucaagcaccuagcacugaaauucaauugaccgauuauggcgcacuaaccuuagauuguaguccacgaacagguuuggacuuuaaugagaugguuuuauuaacgaugaaagaaaaaucguggcuaguacacaaacaaugguuuuuagaccucccauuaccuuggacaaguggugcuucaacaucucaagaaacauggaacaggcaagaucuauuaguaacauuuaaaacagcucaugccaagaaacaagagguaguaguucuagguagccaagaaggcgcaaugcauaccgcacuaaccggugcuacagaaauacagacaagcgguacaacuacuauauucgcaggacaccuaaaaugucgccuaaaaauggauaaauugacgcuuaaagguaugucauacguuauguguacggggagcuuuaaacucgaaaaagaagucgcggaaacacagcaugguacaguucuuguacaaauuaaauaugagggaacugacgcuccauguaaaaucccuuuuaguacgcaagacgagaaggguguaacucaaaaugguagauuaauaaccgcaaaucccauuguaacagauaaggauaagcccguaaauauagaagcugaaccgccuuuuggcgaguccuacauagucauuggggcgggcgaaaaggcuuuaaaauuaucuugguucaagaaaggaaguuccauaggaaaaauguuugaagcaacugcuagaggugcucgaagaauggcaauccuaggagauacagcaugggacuucggcucaauuggcggaguauuuacuucagugggcaaauuaguccaccaaauauucgggacugcuuauggcguucucuuuagcggcgugaguuggacuaugaaaauagguauaggcgucuuauugaccugguuaggacuuaauaguagaucaaccagucuuucaaugaccuguauagcgguuggccuagugaccuuauaucuaggaguuaugguccaagcugacagcggaugcguaauaaacuggaaaggaagagaauugaaguguggcagugguauauucguuacaaaugaaguucauaccuggacugaacaauauaaauuucaagccgacaguccaaaacgucuaagugcggccauaggcaaagcaugggaagagggugugugugggauaagaagcgcaacaaggcuugagaauauaauguggaaacaaauuucaaaugaauuaaaucauauuuuacucgaaaacgacaugaaauucacgguaguaguaggagauguagcagggauauuagcucaaggcaagaaaaugauuagaccacaaccaauggaauauaaauacaguuggaaguccuggggaaaagcgaaaauaauaggagccgauguccagaauacuacauuuauuaucgauggaccaaacacaccagaauguccagacgaucaaagagcauggaacauaugggaaguggaagacuauggcuucgggauuuuuacuacaaauaucugguuaaaacucagggauaguuacacccaggucugcgaucaucgauuaaugucggccgcuauaaaggauaguaaagcagugcaugcggacauggguuauuggauugaaagugagaaaaacgaaacauggaaauuggcucgagcauccuucauagaaguaaaaacaugcauauggccaaaaucacauacauugugguccaacgggguauuagaaagcgagaugauuauaccaaaaauauacggaggucccauaucacaacacaauuacagaccaggcuauuucacccagacggccgguccauggcaccuggggaaacucgaacuagauuuugauuuaugugaaggaacgacgguuguaguugaugaacauugcggcaaccgugguccaucucugaggacuaccacaguuaccgguaagaucauacaugaguggugcuguagguccugcacacuuccaccuuuacgauucaaaggggaagauggguguugguacgguauggagauaagaccuguuaaagaaaaagaagaaaaucuugugaaaucaaugguaagugcagggagcggugaaguugauucauuuucauuaggucuauuauguaucucuauaaugacugaagaaguuaugaggaguagauggucgagaaaaaugcuaaugacagguacacucgcgguuuucuuuuuacucauaaugggacaauuaacuuggaaugaccuuauaagacuaugcaucaugguaggagccaacgccucagacaggaugggcaugggcaccacauauuuagcacucauggcaaccuuuaaaaugaggccaauguucgcaguggguuuacuuuuccgacgauugacuucccgagaaguguuauuacuuacgauagggcuaucccuaguugcuucuguagaacugccuaacucccuggaagaacuaggagauggucuagcuaugggcauaaugauacuaaaguuauuaacugacuuccaaucucaucaacucugggcuacccuucugucccuaacauuuaucaaaaccacguuuagccugcauuacgcauggaagacuauggcgaugguauuaaguauaguaucauuguucccucucuguuuaagcaccacgucucagaaaaccacgugguuaccuguauuacuugguucauuagguugcaaaccauuaacgauguucuuaauagcggaaaacaaaauuugggguagaaaauccuggccauuaaacgaggguauaauggcaguaggaaucguauccauuuugcucucaaguuuacuaaagaaugacguaccuuuagcagguccucucauagccggugguauguuaauugcguguuaugugauaucaggguccucggccgaucucagcuuagaaaaagcugcagaaguauccugggaggaagaagcagaacacaguggagcgucccacaacauuuugguugaaguucaagacgacggaacaaugaaaaucaaagaugaggagagagacgauacauuaacuauauuacuaaaagcaacacuuuuggcgguauccggaguauaucccuuaucaauaccggccacauuauuuguuugguauuucuggcagaaaaagaaacaaagauccggaguauugugggauacaccuucuccgccugaggucgaaagagcagucuuggaugacgggauauaccguauuaugcaaagaggacuguuaggcaggagucaagugggaguuggaguauuucaagaaaacguauuucacaccauguggcacgugacucgaggugcaguacuaauguaccaaggcaaacgacuagaaccaucuugggcaagugucaagaaagaucuaauuucauauggaggaggcuggcgacuacagggcaguuggaauacaggggaagaaguacaggucauagcaguagaaccuggcaaaaaucccaaaaauguacagacagcaccugggaccuuuaaaacaucugagggagaaguaggagcaauagcauuggauuuuaaaccggguaccagcgggaguccaauugugaauagagaagguaaaauaguagguuuguacggcaauggaguugucacaacaucagguacauacguuucggcaauugcgcaagccaaagccucccaggagggaccccugccagaaauugaggacgaaguauuccguaagcguaacuuaacuauaauggacuuacaucccggcaguggaaaaacccgacgcuauuuacccgcuauaguacaugaagccauaaaacggaaacuaaggacauuaauauuggcaccaacccgaguagucgcuagugaaauggccgaagcgcuaaaaggaaugccaauacgauaucagacuacggcuguuaaaucagaacauacugguaaagagauaguagaucuaaugugucaugcgaccuucacuaugagacuacuuucaccagugaggguaccaaacuauaacaugauaauuauggaugaagcacacuucacagauccaaguuccauagcugcaaggggauauauauccacuagaguagguaugggggaagcugcugccauauucaugacugcaacgcccccggguucuguagaggccuucccacaaucuaacgcuguaauccaagacgaggaaagagauauaccagagcguucuuggaacucagguuaugaguggauaacggauuuccccgguaagacgguaugguucguaccuaguaucaaaucaggaaacgacauagcuaauuguuugcggaagaacggaaaaagaguaauacaacucaguagaaaaacauucgauacggaauaucaaaagacuaaaaauaaugauugggauuacguaguaacuacugacauuucggagaugggugcaaauuuuagagccgauagagucauagacccuagaagaugucucaaacccgucauuuugaaggauggcccugagcgaguaauuuuggccggaccaaugccagugacuguggcaucagcagcccaaagaagaggaagaauugguagaaaucauaauaaagaaggcgaccaauacguauauauggggcaaccacuaaacaaugaugaagaccaugcccauuggacggaagccaagauguuacuugacaauauuaacaccccagaaggaauaauacccgcauuauuugaaccugaacgcgagaaaagugcugcaaucgacggagaauacagacuaaggggagaggcgcggaaaacguuuguagaacuaaugaggagaggagacuugccggugugguuauccuauaaagucgcgucugagggcuuccaauacucugauaggcguuggugcuuugauggggaaagaaauaaccagguguuagaagagaauauggauguagaaauauggacaaaggaaggagagcguaagaaacucagaccaagauggcuugaugcuaggacuuauucugacccuuuggcgcuacgagaauuuaaagaguucgcagcuggccgcagaucugugucaggagauuuaauuuuagaaauaggcaaacucccccaacaucuaacacaaagagcccaaaaugcguuggauaaccuaguaaugcuacauaacucugagcagggaggacgagcauauaggcaugcuauggaagaauuaccugauacaauugaaacucucaugcuauuagcacuaauagcaguauuaacuggcggagugacacucuucuuucugucaggaagaggucuaggcaagacaaguauaggucuauuaugugucauggcgucgaguguccugcuuuggauggcuuccgucgagccccacuggauagcagcaucaauaauauuagaguucuuucuaauggugcucuugauacccgaaccugacagacaaagaacaccucaagauaaccaacuggcguacgucguaauaggccuacuuuuuaugauccucaccguagcagcaaaugaaaugggacuuuuggaaacaacgaaaaaggaucuagguauuggccacguagcgguagaaaaucaccaccaugcugcuauguuggacgucgauuuacaccccgcaucggcguggacucuauacgcgguagcaacaacuauaauuacucccaugaugcgacacaccaucgaaaacacgacagcgaacauuucacuaacagcaauagcuaaucaggcugcuauucuuaugggacuagauaaaggauggccaaucaguaagauggauauaggcguuccguuacuagcgcuuggcugcuauucacaagucaauccuuugacucuuacagcagcgguauuaauguuaguagcacacuaugcaaucauaggcccaggccuccaagcaaaagccacccgugaggcacagaaaaggaccgcagcaggaauuaugaaaaauccuacggucgacggaauaguugcaauugaccuugauccagugguguacgaugcgaaauucgaaaaacaauugggucaaauuaugcuacuaauccuaugcacuagccaaauacuacuaaugcguacaacaugggcacuaugugagucuauuacguuggcuacuggcccacuaacuacucuaugggaagguagcccaggaaaauuuuggaauacuacuauagcggugucaauggcaaacauuuucagaggauccuaucuagcaggagcaggacuggcuuuuucacucaugaaaaguuuaggaggugggcgucgugguacuggggcacagggagagacacugggugagaaauggaaaagacagcuaaaccaauuaucgaaguccgaauuuaacacguauaaaagaagugggauaauggaagucgacagaucggaagcaaaagaaggauugaaacgaggugaaacuacaaagcacgccgugagucgcggaacagcaaaguuaagaugguucguagaaagaaaucuaguuaaaccggaagguaaagugaucgauuuaggaugugguaggggcggauggucuuauuauugcgccggucucaagaaaguaaccgaggugaaagguuacacaaaaggaggacccggucaugaggaaccaauuccaauggcaacguauggcuggaauuuagucaagcuacauucggggaaggacgucuucuucaucccacccgaaaagugugauacacuauugugcgauauuggugaaaguucgccaaacccaacuauagaggaagggcgaacacucagaguacuaaaaaugguugagcccugguuacguggaaaccaauuuugcauuaaaauacugaauccuuauaugccaagcguagucgaaacauuagaacaaaugcagagaaaacacggugggaugcuuguuagaaauccauugucacguaauucuacccaugaaauguacuggguuaguugcggaaccggcaauauuguuucagccguaaacaugacaucacgaauguuacucaaucgauucacuauggcgcaucgcaaaccaacuuaugagcgcgauguagaucugggggcugguacaagacauguagcgguagaaccggaaguagcuaauuuagacauuaucgggcaaaggauagagaauauaaaacaugaacauaaaagcacauggcauuacgacgaagauaauccuuacaaaacgugggcguaccauggaucuuacgaaguaaaaccuucaggaucagccuccagcauggugaacggagucguaaaacucuugacuaaaccaugggauguaauuccgaugguuacgcaaauugcgaugacugauacaacuccguuuggacaacaaagaguuuuuaaagagaagguagauacaagaacucccaaggcaaagagaggcacagcucaaauaauggaaguuaccgcgaaaugguuaugggguuuucugucccgaaauaagaaaccgagaauauguacccgcgaggaauuuacgcgaaaaguucgcagcaaugcagccauaggagcaguauucguagacgaaaaucaauggaacuccgccaaggaagcaguagaagaugagcgauucugggacuuaguucaucgugaacgcgaauugcauaaacaaggaaaaugcgccacuuguguuuacaacaugaugggaaaaagagagaagaagcucggugaguuuggaaaggcaaagggaucucgcgcaauaugguauaugugguugggggcaagauuucuagaauuugaagcacugggauucaugaaugaagaucauugguucaguagagaaaacucacuaucaggaguggagggagaagguuugcauaaacuuggguauauucuucgugauauaucgaaaauaccuggagguaauauguacgcggacgacacagcugguugggauacccguauuacagaagaugaucuacagaaugaagcaaagauaacggauauuauggaaccggaacaugcuuuguuagcaaaauccauauuuaaacuaacauaccagaauaaaguaguucgcguccaaagaccagcgaaaaaugggacgguuauggauguuauaucuaggagggaccagaggggaucggggcaaguagguaccuauggauuaaauacuuuuacaaauauggaagcucagcuaauacgucaaauggagucagaggggaucuucucuccaucagaacuagaaacuccuaacuuagcaggccgcguucucgauuggcucgaacgccauggggucgaacgguuaaaacgcauggcaauaaguggugacgacuguguaguaaagccuauagacgaucgauuugcgaccgcacucacagcacucaaugacaugggcaaaguuagaaaggacauuccacaaugggagccaaguaaaggguggaaugauuggcaacaaguaccauuuuguagucaucacuuccaucaauuaauuaugaaggauggucgcgagauuguuguacccugcaggaaccaagacgagcuaguuggcagagcacgggugucgcagggggccggauggagccuucgcgaaacugcaugucuugguaagucauaugcucaaauguggcaacucauguacuuccauaggcgugacuuaagguuggcugccaacgcaauauguucugcaguaccagucgacuggguuccaaccagucguacaacauggagcauucaugcacaucaucaguggaugacaacagaggacaugcucucaguuuggaaucgaguauggauagaggaaaaucccuggauggaagauaagacacauauuucuucuuggggugauguaccuuaccuagguaaacgggaagaccagugguguggcucauuaaucggccuaaccgcuagagcgaccugggcgacaaauauucaaguagcgauaaaccagguaagaagacuaauagggaaugaaaauuauuuagacuacaugacuuccaugaagcgauucaaaaacgaaagugacccggagggugcguugugguaa

SEQ ID NO: 21587 - RNA, 9879 nt, Artificial Sequence
  derived and/or modified CDS sequence (opt6) from DENV-1__FJ410247__SS-prME
ucaguuacgaugcugcuuauguugaugccuacugcacucgcuuuucacuuaaccaccagggguggugaaccucauaugauuguaucgaaacaagaacguggaaaaucacuauuauuuaaaaccagugcgggaguuaauaugugcacccugaucgcaauggauuuaggugaauuaugugaagauacaaugacguacaaauguccuaggaucacggaaacagaacccgacgauguggacugcuggugcaaugcaacagacacaugggugacuuauggaacuugcucacaaacuggugaacaucgaagagauaaaagaucaguagcacucgcuccacaugugggauugggguuggagacacgaacagagacuuggaugucgagugagggggcguggaaacaaauucaaagaguggagacuugggcgcuaagacaccccggguuuacgguuaucgcgcuguucuuagcacacgcaauuggaacaaguauuacccaaaaaggaauaauuuuuauucucuuaauguuaguaacaccuaguauggcaaugagaugugucggaauaggaaguagagauuucguggaagggcugagcggagcgaccuggguagacgugguacuagaacauggaucgugugucacuaccauggcuaaagauaaaccgacauuagacaucgaacuguuaaaaacagaagugacaaaucccgcgauucuuagaaaacuuugcaucgaagcaaaaauaucaaauaccaccaccgauucccgauguccuacccaaggugaagcaacuuuaguagaagaacaagacgcaaacuucguuuguaggagaacuuucguugacagaggaugggggaacggcuguggucuauuuggaaaaggaucguugauaacaugugcuaaauucaaaugugucacaaaauuagaagguaaaauaguacaauacgagaaccucaaauauucugugauugucacaguacauacuggagaucaacaucaaguuggcaacgaaucuaccgagcacggaacuacagcaacaauuacaccccaggcgcccacaacagagauacaauuaacagauuauggagcacuaacacuugauuguuccccaagaaccggacuagacuuuaaugaaaugguacuccuaacuaugaaagaaaaaucauggcuaguccauaaacaaugguuucuagacuugccguuaccauggacgaguggagcaucaacaagucaggaaacauggaacaggcaagauuuauuaguaacuuuuaagacagcccacgccaagaagcaagaaguggugguauuagggagucaagaaggugcaaugcacacggcacucacgggagcgacagaaauacagaccucaggaacaacaacaauauuugcaggacauuugaaaugucgauuaaaaauggauaaauuaaccuuaaaagguaugaguuaugucauguguacaggcucauuuaaauuagagaaagaggucgcugagacccagcaugguacugucuuaguacaaauuaaauaugaaggaacugaugcaccaugcaaaauuccguucucuacacaagacgagaaagguguaacacagaacggacgacuuauaaccgcuaaucccauugugacagauaaagaaaaacccgugaacauagaggcagaaccgccauucggagaaucuuauauuguaauuggcgcuggugaaaaagcucuaaaacugagcugguucaagaaaggaaguucgauaggcaaaauguucgaagcaacggcucgcggugcgcggaggauggccauucuaggagacacagcuugggauuucgguucaauagguggaguguuuacaagugucggcaaauugguacaucaaauuuuuggaacagcuuacggagugcuauucucuggaguaaguuggaccaugaaaaucggcaucgggguccuuuuaacaugguuaggucuaaauaguagaucuacaucauugucuaugacauguauagccguuggccuagucacuuuauaccuuggugucauggugcaagcggacucaggaugcgucaucaauuggaaaggacgagaauuaaaguguggcucagguauuuuuguuacaaacgagguacauacauggacagaacaauauaaauuccaggccgauucuccuaagagauuguccgcggcaauuggaaaagcaugggaagaaggugugugcgggauaagauccgcaacgcguuuagagaauauaauguggaagcaaauuaguaacgagcuuaaucauauauuauuagaaaaugauaugaaauuuacagucguaguaggggacguagcggggauuuuagcgcaagguaagaaaaugauucgaccacaaccgauggaauacaaauauucauggaaaaguugggguaaagccaaaauaauaggugcugacgugcaaaauacgaccuuuauuauagacgggccuaacaccccagaguguccugaugaucagcgagcauggaauauaugggaagucgaggauuacggguuuggaauuuuuacaacaaauauauggcugaaacuacgcgacucauacacacaaguaugugaucacagauuaaugucagcggcuauuaaagauucuaaagcaguacacgcagacauggguuacuggauugaaucggagaaaaaugaaacauggaaguuggccagggccaguuucaucgaagucaaaacguguauuuggcccaaaagccacacuuuguggaguaaugggguacuagagucagaaaugauaauuccuaagauauaugguggaccaauaagccaacauaauuaucguccuggauacuuuacgcagaccgcugguccguggcacuuagguaaguuagaguuggacuuugaucugugugaagguacaacagucguaguggaugaacauugcggcaaucgagguccaaguuuaagaacaacaacgguaaccggcaagauaauacaugaauggugcugucgaagcuguaccuuaccaccgcugagauucaggggagaagaugggugcugguaugguauggaaauaagaccggugaaggaaaaagaagagaacuuagugaaauccaugguaucagccggaucaggagaaguugacucauucucgcuaggucuacuguguauaucgauuaugauagaagaaguuaugagaaguagauggucuaggaagaugcugaugacugguacuuuggccguuuuucugcuauuaauaaugggacaauuaaccuggaacgacuugauccgacuaugcauaaugguaggagcaaacgcuucagacagaaugggaaugggaacaaccuaucuagcucuuauggcaaccuuuaaaaugcgaccaauguuugcgguaggucuauuguucaggagauuaacuucaagggaaguacuacugcucacgauaggacuuucacuugucgcuagcgucgaauugccaaacucccuugaagaauuaggugauggauuagcgaugggaauuaugauacucaaacugcugacugacuuccaaucccaucaguuaugggcaacauugcugagccuaacauucauuaaaacuacauucaguuuacauuaugccuggaaaacaauggcuauggugcuuagcauagucuccuuauuuccucugugucuuaguacuacaagucagaaaacaacauggcugccuguauuauuagguucgcucggcugcaaaccccucacgauguucuugaucgcagaaaaccggaucugggguagacggucauggccguuaaaugaggguauaauggcaguuggcauaguaucuauauuacuuaguagucugcuuaaaaaugauguacccuuagcgggaccauuaauugccgguggaaugcuaauagcauguuacguuauaucgggaucaagugcagaccucucguuagaaaaagcagcugaaguaagcugggaggaggaagcagaacacucaggcgcuucacauaauauccucgucgaggugcaagacgauggaacaaugaaaauuaaagacgaggagcgagaugauacccuaacuauccucuuaaaagcaacucuauuagcagugagcggaguauauccauuaucaauaccagcaacauuguucguaugguauuuuuggcagaagaagaaacagcgcaguggaguauuaugggauacccccagcccgccugagguggagagagcagugcuagaugaugguauauauagaaucaugcaaagaggacucuuagguagaagucaaguaggagucgguguauuucaagaaaauguauuucacacaauguggcaugugacaagaggagcagugcuaauguaccaagguaaaagauuagaaccuucaugggcaagugugaagaaagauuuaauaucauauggagggggauggcgacuucaagguucuuggaauacaggagaagaaguacagguuauagcaguagaaccagguaaaaauccgaaaaauguacaaacgacaccgggaacauucaagacaccggaaggugaaguaggagcaauagcucuggauuucaaaccaggcacaucagguuccccaauuguaaacagagaggguaaaauugucggccuguaugggaauggcgucguuacuacuucagggacguaugugucugcuauugcacaagcgaaggcaucccaagaaggaccucuaccagagaucgaggaugaagucuuucgcaaacgaaaccugaccauuauggauuugcaucccgguucagggaaaacuagaagauaccuuccugcuauaguaagagaagcaaucaaaaggaaauuaagaacacugaucuuggcgccuacaagaguaguugcgucugaaauggcagaggcguuaaaaggcaugccaauaagauaucaaacgacagcagucaagucggaacauacggguaaagaaaucgucgacuugaugugccacgcuacauucaccaugagacuucuuucaccuguaagaguuccuaauuauaacaugauaauaauggaugaggcgcacuucacagauccaucuucaauagcggcaagagguuauauaucuacuagagucgggaugggggaagccgcagcuauauuuaugacugccacgccuccgggaucagucgaggcauuuccacaaaguaacgcagucauccaagacgaagaaagagauauaccugagcgaucuuggaacagcggguaugaauggauaacugauuuuccgggcaaaaccgucugguucguaccaucuaucaaaagcggcaacgacauugcaaauuguuugcguaaaaaugggaagagaguaauucaauuaucgagaaaaacauucgacaccgaauaccaaaagaccaagaacaaugacugggauuauguuguuacuacagacauaagugaaaugggagcaaacuuuagagcagacagggucauagacccaagacguugcuuaaagccaguuauauuaaaggauggcccagaacgcguuauacuagcagguccaaugccagugacaguggcuucugcugcacaaagacgugguagaauagguagaaaucauaauaaagaaggggaccaguacauauauauggggcaacccuuaaauaacgaugaggaccaugcucacuggacugaagccaaaauguugcucgauaauauaaacacucccgaaggaaucauaccagcucuguucgaaccugagcgugagaagucggcggcgauagauggagaauauagauuaaggggcgaagcuagaaaaacauuugucgaauugaugagaaggggagacuuaccaguguggcucagcuauaagguugccuccgaaggguuccaauacagugauagaagaugguguuuugacggagaacguaacaaccagguguuagaagaaaauauggauguugaaauauggacaaaagaaggugaacgaaagaaauugcggccccgaugguuagaugcccgcacguauagugacccauuagcauuaagggaauuuaaagaguucgcagcagguaggcgaaguguaaguggggaccuaauuuuagaaaucggaaaauugccacaacaccuaacgcaacgggcgcaaaaugcuuuagacaaucugguuaugcuacacaauagcgagcaaggcggcagagcauaccgacaugccauggaagaacucccggacacaauagaaacguuaauguuacuugcgcucaucgccgugcuuacggguggagucacauuguuuuuccuuucgggucguggccuaggaaaaaccucaaucggauuauugugcguaauggcuucuagcguucuacuuuggauggccuccguugagccucauuggauugcugccucaauaauccuugaauuuuucuuaaugguuuuacuuaucccggaaccggauagacaaagaacuccgcaggauaaccagcuugcauacguaguuauaggauuacuuuuuaugauacucacgguugccgcuaacgagaugggauuauuggaaacgacuaagaaagaucuagguauaggacauguggcaguggguaaccaucaucaugcggcaaugcucgauguagaucuucaucccgcuagcgcguggaccuuauacgcuguggcgacuacuauuauaacgccgaugaugcgucauacuauagaaaauacaacagcaaauauuagcuugacagcuauagcaaaccaagcugcuauucuaaugggauuggacaagggcuggccgauauccaaaauggacauaggaguacccuuacuagcauugggauguuacagucaagugaacccuuuaacacugacagcagcuguacuuauguuaguggcccauuaugcaauaauugguccgggauuacaagcaaaagcuacacgagaagcacaaaaacgcacugcggccggaaucaugaaaaacccuaccguggauggaaucguagcaauagauuuagacccagucguauaugaugcaaaauucgaaaaacaacugggacaaauaauguuauuaauacuuuguacaagucaaauacugcugaugcgaacaacaugggcacuuugcgaaucuauaacguuagcaacgggcccauugacaacauuaugggaggguagcccgggaaaauuuuggaauacaacaauugcggugucuauggcgaauaucuucagaggauccuauuuagccggugcuggucuugcuuuuagccuaaugaaaucguugggcgguggucgacgggguaccggugcccaaggagaaacauuaggagaaaaguggaaaagacaacuuaaccaacucagcaaaagcgaauuuaacacauauaaaaggucuggcauaauggaaguugaccgaagcgaagcaaaagagggccuuaaacgcggagaaacuacuaagcaugccguaucucgaggaacugcaaaacuaagaugguuuguugaacguaauuuaguaaaaccggaagguaagguaauagaucuagguuguggccgagggggcuggucuuauuauugugccggucuuaagaaagucacugaagugaagggauauacaaaagggggaccaggacaugaagaaccgauacccauggcaaccuacggauggaacuuagugaaauuacauucgggcaaggacguguucuuuauaccacccgaaaagugugauacuuuacuaugcgacauaggagaaucauccccuaauccuacuauugaggaaggaaggacccuucgaguccucaagauggucgaaccgugguugagggggaaccaauucuguauuaagauacucaaucccuauaugccaucggugguagaaaccuuagaacaaaugcaacgaaaacacggagguauguuaguaaggaacccgcuuagcagaaacuccacgcacgagauguauuggguaaguugugggacuggcaauaucgucucagcagucaauaugacaucacgaauguuacucaaucguuucacuauggcgcaccggaagccuaccuacgaaagagacguugacuuaggggccggcacccgccacguagcaguagagccugaaguagcuaaucuagauauaauagggcaacguauagaaaauauaaaacaugaacacaaaucgaccuggcacuaugacgaagacaacccauacaaaaccugggcauaucaugguaguuaugaagugaaaccgucaggcucagcaaguucaauggucaauggcguggucaaacuuuuaacuaagccaugggaugucaucccaauggugacacaaauagcuaugacugauacaacuccuuucggccagcagaggguuuuuaaggaaaaaguagauacaagaacaccaaaggcaaaacaaggcacggcgcagaucauggaaguuacagcuaaaugguuguggggguuccuaucucgcaauaagaaacccagaaucuguaccagagaagaauuuacucguaaaguaagaucaaacgcugcgauaggcgcuguuuuuguggacgaaaaucaguggaauagcgcaaaagaagcagucgaagaugaacgguucugggaccuaguccacagggagcgagaacuucacaaacaagguaaaugcgcuacuugcgucuauaauaugauggguaaaagggagaagaaacugggcgaguucggaaaagcgaaagggucucgagcuauuugguauauguggcuuggagcuagguuccuggaguuugaagcgcuaggauuuaugaaugaagaccacugguucucuagagaaaacuccuuauccgggguagaaggagaagguuuacauaaauuagguuauaucuuaagagauauuaguaaaauaccaggagguaacauguaugcugacgauaccgcuggaugggauacacgaauaacggaagaugauuugcaaaaugaagcuaggauuacggacauaauggagccagagcaugcuuuacucgcaaaaaguauauuuaaacuuacauaccaaaacaaagucguaaggguacaacgaccagccaaaaacgguacuguuauggacguaauaaguagaagagaccaacggggaucaggacagguaggaacuuacggacuaaacaccuucacaaacauggaagcccagcuaaucaggcaaauggagagugaggggauauucagcccaagcgaauuggagacaccgaaccuugcagaaagaguucuggacuggcuagaaaaauacgggguagaacgacuuaagagaauggcuauuuccggugaugauugcguuguuaaaccuaucgaugacagauucgcaacggcacuaacagcacugaaugacauggguaagguacgaaaagauauaccucaaugggagccuuccaaagguuggaacgauuggcaacaaguaccuuuuugcagccaccacuuccaccaacuaaucaugaaagauggaagagaaauuguagugccgugccgaaaucaggaugaauuaguagguagagcacgggugucucaaggugcaggcuggucgcuacgagaaacagcaugucuaggaaaaaguuaugcccaaauguggcagcuaauguauuuccauagacgugacuugagauuagcugcgaacgcuauuuguagugcaguuccagucgauuggaucccaacaucgagaacaacauggagcauacacgcucaccaccaauggaugaccaccgaagauauguuaaguguuuggaaucgcguguggauagaagaaaauccauggauggaagauaaaacucacauuagcagcuggggugauguaccauaucuugguaaaagggaagaucaauggugcgguucgcugauaggcuugaccgcucgagcuaccugggcaacaaauauucagguugccauuaaucaggugagaagacuaaucgguaacgaaaauuaucuugacuauaugacaucaaugaaaagauucaaaaacgagucugaucccgagggagccuugugguaa

SEQ ID NO: 21588 - RNA, 9879 nt, Artificial Sequence
  derived and/or modified CDS sequence (opt6) from DENV-1__FJ410248__SS-prME
ucggugacuauguugcuuaugcuuaugccaacggccuuagccuuucauuugacuacaagagggggagaaccgcauaugauuguaucaaaacaagaacgaggcaaaucauuacuauucaaaacuucagcaggaguaaauaugugcacuuuaauugcuauggauuuaggugagcuaugugaagauacaaugaccuauaaaugcccacgaauaacagaagcggaaccagaugacguagacugcuggugcaaugcgacugacacaugggucacguacgguacguguagccaaacaggggaacauaggagggauaaaaggucuguugcuuuagcaccgcauguugggcucggucuagaaacucgaacagaaacuuggaugaguucugaaggcgcuuggaaacaaauucaaagaguugagacgugggcauuacgacaucccgguuuuaccguuauagcacucuuuuuagcccacgcuauaggaacgucgauaacucaaaaagggauaauuuuuauacuucuuauguuaguuacaccuucuauggcaaugagaugcguuggaaucggaucucgugauuuugucgaggguuuguccggugcaacauggguggauguaguacuggaacacgguucuugugugacuacgauggcaaaagauaaaccaacauuagauauagagcuucuuaaaaccgaggucacuaauccagcgguucuuagaaaacuuugcauagaagcaaaaauuaguaauacaacuaccgacaguaggugucccacacaaggagaagcgacccuaguagaggaacaagaugcuaacuuuguaugcaggagaacuuuuguugaccgcggauggggaaacggcuguggauuauucgggaaaggcucacuaaucacuugugcaaaauucaaaugugugacuaaauuggaagguaaaauaguccaauacgaaaauuuaaaauacaguguaauuguuacuguacacaccggagaccagcaccagguagggaaugaaucuacagaacauggaacaacggcuaccaucacgccgcaggcuccaagcaccgaaauccaacuaacagauuacggagcguugacguuagacugcaguccgaggacagguuuagacuucaaugagaugguacuacuaaccaugaaagaaaaaucguggcuaguccauaaacagugguuuuuggacuuaccucuaccauggacaaguggagcgucaacaucgcaggaaacauggaaucgccaagaccuguuaguaacguucaaaacggcucacgcgaagaaacaagaaguagugguguuagguucacaagaaggagcaaugcacacggcacugacaggugcaacagaaauucaaacgagcggaacaacuacaauauucgccggccaccugaaaugucggcuuaaaauggauaaauuaacacuuaaaggaaugucauacgugaugugcacaggaucauucaaacuugagaaagaaguagcugaaacucaacaugguacgguacugguacaaauaaaauacgaaggaaccgaugccccauguaaaauacccuuuucuacucaagacgaaaaaggaguuacccaaaaugguagacucauuacagcuaacccaauuguaacugauaaggaaaaaccuguaaauauagaagcugaaccucccuuuggagaauccuacauuguaauaggcgcaggggaaaaagcauugaaacuuagcugguuuaagaaaggguccaguauagggaagauguucguagcaacagcacgaggugccagaagaauggcgauccuuggagacacugcaugggauuuuggaagcauaggaggaguguuuacaucaguagguaagcuaguucaccaaauauuuggaacagcauacggaguucuauuuucaggugucucuuggacaaugaaaauugguauaggaguauuacuaacuugguugggacucaacagcaggucuaccucgcuaucuaugaccugcaucgccguuggacuuguaacucuuuaccuugguguaaugguccaggcugacaguggcugcguuauaaacuggaaaggacgcgaauugaaaugcgguagugguauauucguuaccaaugagguucacacuuggacggaacaauacaaauuucaggcagacagcccuaaaagguuguccgcggcaauagguaaggcuugggaagagggaguuugcggcauucgaucagccacgagacuagaaaacaucauguggaaacaaauaucuaaugaacuaaaccauaucuuauuagagaacgauaugaaguuuacgguaguagugggagacgucgcagguauauuagcacaaggcaaaaagaugauacgaccucagccuauggaguacaaauauaguuggaaaaguuggggaaaagcuaaaauaauaggggcugauguacaaaauacaacuuuuaucaucgauggcccaaauaccccugaguguccugaugaucaacgcgcauggaauauuugggaaguugaggacuauggguucggaaucuucacgacgaauauauggcugaaauuacgugauaguuacacucagguuugcgaucacagauugaugagugcagcgauuaaagauagcaaagcuguacaugcagauaugggguauuggauugaaucugagaaaaacgaaacauggaaacuagccagagccagcuuuauagaaguaaaaacauguauuuggccaaaaucacauaccuuauggucuaauggugugcuagaaucagaaaugauaaucccaaaaauuuaugggggaccuauaucacaacauaacuauagaccgggauacuuuacucaaacagcagggccguggcauuuagguaaacuagaauuagauuuuaacuuaugcgaaggaaccacagugguuguggaugagcacugugggaaucguggcccaucauuaagaacuacuacagucacuggaaaaaucauccacgagugguguugucgaaguuguacgcuaccaccgcuaagguuuaaaggugaagacggaugcugguauggaauggaaauaaggcccgucaaggaaaaggaagaaaaucugguuaaaucgauggugucggcaggcaguggagaaguagacuccuuuucacuagguuuauuguguauaagcauaaugaucgaggaggugaugaggagucgcuggagucguaaaaugcuuaugacagguacccuugcaguauucuuuuugcuuaucaugggucaacuaacguggaaugaucuaauaaggcuguguauuaugguuggugcaaaugcuagugaccgaaugggaaugggcacaacauaucucgcauugauggcaacguuuaaaaugagaccuaugcuggcagucggucuacuauuccgaagacucacauccagagaaguacuauuauuaaccauagguuugagccucguagcaagugucgagcuaccgaacucacuagaagaacuuggcgaugggcuugcaaugggaauaaugauauugaaauuacuaacagacuuucaaagucaccaacugugggcuacucuucuaucccuaacauucauuaaaacuacauacaguuuacauuaugcauggaaaacaauggcaaugguacuuaguauugugaguuuguuuccuuugugcuugucgacuacaagucaaaagacuaccugguuaccuguguuacuuggaagucuaggauguaagccacugacaauguucuuaauugcagaaaacaagauaugggggagaaaaaguuggccucugaacgaaggcauaauggcaguagguaucgucaguauacugcuaucuucauuacuuaaaaaugauguaccuuuagcaggaccacuaauagcaggcgguauguuaaucgcauguuaugugauaagugggucaucagcggaucucagucucgaaaaagcagcugaagucuccugggaagaagaggcggaacauuccggggccagucauaacauauuaguggaaguucaggaugacgguaccaugaaaauaaaagaugaagaaagagaugauacccuuacgauuuugcucaaggcgacacuucuagcaguuaguggaguuuauccauugaguauuccagcgacauuauuuguaugguauuuuuggcagaagaagaaacaaagaaguggaguacuuugggacacgccaagucccccggagguagaaagggcugucuuagacgaugggauauaccguauaaugcagcguggccuauuagggcggagucaaguuggaguaggggucuuccaggaaaacgucuuccacacuauguggcacgugacgagaggagcagucuugauguaucaagggaagagauuagaaccaucuugggcaagugucaagaaagaucuaaucucauauggaggcggguggagacugcagggaagcuggaacacaggggaggaagugcagguaauagcggucgagccggguaagaaccccaaaaauguacaaaccgcaccggguacguuuaaaaccucugaaggagaggucggagcaauugcacuugauuucaaaccagggacuagcggaucaccuauaguuaauagagaagggaaaauuguugguuuauauggaaacggaguagucaccacuucuggcaccuacguaagugcgaucgcgcaggcaaaggcuucucaagaagggccauuaccugaaauagagaaugaagucuuucguaaacggaaccuaacaauaauggacuuacacccaggaaguggaaaaacucgaagauaucuuccagcuauugucagagaggcaauaaaaagaaaauuaagaacacuaauacuugcuccgacaagggugguggcaagcgagauggcagaagcccuuaaaggaaugccaauucgauaucaaacaaccgcaguaaaaagcgagcacacagggaaggaaauaguugaucugaugugccaugcaaccuucaccaugcggcuuuuaagcccaguuagaguuccaaauuacaauaugauaaucauggacgaagcucauuucacagacccaaguuccaucgccgccagaggguauauuaguaccagagucggaaugggagaagcugcagcaaucuuuaugacagcuacuccaccugguaguguugaagcauuuccccaaaguaacgcuguuauacaagaugaagaaagagauauuccagaaaggaguuggaacagcggauaugaauggauuacagacuucccaggaaaaacaguuugguucguccccaguauuaagucugguaaugauauagcaaacuguuuaaggaaaaaugguaaacgaguaauccagcugucccguaaaacguuugauacagaguaccagaaaacuaaaaacaaugacugggauuauguagucacaaccgacaucagugaaaugggugcuaacuucagggcugaucgaguaauagacccuagacgaugcuuaaaaccaguaauucugaaggauggcccagagagggugauauuagcagggccaaugccgguaacuguugcuagugcggcacaacgucgcggaagaauuggacgaaaccauaauaaagaaggagaucaauauauauacaugggucaaccauuaaauaaugacgaagaccacgcucauuggacagaagcaaaaauguuacuugauaacauaaacacgccggaaggcauuauaccagcucuuuuugagccugagagagaaaagagcgcugcuauugauggugaauauagauuacguggagaagcccgcaaaacuuuugucgaauugaugcgaagaggggacuuaccaguauggcuaucauacaaaguagcuucugaggguuuucaauauagcgaccggcgauggugcuuugacggugagaggaauaaccagguacucgaagaaaauauggacguagaaauauggacgaaagaaggugagcgcaagaaauuacggccaagaugguuagaugcuaggacauacucggacccacuggcgcuuagagaauuuaaagaauuugcggcgggcagaagguccguaucgggugaucuaauucuggaaauaggaaaacuaccgcaacaccucacacagagagcucaaaacgcuuuagacaaucugguuaugcuacauaauucagaacagggcgguagagcguaucgccacgccauggaagaacuuccagacacaauagaaacuuuaaugcuucuggccuugauagccguacucacagguggcgucacauuauucuuucuguccggaagaggccuuggaaaaacaaguauuggacuccuaugcgucauggcuagcagcguacuauuauggauggccucuguggaaccacacuggaucgccgccucaauuauuuuggaguucuuucuuauggucuuauuaauaccagagccagaucgccagcgaaccccucaagauaaucaauuggcguauguagucauugggcuguuauuuaugaucuuaacuguagcggcuaaugagauggggcuacucgagacaaccaagaaagaccuagguauuggccacguggcagucgagaaccaucaccaugcagccaugcuugauguggaccuccauccugcgagcgcuuggaccuuauaugcugucgccacuacaauaauuacaccaaugaugagacauacuauugagaacacuacugcuaacaucagcuuaacugcuauagcuaaccaagccgcaauacuaaugggacuagauaaaggguggccaaucucaaaaauggauaucgguguuccguuauuagccuuaggcugcuauucacaaguuaauccguuaacgcucacagcagcuguauuaaugcuugucgcucacuacgcgauuauugguccaggguugcaagccaaagcaacccgggaggcacaaaagcguacggcugcaggaauaaugaagaauccaacuguugauggaauaguugcuauugauuuagacccaguuguguaugaugcuaaauuugaaaaacaauuaggacaaauaaugcuucuuauacuaugcacuagccagauucuccuaaugcggacaacgugggcguuaugcgaaucgauuacauuggccaccgguccuuuaaccacauugugggaggguucgccugguaaauucuggaacaccacgaucgcagugucuauggcgaacauuuucaggggguccuacuuggcaggggcugguuuggcguucucauuaaugaaaucauugggcggaggccgucggggaacaggagcacaaggugaaacucuaggggaaaaguggaaacgacaacuuaaucaacucuccaaaagugaauuuaacacauauaaacgaucaggcauaauggaagucgauagaagugaggcaaaagaagguuugaagagaggagagacuacgaagcaugcgguuagcagggguacggcgaaacuuagaugguuuguugaacguaaucuagugaagccagaaggaaaagugaucgaucuugguugcggcagaggagguuggucuuauuauugcgcuggauuaaagaaaguaacugagguaaaaggauauaccaaaggaggaccaggccaugaagaaccuauaccuauggcaacuuauggauggaaucuagugaaacugcauaguggaaaggacguauucuuuauuccacccgaaaagugugacacuuuguuaugugauauaggagaaucaucgcccaaucccacaauugaagaaggacgcacacuaagggucuugaaaaugguggaaccauggcuacgagguaaccaauuuugcauaaaaauauuaaacccauauaugccuucgguaguagaaacuuuggaacaaaugcaaaggaaacaugguggaaugcuuguacguaacccauuaaguagaaacaguacccaugaaauguacuggguuaguuguggcacgggaaauauaguaucugccguaaauaugacuuccaggaugcuccucaaucgguucacaauggcgcaucggaagccaacauaugaaaaagacguagacuuaggcgcuggaacacgccauguagcaguugaaccggaggucgcgaacuuagauauaauaggucagaggauagagaacauaaagcacgaacacaaauccacuuggcacuacgacgaagauaacccauauaaaacaugggcuuaucauggcucauaugaagucaaaccuucuggaucagccucgucaaugguaaauggagucgugaaacuccuaacaaaaccaugggacguuauacccaugguuacccaaaucgcuaugacagauacuacaccauuugggcaacagcgcguauuuaaagagaaagucgauacaaggacaccaaaagcuaaaagagguacggcccaaauuauggaaguaacagccaaaugguuauggggguuuuugucacgaaauaagaaaccgcguauaugcacuagagaggaauuuacacggaaaguaagguccaacgcagcaauaggugccguauuuguggaugaaaaccaauggaauagugcuaaggaagcuguagaggaugaaagauuuugggaccuaguacauagagaaagagaauuacacaaacaaggcaaaugugcgacgugcguauauaacaugauggggaaacgggagaagaaauugggugaauuugguaaagccaaagguucacgugccauaugguauauguggcuaggggcgcgauuuuuggaauuugaagcccuggguuuuaugaacgaagaccacugguucaguagggaaaacucuuuaucugguguagaaggggaaggauuacauaaguuaggguacauauuaagagauauuaguaaaauuccaggcggaaauauguaugcagaugacacggcaggaugggauacaagaauuaccgaggaugacuuacaaaaugaagcaaaaaucacagauauaauggaaccugaacaugcacuauuagcuaaaucaaucuucaaguugacauaccagaauaaaguuguacgaguacaacggcccgccaagaauggaacgguaauggaugugaucucuagaagagaccaaagggguucgggacaagugggaacuuacggauuaaauacauuuacaaauauggaggcgcaacuaauacgacaaauggaaucugagggaauuuuuaguccaagcgaacucgaaacuccuaaucucgcggguaggguguuagauuggcuugagaagcacgggguagaaagauugaaacgcauggcaauaaguggagaugauugcguagucaaaccgauagacgauagauuugcaacagcucuaacggcucuaaaugacaugggaaagguacgcaaagacauuccucagugggagccuaguaaaggauggaacgacuggcagcaaguuccauucuguagucaccauuuccaucaacuaauaaugaaggaugggcgugagauagugguaccuugucggaaucaagacgaacuuguaggacgugcucguguaagccaaggagcuggauggucgcuucgggaaacggcaugccuugggaaaagcuaugcucaaauguggcaauuaauguauuuucaucguagagacuuaagguuggcagcaaaugcaaucuguucagcuguacccguagauuggguaccaacaaguaggacuacauggagcauacacgcucaucaucaauggaugaccaccgaagacaugcuuucaguauggaauagaguguggauagaagaaaacccauggauggaagauaaaacgcauauuucaagcuggggagauguuccuuaccuaggaaaacgagaagaccaaugguguggaucuuugaucggacuuacggcaagagcaacuugggcaacaaacauacaaguggcaaucaaccaaguacgacguuugauaggaaacgaaaacuaucucgauuauaugacaucgaugaagcguuuuaaaaaugaaucugauccugaaggagcucuuugguag

SEQ ID NO: 21589 - RNA, 9879 nt, Artificial Sequence
  derived and/or modified CDS sequence (opt6) from DENV-1__FJ410249__SS-prME
aguguaacuauguuacuaauguuaaugccaaccgcauuggcauuucaccuuacuacgcggggaggugaaccacauaugauuguaucgaaacaagaaagagguaaaagccuucuguuuaaaacaucggcugguguaaauauguguaccuugauagcaauggacuuaggggaauuuugugaagacacgaugacuuacaaauguccacgcauaacugaagcugaaccagaugauguagacuguuggugcaaugcuacagauacuuggguaacauaugguacuugcucacaaaccggagaaagaagacgagauaaaagaagcguugcucuagcuccgcacguaggucucggacuagaaacuaggacagaaacauggaugucaucagaaggugccuggaaacaaauccaacguguagaaacaugggcacuccgacacccggguuuuacuguaauagcacuguuuuuagcucaugcaauuggaacaucaauaacucaaaaaggaaucauuuuuauuuugcuuauguuagugacuccgaguauggcaaugcgauguguuggggucgguucacgcgauuuuguggaggguuuaucgggugcaacauggguagacguuguacuugaacacggauccugugucaccacaauggccaaagacaaaccaacauuggacauagaacuacuaaaaacugaaguaacgaaucccgcaguacugaggaaauuguguauugaagcaaaaaucucgaauacaaccacagacagcagaugccccacucaaggagaagcgacguuaguagaagaacaagaugcuaacuuuguaugccgucgaacauuuguagauagaggaugggggaacggauguggauuauuugggaaaggcucauuaaucacgugcgcaaaauuuaaaugugucacaaaacuagaaggaaaaacagugcaguaugaaaaucuaaaauauucagucaucguuacaguacauacgggugaucagcaucagguagggaacgaaucaacggagcauggaacaacagcuacuauaacgccgcaagcuccuucaaccgaaauccaauuaacagauuauggggcacucacauuagacuguagcccuaggacuggacuagacuucaaugaaaugguuuuacuuaccaugaaagaaaaaucaugguugguucauaaacaaugguuucuugacuugccguuaccauggacaucaggugcgucaacgagucaagagacguggaauagaaaggaccucuuaguuacguuuaaaacugcucaugccaagaaacaggaaguaguaguccucgguagccaagaaggugcuaugcacacagcacuuacuggagcaacagagauacaaacuucagguacaaccacaauauuugcugggcauuuaaaauguagguugaagauggauaaacuaacauuaaaagguaugucauauguuauguguacugguaguuuuaaacuugaaaaagaaguugccgaaacacaacauggcacgguccuaguacaaaucaaauaugaggggaccgaugcaccgugcaaaauuccauucucaacgcaggaugaaaaaggaguaacacaaaacggaagauuaauuacugcaaauccaauugucacugacaaagaaaagccugugaacauagaggcggagccaccauuuggagaaucuuauaucguuauuggggcgggugaaaaggcacuuaaguuaucaugguuuaagaaaggaucuagcauaggcaaaauguuugaagcaacagcucguggcgcuagaaggauggcaauucuaggagauacggcaugggacuuuggaucuauuggugguguauucacaagcguaggaaagcugguucaucagauauucggugcggcguauggaguauuauucagcggugugaguuggacaaugaagaucgguaucggcguauuauuaacuuggcuaggucuaaauagucgaaguacuagccucucuaugacgugcaucgccguaggccuaguaacacuauauuugggaguaaugguacaagccgauuccggcuguguaauaaauuggaaaggaagggagcuuaaaugugguuccggcaucuucguuaccaaugaaguccauacauggacagaacaauauaaauuucaagccgauaguccuaaacguuuaucagcugcgauaggcaaagccugggaagaagguguaugcggcauuagaagcgccacccguuuggaaaacauaauguggaaacaaauaaguaacgaauuaaaccacauuuuauuagaaaacgacaugaaauuuacaguaguagugggagaugucgcaggaauauuggcgcagggcaagaaaaugauaagaccacaacccauggaguacaaguacaguuggaaaucaugggguaaagccaaaauaauaggugcugauguccaaaauaccacguuuauuaucgaugggccuaauacucccgaaugccccgacgaucaaagagcauggaauauaugggaaguugaagauuauggauuuggaauauucacaacuaacaucuggcuaaagcuaagggacuccuacacacagguaugcgaucacaggcuaaugucggccgcaaucaaagacucgaaggccguucaugcggauaugggcuacuggauugaaagcgagaaaaaugaaacuuggaagcucgcgagggcgucuuuuauagaggugaagacauguauauggccaaaaucacauacgcuauggucgaacggaguccuggaaagcgaaaugauuauacccaagauauacgguggcccuauaagccagcauaacuauagacccggcuacuuuacacaaacugcugguccuuggcaucuaggaaaauuagagcucgauuuugaucucugcgaagggacuaccguaguaguugaugaacauugcgguaauagaggucccagcuuaagaacaacaacuguaacagguaaaauuauccacgagugguguugccgauccugcacauuaccacccuugagauuuaagggggaagauggauguugguacggaauggagauuaggccagucaaagaaaaagaagaaaaucuuguaaaaucaauggucagcgcugggucgggagaaguugacagcuucucacugggucugcugugcauaaguauuaugaucgaggaagucaugagaagucguuggucccguaaaauguuaaugacuggaacguuagcgguauucuucuuucuaaucaugggacaacuuacauggaaugaucuuauaaggcuuugcaucaugguuggagcuaaugcguccgacagaauggguaugggcacaacauaucuagcuuugauggcaacuuuuaaaaugcgaccaauguuugcgguaggccuccuuuucagacgccugacuucaagggaaguuuuauugcuaacuaccggccuaucuuuaguagccucgguagaauuaccuaauucuuuagaagaacugggugauggauuagcgauggggaucaugauacugaaacuuuuaacggauuuccaaagccaucaauugugggcuacucuucuuagccugacauuuauaaaaacuacauucucacugcacuaugcguggaagacuauggcgauggugcuauccauaguaagccuauucccuuuaugucuaucgacgacaucacagaaaacaacauggcuaccugucuugcugggaucgcuuggauguaaaccucugacaauguuuuuaauugcggaaaauaaaauauggggacggaaaagcuggccccucaaugaaggaauuauggcaguagguauaguguccauacuucuaagcucauuacuuaaaaacgauguaccuuuagccggaccuuuaaucgcagggggaauguuaaucgcgugcuauguaaucucugggaguucagcagauuuaagucuagaaaaagcggcagaaguaagcugggaagaggaggcagaacacucuggagcuagucacaacauucuuguggaaguacaagacgauggaacgaugaaaauuaaagaugaagaaagagaugacacucuaacuauccuacuuaaggcgacccuauuagccguaagugggguauauccguuaucaauuccugcaacacuguucgucugguauuucuggcagaagaagaaacaaagaaguggaguucuuugggacacuccuucgccacccgaaguagaacgcgcaguauuagacgacggcaucuaccguauaaugcagcggggucuucuaggaaggagucaaguaggugucgggguuuuucaggaaaacguauuucacacaauguggcaugucacgaggggagcaguccugauguaucaagguaaaagacuggagccaucuugggcaucaguuaagaaagauuuaaucaguuacggcgguggauggaggcugcaaggaaguuggaacacaggagaggagguccaagugauugcuguggaacccgguaagaauccuaaaaauguccaaacugcacccggaacguucaagaccagcgaaggagaaguaggcgcaaucgccuuagacuuuaagcccggaacgucgggaucuccuaucguuaauagagaagguaaaauaguggguuuauacgguaauggagucgucaccacuucagguacuuacguaagugcuaucgcucaggcgaaggcuucucaagaaggaccuuuaccugaaauagaagaugaaguuuuccguaaaagaaauuuaacaauaauggauuugcauccuggaagcggaaaaacuagaagauauuuacccgcaauaguaagagaagcuauaaaacgcaaacuaagaacgcucauccuggcgccgacaaggguugucgcgagcgaaauggcagaggcuuuaaaggguaugcccauaagauaucaaaccaccgcggucaaaagugaacacaccggaaaagaaauaguugaccugaugugucacgcgacuuucacaaugagacugcuaaguccgguaagaguucccaauuacaauaugauuauuauggaugaggcccauuucacggauccuucgaguauugcugcuaggggauacauuaguacgagaguuggaaugggugaagcggcugcaauuuuuaugacggcaacaccucccggaucuguugaggcauuuccacaaucaaaugccguuauucaagacgaagaacgugacaucccugaacgaucauggaacucggguuaugaauggauaaccgacuuuccggggaaaacagugugguuuguuccuuccauaaaaucuggcaacgacaucgcaaacugucuacguaagaaugguaaaaggguuauucaguuaucacgaaaaacuuuugacacggaguaccagaaaaccaaaaauaacgauugggauuacguaguaacaacagauauaucagaaaugggugcuaacuuuagggcugacagagucauagauccgagacguugucucaagccgguaauucugaaagacggaccggaaagagugauacuagcgggaccaaugccuguaacaguagcaagugcugcucaaaggcgagggaggauaggcagaaaccacaacaaagaaggagaucaauacauauauaugggacaaccacuaaauaacgaugaagaucaugcacacuggaccgaagccaaaauguuauuagauaacauuaauacuccggaagggaucauucccgcacuguucgaaccagaacgugaaaaauccgccgcgaucgauggugaauacaggcuaaggggagaggcgaggaaaacauucguugaacuuaugcgaaggggugacuugccuguaugguuaucauauaaaguagcgagugaggguuuucaauauagugaccggagauggugcuuugacggcgaacggaauaaucagguucuagaagaaaauauggaugucgaaaucuggacaaaggaaggugagagaaagaaauuaagaccaagguggcuggacgccagaacuuauagcgauccauuagcacuaagagaguuuaaagaauuugcagcaggaaggaggucggugaguggcgacuuaauauuagaaauuggaaaauugccccaacaccucacacaaagggcgcagaaugcguuggacaaucuaguuauguuacauaauuccgaacaaggaggcagagcuuaccggcacgcuauggaggaauugccagacacaauagaaacucuuaugcugcuggcguugauagcuguauuaacaggugguguaaccuuguucuuucuaucgggucgaggacucggcaaaaccuccaucggacuauuaugcgucauggcgucuucuguucuauuauggauggcgagcguagagccgcauuggauugcggcaucaauaauacucgaguucuuuuuaaugguauuguugauaccugaacccgauagacaacguacuccgcaggauaaucaacuugcauacguggugaucggacuacuuuuuaugauacucacaguagcggcgaacgagaugggacuauuggagacuacaaagaaagauuugggaaucggucauguggccgucgaaaaccaccaucaugcagcaauguuagauguggacuuacaucccgcaagugcauggacacuguaugcuguugccaccaccauaauuacuccgaugaugagacacacuauagaaaauacaacagcaaauauaucauuaacagccaucgccaaccaggcagcaauucuuaugggguuagacaaaggcuggccaauuucuaaaauggacauagguguaccucuacuagcacuaggcuguuacagucaaguaaauccacuaacguuaacugcggcagugcuaauguugguagcccauuaugcgauaauugggccaggauuacaggcaaaagcuacaagggaagcacagaaaagaacagccgccggaaucaugaaaaaucccacaguggacggaauaguagccauagaucuagauccugugguauaugacgcuaaauuugaaaaacaacuuggacaaauaauguuacuaauccuuuguacgagucaaauucuacuaaugcgaacgaccugggcacucugugagaguaucacauuggccacagggccccugacaacacuaugggaaggaucaccagggaaauuuuggaauacaacgauagccgugagcauggcuaacaucuucagagggucauaucucgcuggagcgggcuuagcuuuuaguuuaaugaaaucauuaggagguggaagaagagguacaggagcacaaggagagaccuuaggagaaaaauggaagaggcaauuaaaucaacugucaaaaagcgaguucaacacauacaaaagaucagggauaauggaaguagaucggagugaagcaaaggaaggacuuaaacgaggcgaaacaacgaagcaugcugugagcagaggaacggcaaaauuacguugguuugucgagagaaacuugguuaaaccggaaggcaagguaauugaccuagguuguggaagaggaggauggucuuacuauugugccggccuuaagaaaguuacugaaguaaaaggcuauacaaagggaggcccaggccaugaagaaccaauaccgauggcuaccuacggauggaaucuaguaaaauuacauucgggaaaggauguauuuuucaucccaccagagaaaugcgauacgcugcugugcgauauuggggagaguucuccaaauccgacuaucgaggaaggucguaccuuacgcguacuaaaaaugguagaaccaugguuaagaggcaaccaauuuuguauuaagaucuuaaaccccuacaugccgagcguugucgaaacuuuagaacaaaugcaacgaaaacauggcggaaugcuuguaagaaacccuuuaagcagaaauucuacacacgagauguauuggguuuccugugguacggggaauauugugagcgcaguaaauaugacuucgagaauguuacuaaaccgauucaccauggcgcaucguaaaccuacuuaugaaagggaugucgaucuaggugcuggaacucgacaugucgcuguggagccggagguugcaaauuuagacauuauuggucaacgaauagaaaacaucaaacaugaacauaagaguacuuggcacuaugacgaagauaacccauauaaaacaugggcuuaccacggaaguuaugaaguaaaaccaucaggauccgcgaguucaaugguuaacggaguagugaaacuuuuaacaaaaccuugggacguuauucccauggugacccaaaucgcaaugacagauacuacuccguucggucaacaacgggucuucaaggaaaaaguagauacgagaacuccuaaagcgaaaagaggcacggcacaaauuauggaaguuacugcaaaauggcuuuggggauuccuaagcagaaauaagaaaccacgaauuugcacucgagaagaauuuacgaggaaaguaagaagcaaugcugcaaucggggcgguuuuuguggacgaaaaucaguggaacuccgcaaaagaagccguagaagacgaacguuuuugggaucucguccaucgcgaaagagaacuacauaaacaaggaaaaugcgcuacauguguuuauaauaugaugggaaaaagagagaagaaauuaggugaauuugggaaagcaaaggguagcagagcaauaugguauauguggcuuggagcucgcuuuuuagaauuugaggcucucgguuuuaugaacgaggaucauugguuuaguagagaaaauucauuaagugguguagaaggugaaggacugcauaaacucgguuacauucuacgagacauaucaaaaauacccgguggaaacauguacgcggacgacacugcuggcugggauacaaggauaacugaagaugauuuacaaaaugaagcgaaaauuacagauauaauggagccagaacaugcauuauuagcaaaaaguaucuuuaaacuaacuuaucaaaauaaaguaguucgugugcaaagacccgccaaaaaugguaccguuauggauguaauuucaagacgagaucaacguggauccggacaaguaggaacauacgggcuaaauacauuuacuaacauggaggcacaauuaauaagacaaauggagucggaaggaauauuuaguccuucagaauuagaaacgccuaacuuagcgggaaggguauuagauugguuagagaagcacgguguagaacgucuuaaacguauggcaauuucaggagaugauuguguggucaaacccaucgacgaccgcuucgccacagcacuaacugcucuaaaugacaugggaaaaguucguaaagauguaccgcaaugggaaccuaguaaagguuggaaugacuggcagcaaguaccauuuuguucacaccauuuucaccaacugauuaugaaggacgguagagaaauaguugugccaugcagaaaccaagacgagcuaguuggaagggcucgagucagccagggagcagguuggaguuuaagagaaacagcguguuugggaaagucauaugcacaaauguggcaacucauguauuuccacaggagggacuugcgacuagcagccaacgcgaucuguucugccguuccagucgacuggguaccaacgagucgaacaacuuggucaauacaugcacaccaccaauggaugacuacagaagauaugcuaagcguauggaaucgaguuuggauagaggaaaacccauggauggaggacaagacccacauaucaaguuggggagauguaccuuauuugggcaaaagagaagaucagugguguggcagcuuaauaggacugaccgcgagagcuacaugggcaacuaauauucaaguggcaauaaaucaaguacgccggcuuauaggaaacgaaaacuaccucgauuauaugacaucaaugaaaagguucaaaaaugaauccgauccugaaggagcuuuaugguaa

SEQ ID NO: 21590 - RNA, 9879 nt, Artificial Sequence
  derived and/or modified CDS sequence (opt6) from DENV-1__FJ410251__SS-prME
agcguuacgauguuacucaugcuuaugccaacggcucuugcguuucaccuaacuacucgagggggagaaccacacaugauuguaacuaaacaagaaagggggaaaucguuauuauucaaaaccucugcgggaguuaacaugugcacuuuaauugcuauggaucuaggggaacuaugugaagauacuaugaccuauaaaugccccagaauaacugaagcagaaccagacgacguugacugcuggugcaaugcaaccgauacauggguaacauaugguacauguucucaaacuggugaacaucgaagagacaaaagaucaguugcccuugcaccacaugucggauugggucuagaaacaagaacagaaacuuggauguccagcgaaggagcguggaaacaaauacaacgaguggaaaccugggcuuugcgacauccggguuuuaccgugauugcauuguuucuugcucaugcaauaggaacaaguauuacucaaaaaggcauaauauucauucuauuaauguuaguaacaccuuccauggcaaugagguguguagguauuggaucucgagacuuuguagaagguuugagcggagcuacauggguagaugucguauuagaacauggcaguuguguaaccacuauggcuaaagauaaaccaacauuagauauagagcuuuuaaaaacagaggucacaaacccugccguuuuaagaaaauuaugcaucgaagcuaaaauuucuaacacaacuacggauaguaggugcccgacacaaggagaggccacacucauggaagaacaagacgcuaauuuuguauguagaaggacauuuguagaucguggcuggggcaaugguuguggucuauucgguaaaggcucuuuaauuaccugcgccaaauuuaaaugugucaccaaacucgaagggaaaauaguacaauacgaaaaucuaaaauauucugucauaguaacuguacacacaggagaucagcaucaaguagguaaugaaucgacugaacauggcacgacugccacgauaacuccucaagcuccaacaagugaaauucaauuaacagauuauggggcguuaacuuuagacuguucacccaggacaggccuugacuucaacgaaauggugcuuuugacuaugaaagagaaaucgugguugguucauaaacaaugguuccuagacuuaccacuacccuggacaagcggugcaucgaccucucaggaaacauggaaccggcaggaccuguuaguaacuuucaaaacggcucacgccaagaaacaagaaguagugguauugggaagucaagagggggcaaugcauacagcacuaaccggagccacagagauucaaacguccgggacaacgacuauauucgcuggacaccuaaaauguagacuaaaaauggauaaauugacuuugaaaggaaugucauacgugaugugcacuggaaguuucaaacuugaaaaagagguggcugaaacucaacaugggacaguccucgugcaaauuaaauacgagggaacggaugcacccugcaaaaucccuuucucaacgcaagaugaaaaaggagugacucaaaaugggagacuuauuacugcgaauccgauugucacagauaaagaaaaaccuguaaauauugaagcagaaccaccuuucggagaaucuuauauugucauuggcgcuggcggaaaagcauuaaaacuaucuugguuuaagaaaggaaguaguauaggaaaaauguucgaagcuacugcaagaggggcaaggagaauggcaauacuaggagauaccgccugggauuucgguucaguagggggcguuuuuacaucugucggaaaauuaguccaucaaauauucggcacugcuuauggagugcuauuuuccggcguaucuuggacuaugaaaauagguauaggcgucuuacuaacaugguuaggccuaaauucaaggucuacaucucucucgaugaccugcaucgcugugggacucguuacuuuauaucuugguguaaugguucaagcagauagcggguguguaaucaauuggaaagggcgagaacuaaaauguggaaguggcauauuugugacaaaugaaguucacaccuggacugaacaauauaaauuucaggcggacagcccuaaacgacuaagugcagcaauugggaaggcuugggaagaagguguuugugguauaaggucugcaacaagauuagaaaacaucauguggaaacaaauauccaacgaacucaaccauauccucuuggagaacgauaugaaauuuacaguugucgugggagauguaguggguauacuagcccaagguaagaaaaugauaagaccacagccaauggaacauaaauacaguuggaaaucuuggggaaaggcaaaaauuauaggugccgacgugcagaauacaacuuuuaucaucgauggaccaaacacgccagagugcccggaugaucagcgcgcuuggaauaucugggaaguugaagauuauggauucggcauauuuacaaccaauaucuggcucaaacuucgcgauucauauacgcaaguaugugaucacagacuuaugucggcggcaauuaaagacucgaaagccguacacgcugacaugggauauuggauagaaagcgaaaagaacgaaacauggaaacuagcgagggccagcuuuauagaaguuaagacauguaucuggccgaaaucacauacccuauggucgaacggagucuuagaaucugaaaugauuaucccgaagaucuacgguggacccauaucgcagcacaauuauaggccaggauauuuuacccaaacggcugguccguggcaucucggcaaacuagagcuagacuucgacuugugcgaagggacgacugugguagucgaugaacauuguggaaaucgaggcccuucucuacggacaacuacaguaacuggaaaaauaauacaugaauggugcugucgaucauguacgcuaccaccguuaagauucaaaggugaagaugguugcugguauggaauggaaauucgaccagugaaagaaaaggaagaaaaucuaguaaaaucuaugguaucugcgggcucaggagaaguugacucauucagcuuaggcuuacugugcauaagcauuaugaucgaggaagucaugcggucucgauggaguagaaaaauguugaugaccgggacauuggcuguuuuccuauuauuaauaauggggcaacuaacuuggaacgaccugauuagacuaugcauuaugguuggugcuaacgcauccgaucgcaugggaauggggacuaccuaccuagccuuaauggccacguucaaaaugaggcccauguuugccguaggacuacuauuucguaggcuuacaucaagggaaguauuguuauuaacgauaggccuuaguuugguagccuccguggagcuaccaaacucauuagaagaacuaggagaugggcuagcgaugggcauaaugauuuuaaaguuacuaacagauuuccagucccaccaacuaugggcgacucuccuuucucuaacauuuauaaaaacuacucuaucuuuacacuaugccuggaaaacgauggcaauggugcugucaaucgugucccuuuuuccguuaugucuaaguacuacaagccagaaaaccaccugguuaccgguacucuugggcuccuuaggguguaagccgcuaacaauguuucuuauuacugaaaauaagauauggggcagaaaaucuuggccacucaaugaagguauuauggcugucggcgucguaagcauauuauuaaguagucuacuaaagaacgauguaccguuagcagguccuuuaauagcaggaggaauguuaaucgcuuguuauguaaucucuggaagcucagcugaccuaucacuagaaaaagcugcggaaguaucuugggaagaagaagcggaacauagcggagcaucacauaacauucuuguugaaguacaagaugauggaacuaugaaaauuaaagaugaggaaagggaugacacccuaacaauuuuguuaaaagcaacacuguuagccguaaguggaguauauccauugaguauucccgcaacauuauuugucugguacuuuuggcagaagaagaaacaacguagugguguccuaugggauaccccgaguccaccggaaguagaaagggcgguuuuagaugacgguauuuauagaauuaugcaaagaggauuacuuggaagaagucaaguaggagugggaguauuccaagaaaauguguuccacacaauguggcaugucacucguggagccguuuuaauguaucagggaaaacguuuggaaccuagcugggcauccguuaagaaagaccuuauuuccuaugguggcgguuggagacuacagggcucauggaacacgggggaagaagugcagguaauagcaguugaaccaggcaaaaaucccaaaaauguacaaacagcgccugggacuuucaaaacaccggaaggcgaaguuggugcuauugcacuugauuuuaaaccaggaacaucaggaaguccaauaguaaaucgggagggaaaaauaguggggcuauauggaaauggagucguaacaacgucggguacuuauguauccgcuauugcccaagcaaaagccucgcaggaaggaccgcucccagaaaucgaggaugaaguguuccggaaaagaaaccuaacgaucauggacuuacacccaggaagcgguaagacaagaagauaccugccagcuauagugcgcgaagcaauuaagcgaaaauugcgcacucucauccuggcgccaacgagaguagucgccucagaaauggcugaagcucuaaagggcaugcccauaagguaucaaacuacugcuguaaaaucggaacauacagggaaagaaauuguggaucuuaugugccaugcaacauuuacaaugagauuacuuuccccggugcggguucccaauuacaauaugauaauaauggacgaagcucauuuuacugauccauccagcauagcagcuagagguuacauaucuacacgcgucggaaugggcgaagcugcugcaaucuuuaugaccgccaccccaccaggcucuguagaagccuucccccaaucaaacgcaguuauacaagaugaagaaagagauauuccggagagaagcuggaacucggguuaugaauggauaacagacuuucccgguaaaacgguaugguucguuccaucaaucaaaucgggaaacgacauugccaauuguuugaggaaaaacgggaaaagaguuauacaacuaucucgaaaaacauucgauacagaauaccagaagacuaaaaacaaugauugggauuauguaguaacgacagauauaagcgaaaugggagcaaacuuuagggcagauagagugauagacccgcgucguugcuuaaaaccuguaauacugaaagauggacccgagagaguaauacuagcuggacccaugccagugacaguugcuucagcugcucaaagaagaggcagaauugggagaaaucauaacaaagaaggugaucaauauauauauauggggcaaccauugaauaaugacgaggaucaugcgcauuggaccgaggcuaaaauguugcuugauaacaucaauacccccgagggaauaauaccugcucucuucgaaccagaacgagagaaaucagccgcaauugacggagaguauagacuacgaggcgaagcucguaaaacuuuuguugaauuaaugcgaagaggagauuugccaguauggcuuucguauaaaguugcuucagaaggguuccaauacagugauaggcgaugguguuucgacggagaaagaaacaaucaaguauuagaagaaaacauggacguugaaaucuggacuaaagaaggugagagaaagaaacugaggccccguugguuagaugcgcggaccuacucagaccccuuagcuuuacgagaauuuaaggaauuugcagcuggaagaagaucuguaucuggagaccuaauauuagagauaggaaaauugccccaacaucuaacgcagagagcacaaaacgcuuuggauaaucuagugaugcuccauaacuccgaacaaggagggcgagcauauagacaugccauggaggagcuaccagacacaauugaaacgcuuauguuacuugcacugauugccguauugacaggugggguaacucuauuuuuccugagcggcaggggucuagguaaaacaaguaucggucuccuguguguuauggcaucgagcgugcugcuuuggauggcaagugucgaaccucauuggauugcggcaaguauaauacuugaguuuuuccuaaugguuuuacuuauaccugaaccagaccgucagcguacaccccaagacaaucaacuugccuacgucguaauaggccugcuauuuaugauuuuaaccgucgcugcuaacgaaaugggucuguuggagacgacuaagaaagauuuaggaauagggcacguagcgguugagaaucaucaccaugcuacuaugcuugaugucgauuuacaccccgcaucugcguggacauuauaugcuguugcuacuaccauaauuaccccuaugaugcgccauacuauagaaaauacuacagcgaacaucagccucacagcaauagcgaaccaggcagcgaucuuaaugggacucgauaaagguuggccaauuaguaaaauggacauaggaguaccacuauuagcuuuagguuguuacucacaaguuaacccgcucacacuaacagccgcgguuuuaauguuaguggcacauuacgcaaucaucggaccgggauuacaggcgaaagcaacgcgagaggcacaaaagagaaccgcggcgggaauaaugaaaaacccaacuguugaugguauuguagccaucgauuuggaucccgucguguaugacgcgaaauuugagaagcaacuuggacagauuaugcuucuuauucuauguacuucacagauccuacugaugaggaccacgugggcacuaugcgaaucaaucacguuggcaacgggcccguuaaccacucuaugggagggaucgcccgguaaauuuuggaauacaacaauagcaguaucaauggcaaauauauuucgcggaucguauuuggcgggggcaggacucgcauucuccuuaaugaagucauugggaggagggaggcgcggaacaggagcccaaggggagacuuugggagagaaauggaaaagacaguuaaaucagcuaagcaaaagugaguucaauauuuauaaacguucugggauaauggaggucgacagaagugaagcuaaggaaggacucaaacgcggggaaacgacucgacaugccgucucucgaggaacagcuaaacugcgcugguucguagaacgaaaucugguuaaacccgaaggaaagguuauagaucucggguguggcagggguggauggaguuacuauugugcgggacuaaagaaaguaacagaaguuaaagguuauacuaagggugguccuggccaugaagaaccgauuccaauggcuacauauggcuggaaccuaguuaaauuacacuccggaaaggacguauucuuuacaccaccugagaaaugcgauacauuacuaugugacauuggggagucaucaccuaacccaacaauagaagaggggcgcacguuaagaguacuuaaaaugguagagcccuggcuucgaggcaaccaauucugcauaaaaauucuuaaucccuauaugcccaguguaguagaaacacuggaacaaaugcaacguaaacauggaggaaugcuaguacgaaauccacuuucaagaaauucuacgcaugagauguauuggguaagcuguggaaccggcaacauuguuucugcaguaaauaugacuagccgaaugcuucuaaaucgguuuacuauggcacaccgaaaaccuacguaugaacgagacguugaucuuggcgcgggcacuagacauguagcgguagaacccgagguagcaaauuuagauauuauugggcaacggauagagaacauaaaacaugagcauaaaucuacuuggcauuaugacgaagacaacccguacaaaacaugggcuuaccauggcuccuaugaaguaaaacccucugguucugcgucuaguaugguuaauggcguagucaaacuucuaacgaaaccuugggacguuauaccaaugguaacucagaucgcaaugacagauacuacuccauuuggucaacagagaguguucaaggaaaaaguagauacaagaacuccgaaagcuaagagaggcacagcccaaauaauggaaguaacggccagauggcucuggggauucuugucacgaaauaagaaacccaggaucuguacacgagaggaauuuacaagaaaagugagaaguaaugcagcuaucggagcuguauuuguugaugagaaccaguggaacucggccaaggaggcaguugaggaugaacgauucugggaccuaguucaaaaggaacgugaauuacauaagcaggggaaaugcgcgacuugcgucuacaauaugauggguaagcgagagaagaaauuaggagaguucggaaaggcaaaagguucucgagccauuugguacaugugguuaggagcacgguuccuggaguucgaagcacuaggauuuaugaaugaagaucacugguuuucuagagaaaacaguuuauccgggguagaaggagaaggauuacauaaguuaggauauauacuucgagauaucaguaaaaucccaggaggcaauauguaugcagaugauacagcggggugggacacucggaucacugaggacgauuuacaaaacgaagcaaaaaucaccgacauuauggagccagaacacgcgcuccuggcuacgagcauauuuaaauuaacauaccaaaauaaaguuguaagaguacaacgaccugcuaaaaacggcacuguuauggauguaauaagucgaagagaucaacgcggaagugggcaagucgggaccuaugggcugaacacauuuaccaauauggaggcucaguuaauucgccaaauggaaucggaagguauuuuucuuccauccgaauuggaaacgccgaauuuagcugaaaggguauuagacugguuggaaaaguauggagucgaacgacuaaaaagaauggcuauuagcggagacgauugcguaguaaagccgauugacgauagguucgcuacugcgcugacagcgcuaaaugauaugggaaagguuaggaaagacauuccgcagugggaacccagcaaaggguggaaugacuggcaacagguaccguuuugcagccaucauuuucaccagcugauaaugaaagaugguagggaaaucguaguuccgugccgcaaccaagaugaguuggugggucgggcaagaguaucacaaggugcaggauggagucuccgugaaaccgcuuguuuaggaaaaucauaugcgcaaauguggcaauuaauguauuuucauagacgggaccucagacuugccgcuaaugcaauaugcagugccguaccaguugauugggugcccacaagucgaacaacaugguccauccacgcacaccaucaauggaugaccacagaagauaugcuaaguguauggaaucgaguuuggauagaggaaaacccauggauggaagacaaaacgcauguauccucauggggagacguaccauaccuggguaagcgagaagaccaaugguguggaucuuuaauaggucuuacagcgagagcuaccugggccucuaauauccaaguugcuauaaaucaaguacgccgacugauuggaaaugaaaauuaucuugacuacaugacuucaaugaaaagguucaaaaaugaaggagauccugagggagcacucugguaa

SEQ ID NO: 21591 - RNA, 9879 nt, Artificial Sequence
  derived and/or modified CDS sequence (opt6) from DENV-1__FJ410252__SS-prME
ucuguaacuauguuauugaugcuaaugccgacggcuuuagccuuccacuuaaccaccagaggaggggaaccccauaugauuguuucuaaacaagaacgaggcaaaucauuauuauuuaaaacaagugcggguguuaacauguguaccuuaauagcuauggaucugggagaauuuugugaagacacgaugacauauaaaugcccaagaauaacagaagccgaaccugacgauguugauuguuggugcaaugcaacagauacaugggugacauacgggacauguagucaaacuggggaacacagacgagauaaacggagcguagcauuagcgccccauguaggacuaggacucgaaacgcgaacugaaacauggauguccucagagggugcuuggaaacaaauucaacgagucgaaaccugggcucugagacauccuggguucaccguaauagcucuauuucuugcacacgcuauaggcacgucaauuacucagaaaggaauaauauuuaucuuacuuauguugguuacaccaucgauggccaugagaugcguuggcauugggucaagagacuucguggagggcuuauccggggcaacuuggguagauguaguuuuggagcaugguucgugcguaacuacgauggcaaaagacaaaccuacauuagauauugaacuguuaaaaacagaaguaacaaacccagcuguacuuagaaaauuauguauagaagccaaaauaagcaacacuacaacugauagucgcugcccuacucaaggagaagcgacccuaguagaagaacaagaugcuaauuuuguaugcagaaggacguuaguagauagaggcugggguaauggauguggucucuuuggaaagggaagccuaauaacaugcgcaaaauucaaauguguaacuaaacuagagggaaaaauagugcaauacgaaaacuuaaaauauuccguuaucguaacuguccauacuggagaucagcaucaaguggggaacgaaaguaccgaacaugggaccacagcgacaauaacaccucaagcaccaucaacugaaauacaacugacagacuacggcgcgcuaacauuagacugcagcccaagaacaggguuggacuuuaacgaaaugguauuacuaacuaugaaggaaaaaucauggcuaguccauaaacaaugguuccucgaucuuccuuuaccauggacaagcggagcaucaacaagucaagaaacguggaauagacaagaucuauuaguaaccuuuaaaaccgcucaugcuaaaaagcaagagguaguuguacuaggaucacaagaaggugcaaugcacacugcccugacaggugcaaccgagauccagacaagugguaccacaacuaucuucgcuggacaucuaaaaugccggcucaagauggacaaauugaccuugaagggcaugucuuauguaaugugcacuggguccuucaaauuggaaaaagaaguugcggaaacacaacauggaacaguccuggugcagauaaaauaugaagguacugaugccccuuguaaaauaccuuucuuaacccaagacgagaaaggaguuacccaaaacgggagacugaucacagcaaaccccaucguaacagauaaagaaaagccuguaaauauagaagcagaaccaccauuuggagaaaguuauauaguuauuggagccggggaaaaagcacugaaauuaaguugguuuaagaaaggaucgucuauugggaaaauguuugaagcaacagcgcgaggggcacgcagaauggcaauuuuaggggauacggccugggauuucggauccauaggaggaguuuucacaaguguugguaaacucguacaucaaauauuuggcacagcauaugguguuuuauucuccggaguaucguggaccaugaagaucggaauagggguucuucuaacauggcuugggcucaauagucgaucgaccucccugagcaugacgugcauagcaguagggcuuguuacacuauauuuaggcgucaugguucaagcggauagcggauguguaauaaauuggaaagguagagaauuaaaaugugggucagguauauucgucacuaaugaggugcauacuuggaccgaacaauauaaguuccaagcggauucgccuaaaagauuaucagcugcgauaggaaaggcaugggaggaaggcguuugugggauuagaucugccacgcgauuagaaaauauaauguggaaacagaucuccaacgaacuuaaucauauucuauuagaaaaugauaugaaauuuacugucguuguaggagauguagcaggcauccuagcucaaggcaagaaaaugauuagaccgcaaccaauggaauauaaauauucuuggaaaucaugggguaaagccaaaauaauaggagccgauguucagaacacaacauuuaucauagacgguccaaauacgccugaaugcccagacgaucagagagcauggaauauuugggaaguagaagacuacggauuugguauauuuacgacgaauaucuggcuaaaacuaagggacucauacacccaaguaugcgacuauaggcuuaugagugcagcuauaaaagauaguaaggcaguacacgcggauaugggguacuggauagaauccgagaagaaugagacauggaagcuagcccgagcuucauuuauagaagucaagacuugcaucuggcccaaaucacauacauuaugguccaauggugucuuagaaagugaaaugauaauuccaaaaauauauggaggaccgaucucacaacacaacuauagaccaggauacuucacccagacugccggaccguggcaccucggaaagcuagaacuugauuucgaccucugugagggaacaacgguuguaguugaugaacacugcgguaaucgaggaccaucccuaaggacuacaacuguaacgggaaaaaucauucacgaaugguguugucggaguugcacccuuccuccacuacgauuuaaaggggaggauggcugcugguaugguauggagauacgaccagugaaggaaaaagaggaaaauuuaguuaaaaguaugguaucugccggaucuggagaagucgacucuuuuucauugggacuacuuugcauaucgauaaugauagaagaaguaaugcggucaagauggucaaggaaaaugcucaugacugguacccuagcaguauuuuucuuacucauuaugggccaacuaaccuggaacgaccugauuagauuguguauuaugguaggugcaaacgcuucagaucguauggguauggggacaaccuacuuagcacuaauggccacauucaaaaugcgaccgauguuugcgguaggacuuuuguuuaggaggcuaaccucaagggaaguucuucuauugacuauaggauugucauuagucgccagcguugaacuaccaaacucccucgaagaacuaggggauggacuagcuaugggaauaaugauacuuaagcugcuaacugauuuccaaagucaccaacuaugggcuacucuacucagcuuaacguucauuaaaacgaccuucagcuuacacuacgcauggaaaaccauggccauggucuuaucaauaguaucacuauucccauuauguuuaucaacuaccucacaaaagaccaccuggcuuccuguacuauuaggcucuuugggauguaaaccgcuaacgauguucuuaauagcagagaacaaaauauggggccgaaaaucuuggccgcugaaugagggcauaauggcuguaggcaucgugagcauacuuuuaaguucucuauugaaaaacgaugucccgcuugcaggcccauuaauagccggagggauguuaauagcaugcuacguaauaucagggagcucggcagauuuaaguuuagaaaaagcagcagaggucucaugggaagaagaggccgaacauuccggugccucucauaauauucuaguagaaguacaagacgacggaacaaugaaaauuaaagacgaggaaagggaugacacacuaacgauucuguuaaaggcuacacuauuagccgugucagggguauauccauuaagcauaccagcaacacuauuuguuugguauuucuggcaaaagaagaaacaacgaaguggugugcucugggauacuccuaguccgccagaaguagaaagagccguauuagaugacgguauuuauagaauuaugcaaagggggcuguuaggaagaucacaggucggagucggaguuuuucaagagaauguguuucacacaauguggcacguaacucgcggcgcagugcugauguaccagggaaaacggcuugaaccgucuugggccagcgucaagaaagaccucauuuccuaugguggcggcuggagacuucaaggaucauggaacacaggggaggaagugcaaguuauagcuguagaaccugggaaaaacccuaaaaauguacagacggcccccggaacuuucaaaacgagcgaaggcgaaguaggugcaauugcacuagauuuuaaaccgggcaccuccgguagcccaauaguaaauagggaagggaaaauaguaggucuuuacgguaauggagugguaacaacaagcggcacauacgucagcgcaaucgcacaagcaaaagcaagccaagaagggccccuaccggagauugaagaugaaguauucaggaagcgaaacuuaacaauaauggauuuacacccagggaguggaaaaaccagacgauauuugccugcaaucguucgagaagcaauaaaaagaaagcugcgcacguuaaucuuagcaccuacuaggguuguagcgagugaaauggcugaggcuuuaaagggaaugccuauacgauaucaaaccacugcaguaaaaucagaacauacagggaaagaaaucguagacuuaaugugucacgcgaccuuuacgaugcguuuacuuucgccgguucguguaccuaauuacaauaugauaaucauggacgaggcccauuuuaccgaucccucauccauugcagcaaggggauauauaucuacuagaguaggaaugggagaagcugcagcaaucuuuaugacggcgacaccaccaggaaguguugaagcguucccccaaaguaacgcugugauacaagacgaggaacgugauauaccggagagaaguuggaacaguggauaugaauggauuaccgauuuuccgggcaaaacugucugguuugucccguccauuaaaagugggaaugacauagcaaauugucuuagaaagaaugguaaacgagucauacaacuuucuagaaaaacguuugauacggaauaucagaaaacuaaaaacaacgacugggauuauguaguaacaaccgacauaagugagaugggcgcaaauuuccgugcugauagagucauagauccaaggcggugucugaagcccgugauacuaaaagacgguccggaaagggugauauuagcagggccaaugccaguaacgguugcaucugcagcucaaagaagaggaagaauagguagaaaucacaacaaagagggcgaucaauauaucuauaugggacaaccccuaaacaaugaugaagaccacgcacacuggacggaagcgaaaaugcuguuagauaacaucaauacaccggaaggaauuauuccugccuuauuugagccagagcgugagaaaagcgcugcaauagauggcgaguauagauuaaggggugaagcgagaaaaacauucgucgaacuaaugagacgaggagauuuaccggucuggcuaucuuauaaaguagccucugaaggauuucaauacagcgauagaagaugguguuucgauggcgagcguaauaaucagguauuggaagaaaauauggacguugagauauggacuaaggagggagaaagaaagaagcugcggccaaggugguuagacgcaagaacauacucugauccauuagcucugcgggaauuuaaagaauuugccgcuggccgccguaguguuaguggggacuuaauacuagagauugguaaauuaccgcagcauuuaacccaaagagcucaaaacgcucucgauaaucugguaauguuacacaauagugaacaagggggacgagccuaccgucaugcaauggaagaauuaccagacacuauagaaacgcuaauguuacuggcauuaauagcgguguuaacgggaggaguuacauuauucuuucucagcggacgaggccuaggaaagacaaguauaggucuucuguguguuauggcuagcaguguuuuacuguggauggcaucgguugaaccucauuggauugcugcaucuauaauccuagaauuuuuccuaaugguccuccuuauuccggaaccagauaggcaaaggacaccucaagauaaucaauuagcauacguggugauaggccuuuuauuuaugauacuaacgguagcagcuaacgaaauggguuuauuagaaacuacuaagaaagaucuagggauuggacacguugcuguagaaaaccaucaucaugccgcuaugcuugauguggauuuacacccugccucagcauggacauuauacgcgguagcaaccacaaucauuacaccaaugaugaggcacaccauagaaaacacgaccgcaaauauaagucuaacagcgaucgcgaaccaagcagcuauccugaugggucuagacaagggauggccuauuucgaagauggacauaggcguaccguuacuagccuuaggauguuauagucagguuaacccacuaacccuaacggcugccguuuugaugcucgucgcacauuacgcgauuaucgggccaggacuucaagcgaaggcaaccagagaagcucaaaaacgaacagccgcaggaauaaugaagaauccaacugucgacggaauagucgcgauugaucuugauccgguaguuuacgacgcaaaauucgaaaaacaauugggacagauuaugcuccuaauucucuguacaucacaaauucuucucaugagaacaacaugggcacucugugaaucaaucacucucgcaacagguccauuaacaacauugugggaagguagcccugguaaauucuggaauacaacgauugcagucagcauggcaaauauauuuagagguucauaucuugcaggcgccggcuuagcauuuucauuaaugaaaucgcucgguggaggaaggaggggaacgggagcucaaggugaaacgcucggugaaaaguggaagcgccaacuaaaccaguuguccaagucagaguucaauacguauaaaagaaguggaaucauggaaguagaucgcucagaagcaaaagaaggacuaaaacgaggugaaacuacgaaacacgcaguaagccgagguacugcaaaacuaagaugguuuguagaacguaaccuggucaaaccagaaggaaaagucaucgaccucggcugcggcagaggaggauggucauauuauugcgcuggauugaagaaaguuacagaagugaaaggcuauacgaaagggggucccgggcacgaggaaccgauuccgauggcaaccuacggcuggaacuuaguaaaacuccacuccgggaaggacguuuucuucaucccgccagaaaaaugcgauacguugcuaugugauaucggugaaucuucaccgaauccuacuauugaagagggacgcacucucagaguacugaaaaugguagaaccgugguugagaggaaaucaguucuguauaaagaucuuaaacccauacaugccuucaguagucgagacguuagaacaaaugcagagaaagcacggggguaugcuaguuaggaauccacuaucaaggaacagcacacaugaaauguacuggguauccuguggaacugguaacauaguuagcgcaguuaacaugacuucaagaaugcuacuaaauagauucacgauggcacauagaaaaccuacguaugaacgcgauguggacuugggcgcgggaacacgacacguugccguggagcccgaaguagcgaauuuagacauuaucggacaaagaaucgagaauaucaagcaugaacacaaaucaacuuggcacuacgacgaagauaauccauacaaaacuugggcauaucacgguuccuaugaaguuaagcccaguggcucagcaucgaguauggugaacggaguaguuaaacuccuaacuaaacccugggauguaauaccgauggucacucaaauugccaugacagacacaacaccauuuggacaacagagaguauuuaaagagaagguggacacgcgaacaccuaaagcaaaaagaggaacugcgcaaaucauggaagugacagcuaaaugguuauggggauuucuuagccggaauaagaaaccucgcauuuguaccagggaagaguucacacguaaagugaggucgaaugcugcuauuggggcaguauucgucgacgaaaaucaauggaacucagcgaaggaagcugucgaggacgagagauuuugggaucucguucacagagagcgagaauuacauaagcaaggaaaaugugcaacauguguauacaacaugauggguaaacgagagaagaaacucggagaguucggaaaagccaaagguucacgugcuaucugguacauguggcucggugcgcgguuccucgaguuugaagcgcuuggauucaugaaugaagaccauugguuuucacgagaaaacagcuuaaguggcguugagggugaaggguuacacaaauugggauacauuuuaagagauauaucuaaaauacccggggguaauauguacgcagaugacacagccgggugggauacuagaauuacagaggacgaccuacagaacgaagcaaaaauaacggauauuauggaaccugaacacgccuuguuagcaaaaaguauuuuuaaacuaacauaccaaaacaaaguuguaagaguacaacggccggccaaaaacggcacaguaauggacguuauaucaaggagagaucaaagaggaucaggacaagugggaacauacggcuuaaauacauucacaaauauggaagcacagcuuauuagacagauggaaucagaaggaauauuuucgccaagcgaauuggaaacaccaaacuuagcuggaagggugcuagacugguuggaaaaacauggagucgaaagacucaaaagaauggcuaucaguggagaugauugugucguaaaaccuauagacgauagauucgccacggcucuaacagcauugaacgacaugggaaaaguaagaaaggacauuccacaaugggaacccaguaaggguuggaaugauuggcaacaagucccauuuuguucacaccacuuccaucaauuaauuaugaaagacgggcgagaaauagucgucccgugucguaaccaagaugaauuagucggacgcgcacgggucucacagggggcaggauggucauugagagaaaccgcaugccucggaaagucguacgcacagauguggcagcuaauguauuuccauaggagagaucugaggcuagcagcuaaugccauuugcucggcaguuccaguugacuggguaccuacaucaagaacgacauggucaauccacgcucaucaucaauggaugacgacugaggauauguuaaguguuuggaacagaguauggauagaagagaacccuuggauggaagauaaaacucauauauccucguggggugacgucccauaucucggcaaaagagaggaucaaugguguggcaguuuaauagggcuaacagcaagggcuacgugggcaacaaauauacagguagcaauaaaccaaguaagacgauuaauaggcaaugagaauuaccuugauuauaugacuucgaugaaaagauuuaaaaaugaaucugacccugaaggggcauuaugguga

SEQ ID NO: 21592 - RNA, 9879 nt, Artificial Sequence
  derived and/or modified CDS sequence (opt6) from DENV-1__FJ461331__SS-prME
ucaguaacuaugcuuuuaaugcuaaugccgacagccuuggcauuucaucuuacaacaagagggggagaaccucacaugauaguuaguaaacaagaacgcggaaaaucucuacuguuuaaaacaucggcugggguuaauaugugcacccugaucgcaauggacuugggagaacugugugaagacacuaugacauacaaauguccaagaauuaccgaagccgaaccggacgauguugauugcuggugcaaugcuacugauacaugggugacauaugggacuuguagccaaacaggugaacaucguagagacaagcgcuccguggcguuagcuccucaugugggacucggauuggaaacccguacagaaacauggaugucuagcgaaggugcuuggaagcaaauucaacgaguugaaacuugggcucuacgucauccaggcuuuacaguaauugccuuguuucuugcacacgcaauaggcacaucaauaacucaaaagggaauuauauuuauacuguuaauguuaguaacaccaucuauggcaaugcguuguguuggaauugguucacgggauuuuguugaaggauuaucaggugcgacauggguagacgucguucucgaacacggaucgugugugacaacaauggcaaaagacaaaccaacucuagauaucgaauuacuaaaaacugaaguuacaaauccugccguucuacgaaaacuauguauagaagccaagauaucgaauacgacgacugacucaagauguccaacgcaaggugaagcaacccuaguugaagaacaagaugcuaacuuuguuuguagaagaacuuuuguugaucgaggaugggguaacgggugugguuuauucgggaagggcucacuaaucacaugugccaaauuuaaauguguaacuaaacuagaagguaaaauaguucaauaugagaaucuaaaauacucgguaauaguaacuguacauacaggagaccaacaccaagucggcaacgaaagcacagaacacggaacuacggcaaccauaacaccgcaagcacccaccacagagauacaauuaacugauuauggugcuuuaacauuagauuguagcccuagaacaggucuagauuucaaugaaaugguucugcucacaaugaaagagaaaaguuggcuaguacauaaacagugguuccuagaccuaccauuacccuggaccucuggggccaguacaucucaagagacguggaauagacaagaucuacucguaacauucaagacggcacaugccaagaaacaagagguagugguucuaggaucacaggaaggugccaugcauacugcauuaacuggggcgacggaaauacaaaccagcggaacuacuacgaucuucgcaggacaccuaaaaugcagauuaaaaauggauaaacucacccuuaaagggaugucauaugucauguguacuggauccuuuaaauuagaaaaagaagucgcagagacucagcacggaacuguacucguacaaauaaaauaugaaggaacagaugcuccaugcaaaauuccuuucaguacacaagaugaaaaggggguaacgcagaauggucgauuaauaacagcaaauccaaucgucaccgauaaagaaaaaccagucaauauagaagcggagccaccauuuggugaguccuauauaguaauuggugcaggagaaaaggcucuuaaauugucuugguucaagaagggcagcaguauuggcaaaauguuugaagcuacagccagaggugcacgacgaauggcuauucugggcgacacugccugggauuucggaagcauuggcggagucuuuaccagcguugguaaacuaauacaucaaauauucgggaccgcuuauggaguauuauuuucagguguaucuuggacgaugaaaaucggaauaggaguguuauuaaccugguuagggcugaauagucgaaguaccucuuugucaaugacaugcaucgcagucggauuaguaacuuuauauuuaggaguaaugguccaagcugacucggguuguguaauaaacuggaaagguagagaacuuaaauguggaucuggcauuuucgugacuaacgaaguccacacuuggacagagcaauacaaauuucaagcagauagucccaaaagguugucugcagcuauugguaaagcgugggaagaaggaguuuguggaauccgaucugcuaccagguuagaaaauauuauguggaaacaaaucucgaaugaacuaaaucacauauuauuggaaaacgauaugaaauugacaguagugguaggcgauguggcagggauucucggucaaggaaagaagaugaucagaccacaaccaauggaauacaaauacaguuggaaaucuuggggcaaagccaagauuauaggggcugaugcacagaacacgacuuucaucauagacggaccaaauacaccugaauguccagaugaccaacgagcauggaauaucugggaaguagaagauuacggcuuuggaauuuucacgaccaacauaugguugaaauugagggacucguauacacaggugugugaccauaggcuuauguccgcagcgaucaaagauaguaaagcaguucacgccgauaugggauacuggauagaaucagagaaaaaugagaccuggaaauuagcuagagcauccuucauagaaguaaaaacguguauauggccuaaaucccauacgcugugguccaauggaguacucgagagugaaaugauaauacccaaaauauacgggggacccauaucucaacauaauuacagaccuggauauuucacacaaacugcaggaccauggcaucuaggaaaacucgaauuagauuuugauuugugugaagggacaacaguaguaguagacgaacacugugguaauaggggaccaucauuaagaacaaccacaguuacagguaaaauaauccaugaauggugcugucggaguugcacacuacccccacuaagauucagaggagaagauggcugcugguacggaauggagauuagaccgguuaaagaaaaggaagaaaaucuggugaaaucaaugguaagugcagguaguggagaaguagacucauuuucauuaggacuauugugcauuaguaucaugaucgaggagguuaugcgaucacgauggucacggaagaugcuuaugacggguacccuagcaguauucuuucuguuaaucaugggacaauugaccuggaacgauuuaauacgacuaugcauaauggucggagcaaaugcuuucgaccgaaugggcauggggacaacauaucuugccuuaauggccacauucaaaaugcgcccaauguuugcugucggcuuacucuuucguagacuaacaucucgagaaguacuccuauuaacaauaggccugucuuuaguagcuaguguagaauugccaaacuccuuggaagaguuaggugacggauuagcaaugggaauaaugauauuaaaauuauuaaccgauuuccaaagccaccaauuaugggccacacuauuaucgcuuacuuuuauaaaaaccacauuuucuuuacauuaugcauggaaaacaauggccaugguucucucuaucgucucgcuuuucccauuaugucuaaguacaacgucacagaaaacaacauggcugccaguacugcucggaucacucggcugcaaacccuuaacgauguuccuuaucgcagaaaauaagauauggggcagaaaaucauggccauugaaugaaggcauaauggcaguugggauaguuucuauccuucuaaguucacuauugaaaaacgauguccccuuggccgguccguuaauagcuggaggaaugcuaauugcuugcuauguaauaucaggaucaucagcugaccucucuuuagaaaaggcagcggaagucucuugggaagaagaggccgaacauucuggagcaucacauaacauccuaguggaaguccaggaugaugguacgaugaagauuaaagaugaagaacgcgaugauacucuaacaaucuuauuaaaggccacccuauuagccgugucaggaguguacccacuaaguaucccggcaacguuguuuguaugguacuucuggcagaagaaaaagcagcguucaggcgugcuaugggauacacccucaccuccuguaguagaaagagcaguguuagaugacggaauuuacagaauaaugcaaaggggacuucuuggaagaagucagguaggaguugggguauuccaggaaaacguauuccacacgauguggcacguuacccgaggugccguacucauguaucaaggaaaaagacuugaacccagcugggccagcguaaagaaggauuuaauuucauacgguggaggauggcguuuacggggaagcuggaauacgggugaagaaguacaaguaaucgcugucgaaccaggcaaaaaucccaaaaauguccaaacugcaccaggaaccuuuaaaacuccggaaggagaagugggagcaauagcguuggauuuuaagccgggcacauccggaucaccaauugugaauagagaaggaaaaauugugggucuauacgguaauggaguagucaccacaucaggaaccuauguaucagcgauagcacaagcaaaagcgucacaggaaggaccacuaccugaaauagaggaugaaguauucagaaaacggaaucucaccauaauggacuuacauccugguucuggaaaaacacgaagauaucugcccgcaauaguuagagaagcgaucaaaagaaaacuucgaacccucauacuggccccgacucgcguagucgcuagugagauggccgaggcuuuaaaagguaugcccauuagauaccagacuacugcaguaaaaagcgaacacacaggaaaagagauuguugacuuaaugugccaugcuacguuuacuaugcgucuauuaucccccguaagagucccaaauuauaauaugaucauuauggacgaggcccauuuuaccgaucccagcagcaucgcagcacguggauacauuucuacaagaguuggcaugggagaagcugccgcuaucuuuaugacugcuacaccaccgggaucuguugaagccuuuccgcaaucuaacgccguaauccaggacgaggaaagagacauuccugaacgcucguggaacucuggucaugaauggauaacugauuuucccgguaagacgguaugguuuguccccucaauuaaaucagguaaugacaucgccaauuguuugaggaagaacgguaaaagaguuauacagcugucacguaagaccuucgacacugaauaucagaaaacuaaaaauaaugauugggacuacguuguuacgacagauaucuccgagaugggcgcuaauuucagagccgauagagucauagauccucgacgaugucucaagcccgucauacuaaaagauggacccgaaagggugauacucgccggaccuaugccaguaacggucgcaucggcugcgcagaggagaggccguaucggcagaaaccauaacaaagaaggugaccaauacauuuauaugggucaaccucuaaauaacgaugaagaucaugcacauuggacugaggcaaaaaugcuucuugacaauauaaacaccccagaaggcauuauacccgcauuauucgagccggaacgugaaaaaucugcagcuguugauggagaauauagacucaggggagaggcgcgaaaaacauucguagagcucaugcgaaggggagaucucccuguguggcuaagcuauaaaguagcaagugaaggcuuccaauacucugaccgcagaugguguuuugauggagaaaggaauaaucaaguccuugaagaaaauauggacguugaaaucuggacuaaagagggggagcggaagaaguuaaggccaagauggcucgacgcacggaccuauucugauccacuggcacugcgggaauuuaaagaauuugcagcgggacgucgguccguuucuggugaccuaauucucgaaaucggaaaacuaccucaacaucuaacccagcgugcacaaaaugcacucgacaaucuaguaaugcuccauaauucagaacaaggugguagagcauauagacaugcuauggaggaacuacccgauaccauagaaacucuaauguugcuugcacuaauagccguuuugaccggcgguguuacauuauucuuucuuagcggucggggacuggggaaaacuucaauaggguuacuuugcguaauggcaagcucaguacuccuauggauggcuucuguugagccacacuggauagccgcuagcauuauucuggaguuuuucuuaaugguauugcuaauaccagagccagaucgccaaaggacuccacaagauaaucaguuagcuuacguagugaucggacuucuauuuaugauucuuacgguagcagcaaaugaaauggguuuacucgaaacuacgaaaaaggacuuaggaauaggacauguggcagucgagaaucaccaucaugccgcuaugcuggaugucgacuugcauccugcuagugcauggacacucuacgcuguugcuacaacaauuauuacaccuaugaugcgccauacuauugaaaauacuacagcaaauauaucuuugacggcuauagcaaaccaagcggcuauuuuaauggguuuagacaaagguuggccuauuucaaaaauggauaucggaguucccuuguuagcucuagguuguuauagccagguuaacccacuaacucuaacggcugcaguccuaaugcuagucgcacacuacgccauuauaggaccuggucugcaagcgaaagcgacgagggaagcacagaaaaggacagcagcaggcauaaugaaaaauccgaccguggacggcauaguugcaauugauuuagauccagucguuuaugaugccaaauucgaaaaacaauugggacagauuauguuauuaauacuguguaccagccaaauucuacugaugcgcacaacuugggcuuugugugaaucaauuacucuggcaacaggcccacuaacuacccugugggaaggaaguccagguaaguuuuggaauacuaccauagccguaucaauggcuaacauauuuagagggucauaccuagcuggagcuggacuugcauuuuccuuaaugaaaucgcuuggaggcggucgacgaggcacgggagcgcagggagaaacucugggggagaaauggaagcgacaacuuaaccaacuuuccaaaagugaguuuaauacguacaagcgaucaggaauuauggaagucgacagaucugaagcuaaagaagggcuaaaaagaggagaaacaaccaaacaugccgucucacgagguacugcuaaauugcguugguucguugaacgaaaucuaguuaagccugaggggaagguaauugauuuaggaugcgggagaggagguuggaguuacuacugugcaggacuuaaaaagguuacagaaguaaaagguuacacuaaaggagggccuggucaugaggaaccuauuccaauggcgacauacggauggaauuuaguaaaauugcauucuggaaaagauguauucuuuauuccaccagaaaaaugugauacucuccugugugacauaggagaaaguaguccaaacccaacaauagaagagggucguacucuccgggucuugaaaaugguagaaccuuggcuaaggggcaaccaauucugcauaaaaauucuuaauccauacaugcccucggugguagaaacgcuagaacaaaugcaaagaaaacaugggggaaugcuugugagaaacccgcuaagccgaaauagcacucacgagauguacuggguaucuuguggaacuggcaacaucguuucagcaguaaauaugaccucucggauguuacuuaacagauucacgauggcacacagaaaaccgacuuacgagcgugacgucgaccuaggaacagggacacgucacgucgcaguggaaccagaggucgcaaauuuggacauaauuggacaacgcaucgagaauauaaaacacgagcauaaaaguacuuggcacuaugacgaagauaaccccuauaagacuugggcauaucacggaucauaugaaguaaaaccaucagggucagcuagcaguaugguaaauggcguuguuaaacucuugacuaagcccugggauguaauuccuaugguuacacaaauagcgaugacggauacaacuccauucgggcaacaaagaguauucaaagagaaaguugacacccgaacaccuaaagcgaaaagaggaacugcucaaauuauggaaguuacggcacggugguuauggggauuuuuaucucgaaacaagaaaccgaggauuuguacuagggaagaauuuacuaggaaaguacguaguaaugcagcuauuggcgcaguauucguggaugaaaaccaguggaacucugccaaagaagcaguugaggacgaaagauucugggacuuaguacaccgggagagggaauuacacaagcaaggaaaaugcgcaacauguguauauaauaugaugggcaaaagagagaagaaacuuggggaguucggaaaggccaaagggucacgggcuauuugguacauguggcuaggcgcucgguuuuuagaguucgaggcccuggguuuuaugaacgaagaucauugguuuagcagagaaaauucauuauccggcguugaaggagaaggccugcacaaacuugguuauauacuaagagacaucuccaaaauacccgguggaaauauguaugcagaugauaccgcaggaugggauacucgaauaacagaggacgaccuacaaaaugaagccaaaaucacagauaucauggaaccagagcacgcuuuacucgcuaaagcuauuuucaaauuaacguaucaaaauaaagucguucgaguucaacgaccugccaaaaauggaaccguaauggauguaauaucacguagggaucaaagaggaagcggacaaguuggcaccuacggacucaacacuuucacaaauauggaagcucaacuaauacgacaaauggagagcgaagguaucuucaguccauccgaacuugaaacgccgaaccuagcagaacgcgcacuugacugguuagaaaaguacggggucgaaagacuaaaacgaauggcaauaucgggugaugauuguguagucaaaccaauugacgaccgauuugcaacugcauuaaccgcgcuuaaugauaugggaaaaguacggaaagauaucccacaaugggaaccaaguaaaggauggaaugacuggcaacaagucccuuuuuguagccaccacuuucaucagcuuauuaugaaggaugggagagagaucguuguaccgugcaggaaucaagaugagcuuguaggacgggcuagaguaagucaaggcgcaggguggaguuugcgggaaacagccugccuugggaaaaguuaugcucaaauguggcaauuaauguacuuucauaggcgagaucuaagacuagcugcaaaugcgauauguucagccgugccaguagacuggguaccgacaucacgaacaacaugguccauucaugcacaucaucaauggaugacuacugaagauauguugucaguguggaaucgcgucuggauagaagagaauccguggauggaggauaaaacucacauaucaaguugggaagauguacccuaucugggaaaacgagaagaucaaugguguggcagcuuaauaggccuaacagcccgugcuacuugggcuacaaauauccaaguagcaaucaaccagguaagacgccugauaggaaaugaaaacuauuuagauuacaugaccucuaugaagagauucaagaaugagagcgacccagagggugcacuaugguaa

SEQ ID NO: 21593 - RNA, 9879 nt, Artificial Sequence
  derived and/or modified CDS sequence (opt6) from DENV-1__FJ410256__SS-prME
agugugacgauguuauugauguuaaugcccacugcacuggcauuucaucuaacaacuagaggaggugaaccucauaugauuguuucaaaacaagaaaggggaaagagcuuacuguucaaaacuucugcaggagucaauaugugcacgcuaauagcaauggauuuaggagaguucugcgaagauacuaugacauacaaaugccccaggaucacggaagcugaacccgacgaugucgauugcugguguaaugccacagauaccuggguaacauauggaaccuguagucaaacaggugaacauagaagagauaaaagaagcgucgcauuagcuccacauguaggauuaggauuagaaacaagaaccgaaaccuggauguccucugaaggugcguggaaacaaauccagaaaguagaaacuugggcccuucggcauccaggauuuaccguuauagcguuguuuuuagcucacgcaauagguacauccauaacacagaaagggauuaucuuuauauuacuaauguuaguuacaccaagcauggccaugagaugcgucggcauuggaucaagagacuuuguagaaggauugucuggcgccaccuggguagacguuguucucgaacacggaucaugcguaacaacuauggcuaaagacaaacccacacucgauauugaauuacuaaaaacagagguaacgaauccagcuguccucaggaaauuguguauugaagcaaaaauaagcaauaccacaacagauucacgauguccuacgcagggagaagcuacacuuguagaagaacaggacacgaauuucguaugccgaagaacguuuguagaccguggcuggggaaaugggugcggccucuuugguaagggcagcuuaauaacgugugcuaaauuuaaauguguaacgaaauuagagggaaaaaucguucaauacgaaaauuugaaauauucggucauaguuacaguacacacaggugaccaacaucaaguagggaaugaaaguaccgaacaugguacuacugcaaccauaacuccgcaagcaccaucuacagaaauacagcuaacugacuauggugcucuuacacuugauuguagcccucgaacaggguuggauuucaaugaaaugguacuguuaacaaugaaagagaaaaguugguuaguacacaaacaaugguuccuagauuuacccuuaccauggaccaguggggcgucaacaagucaggaaacauggaauagaaaagauuugcucguaaccuucaagacugcccaugcgaagaaacaagaaguaguuguacuagguagccaagaaggagcaaugcauacagcccuaaccggugcgacagagauacaaacaagugguacgacuacaaucuucgcaggacaccucaaguguagguuaaaaauggacaaacuuacauuaaaaggaauguccuauguaauguguacggguucguucaaauuggagaaggaaguagcggagacacagcauggaacaguacuugugcaaauuaaauaugaagggacggacgcaccguguaaaauuccauucuccacucaagaugagaaaggugugacacagaacggaagacuaaucacugcaaauccgauagugacagauaaggaaaaaccuguaaacauagaagcugaaccacccuuuggagaaaguuacauaguuauuggcgcaggcgaaaaggcacuaaaacuaagcugguucaagaaaggcucaucaauuggcaaaauguuugaagccacagcgagaggagcacgacgaauggcuauacuuggcgauacugcaugggauuuuggaucaauagguggugucuuuacaucagugggcaaacuuguacaucaaauuuuuggaacagccuauggcgugcuauucuccggugucagcuggacaaugaagauaggcauugggguguuacuuacuuggcuaggacugaacaguagaucaacauccuuaucaaugaccuguauagccguagggcuuguaacacucuauuuaggggucaugguacaagcagacucaggauguguuaucaacuggaaaggacgggaguuaaaauguggauccgguauuuuuguaacaaacgaagugcauacguggacagaacaauauaaauuucaggcugacucaccgaaacgacuaagcgcggcaaucgguaaggccugggaggaaggcguuuguggcauucgaucuacgacacgccucgagaacauaauguggaaacagauaucaaacgaauuaaaucauauauuguuagaaaaugauaugaaguuuacgguagugguuggugauguggcaggcauucuagcucaaggaaagaaaaugauacgaccacaaccgauggaauauaaauacagcuggaaauccugggguaaggcuaaaaucauuggggcugacguacaaaauacgacguuuaucauagauggaccuaauacaccugaauguccggaugaccaacgcgcauggaauauaugggaagucgaagacuacggauuugggauauuuacuaccaacauaugguuaaaauuacgugacaguuauacacaaguaugcgaucacaggcuaaugucggcggcgauuaaagacaguaaagcaguacaugcagauaugggauauuggauugagagcgagaaaaacgaaacguggaaauuggcgcgagcuaguuucaucgaagugaaaacuuguauauggccaaaaucacauacacucuggucgaacggcguauuagaaucagagaugaucauccccaagauauauggcggaccaauaagucaacacaacuauagaccuggauauuucacucaaacagccgguccauggcacuuagggaaauuagaauuagauuucgacuuaugugaagguacaacaguuguaguugacgaacacugugggaaucggggcccgagccuaagaacuaccacaguaaccgggaaaauaauacaugaauggugcuguagauccugcacauuaccaccucuuagauucaaaggagaggacggauguugguaugggauggaaauaagaccaguaaaagaaaaagaggaaaaucuugugaagucaauggugagcgcugguuccggggaaguggauucuuuuagcuugggauugcucuguauaucuauaaugauugaggaaguaaugagaagccguuggucgagaaaaaugcugaugacuggcacguuagcagucuucuuucuacuuauaaugggucaauuaacauggaaugaucuuauacgacuuuguauuaugguuggagccaacgccucagauagaaugggaaugggaacgacauauuuagcgcuaauggcaacuuucaaaaugagaccgauguuugcagugggacuacuuuucaggcgucucacuucaagagaagugcuauuauugacgauaggauuaaguuugguagccucaguagaacuccccaacucucuagaagaauugggugauggccucgccaugggcauaaugauauuaaaauuauuaacagacuuucagucacaccaauuaugggcaaccuugcuaagucuuaccuuuaucaaaaccacauuuucguuacauuaugccuggaaaacuauggcgaugguauuaagcauugucagucucuuucccuugugucucucaaccacuagccaaaagacuaccuggcuuccaguguuguuagguucccugggcuguaaacccuugacaauguucuuaaucgcugagaauaaaaucuggggacguaaaucauggccccuuaaugaggggaucauggcugugggaauaguaucgauauuguuaucuagccuuuugaaaaaugacguccccuuggcuggcccguugauagccggaggaauguuaauagcgugcuacguuauuucuggaucuuccgcagaucuuucauuagaaaaagcagcagaaguuaguugggaagaagaagcggagcacuccggugcaucucauaacauacuuguggaagugcaagacgacgguacgaugaaaauuaaagacgaagaaagggaugauacuuuaacaauucuauuaaaggcuacuuuguuagcgguaucgggcguauacccucugagcauaccggcaacacuuuuugucugguauuuuuggcaaaagaagaagcaaagaucuggaguauuaugggauaccccuaguccuccagaaguugaacgugcuguuuuggaugacgguauuuaccgcauuaugcaacguggguuauuaggacggagucaaguugggguaggaguauuucaagaaaacguuuuucauacgauguggcacgucacuaggggcgccguauugauguaucaaggaaaaagacuggaaccgaguugggcgaguguuaagaaagaccuuauaucuuacggcggcggauggcggcugcaggggaguuggaauacuggagaggaaguucaaguaaucgcggucgaaccuggcaagaaucccaagaauguucagaccgcaccagguacuuucaagacaagugagggggaagucggagccauagcccuugacuucaaaccagguaccucaggcagcccuauaguaaauagagaaggaaagauaguagguuuauacgggaacggaguaguaacaaccucagguacauacgugagugcaauugcacaagccaaagcgucccaagaagguccccuccccgaaauagaagaugaaguauuccggaaaagaaacuuaacaauaauggaucugcacccaggaagcgguaaaacacgucgguaucugccugcgauaguaagagaagcuauaaagagaaaauugagaacacuaauucuggcaccgacccgagucgucgcaagugaaauggcugaagcacuuaaagggaugccgaucagauaucaaaccaccgcagucaaguccgagcauacagguaaagagauaguggaucuaaugugucacgcuacauuuacaaugagacuauuauccccugucagagugcccaauuauaauaugauaaucauggacgaagcucauuuuaccgauccaagcaguauagcggccagaggauacaucucgacccgaguuggcaugggggaagccgcagcaauauuuaugacagcgacuccuccgggauccguagaggcuuuuccucaaaguaacgcagucauucaggaugaagaacgcgacauaccagagcgauccuggaacucgggguacgaauggauuacagauuuucccggaaaaacuguuugguucgucccuaguauaaaaagcggaaacgauauagcaaauuguuugcguaaaaacgggaaacguguaauacaauuaucuagaaagacauuugacacggaguaucagaaaacuaaaaauaacgacugggauuauguuguaacgacagauaucuccgaaaugggagccaauuuccgugccgaccggguuaucgauccuagacguuguuugaagccagugauacuuaaagacggacccgaacgcguaauccuggcagggccgaugccuguaacaguugcaucugcagcacaaagacgcggacguauaggccguaaccauaacaaagagggagaucaauacauauauaugggacaaccauuaaauaaugacgaagaucaugcacauuggaccgaagcgaaaaugcuccuggauaacauuaauacuccagagggcauuauacccgcgcuauuugaaccggaaagggaaaaauccgcugcaaucgacggagaguauagacuaagaggugaagcuagaaaaacuuuuguugaauugaugaggagaggcgauuuaccaguauggcuaagcuauaaaguggcaagcgagggauuucaguauagcgaucgucguugguguuuugauggcgaacgaaauaaucaaguccuagaagaaaauauggacguagaaauauggacaaaagagggagagcgaaagaaauuacguccccguuggcuggacgccaggacauauucagauccgcuggcauugagagaauuuaaagaguuugcagccggacgcaggucaguauccggagauuuaauacuagaaauugggaaacuuccgcaacacuuaacucagcgagcucaaaacgcuuuagacaaucucguaaugcuacauaauagcgaacaagguggcagagcuuacagacacgcuauggaggagcugccagauaccauagagacacugauguuauuagcauugauagcaguacuaacggguggaguaacguuauucuuucucucggguagaggcuuaggaaaaaccucuaucggccuguuguguguaguugcauccucuguacuacuauggauggcauccguagaaccucauuggauagcggcuucaauaauucuagaauuuuuccuaaugguacuguuaaucccagaaccggaccgacaaagaacaccucaagauaaccaacuagcauacguggugaucggacuacuuuucaugauacuuacaguugcagcgaaugagaugggucuacuggaaacaacaaagaaagaucuagguauagggcacguagcugccgaaaaucaccaucaugcggcuaugcuugaugucgaccuucacccugccucagcauggacacuguaugcagucgcuacaacuauuauuacuccuaugaugcgucauaccauagaaaacacaacggcaaauaucucauuaacugcuauugccaaccaagcagcaauauuaaugggacuagauaaagguuggccaauaagcaaaauggacauuggggugccacucuuggcuuuggguuguuacagucaaguaaauccccuaacauugacagccgcuguacuuaugcucguagcacacuacgcuaucauugggccaggcuuacaagcaaaagcaaccagagaagcacagaagagaacugcggcagguauaaugaagaacccaacugucgacgggauaguagcaaucgaccuugaccccgugguauaugaugccaaauucgaaaaacaguuaggccaaaucauguuacuuauauuaugcacgagucaaauauuguuaaugaggaccacgugggcucuaugugagucuauaacccuugcaaccggaccauuaacaacauuaugggaaggauccccaggaaaauuuuggaauaccacaauagcagucaguauggcaaauauauuuagaggauccuaccuggccggugcagguuuagcauuuucccucaugaaaucacugggcggagggagacgaggcacuggggcucaaggagaaacgcuaggcgaaaaauggaaaagacaauugaaccagcucagcaaaucagaguuuaauaccuacaagcgaaguggaaucauggagguugauaggucagaggccaaagaaggauuaaagcgaggagaaaccacaaaacaugcaguaaguagagggacggcaaaauuaagaugguucgucgaacgaaauuuaguuaagccagaaggaaaaguaauagacuuaggcugcgggagaggaggguggucguacuacugcgccggacucaagaaagugacagaaguuaagggguauacuaaaggcgguccagggcaugaagaaccaaucccgauggccaccuacggauggaacuuagucaagcuacacagugggaaggauguauucuuuauuccgccagagaaaugugauacguuauugugcgacauaggagagaguucuccaaauccaacuauagaagaagggcggacacuuagagugcuaaaaaugguugagcccugguuaaggggaaaucaauuuugcaucaaaaucuuaaaccccuacaugccuagugucguagaaacgcuagagcaaaugcaacgaaagcauggcggaaugcuaguaagaaacccgcuauccaggaacucgacucaugagauguauuggguaaguugcgggacaggcaacauagucagcgcuguaaauaugacuagcaggauguuacugaaucguuuuacuauggcucacagaaaaccaaccuaugagcgcgauguggauuuaggagcagguacgagacacgucgccguagaaccggaaguugcaaaucuagauauuauaggacaacggauugaaaacauaaaacacgaacacaagucaacauggcacuacgaugaagacaacccuuauaagacgugggcauaccaugguuccuaugaggugaaaccaucuggaagcgcuuccaguaugguaaacggcguuguaaaacuuuuaaccaaaccgugggacguaauucccauggucacucaaauugcaaugacagauacgacucccuuuggucaacagagaguauucaaagaaaaaguggauacgcgcaccccgaaggcaaaaagaggaacugcgcaaauaauggaaguuaccgcuaagugguuguggggauuucugaguagaaauaaaaagccgagaauaugcacaagagaagaauuuacccgcaaagucagaaguaaugcggcuauaggagcaguuuuuguugaugaaaaccaguggaacucugcuaaggaggcugucgaagacgaaagauucugggaucuaguucauagagaaagagaauugcacaagcaagguaaaugcgccacaugcgucuauaauaugauggggaaacgagagaagaaacugggugaauuugguaaagcaaaagguaguagagccaucugguacauguggcugggagcaagguuuuuagaguucgaagcucuaggcuuuaugaaugaagaccauugguuuagccgagaaaacucgcuaucaggcguugagggagaaggauuacacaaacuuggguacauauuaagagacauaucgaaaauaccaggaggcaauauguaugcagaugauacagccgggugggauacacgaauaacggaagacgaccuucaaaacgaagcuaaaauuacagauaucauggaaccugaacacgcuuuauuagcaaaauccaucuucaagcuaaccuaccaaaacaagguaguaaggguacaaaggccagccaaaaaugguaccgucauggaugugaucagcaggcgugaucagagagggucuggacagguaggcaccuauggccugaauaccuuuacuaauauggaggcacaacuaauaagacagauggaaagugaggguauauuuagcccaucagaauuggaaaccccaaaucuagcagggcguguuuuggauuggcuagagaagcauggugcugaacgacuuaaaagaauggcaauaucaggagaugacugcguagucaaaccaauagaugaucgguucgccacagcucuaacagcacucaaugacaugggaaaagugcguaaagacauuccacaaugggaaccuucaaaaggguggaaugauuggcaacaggugccauucugcagccaucauuuucaucaauugauaaugaaagauggaagagaaauaguaguaccgugccggaaucaggacgaauuagucggacgugcccguguaagucaaggggcaggauggucauuacgagagacugcaugccuuggaaagucauacgcacagauguggcaacucauguauuuucauaggcgugaucuccgauuagcugcuaacgccauaugcucagcuguaccuguggauuggguacccacaagucguacaaccuggucgauacacgcucaucaucaauggaugacaacugaagauaugcuuaguguuuggaauagagucuggauugaagagaacccauggauggaagacaaaacucacauuagcaguuggggagacgugccauauuuagggaagagagaagaucaguggugcggaaguuuaauaggccugacagcacgagcaacuugggcaacaaauauucagguagcgaucaaucaaguccgaagauuaaucggaaaugagaauuauuuagauuauaugacgucuaugaaacgauuuaaaaacgagagugauccggagggagcucugugguaa

SEQ ID NO: 21594 - RNA, 9879 nt, Artificial Sequence
  derived and/or modified CDS sequence (opt6) from DENV-1__FJ410257__SS-prME
ucagugacaaugcuguuaauguugaugccaacagcguuggcauuccauuuaacaacccgaggaggggaaccgcauaugauaguaaguaaacaagaaagaggaaaaucauuacuuuuuaaaaccagcgccgggguuaauaugugcacauugauagccauggauuuaggagaauuaugcgaagauacgaugacauauaaauguccaagaaucaccgaagcagaaccggaugauguagauugcugguguaaugcuacggauacuuggguaacuuauggaacuugcucacaaacaggcgaacaucgacgagauaaacgaagcguagcuuuagccccucauguaggacuggggcuagaaaccagaacggaaacauggauguccucagaaggagccuggaaacaaauucaacgaguugaaacuugggcauuacgucacccuggauuuacugucauugcucuauuucuagcacacgcuauagggacuagcauaacccaaaaaggcauaauauucauacuguugauguuaguuacuccaagcauggcaaugcgauguguagguaucggcucaagagauuuuguagaaggauugucaggcgccacguggguggacguagucuuggaacauggaagcuguguaacaaccauggcaaaagacaaacccacuuuagauauagaacuucugaaaacagaaguaacaaaucccgcuguauuacgaaaacuauguauugaagcaaaaaucucgaauacaacaacugauucgcguuguccaacgcaaggagaagcgaccuuaguugaagaacaagacgcgaauuucguaugcaggcgcacauuuguggacagaggcugggguaauggaugugguuuguuugguaaagguucacucauaacgugcgcaaaguucaaaugcgugacuaaacuugaaggaaagauuguucaauaugaaaauuuaaaauauucugucauagugacaguacauacgggugaucaacaccaaguaggaaaugaaucuacugaacacgguacaacugcaacaauuacuccacaagcaccaaccaccgaaauucaauuaacugacuacggggcacuuacuuuagauugcaguccgagaacaggacuugacuuuaacgaaaugguuuuauugacgaugaaagagaaaaguuggcuaguacacaaacaaugguuucuggacuugcccuuaccauggacaucaggagcgucaacuucgcaggaaacuuggaacaggcaggaucugcucguaaccuucaaaacugcucaugcaaagaaacaagaaguagucguccuggguagucaagaaggcgcuaugcacacggcuuuaacaggggcuacagagauucaaacgucaggcacaacaaccauauuugccggacaucuuaaguguaggcuaaaaauggauaaauuaacuuuaaagggcaugucguaugugauguguaccggaucauuuaaacuugaaaaagaaguggcagaaacccagcacggcacuguguuaguacagauaaaauaugaagggacagaugcccccuguaaaauuccauucacaacgcaggaugaaaaaggcguaacgcaaaauggcagacugauaacggcuaacccaauuguaacggauaaagagaaaccggucaauauagaggcagaaccgccauuuggagagaguuacauagugauaggugcaggagaaaaggcuuuaaaauuaucaugguucaagaaaggcaguucaauuggaaagauguucgaagcgacugcuagaggugcaaggcgaauggcuauucuaggagacacugcaugggacuuuggcucuauaggggguguauucacaucaguugguaaauuaguccaccagauauuuggaacugcguaugguguauuauuuucaggggucaguuggaccaugaaaauaggaaucggcguauuauuaacaugguuaggacuaaauucaagauccacaucauugagcaugacauguauugcggugggguuaguaacauuauaucugggaguuaugguccaagcagacucagggugcguaauuaacuggaaaggcagagaguuaaaaugugggaguggcauauucguaacaaaugagguacauacauggacggagcaauauaaguuccaagcagauucacccaaaagauuaucagcugcaauuggaaaagccugggaagaggggguaugcgguauucggucggcuacgagacuugagaauauaauguggaagcaaauuucgaacgaacuaaaccauauuuugcucgaaaaugauaugaaacugacuguaguuguaggagacguugcuggcauccuagggcagggaaagaaaaugauaagaccacaaccaauggaauauaaauauagcuggaaauccugggguaaagcaaaaauaauuggggcugaugcacaaaauaccacuuuuauuauugacggaccaaauacuccagaguguccagaugaucagagagcauggaacauuugggaaguagaagacuacggauucggaauauuuacaacuaacaucuggcuuaaauuaagggauucguauacacaaguaugugaucaucguuuaaugucugcggcaauuaaggauucuaaagccguacacgcggacaugggauauuggauagaaucugagaaaaaugagaccuggaaacuugcuagagcgucuuuuaucgaaguaaaaacauguauauggccaaagucgcacacccuauggucaaacgggguuuuagaaucggaaaugaucauaccaaaaauuuacgguggaccgauuucacagcauaacuacaggccgggauauuuuacccaaaccgcagguccauggcaccuaggcaaauuggaauuagauuucgaucuuugcgaggguaccacaguuguaguagaugagcauuguggaaauagaggcccgagcuuacgaacaacaacuguuacaggaaagauuauccaugaaugguguugcagaucauguacuuuaccaccacucagauuuagaggggaggacgggugcugguauggcauggaaauaaggcccgugaaggaaaaggaggaaaaucugguaaagucaaugguuucugcgggcucgggagaaguggacucguuuucccuaggauuauugugcauuaguauaaugauugaagagguaaugagaucaagguggucaaggaaaaugcucaugacaggaacccuagcugucuucuuuuuacugauaauggggcagcuuacauggaaugauuugauaaggcuuuguauuaugguuggugccaaugcaagcgauaggaugggaaugggcacaacguacuuggcuuugauggcgaccuucaaaaugagaccgauguucgcagucgguuuacuauuccgacgauuaacaagcagggaaguacuacucuuaacaaucggacuaucccugguagcaucgguugaacuaccuaauaguuuagaggaacugggugauggacuagccaugggaauaaugauacucaaacuuuuaacagacuuccaaucacaucagcugugggccacccuucucaguuuaaccuucauaaaaacaacuuuuucucuucauuacgcuuggaagacgauggcaaugguuuuaucaauaguuucacucuucccucuuugccucucaacuacuagccagaagacaacuugguuaccuguguuguuagguucccuuggauguaaaccauuaacaauguuccucauagcggagaauaaaauaugggggcggaaguccuggccccuaaaugaaggaauaauggccgugggaauaguaucuauccuauuaucaagccuucugaagaaugauguucccuuagccggacccuuaauagcgggaggcaugcuaaucgcguguuacgugauuucagggagcucugcagaccucucacucgaaaaagcagccgaaguaaguugggaagaagaagcagaacauucaggggcaagccauaacauauuaguagaaguucaagaugaugguacuaugaaaauuaaggaugaagaacgagaugacacuuuaacaauccuguugaaagccacucucuuggcagugucuggcguuuacccgcuuagcaucccagcaacuuuauuuguaugguacuucuggcagaagaagaaacagagguccggagugcucugggauacuccgucaccuccagagguagaacgagcaguauuagaugaugguauuuauagaauaaugcagagggggcuacugggcagaagccaaguugggguuggcgucuuucaagaaaauguauuucauacaauguggcacguuacgcgcggagcuguucuaauguaccaaggcaaaagauuagagccaaguugggcaucagugaaaaaggacuuaauuucuuauggugguggguggaggcuuagagggucauggaauaccggagaggaaguucaaguuauugcaguagaaccugguaaaaaccccaaaaacguacagacugcucccgguacauucaaaacccccgagggcgaaguaggagcuauugcacuagacuuuaagccagggacaaguggaucacccaucgucaacagagaggggaagauuguagguuuauacgguaacggaguaguuacuacuagcggaacguauguuagcgcuauagcgcaagcgaaagccucccaagagggcccauuaccagaaauagaagaugaaguuuuccgaaaaagaaaucuuacuauaauggauuuacacccggggucuggaaaaacccgccguuauuuaccagcaauaguccgagaggcaauaaaaagaaaauuacgaacuuuaauacucgcaccaacaagagucguugcaucagaaauggcugaagcacuuaaaggcaugccgauacgguaccaaacgacagcuguaaaaucagagcauacgggaaaagaaauaguugauuugaugugccaugcuacauucacaaugcgacuacucuccccgguccguguaccaaauuacaauaugauaauaauggaugaggcucauuuuacagauccuaguagcauagcugcgcgaggauacauaucuacacguguaggaaugggugaggcugcugcgauuuuuaugacagcgacuccacccgguucaguagaagcauuuccucagagcaaugcuguaauucaagacgaagaaagggauauacccgagagaaguuggaacucaggauacgaguggauaacagacuuuagcggaaaaacaguaugguuugucccuuccaucaaguccggcaaugauauugcaaauugcuuacggaagaauggcaaacgaguuauacaacucagccgcaaaacguucgauacggaguaucagaaaacuaaaaauaacgauugggauuauguaguaacaacagauauauccgaaaugggugcuaauuuucgugcggauagaguaauugauccacgaagaugucuaaagccaguaauauuaaaggauggacccgaacguguuauacuugcaggaccuaugccaguuacuguggcuagcgcggcccagagacgagggcgcauaggaagaaauuacaauaaagaaggugaccaauauauauauaugggacaaccauugaauaaugacgaagaucaugcucacuggacggaagcaaaaauguuauuagacaauauuaacacaccugaaggaauaauaccagcacuuuuugaaccagaaagagagaaaagcgccgccgucgauggggaauaucgauugcgcggugaagcucgaaaaaccuuuguugaauuaaugcggagaggagacuugccagucuggcuaucuuacaaagucgcgagcgagggcuuccaauacucagaucggcgcuggugcuuugauggcgaacgcaacaaucaagucuuagaagaaaauauggaugucgagauauggaccaaagaaggggacagaaagaaacuacgaccacgaugguuagacgcgagaacuuauucugauccucuugcccugagagagcuaaaagaguuugcggcuggacgccguucaguaucuggagauuuaauuuuggaaauaggaaaacugccgcaacauuugacgcagagagcucaaaacgcacuagauaaucuugucauguuacauaauagugaacaaggaggucgagcauauagacaugcaauggaagaacuaccugauacuaucgaaaccuuaaugcuauuagcauuaauagccgucuugacugguggggugacacuauuuuucuuauccggccguggcuuagguaaaacaaguaucggacugcuuugugugauggcaucaucuguccugcucuggauggcaucaguggagccccauuggaucgcagcuagcauuaucuuggaguucuuucuuaugguguuacuuauaccggaaccagaucgucaaaggacaccccaagauaaucaacuagcuuaugugguaauaggccuacuauucaugauuuuaacuguugcagcaaaugagauggggcuacucgaaacuaccaagaaagaccuaggaauuggucauguugcgguagaaaaucaucaccacgcugcgauguuggauguagaucuacacccagccagugcguggacgcucuaugccguagcuacgacaauuauuacgcccaugaugcgacauacaauugagaacacuacggcgaacaucucuuuaacggcaauagcaaaucaggcagccauacuuaugggccuugacaaaggcuggcccauaagcaaaauggauauagguguaccguuauuggccuuaggauguuacagucaagucaacccccuuacucuaacagcagcaguucugauguuaguggcccacuaugcaauaauuggaccggguuugcaagcaaaagcuaccagagaagcucaaaaacgaacagcggcuggaaucaugaagaacccaacugucgauggcauagucgccauugaucuagacccaguaguauaugaugcaaaauucgagaaacaauuagggcagauuauguuguuaauuuuguguaccucacaaauucuccugaugcgaacuacuugggccuuaugugaaaguauuacucuggcaacuggaccucuaacaacccuuugggaagggucaccaggcaaauucuggaauacaaccauagcaguuucaauggcgaacauauuccgcggaucauaccuagcaggggcgggccucgcauucaguuuaaugaaaucucuagggggaggaagacgagggacaggcgcucagggggaaacacuuggugagaaauggaaaagacaauugaaucaauuaaguaagucugaauuuaauacauauaaaagaucagggauuauggaaguugacaggagugaagcaaaagaaggguuaaagagaggagaaacgacaaaacaugccguaucacgugguacagcaaaacuuagaugguuuguggaacguaaccuaguuaaaccugaagguaagguuaucgaccucgguugcggacguggagguuggaguuacuauugugcgggccuaaagaaaguaacugaaguaaaaggauauacaaaagguggaccggggcacgaagaacccauaccgauggcaacguacggauggaaccuagugaaacuccauagcgggaaagacguauuuuucauuccaccugaaaagugugauacauuacuaugcgacauaggagaauccuccccuaauccaacgauugaagaaggacguacauugcggguacuaaaaauggucgaaccuuggcuccgggguaaucaauuuugcauuaaaauacuaaauccguauaugccgagcgugguggaaacguuagaacaaaugcaacguaagcauggaggaauguugguacgaaauccccuuagcagaaauaguacacacgagauguacugggucucuuguggcacaggaaacauugucagcgcgguaaacaugacaucccggaugcugcuaaaccgguuuacaauggcacauaggaaaccaacauacgaacgugauguggacuuaggaacaggcaccaggcacguggcuguggaaccagaagucgcgaaccuagauauaauaggacaacgaaucgaaaacauuaaacaugaacacaagucaacguggcacuacgacgaagauaacccauacaagacaugggcguaccacgggagcuacgaagucaaaccaagugguuccgcaaguaguaugguuaacgggguugugaaauuguugacaaaaccaugggacguaauucccaugguaacgcagauagcaaugacugauacaacuccguucgggcaacagcguguguuuaaagaaaaaguggauaccagaacaccaaaagcaaaacggggaacugcccaaaucauggaaguuacugcacgaugguugugggguuuccuaagucguaacaagaaaccccgaaucugcacucgugaagaauuuacccgaaaaguaagaucuaacgcagcuauaggagcgguauucguagacgaaaaccaauggaacucagcaaaagaagcagucgaggacgaacgguucugggaucugguacacagggagagagaacuccauaaacaagguaaaugugcuacauguguuuacaauaugaugggaaagcgcgagaagaaacuuggagaguucggaaaagcaaaagguucaagggccaucugguauauguggcuuggggccagauuucuagaauuugaagcauuaggauucaugaacgaagaccauugguucagucgggaaaauagccuuagcggcguagagggugaagggcuccacaaauuaggcuacauauugagggauauaucaaagauaccuggugggaauauguacgcugacgacaccgccgguugggauacaagaauaaccgaagacgaccuacaaaacgaagcaaaaauaacugauauaauggaaccagaacaugcacuccuagccaaagcuauauucaaacuuaccuaucaaaauaagguagugagaguucaacgaccggcgaaaaauggaacugucauggaugugaucucaaggagggaccaaagaggaaguggucaaguuggaacguacggcuuaaacacuuucaccaauauggaagcacaauuaauacgacaaauggagagcgaaggcauauuuagcccuagcgaauuagaaacaccaaacuuagccgaaagagcuuuagauuggcuagaaaaguacggaguagaacgccuuaaacgaauggcaauaagcggcgaugauugcgugguaaaaccgauagaugaccgguuugcaacggcucuaacagcgcuaaacgauaugggaaagguucgcaaggauauuccacagugggaaccuaguaaaggcuggaaugacuggcaacaaguaccuuuuuguucacaucauuuucaucaauugauaaugaaagauggcagagaaauaguaguuccuugccggaaucaagacgaguugguaggacgagccagaguuagucaaggagcuggauggagcuuaagagaaaccgccugucuaggcaagucauaugcacaaauguggcaacuaauguauuuucauagaagagaucuuagacuggcagcgaacgcuauauguucugcgguccccguugauuggguccccacaucaaggacaacaugguccauacaugcccaccaucaauggaugacgacagaggauauguuaagcguguggaauagagucuggauagaagaaaaucccuggauggaagauaaaacucauauaucuaguugggaggauguuccauaucuagggaagcgagaggaccaauggugugggucucucauaggccucacagcacgcgcgacuugggcaacaaauauucaagucgcuauuaaccaggucaggagacuaaucggaaacgaaaacuaccuggacuauaugaccagcaugaaacgguuuaagaacgaaucugauccugagggugcucuuugguga

SEQ ID NO: 21595 - RNA, 9879 nt, Artificial Sequence
  derived and/or modified CDS sequence (opt6) from DENV-1__FJ461332__SS-prME
ucuguuacgaugcuguuaauguuaaugccuacagcauuagcguuucauuuaacaacuagagguggugaaccacacaugauaguuagcaaacaagaacguggaaaaaguuuacuauuuaaaacaagugcaggcguuaauauguguacccuuauugcaauggaucuuggagaauuaugugaagauacgaugacuuacaaaugcccucgaauaacagaagcugaaccagaugauguagauugcugguguaaugcaacggacaccuggguaacauauggaacuuguucccaaaccggugaacauagaagagacaaacggaguguagcucuagcgccccauguaggacuuggucuugagacgagaacugagacauggaugagcagugaaggggcauggaaacagauucaaagaguagagaccugggcacuaagacacccaggauuuacgguaauugcucuauuuuuagcucaugcaaucggaacaucaaucacacaaaaagggauaauuuuuauucuauugaugcuggugacgccgaguauggcaaugcggugcguagggauaggaucacgagauuuuguggaaggacuaaguggagcaacauggguagacgugguguuagaacauggcucuuguguaacgacuauggcuaaagacaaaccaacccucgacaucgaguuauuaaaaacggaaguaacaaauccagcaguuuuacgaaaacucuguauugaggcuaaaauaucgaauaccacuaccgacucacgauguccaacgcaaggggaagcaacucuagucgaagaacaagaugcuaauuuugucuguagaagaaccuuuguagacagaggaugggguaauggcugcggauuguuuggaaaagguucacugaucacuugcgcaaaauuuaaaugcguuacgaagcucgaaggaaaaauuguccaauaugaaaaucuuaaguauucaguaauaguaaccguucauacgggugaucagcaucaagucgggaaugaaagcacugaacaugguacgacugcaacuauaaccccacaagcuccuaccacggaaauacaacuaacagacuauggugcauuaaccuuagauuguucgccuagaacaggucuagacuuuaaugaaaugguuuugcuaacuaugaaagagaaaaguugguuaguccauaaacaaugguuuuuagaucuaccccuaccauggacuucuggagcaucaacaucccaagaaacauggaauaggcaggaccuuuuagugacguucaagacagcucacgcgaagaagcaagaagugguaguacuugguucucaagagggugcuaugcauacugcauuaacgggagcuacggaaauccaaacaucagguacaacgacaauauucgccgggcaccucaaaugucguuugaaaauggauaaauuaacauuaaaaggaaugaguuauguaauguguacagguaguuucaaacuugaaaaagaaguggccgagacacaacauggcacuguuuuaguacaaauuaaauacgaaggaaccgaugccccaugcaaaauaccauucucaacacaggacgaaaaagguguaacacaaaacggacgacuaauaacggcaaauccuauuguaacugacaaagaaaaaccagugaauauagaagcagagccgccauucggagaauccuacauaguaauaggagcgggagaaaaagccuugaagcuaaguugguuuaagaaagggaguucgauugggaaaauguuugaagcuaccgcgagaggagcaaggcgaauggcuauacuuggggauacagcaugggauuuuggaucaauaggaggaguauuuacaucaguuggaaagcuaauccaucaaauuuuugguacugcauacggagucuuauucucagguguaucuuggacaaugaagauugguaucggaguauuacuuacuuggcuagggcuuaauaguaggucaacaagucuaucgaugacauguauagcgguuggacugguaacauuauaucuuggaguuauggugcaagccgacagcgguugcguuauaaauuggaaaggcagagagcuaaaaugugguucugguauauucguuacuaacgagguacauacuuggacagaacaguacaaauuccaagcugauagcccaaaaagauuaucagcagcaauuggaaaggcuugggaagaagguguauguggaauuagaagugcgacacgcuuagaaaauauuauguggaagcaaaucaguaacgaauuaaaccacauacuacuagaaaaugauaugaaguuaacuguaguaguuggugaugucgcggguauucuaggccagggcaagaaaaugaucagaccacaaccaauggaauauaaauacuccuggaagaguuggggaaaagcgaagauaauaggggcagaugcgcaaaauacaacuuuuauaauugacgguccuaacacgccagagugcccagaugaccaacgcgcauggaauauuugggaaguggaagacuacgguuuugguauauuuacaacaaauauuuggcucaaauuacgagacucauauacccaaguuugcgaccaucgcuugaugagugcagcaauuaaagauaguaaagcaguccacgcagacaugggauauuggauagaaucagagaaaaaugaaacauggaaacuugcaagagcgucguucauugaaguaaaaaccugcauuuggcccaagagccacacauuauggucaaacggcgucuuagaaagcgagaugauaauaccaaaaauauauggagggcccauuagccaacauaacuauaggccugguuacuucacucaaacagcgggaccguggcauuuagggaaguuggaacuugacuucgaucugugcgaagguacaacaguaguaguagaugaacauugugguaaucgcggaccaucguuacgaaccacuacagucaccggcaagauaauacacgaauggugcugcagaucuuguacucuacccccuuuacgauucagaggggaagacggauguugguacggcauggaaauccguccaguaaaggaaaaagaagaaaaucuuguaaaaucaaugguuucggcaggaucgggugaaguugacuccuuuagucuagggcugcucuguauaucuaucaugauagaggagguuaugagaucaagauggucaaggaaaauguuaaugacuggaacauuagcgguauucuuuuuauuaauaaugggacaguuaaccuggaacgaucucauuagacuauguauaaugguuggcgcgaaugcauucgaucgcauggguaugggcacaacauaucucgcucuuauggccacauuuaaaaugaggcccauguucgcaguggggcuucuauuuagaagauuaacaagucgggaaguccugcuuuuaacaauaggauuaucccuaguggcaagugucgaauuaccaaauucccuggaggaacucggugacggucucgcaaugggaauuaugauucuuaaacuauugaccgauuuccaaucccaucaguuaugggcuacacucuugucccuuacauuuauaaaaaccacauuuucacugcauuacgccuggaaaaccauggcuaugguacuuucaauagucagucuuuuuccgcugugcuuauccacgacaucacagaaaacuacauggcucccuguacuucucggcucucugggcuguaagccuuuaacaauguucuugauagcugaaaauaaaauauggggaagaaaauccuggccucugaaugaagguauaauggcggugggcauagucucaauccuccucucaucauuacuaaagaacgauguaccuuuagcugguccauuaauagccggugguaugcuaauugcaugcuauguuauuagugguucauccgcagaccucagccuggaaaaagcagccgaaguaagcugggaagaagaagcugagcauucaggagcaagccacaauauucuuguagagguacaagaugaugggacaaugaaaauaaaagaugaagaaagagacgauacguuaacaauacuacuuaaagcuacucuucuggcuguuucuggaguauacccacuuucuauaccggcuacacucuucgugugguacuuuuggcaaaagaagaaacagagaucuggaguauuaugggacacacccucaccuccugucguagagcgagcaguacucgacgauggaauuuacagaauaaugcagcggggcuuacuuggaagaucucaaguugggguaggcguuuuucaggagaacguuuuucauacaauguggcacguaacucgcggagcuguccuuauguaucaaggaaaacggcuggaaccuaguugggcaaguguuaagaaagaucugauaucauacggaggcgguuggcgucuucgcgggagcuggaauacgggagaggaagugcagguaauugcagucgaaccuggcaaaaacccuaaaaacguacaaacagccccuggaacuuuuaaaacgccggagggcgaggucggcgcuauagcauuagauuuuaaaccagguacuucuggaagucccaucgugaaccgcgaagggaaaauaguaggacuuuaugguaauggaguugucacaaccucggguacauacguaagugcgauagcacaagcuaaagcaagucaagaagguccuuugccagaaauugaggaugaagucuuucguaaaagaaauuugacaauaauggaucuccauccaggauccgggaaaacgcgucgauaccuuccggcuauaguaagggaagcuauuaaaagaaaacuaagaacacuaauucuagcgccaacucgugucgucgcaucugaaauggcagaagcauuaaaagguaugccaauucgguaucaaacgacagcggugaaaucagaacauaccgguaaagaaauuguggauuuaaugugucaugcaacauuuacaaugcgauuacuguccccugugcgaguaccuaacuauaauaugauaaucauggaugaggcacauuuuaccgacccaucuaguauugcagcacgagguuacauaagcacuaggguagggaugggagaagcggcugcaauuuucaugacagcaacaccuccagguucuguagaagcguucccccaaucuaaugcagugauacaagaugaggagagggauauucccgaaagaaguuggaauagugggcacgaauggauuacggacuuuccaggaaaaacgguaugguuugugcccucuaucaagaguggaaaugacauagccaauuguuuaaggaaaaaugggaagagagucauccaauuaucacggaaaaccuucgauaccgaauaucagaaaaccaagaacaaugauugggauuacguuguuacgacggauauuuccgagaugggggcgaauuuuagggcggaccgagugauagauccgaggcgauguuuaaaaccuguaauccugaaagaugguccugaaagaguuauuuuggcuggaccuaugcccguaacuguagcuagugcagcgcaaaggcguggaagaauaggaagaaaucauaauaaagaaggcgaccaauauauuuacaugggucagccuuugaacaaugaugaagaccacgcacauuggacggaggcaaagauguuauuagacaauauaaacacacccgaagggauaaucccggcauuauuugaaccagaacgagagaaaagugcugcaguugacggagaauauagauuacgcggagaagccagaaaaacguuugucgaacucaugcgucgaggcgacuuaccuguuugguugucguauaagguggcaucggagggguuucaauauucggaccgccgcugguguuuugacggugaacggaauaaucagguauuagaagaaaauauggauguggaaauauggacaaaggaaggggagaggaagaaacuaagaccccgauggcucgaugcacgaaccuauucggacccauuagcgcuacgcgaguuuaaggaauuugcagcgggucggagaagcguauccggagauuuaauuuuagagauuggaaaguuaccacaacaccucacccaaagggcgcaaaaugcccuugauaaccuagucaugcugcauaauucagaacaaggagggagagcguauagacaugcaauggaagaacuuccagacaccauugaaacacucauguuauuagcauugauugcuguucuaacuggaggagucacucuguucuuucuaucagguaggggucugggaaaaacgucaauuggccuacucugugugauggcuucaaguguauuauuauggauggcgagugucgaaccgcauuggaucgcugcuucaauaaucuuagaguucuuucuuaugguucuuuuaauuccagaaccagaucggcaaaggacgccgcaggauaaucaguuagcuuacgugguuauuggacuuuuguuuaugauacuaacgguagcugcaaacgaaaugggauuacucgaaacaaccaagaaagacuuggguauaggacaugucgccgucgaaaaucaccaucaugcagcaaugcuggacguggaccuucauccagccucagcauggacgcuauacgcaguggcuacaacuaucauaacacccaugaugagacacacaauagaaaacacaacugccaauaucagcuuaacagcaauugcaaaucaggccgcaauacucaugggacuugauaaagguuggcccauuucaaaaauggauauaggagugccauuguuagcguugggguguuauagucaaguaaauccacucacauugacugcggcgguacuuaugcuaguugcacauuacgcuauuauagggcccggauuacaagcaaaagcgaccagagaagcucagaagagaacggcagcugggauuaugaaaaacccuacgguagaugguauaguggcaauagaucuagacccuguaguauaugaugugaaauucgaaaagcaauuaggacagauuauguuacucauuuuaugcaccagccaaauuuugcucaugaggacaacuugggcuuuaugcgaaucgaucacacucgcaaccggcccauuaacaacgcuuugggagggaucaccuggcaaguuuuggaacacgacuauagcggugucuauggcaaauauauucagagguucguaucuugccggugcagguuuagcauuuaguuuaaugaaaaguuuaggaggcgggaggaggggaacaggagcccagggugaaacgcuaggagaaaaauggaaacggcagcuaaaucaacuuagcaagucggaauuuaauacauauaaaagaucaggaauuauggaaguagacagaucagaagcaaaagagggauuaaaaagaggagagacuacuaagcacgcaguaucuagagggaccgcaaaacugagaugguuuguggagagaaauuuggugaaacccgaaggcaaagugauugaucuaggaugcggucgagguggauggaguuauuauugcgcgggucugaagaaaguaaccgaaguaaaggguuacacuaaagggggccccggacacgaagaaccuaucccaauggcaacauauggauggaacuuaguuaaacuucauaguggcaaggauguauucuuuauuccuccagaaaaaugcgacacacuccuaugugauauaggagaaucguccccaaauccaacuauagaggaaggaagaaccuuaaggguacuaaaaaugguagaaccauggcuuagaggaaaucaguuuuguauaaaaauacuaaauccguacaugccuaguguuguggaaacauuagaacaaaugcaaagaaaacaugggggaauguuagugcgaaauccacuaucucgcaacucuacgcacgaaauguacugggucucuugugggacagggaacauaguuagcgccguaaacaugacaucuagaauguuacucaaccguuucacaauggcacaucgcaaaccuacguacgagcgagacguagaccuugguacuggcacacgucaugucgcaguagagcccgagguagcuaaccuugauauaauuggucaacgaaucgaaaauaucaaacaugaacauaaaaguacuuggcauuacgacgaagauaauccauauaagacuugggcuuaucacggaaguuaugaaguaaaaccgucaggauccgcaagcagcaugguaaacggggugguaaaauuacuaacaaaaccuugggacgugauaccaaugguaacgcagauugcaaugacagauacaacaccuuuugggcagcaaagaguauuuaaagaaaaaguagacacacgaacuccaaaagcuaaaagaggaacagcgcagauaauggaagucacagcccgauggcuauggggauuuuuaagucgaaacaagaaaccacgcauauguacccgugaagaauuuacucguaaaguuagaagcaacgcagcaaucggggcuguguucguagaugaaaaucaguggaauagugcaaaagaagcaguugaggaugaacgauucugggacuuaguccauagggaaagagaacuacacaagcaagggaaaugugcuacaugcguguauaacaugaugggcaaacgcgagaagaaauuaggagaauuugggaaggcgaaaggaagucgagcuauaugguacauguggcuaggagcuagguuccucgaauuugaggcucuaggauuuaugaacgaggaccacugguucaguagagaaaauucccuuucaggcguugaaggcgaaggacuucauaaacuuggauauauacuacgagacaucuccaaaauuccagguggaaauauguacgccgaugauacagcgggaugggauacgaggaucacagaagacgaucuucagaaugaggcgaagauuacugacauaauggaaccggaacaugcacuccuugccaaagcaauauucaaguuaacguaucaaaauaaaguuguuagaguacaaaggccagccaaaaacgggacgguuauggauguaauaucaaggcgggaucagagagguuccgggcaagugggcacauauggccuuaacacguuuaccaauauggaggcccaacuuauaaggcaaauggaaucagagggcauuuucucuccuucagaauuagagacgccaaaccuagcagagagagcucuggacugguuggaaaaguacggaguagagaggcuuaaaagaauggcuauaagcggagacgacugcguuguaaaaccaauagacgauagauuugcgaccgcccucacagcuuuaaaugauaugggaaaaguaagaaaagauaucccucaaugggagccgagcaagggauggaaugauuggcaacaaguuccuuuuugcagucaccacuuucaucagcugauuaugaaagacgggcgugaaaucguuguaccauguagaaaucaagacgaacuugucggaagggcaagagugucacaaggggcgggauggucuuuaagagaaacagccuguuuaggaaaauccuacgcacagauguggcaauuaauguauuuccacaggcgagauuuaagacuugcggcgaaugcuauuuguagcgcaguaccaguagacuggguaccgacaagcaggacgacuugguccauucaugcccaucaucaauggaugacaacugaagacaugcuaucaguauggaaccgaguguggauagaagaaaacccauggauggaagauaagacucacaucagcagcugggaggacguaccguaccuagggaaacgagaagaucaauggugcggaucucugauaggauugacagcaagggcuacaugggcaacuaacauccagguagcuauaaaccaagugcguagauuaauaggaaaugaaaauuaucuagacuacaugacaucgaugaagagauuuaaaaaugaaucugauccugaaggagcccuuugguaa

SEQ ID NO: 21596 - RNA, 9879 nt, Artificial Sequence
  derived and/or modified CDS sequence (opt6) from DENV-1__FJ461333__SS-prME
agcguaacuaugcuucuaaugcucaugcccacugcguuggcauuucaccugacgacuagggguggagaaccccacaugguuguaucaaaacaagaaagagguaaaucucuuuuauucaaaacuagcgcuggggucaacaugugcacguuaauagcaauggauuuaggagaauuaugugaagacacuaugacguauaaaugcccaagaauuacugaagcagaacccgacgauguagacugcugguguaacgcuacagacacuuggguaaccuaugguacuugcagucaaaccggggaacauagacgagauaaaagauccguagcacuugcaccacacguaggccuuggccucgaaacacgaacagaaacguggaugucaagcgaaggggcauggaaacaaauccaacguguagaaaccugggcucuaagacauccuggauuuacaguaauagcacuauuuuuagcucaugccauugguacgaguauaacacaaaaaggaauaauauucauucugcuaauguugguaacuccaaguauggccaugagauguguuggaauaggcucuagggauuuuguugaaggguuaucaggcgcaacguggguagacgugguccuagaacauggguccugcguaaccacaauggcaaaagacaaaccuacucucgauauugaacuacuuaaaacggaagucaccaauccagccauauugcgaaaacucugcaucgaagcaaaaauaucuaauaccacaacagauucuagguguccaacgcaaggugaggcuacauuaguagaagaacaagaugccaauuuuguuugcaggcguacauucguugaucgagguuggggcaaugguugcggguuauuuggcaaagguucucuaauaacgugugcuaaauuuaaauguguuacuaaacuagaaggaaaaauagugcaauacgaaaaccugaaauacuccgucauaguuaccguccauacuggagaucaacaccagguaggaaacgaaucuacugaacacgguacgacagcaacaauaaccccacaagcacccaccacagaaauacagcuuacagauuauggggcguugacucuggauuguagcccaagaacaggccucgauuuuaacgagauggucuuacuuaccaugaaagagaaaucaugguuaguacauaagcaaugguuccuggaucugccgcucccguggacaagcggcgccucuacuucccaagaaacauggaauagacaagaccuauuaguuaccuuuaaaacagcgcaugcaaagaagcaggaggugguuguucuggguucacaggaaggggcaaugcacaccgcccucaccggagccacagaaauucagacgucaggaacuacuaccauauuugcaggucaucuuaaaugcagauuaaaaauggauaaauuaacuuuaaaggguaugaguuacguaaugugcacagguagcuuuaaauuagaaaaagaggucgcugagacacaacacgggacaguauugguacaaaucaaauaugaggguacugaugcaccuuguaaaauucccuuuaguacgcaagaugaaaaaggcguaacucaaaauggacgauuaauuacagcuaauccaaucgucacugauaaggaaaaaccuguaaauauagaagcagaacccccguucggagaaaguuauauugugauuggagcuggcgaaaaagccuugaaauugagcugguucaagaaaggaagcagcauagguaaaauguuugaagcaacagcaaggggagcaagacgcauggcuauccucggagauacagcuugggacuuugggaguauuggagguguuuuuacaaguguuggcaaauuaguacaccaaauauuugggaccgccuaugguguacuauucucaggaguaagcuggaccaugaaaauuggacuaggcguucuguuaacauggcucgguuuaaacaguagguccacaaguuuaaguaugacauguauagcaguuggcuuaguaacccuauaucugggggugaugguacaagcagacucagggugcgugaucaacuggaaaggaagagaacuaaagugcgggaguggaauauuuguaacuaaugaaguacacaccuggacugaacaauauaaauuucaggcagacagcccuaagagacuaagugcagccauaggaaaggccugggaggaaggaguaugcggaauacggagugccacucgucuagagaacgucauguggaagcaaauuucuaacgaacuuaaccauauacuauuagaaaacgacaugaaguuuacuguaguagucggggauguugcgggaauuuuggcccaaggaaagaagaugauacgaccacagccgauggaacauaaauauucauggaaaucuuggggaaaagcuaaaaucauaggcgcggacguacaaaacacuaccuuuauaauagauggcccaaauacgccagaaugcccagaugaucagagggcauggaauauaugggagguagaagacuacgguuucggaauuuucacaacaaauauaugguugaaauuacgagauagcuauacccagguaugcgaccaccgacuuaugucggcugcuauuaaagacaguaaagcuguacacgcagacaugggguacuggauugaaucagagaaaaacgaaacauggaaguuagcacgugcuucuuucauagaaguuaaaacuuguaucuggccuaaaucgcacacuuuauggucaaacggugugcuagaaagugagaugauuauaccgaaaauauauggaggaccaauuagucaacauaauuaccggcccggauacuuuacacaaaccgcaggaccauggcauuuagggaaacuagagcuggacuucgaucugugugaaggaacaacaguaguuguggacgaacacugcgguaauagagguccgagucucagaaccacaaccgucacaggaaaaaucauucacgaaugguguugucgauccugcacacuuccgccauuacguuuuagaggugaagacggauguugguauggaauggaaauacgcccuguaaaagagaaagaagaaaaccuaguuaaaucgaugguaucugcaggcaguggugagguggauucuuuuagccuuggacuauuauguauaaguaucaugaucgaggaagucaugcgaucccgauggucgaggaagauguuaaugacagguacuuuagcuguauuucuguugcuaaucaugggacaacuuacuuggaaugauuuaaucagauuguguaucaugguuggagcuaacgccagugauagaaugggaaugggaacaacauauuuagcucuuauggcuacguuuaaaaugagaccgauguuugccguuggacuauuguuuagacguuugacaucacgagaaguccuccuauuaacaaucggguugagccuaguagccagcguugaauuaccuaacagccuggaggaauuaggggacgggcuagcaauggggauaaugauacuuaaauuacugacagauuuccaaucgcaucagcuaugggccacccuacuauccuuaaccuucauuaagacaacauuuagccuucauuacgcauggaaaacuauggcaaugguuuugucgauaguuagccuauuuccauugugccuaucaaccacgucccagaaaaccacaugguuacccguauuauugggaucacuagguuguaaaccccuaacaauguuucucaucgcagagaacaagauuugggguagacgcucuuggcccuuaaacgaggguaucauggcgguagguauaguaucuauauuauuaucaucacuucuaaagaacgacgucccguuagccgggccucugaucgcaggaggaaugcugaucgcauguuacguaauauccgguucgagcgccgauuugagucuagagaaagcugcugagguaucuugggaggaagaagccgaacacucgggagcuucgcauaauauauugguagaaguccaagaugacgguacaaugaaaauaaaagaugaggagagggaugauacacuuaccauacugcuuaaagcaacgcuucuagcaguaucaggaguauauccacuaucaauaccggcaacguuauuuguaugguauuucuggcagaaaaagaaacaaaggucuggaguuuuaugggauacaccuuccccaccagaagucgaacgggcuguccucgaugauggaauauaccguauaaugcaaaggggccuacuagggagaucacaaguaggcgucggaguauuucaggaaaauguuuuccacacaauguggcauguuacuagaggcgcaguucuuauguaucagggaaagaggcuagaaccauccugggcgagugucaagaaagaccuuauuagcuacgggggcggcuggaggcuccaaggaaguuggaauacaggggaagagguacaaguaauagcggucgaaccaggcaagaacccgaaaaauguacaaacagcaccaggaaccuuuaaaacaccagaaggagaaguuggcgcuauugcacuugauuucaagcccgggaccagcggcaguccuauuguaaacagggaaggcaaaaucgucggcuuguacggcaauggaguaguaacuacaagcggaacguauguaagugcuauagcgcaagcgaaagcaucgcaagaaggcccccuacccgaaauugaagacgagguauuuagaaagcgcaaucuaacaauaauggaucuccacccuggaucuggaaaaacuagacgguacuuaccggccauagucagggaggcaauaaagcgaaaguuacguacauuaauacuugcgccgacuaggguaguugcgagugaaauggcagaagcgcuaaaagggaugccuauacguuaucaaaccacagcuguaaaaagugaacauacagggaaggaaauaguagauuuaaugugucaugcuaccuuuacaaugagauuacugagcccgguucgaguucccaacuauaauaugaucaucauggaugaggcucacuucaccgacccaucuucuauagccgcuaggggauacauaucuacccgaguagguaugggagaagcagcagcgauauuuaugaccgcaacgccacccgggagugucgaagcauucccccaaucgaaugccguuauacaggacgaagagagagauauuccugaaagaagcuggaacucugguuaugaguggaucacagauuuccccggaaagacaguuugguuuguuccgagcauaaaaucuggaaacgauauagcuaauuguuugagaaagaacggcaaacggguaauacagcucagccgaaagacauuugauacugaauaucagaaaaccaagaauaaugauugggacuacguagucaccacagauauaagugaaaugggcgcaaauuucagggcugaccgcguaauugacccacgucgguguuuaaaaccagucaucuuaaaagauggcccggaaagaguuauccucgcugggccuaugccagucacgguugcgucugccgcacaacgaagagguaggauaggaagaaaccacaauaaagaaggggaccaguacauauauaugggucaaccacuaaauaacgacgaggaccaugcucauuggacagaagcaaagauguuguuagacaacauaaacacucccgaaggaauaauaccagccuuguuugagccugaaagagaaaaaucagcagccauagauggugaauauagacuucgaggcgaagccaggaaaacauuuguugaacuaaugagacgaggagaucuaccaguguggcuuucuuacaaaguugcaagcgaaggauuccaauauagugauaggcggugguguuucgauggugagcgaaauaaccaagugcuagaagagaacauggauguugagauauggaccaaagaaggggaaaggaagaaauuacgcccaagaugguuagaugcucgaacauacagugauccacucgcacuaagagaguucaaagaguucgcugccggucggagaagcguuucaggagaucuuauacuggaaaucggaaaacuuccacaacaucugacacagagagcgcaaaaugcacuagacaaucuuguaaugcugcacaauucagaacaaggagggcgugcauaucgacaugcaauggaagaauuaccagacacaauagaaacacuaaugcugcuugcauuaauagcaguuuuaacaggagggguuaccuuguucuuucuuuccggaaggggauuggguaagacaaguauuggucuacucugcguaauggcaucaaguguacuccuuuggauggcuaguguagaaccccacuggauagcagcaucuauaauccuagaguucuucuugaugguacuauugauaccagaaccugauaggcaaagaacuccccaggauaaucaauuggccuaugugguaauuggucuguuguucaugauacuuacagucgcagccaacgaaaugggucuacucgagacuacgaaaaaggaccuuggaauaggacacgcagcggucgguaaucaucaucacgcagcaaugcuggacguugauuuacauccggcuucugcauggacuuuguaugcagucgcaacaaccauuauaacucccaugaugaggcauaccauagaaaauacaacugcgaacaucaguuuaacugcaauugcaaaccaagccgcgauuuuaaugggauuggacaaaggguggccuauuuccaaaauggauauugguguaccguuacuagcguuaggaugcuauagucaaguuaauccgcugacuuugacggcggcugugcugaugcugguugcccacuaugcaauaauagggccaggacuacaagcaaaggccacacgugaagcacagaaaaggacagcagcugggauaaugaaaaauccuaccguagaugguaucgucgcuauugauuuagauccuguggucuacgacgcaaaguucgaaaaacaacuaggucaaauaaugcuccuuauacuuugcacaagucaaauacuucuaaugcggacaacgugggcacuaugugaaagcaucacccuugcaaccgguccucugacuacauuaugggaaggcucucccggaaaguuuuggaauacaacgauugccguguccauggcaaauauuuuccguggauccuaucuagcaggcgcaggauuggccuucucucuaaugaaaucucugggaggaggccgacgagggaccggcgcgcaaggugaaacauuaggggaaaaguggaaaagacaacuaaaccaacugucaaaaagcgaguucaauacguacaaacgaucagguauaauggaggucgaucgaagugaagcaaaagaaggguuaaaaaggggugaaaccaccaaacacgcgguuucaagaggaacagccaaacuuagaugguucguggaacgaaaucucgucaagccggaagguaaaguaauagaucugggcuguggaagaggcggcuggaguuauuauugugcgggacuaaagaaggugacagaagugaagggguacacgaaagguggcccgggacaugaggaaccaaucccgauggcgaccuacgguuggaauuuagugaaacuacacagcgguaaagauguguucuuuauaccaccagaaaagugcgacacacuguuaugcgauauaggcgagagcucgccuaacccaacuauagaagaagguagaacccuaagaguccuaaagaugguugaaccauggcuaagggggaaucaauuuugcauuaaaauccuuaacccauauaugccuagcguuguagaaacauuggaacagaugcagagaaagcauggugguauguugguaagaaauccauuaucuagaaauucuacucaugaaauguauuggguuucaugugguacggguaauauaguaucagcgguuaacaugacaaguaggaugcuauuaaaccgguucaccauggcacauaggaagccaacguaugaaagagauguugaccuuggcgcagguacgcgacacguagcggucgagcccgaaguggcgaaccuagauauaauaggacagaggaucgagaauaucaaacaugaacauaaaucaacauggcauuaugacgaagacaauccuuacaaaaccugggcguaccacgguucuuacgaaguuaaaccaagcggcucugcaucaagcaugguuaacgguguagucaaauuauuaacaaaaccaugggaugucauaccaaugguaacacaaauagcaaugaccgacacuacuccuuucggacagcaacguguauuuaaagagaaaguagauacacguacucccaaagcaaaaagaggaacugcccaaauaauggaggugacggcaaaguggcuaugggguuuucugucuagaaauaagaaaccccgcauauguacucgugaagaauuuacacggaaaguuagaucuaaugccgcgauaggugcaguauuuguagaugaaaaucaguggaacucagcuaaggaagccguagaagaugaacgcuuuugggauuugguacaucgugaaagggagcuacauaagcaagguaaaugcgccacuugcguuuacaauaugaugggcaaacgagagaagaaauuaggggaauuuggaaaagcgaaagguucacgagccaucugguauaugugguuaggagcgagauuuuuggaguucgaagcccuaggcuuuaugaaugaagaucauugguucaguagagaaaacaguuuaagcggaguagaaggcgagggauuacauaaguuaggauauauauuacgagacauauccaaaauucccgguggcaauauguacgccgacgacacagccggaugggauacgaggauaaccgaagaugauuuacagaacgaagccagaauuacugauauuauggaaccagaacacgcacucuuggcgaaaucuauuuucaaacuaacguaccaaaauaaagucgugcggguccaacggccugccaaaaauggcacgguuauggacguaauaucgaggagagaucaaaggggcagcggacaaguugggaccuauggauugaauacuuucacaaauauggaagcgcaauuaauucgacaaauggaaagcgaaggcauauuuaguccuucagaacuugaaacaccaaauuuagcagagagggugcuugacuggcuagagaaauacggcgucgaacggcugaaacguauggcgaucaguggagaugacugcguaguuaaaccaaucgaugacagauuugcuacagcacuaacugcuuuaaaugauaugggcaaaguccgaaaagacaucccccaaugggaaccauccaaaggauggaaugauuggcaacagguccccuuuuguucacaucauuuccaccaguuaauaaugaaggaugggagagaaauagucguuccaugucguaaucaagacgaauuaguugguagagcuagagugagccagggcgcuggauggagccugagagaaaccgcuugcuuaggcaaaucauacgcccaaauguggcagcugauguauuuccaccgucgggaucuuagauuagcggcuaaugcuauaugcucagcuguaccgguugacuggaucccaacaucaaggacuacuuggucaauccaugcacaccaucaauggaugacaacugaagauaugcuaucaguuuggaauagaguguggaucgaagaaaacccuuggauggaggauaagacacauauaucuagcuggggagauguaccuuacuuaggaaaacgcgaagaucaaugguguggcucauuaauagggcugacggcgagggcuacuugggcaacaaauguccagguagcgauuaaucaaguuaggagauuaauaggcaaugagaauuauuuagacuacaugacaucgaugaaacgcuucaaaaaugaaagugacccugaaggagcguugugguaa

SEQ ID NO: 21597 - RNA, 9879 nt, Artificial Sequence
  derived and/or modified CDS sequence (opt6) from DENV-1__FJ410262__SS-prME
agcguaaccaugcuauugaugcuaaugccuacagccuuagcauuccauuugacuacaagagguggugaaccccacaugauagugagcaaacaggaacgggggaaguccuuacuuuuuaaaacaucugcugguguuaauaugugcacacuuauagcuauggaucuuggagaauuuugcgaagauacuaugacauacaaauguccaagaaucacagaagcagaaccugacgauguggauuguugguguaaugcuacggauacaugggucaccuaugguacauguucucaaacuggagaacacaggcgugacaaaaggagcgucgcucucgcgccucauguuggucugggacuagaaacaagaacugaaacauggauguccucugaaggcgcuuggaaacagauacaaagaguggaaacaugggcacuacgucauccuggauucacugugauagcauuguuccuagcccacgccauugggacgagcauuacacaaaaagggauuauuuuuauauuauuaaugcuagucacucccaguauggcgaugcggugcgucggcauugggucgagagauuucguugaaggacuaucuggcgcuacaugggucgacguaguucuggaacauggcaguuguguuacuacaauggccaaagauaaaccuacacuugauauagaacuacuuaaaacugaaguuacaaauccggcuguacuacgaaaacuuuguaucgaagcaaaaauaaguaacacuacaacagacucacguugccccacgcaaggagaagcgacauuaguagaagaacaagaugcgaauuuuguuugucgucgaaccuuugucgauagagguugggguaacggguguggucucuuugggaaaggaucucuaauaacuugugcuaaauuuaagugcguaacuaagcucgaagggaaaacaguccaguacgaaaaucuaaaguauagugucauugucacagugcauacaggggaucaacaccaaguugggaaugaaucaaccgagcauggcaccacagcuacaauaacuccucaagcuccaucaaccgagauacaguugacugauuacggagcuuugacucuagacugcucaccaaggacaggcuuagacuuuaacgaaaugguacuauuaacuaugaaggagaaaagcuggcuaguccauaagcaaugguucuuggacuuaccuuuaccuuggacaaguggugcuaguacaucacaagaaacauggaacagaaaggaucuauugguuacguuuaaaacggcacacgcuaagaaacaagagguaguaguucuaggaagucaggagggcgcuaugcauacggcguugacaggagcaaccgaaauccagacaucuggaacaaccacaauauuugcaggacauuuaaaaugccgacuuaaaauggauaagcuaacauugaaagggaugucauauguuaugugcacuggaucauuuaaacuagagaaagaagucgcggaaacacaacacgggacgguccuaguucaaauuaaauacgaagggacagaugcuccuuguaagauaccauuuuccacacaagaugaaaaagguguuacccaaaacggaagauuaaucacagcuaacccaauagugacagauaaagaaaaaccaguuaacauugaagcagagccgccauucggagagucuuauauuguaauaggagcuggagaaaaagcguuaaagcuaagcugguucaagaaaggguccucuauaggaaaaauguucgaagcuacugcaagaggcgcgaggagaauggcgauuuugggagauacugccugggacuuuggaaguauaggggguguuuuuacgagcguuggaaaauuaguucaucaaauauuuggaacagcauacggaguucuauuuagcgguguaucauggacuaugaaaaucggaaucggaguacuccuaacuuggcuaggucuuaacaguaggucuacaucauuaucaaugacgugcauagcuguuggucucgugacucuuuauuuaggagugauggugcaagcagacucuggaugugugauaaauuggaaaggcagagaauuaaaauguggauccggaauuuucguaacgaaugaaguacacacguggaccgaacaauauaaguuucaggcagauagcccaaaaagacugucugcagcaauugggaaggcaugggaagaaggcgucugcgguauaagaagcgcaacaagauuagaaaauauaauguggaagcaaauuucgaacgaacuaaaucauauauuacuggaaaaugacaugaaauuuaccguugucguuggugauguagcggguauucuugcccaagguaagaaaaugauacgcccgcaaccgauggaauacaaauauagcuggaaaucuugggguaaggccaagauaauaggagcagacguacaaaacaccacguuuauuauugacgguccuaacaccccugaauguccagaugaucaaagagcauggaauauaugggaaguagaagacuaugguuucggaaucuucacuacaaauauaugguuaaaacuacgagauucguauacacaaguuugcgaucacaggcuaauguccgcugccauaaaagacucuaaggcgguacacgccgacauggguuauuggauagaaagugagaaaaaugaaacguggaaacuagcacgggcaucguuuauagaagucaaaacauguaucuggccuaaaagccauacguuauggucaaaugguguguuggagucggaaaugauaauuccgaaaauuuauggagguccaauaucucaacauaauuaucggccagguuacuuuacacagacagcgggaccuuggcaccuugggaagcuagaacuugauuucggacuaugugagggaacuacuguugugguggacgaacacugcggaaauagagggcccagucuacgcacaacaacgguuacaggaaaaauaauucaugaaugguguuguagaucaugcacguuaccacccuuaagauucaaaggagaagacggauguugguacggaauggaaauucggccaguaaaggaaaaagaggaaaauuugguaaaaaguaugguauccgcaggaucaggcgaaguugauaguuucucacucggacugcuauguauaucaauaaugaucgaagaaguaaugagaaguagguggagccgaaaaauguugaugacggguacccuagcaguauucuuucuacuaauuaugggucaacuuacguggaaugaccuaauaagacuuuguauuaugguaggggcuaacgcuagugaucgcauggguauggggacaacauacuuagcgcugauggccacuuuuaagaugcgacccauguuugccguuggacuucuauucaggagauuaacaucuagagaggugcuauuguuaacaaucggcuuguccuugguugccucaguugaauugccgaauaguuuggaagaauuaggcgauggguuagcaaugggcaucaugauauuaaaauugcuaacugacuuccagagccaucaauuaugggcuacuuuacucucauuaacuuucauuaaaacaacauucucucuacacuaugcauggaaaacaauggccaugguucuuagcauuguuagcuuguucccacugugccuuagcacaacaagucagaaaacuacauggcuacccguacuauuagggucauuaggaugcaaaccguugacaauguuccuaauagcagaaaauaaaauuugggggagaaaauccuggccgcuaaacgaaggaauaauggcgguagguauagucaguauuuuguugucgucauuacucaaaaacgauguaccacuugcagguccacuaaucgcuggaggaauguuaauagccugcuacgugauaagcggaagcagcgcugaucucagucuagaaaaagcagcugaaguuucuugggaggaagaggcagagcauucuggagcgucccacaauauacucgucgaaguacaagaugacggcacaaugaaaauaaaagaugaagaacgcgaugauacacuuacgauauuguugaaagccacauuauuggcuguaucgggugucuacccauuaaguauuccagcaaccuuguuuguaugguacuuuuggcaaaagaagaaacaaaggagcggaguguuaugggauaccccuagcccaccggaaguggaaagggcaguccucgaugaugggauuuacagaaucaugcaaaggggacuccugggaagaucgcaaguuggcguggggguauuucaagaaaauguauuccauacaauguggcaugugacaagaggcgcaguguuaauguaucaaggaaagagauuagaaccuucuugggcguccguuaagaaagaccucaucagcuaugggggaggcuggagacuucaagguaguuggaauacgggugaagaagugcaagugauagcuguggaaccuggaaagaacccaaagaauguacaaacggccccaggaacguuuaaaacaagugagggggagguaggcgccauugcguuggacuucaagccaggaacgaguggcuccccuauuguuaauagggaggguaaaauaguaggccuauaugguaauggcguggugacaaccaguggcacauauguuuccgcuaucgcgcaagcgaaagcaucucaggaggguccuuuaccagaaauagaagacgaaguguucagaaaacggaaucugacaauaauggaccuucauccaggaaguggaaaaacuaggagguaucuaccagcuauaguccgagaagccauaaagagaaaauugagaacguugauucuagccccaacacguguaguugcuucggagauggcagaggcuuuaaaggggaugccgauccgguaucaaacgacugcaguaaaaucugaacauaccggaaaggaaauuguugaccuaaugugucaugcaacguuuacuaugcgguuauuaucaccaguucgcguuccaaauuacaacaugauuauaauggaugaagcacauuuuacggacccaucuagcauugccgcacgaggauacauuagcaccagaguugggaugggagaagcggcagcuauuuuuaugacugcgaccccuccgggaucgguggaagcguuuccucaaucaaaugcaguaauacaagacgaggagcgagauauaccagaaaggucauggaauagcgguuaugaguggauuacggauuuccccggcaaaacagucugguucguacccucaauuaaguccggaaaugacauugcaaauugccucaggaaaaaugguaaaagggugauucaguugucaaggaaaacauuugacacagaguaucaaaagacuaaaaacaaugacugggauuacguugugaccacagacaucuccgaaaugggggcuaauuuuagagcagaccgcguuauagauccaagaagguguuuaaagccuguaauacuaaaagacggucccgagagaguaauacuagccggucccaugccugugacuguugcuagugcagcacaaaggcgagguagaaucgguaggaaucauaacaaggaaggagaucaauauauauauauggggcagcccuuaaauaacgacgaagaccaugcacauuggacagaagccaagaugcuucuagacaacauaaauacgccagaaggaauuauaccagccuuauucgagccggagcgcgaaaagucggcagcaauugauggggaguaucgucuacgaggugaagcaagaaaaacuuucgucgaauuaaugagacguggagaucuuccugugugguugucauacaaaguagcgagugaaggauuucaauauuccgaccgacgauggugcuucgacggcgaacggaacaaucaaguacuagaagaaaauauggacgucgaaaucuggacaaaagaaggagaaaggaagaaauugcguccuagauggcuagaugcaaggacuuauucugacccacuggcccugagagaauuuaaagaguucgcugcuggacggcguucaguuucuggugaucugauacucgaaauuggcaaacuuccacagcaccucacucaacgagcacaaaaugcucuggacaaucugguaauguuacauaauagugagcaaggcggcagagcauaucggcacgcuauggaagaacuuccagauacaauugaaacauugaugcuauuagcguugaucgcgguacuuacaggaggaguuaccuuauucuuucuauccggaagaggauuagggaaaacuucgauaggccuuuuaugcgucauggcaaguaguguuuuauuauggauggcaagcguugagccucauuggauagccgcaucaauuauccuagaguucuuucuuaugguauuacuuaucccagaaccagauagacaaagaacaccacaagauaaucaacucgcuuauguagugauugggcuucuauucaugauauugacuguugcggcaaaugagaugggauuacuagaaacgacuaagaaggauuugggcauuggacauguggcaguugaaaaucaucaucaugcggcaaugcuugauguugauuuacaucccgcuucagcuuggacacuauaugcaguugcaacgacaauaaucacuccaaugaugcgccauacaauagaaaauacuacagcuaacauaucucuaacugcaauugcaaaucaggcagcaauuuuaaugggucucgauaagggguggccuaucaguaaaauggacauaggggugccuuuacucgcacuuggguguuauucccagguaaacccucucacgcuaacugcagccguccuuaugcuagucgcgcauuaugcaauaauuggcccuggauugcaagcaaaagcaaccagggaagcgcagaaacggacagcugcuggcaucaugaaaaacccaacugucgauggaauaguagcaauagaccucgaucccguaguuuacgacgcaaaauucgaaaaacagcuaggacaaauaaugcuguuaauucuauguaccagccaaauucuauuaaugcggacgacaugggccuugugcgagucaauuacucuugccacuggaccauuaacuacacuuugggaggguagcccaggcaaguucuggaauacuacaaucgccgugucaauggccaauauauuuagaggaucauaucucgccggagcuggauuggcauuuucacuaaugaaaucucuagguggagguagaagagguacaggagcacaaggggagacacuaggagaaaaauggaagcggcaacuaaaccaauugucuaagagcgaguucaauacauauaaaagaaguggaauaauggaagucgaucguucagaagccaaagaggguuuaaagaggggagagacgacuaaacacgccguaucacgggguacugcaaaauuacgcugguucguggaacgaaauuugguaaaaccagaaggaaaaguuaucgauuuagguugugguagaggcggauggagcuauuauugugcuggauugaagaaagucacugaaguaaagggcuacacaaagggcggaccuggacaugaggagccgaucccaauggcaacuuauggguggaauuuaguuaaacugcauucagguaaggauguuuucuuuauuccuccggagaaaugcgacacuuuacuuugugacaucggagaaucaucgccaaauccaacuauugaggaaggaaggacucuaagaguacugaagaugguagaaccaugguugcgagggaaucaauucugcauaaagauauuaaauccguauaugccuaguguagucgaaacauuagagcaaaugcaacgaaaacacgggggcaugcuaguccgcaacccuuuaucacggaacagcacacacgaaauguacuggguuagcuguggaacagguaauaucguaagcgcaguaaauaugacaucgagaaugcuuuugaaucguuuuacaauggcacacaggaaaccaaccuaugaaagggacguagacuugggagcgggaacgaggcauguagcuguugaaccugaagucgccaaucuugauauaauaggucaacggauugagaacauaaaacacgaacauaaaucaaccuggcacuacgacgaagauaaucccuauaaaaccugggcguaucauggaucuuacgaagucaaaccauccggaucagcaagcucaaugguuaauggaguuguaaaacuauuaacuaagccgugggauguaaucccuauggucacccaaauagccaugaccgauacaacacccuucggacaacaacgcgucuuuaaagaaaagguggauacgaggacaccgaaggcgaagagagguacugcacaaauuauggaaguaacugcaaaauggcucuggggauuucuuucuaggaauaagaaaccgagaauuuguacacgugaagaguucacaaggaagguaagguccaacgcagcaaucggcgcgguuuuuguagaugaaaaucaguggaacuccgcaaaagaagcgguugaagaugaaagguuuugggaccuuguccaucgggaacgcgaauuacacaaacaaggaaagugugcaacguguguuuacaacaugauggguaaacgggaaaagaaacuuggggaauuuggaaaggcaaaaggaaguagagcuauaugguauauguggcuaggagcaagauuuuuagaguucgaggcuuugggcuucaugaaugaagaccauugguucaguagggaaaauagcuuaucaggaguagaaggcgaaggccugcacaagcuagguuauauccuucgugacauuaguaagauaccugguggcaacauguacgcggacgauaccgccggaugggauacaaggauaacagaagaugauuuacaaaacgaagcaaagauuaccgauauuauggaaccugaacacgcucuguuagcaaaaagcauuuuuaaauuaacauaucaaaauaaagucgugcguguacagagaccagcuaaaaacggaacugucauggaugucauaucgcguagggaccaacgaggaucuggacaaguagguacuuauggucugaacacguuuacgaauauggaagcacagcuaaucagacaaauggaaagugaggguauuuucucucccucggaguuggaaacaccgaauuuagcaggaaggguguuagacuggcuugaaaaacacgguguugaacguuugaaacgaauggccauaucuggagaugacuguguagucaaaccuauagaugacagauuugcuaccgcucucacagcacuaaaugauauggguaaaguuagaaaagauauaccgcaaugggaaccuaguaaaggguggaacgacuggcaacagguuccguucuguagccaccacuuccaccaguugauaaugaaagauggacgugaaauugucguaccauguagaaaucaagaugaguuaguuggucgcgcaagaguaagccaaggagcgggguggucacuuagagaaacggcuugucuagggaaaucauaugcgcaaauguggcaacugauguacuuucauaggcgagauuuaagacuagcagcaaaugcuauuugcagcgcuguaccagucgauuggguuccuacaucaaggacuacuuggucaauucaugcucaucaucaauggaugaccacagaagacaugcuaucuguuuggaaucgaguauggauagaggagaaucccuggauggaagauaaaacucauaucucuaguuggggugacgucccauaucuagguaaacgagaagaucaguggugcggaucccugauuggucuuacggcacgagcuacaugggcaacgaauauucaaguagcuauuaaucagguuagaagauugaucggaaacgagaauuaucuagacuauaugacuucuaugaagcgcuuuaaaaaugaaucugaucccgaaggggcacuaugguga

SEQ ID NO: 21598 - RNA, 9879 nt, Artificial Sequence
  derived and/or modified CDS sequence (opt6) from DENV-1__FJ410263__SS-prME
ucagucacaaugcugcuaauguugaugccgaccgcgcuugcauuccaccuaacuacaaggggcggggaaccacacaugauuguauccaaacaagaacgagggaaaucucuacuuuuuaaaacaucugcugguguuaauaugugcacuuuaauagcaauggaucuaggggaauuaugugaagacauuaugacguauaaauguccaaggauuacagaaacugaaccagaugauguagacugcuggugcaacgcgaccgauaccuggguaaccuacgggacguguucccaaacuggagaacaucgaagggauaaaagaucgguugcauuagcaccacacguaggauuagguuuagaaacgagaaccgaaacuuggaugaguucugaaggcgcauggaaacaaauacaacgaguugaaacgugggcauuaaggcauccugguuucacugugauagcguuauuucuugcacaugcgauagguacgucaauuacucagaaagguauuauuuuuauacuauuaauguuagucaccccuucaauggcaaugagaugugucggaaucgguaguagagauuuuguugaaggacuuucgggagccacuugggucgauguaguccucgaacacggaucuuguguuacuacgauggcuaaagauaaaccgacauuagauauugaauugcuuaaaacagaaguuacaaacccagcgguauuaagaaaacuguguauagaagcaaaaauuucaaauaccacaaccgauucacgaugcccaacacaaggagaagcaacucugguggaagaacaagacgcuaacuucguuugccgcagaaccuuuguugauagaggaugggggaacgguugcgguuuguuugguaaagguagcuuaaucacgugcgcaaaauuuaaaugugugacuaaauuagaaggaaaaaucgugcaauaugaaaauuuaaaauacucaguuauugucacagugcauaccggagaccaacaucagguugggaaugaaucuaccgagcacgguacaacugcgaccauaacaccacaagcaccaacgacagaaauacagcuaacagauuauggagcacuuaccuuagauuguucaccuaggaccgguuuagacuucaacgaaaugguuuuauuaacuaugaaagaaaaaucauggcuggugcauaaacagugguuucuugauuuacccuugccuuggacuagcggggcaucaacaagucaggagacauggaauagacaggacuuacucguuacuuuuaaaacugcccaugccaagaaacaggaagucguaguauuggggagccaagaaggagcuaugcauacagcguugaccggugccaccgaaauccagacaaguggaacaacaacaauuuuugcgggucaucuuaaauguaggcucaaaauggacaaacuaacccugaaagggaugucauauguaauguguacuggaucuuucaaauuagagaaagagguugccgaaacgcagcaugggaccguguuagugcaaauuaaauaugaaggaacagacgcaccauguaagauaccauuuaguacacaagacgagaaaggaguaacacagaacgguagacuaauuacugccaauccaaucguaacagacaaagagaaaccuguaaacauagaggcagaaccgccauuuggcgagaguuacaucguuauuggggcaggcgaaaaagccuugaagcuaagcugguuuaagaaagguaguaguauaggaaaaauguucgaagcgacagcaaggggagcuagaagaauggcuauucuuggugauacagcuugggauuuugguagcauuggugggguuuuuaccucaguuggaaaguuagugcaucagaucuuugguacagccuauggggugcuauuuagcggugucaguuggacuaugaaaauaggaaucggaguacuguuaacaugguugggacuaaacuccagaagcacuucucuaagcaugacauguauagcaguagggcuagugacucucuauuuaggcguaauggugcaagcagacaguggcuguguaauuaacuggaaagggagggaauugaaaugugguuccgggauauucgucacuaacgaaguacauacguggacagaacaguacaaguuccaggcagacaguccuaagcgucuaagcgccgcuauaggaaaagcaugggaagaagggguauguggaauccgcucagcaaccagauuagagaacauuauguggaaacagaucagcaacgaauuaaaucauauauugcuugaaaaugauaugaaauucacuguugucguaggagauguggcugguaucuuggcacaaggaaagaagaugaucagaccucaaccaauggaauacaaauacucauggaaaaguuggggaaaagcuaaaauaauuggugcggacguccagaacacuacauucauuauugacggaccuaacacaccagaguguccagacgaccaacgagccuggaacaucugggagguagaagauuaugguuucggcauauucaccacuaauauauggcuaaaacuacgugauagcuacacucagguuugcgaucaccguuuaaugagcgcagcaauaaaagauucaaaagcaguccaugccgauaugggcuacuggauagagagugagaaaaacgaaacauggaaguuagcgagagcgucauucauugagguuaaaacgugcaucuggccgaaaucucauacuuuauggaguaauggaguucuugagucugaaaugauuauaccaaaaauauacgguggaccgauaagccaacacaauuaucgaccaggcuacuucacgcaagcagcaggccccuggcacuuaggcaaauuagaacucgauuuugacuugugugaaggaacgaccguaguaguagaugagcauugcggaaauaggggacccagcuuacguacuacuacggugacagguaagauaauacaugaaugguguuguaggucaugcacucugccgccuuuaagguuuagaggcgaagacggcuguugguaugggauggagauacgaccuguuaaagaaaaagaagaaaauuuagugaaaagcaugguaucagcuggaucuggcgaaguugacuccuucaguuuaggcuuacuuugcauaucuauuaugauagaagaggucaugagaucaagguggagucgucgaauguuaaugaccgggacacuugcuguguucuuuuuacuuaucaugggucaauuaacguggaacgauuuaauacguuuaugcauaauggucggggcaaacgcuucugacagaaugggaauggguaccaccuaucuggcgcucauggcuacuuucaaaaugcgaccaauguucgcagucggucucuuauuuaggcgucuaaccucaagggaaguacuauuguuaacaauuggucuaagucuaguagccagcguagaauuaccaaauaguuuagaagaguugggagauggcuuagcaauggguaucaugauucuaaaguugcucacggacuuccaaagccaucaacuuugggcaacuuuauuaucacuaacauuuaucaagacgacauuuucacugcauuacgcguggaaaaccauggccaugguguugucuauuguaucacuguucccacuaugucuuucaacgacaagucaaaagacuaccugguugccaguccugcuaggaucauuggguugcaaacccuuaacaauguuucuuauugcggaaaauaaaauauggggaaggcgaucauggccacugaacgaagguauuauggcagucggcauuguaucaauuuuauugagcucacuacugaagaaugauguuccacuugccggccccuuaauagcaggaggaaugcucauagccuguuacguaauaucgggaaguagcgcggaucucagcuuggaaaaagcugcagaaguaucaugggaggaagaagcugaacacucaggagcgagucacaacauucugguugaaguacaggacgaugggaccaugaaaauaaaagacgaagaaagggaugauaccuuaaccauauuacucaaggcgacccuguuggcuguuaguggagucuauccucuuucuaucccugcuacacuauuuguuugguacuuuuggcagaagaagaaacaacguucuggcguuuuaugggauaccccaucaccgccagaagucgaacgugccguacuggaugaugggauuuauagaauaaugcaacggggacuauuaggacgaucacaaguuggcguaggaguguuucaagaaaauguguuccacaccauguggcaugucacccgaggagcaguccuaauguaucaagggaaacgauuagagccuucgugggcuucuguaaagaaagacuugaucaguuauggagguggcuggagacuucagggaagcuggaauacuggagaagaaguucaaguaaucgcaguugaaccagggaaaaacccgaaaaauguacaaacugccccuggaacguuuaaaacuccugaaggagaaguaggagcaauagccuuagauuucaaaccaggaaccucagggucaccaauaguaaauagagaaggaaaaauagucggauuguaugggaacggcgugguaacuacuucgggaacauacgugucagcuauugcccaagcuaaagccagccaagaaggaccgcuuccagaaauagaggaugagguauuucgcaaaaggaacuuaacaauuauggauuuacacccagggagcggaaaaacaagaagguaucuucccgcaauaguacgagaagcaauaaaacgcaaacuaaggacacuaauacuagcuccaacacguguaguagccagcgaaauggccgaagcauugaaaggaaugccaauaagguaucaaacuacugcaguuaaaucugaacacaccggaaaagaaauagucgaccuaaugugucaugccacguuuacaaugagguuacugucgccaguacgcguuccuaacuacaacaugauuauaauggaugaggcacacuuuacugacccaucgaguaucgcugcuaggggauauaucucgacucgaguagguaugggagaagcagcagcaauauucaugacugcuacaccaccugggagugucgaggcuuucccucaaagcaacgcuguaauacaggaugaagagagagacaucccagaacgaaguuggaauagcggguacgaauggauaacagacuuuccgggaaaaaccguuugguuuguuccaucuauaaaaagcgggaacgacauagcgaauuguuuacguaaaaaugggaagagaguuauacaauuaagccgaaaaacauuugauacagaauaccaaaagacgaagaauaaugauugggacuacguaguaaccacugauauaagugaaaugggcgcuaacuuucgugccgauagggugauagauccacgaaggugcuuaaaaccuguuauccucaaggauggaccagaaagggucauccuggcagggccgaugccggucacuguugccucugcugcgcaaagaaggggaagaaucggacgcaaucauaacaaagagggagaucaauacauauauaugggacaaccgcugaauaacgaugaagaucaugcucacuggacugaagcuaaaaugcuacuggauaacauaaauacaccagaaggaauaaucccagcauuauucgaaccagaaagagagaaaagugcagcuauagauggugaauaucgacuucggggagaggcacguaaaacauucguggaacuaaugagaagaggggacuuaccugucuggcucucuuauaagguugcaucugaaggcuuucaauauagugauagaagauggugcuucgacggugaacgcaauaaucagguacuagaagagaauauggauguugaaauauggacgaaagaaggugaaaggaagaaauuaaggccuagauggcuggacgcuaggaccuauucugacccauuagcauuaagagaguuuaaggaauuugcugcaggucguagaucagucagcggugauuuaauccuggaaauagguaagcuaccgcaacaucuuacacaacgcgcgcaaaacgcucuagauaacuugguaaugcuucacaauucugaacaaggagggagggcuuauaggcacgccauggaagaguugccggauaccauugaaacucuaauguuauuagcguuaauagcaguucucaccggugguguaacauuguucuuucuaaguggccggggauuggguaagacguccauaggacuuuuaugugugauggcaucgaguguucuauuauggauggcuagcgucgaaccucacuggaucgcugccucgauaauauuagaauuuuuccuuaugguauuacucauccccgaaccggaucgacaaagaaccccacaagacaaucaauuagcauauguagucauuggccuucucuucaugauacuaacuguggcagcaaaugaaaugggauuauuagaaacgacaaagaaagauuugggcauaggacacguugcuguagaaaaucaccaccaugcagcaauguuggacguggacuuacacccagcaagugccuggacacuauacgcgguagccacuacaauuauaacaccgaugaugagacauacaauugaaaacacaacagccaacaucagcuuaacagcaauagcaaaccaggcugccauacucaugggacuagauaaggguuggcccauaucaaaaauggauauuggugucccauuacuugcauuagguugcuacagucaaguaaacccguugacauugacggcagcuguauuaauguugguagcacacuaugcuauaauugggccaggauuacaagcgaaggcaacuagagaagcacagaaaagaacagcagcuggaaucaugaaaaauccaacuguagauggaauagucgccaucgaucuggauccagucguuuaugaugcuaaauuugaaaaacaacuaggccaaaucaugcuauuaauauuaugcaccucacaaauauugcuaaugcgcacgacuugggcguugugcgaaucaaucacucuagcaacugggccauuaaccacucuaugggaaggcuccccaggcaaguucuggaauaccaccauagccguaucgauggcuaauaucuuccgugggucuuaccuugcgggagcgggucuggccuuuucacuuaugaagucuuuagguggaggacgacgaggcaccggcgcacaaggagagacauuaggggaaaaauggaagcgccaacucaaucaacuaagcaaaucagaguucaacacauacaaacgauccggaauuauggagguagaucgaagcgaagcaaaggaggggcuaaagagaggagaaaccacuaagcaugcuguuucucgaggaaccgcaaaauuaagaugguuuguugagcggaauuuaguaaaaccugaaggcaagguuauagauuugggauguggaagagguggauggagcuauuacugugcgggucuaaagaaagucacugaggucaaaggauauacgaaggguggcccaggccacgaagaaccgauuccuauggcgaccuauggauggaaucuaguaaagcugcauagugguaaagauguauuuuucauuccaccagagaagugugacacacuucuuugugauauaggagagagcucaccgaauccuacgauagaagaaggacgaacgcuacgaguacucaaaaugguggaaccuuggcuaagaggaaaccaguucugcaucaaaauauugaauccauauaugcccucgguuguugaaacauuagaacaaaugcaacguaaacauggcggaaugcucgucagaaaucccuuaagcagaaauuccacgcaugagauguacugggucucauguggaacagggaacauuguaagcgcagucaacaugacuuccagaauguuacugaaucguuucacaauggcgcacagaaagccaacauaugagagagacguagacuuaggagcaggaacuagacauguugcaguggagccugaaguggcaaauuuagauauaauaggacagcgaauagaaaacauaaaacaugagcacaaaaguacuuggcacuacgaugaggacaaccccuacaaaacuugggccuaucaugguaguuaugaaguuaaaccaagcgggagugcuucaucuauggugaauggcguggucaaauuguuaacuaaaccaugggacguuauaccaauggucacucaaauagccaugacagauacuaccccuuuuggucaacaacgcguguuuaaagagaaaguagauacacggacuccuaaggcgaaacggggcacggcccagauaauggaagugacagcgaaauggcucuggggguucuugucuagaaauaaaaagccaagaauaugcacacgugaagaguucacaagaaaaguaagauccaaugccgcaauaggcgcaguauucguagacgaaaaucaauggaacucagcaaaagaagcaguagaagacgaaagauuuugggauuuaguacauagagaaagagaguuacacaaacagggaaagugcgcgacaugcguguauaacaugaugggaaagcgagagaagaaacuuggagaguucggcaaggcaaaaggaaguagagcaauaugguauaugugguugggagcccgcuuuuuagaguucgaagcauuaggcuucaugaaugaggaucauugguucucucgagaaaauaguuuaucaggcguugaaggagaagguuugcauaagcucggauauauacuaagggauauaaguaagaucccagguggaaauauguacgcugaugacacagcagguugggacacacguauuacugaagaugauuugcagaacgaagcacgaauuaccgacaucauggaaccagagcacgcucucuuggcuaagucaauauuuaagcugacuuaucaaaauaaagucgugagaguacaaagaccagcaaagaacggaacagucauggacguaauaucgagacgcgaucaaagaggaucaggucaaguaggaacauauggacuaaauacauuuaccaauauggaggcccaacucauaagacaaauggagagugaagggaucuucucgcccagcgaacuugaaaccccgaaccuggcugaacgaguucuggauugguuagaaaaauauggaguagagagauugaaaagaauggcaauauccggagacgacugugugguaaaaccaauugaugauagauuugcaacugcacucacggcacucaaugacauggggaaagugaggaaggacauaccucaaugggaaccaagcaaggguuggaaugauuggcagcaaguucccuucugcucacaccauuuccaccaacucaucaugaaagauggaagagaaaucguagugccgugcagaaaccaggaugagcuagucggcagagcacggguuagucagggugcuggguggucauugagagagacagcaugcuuaggaaaaucguaugcucaaauguggcaacuuauguauuuucauagacgagaucuuaggcuugcggcaaaugccauuugcagcgcaguaccaguagauuggauaccaacuucacgaaccacauggucaauucaugcacaucaccaguggaugacaacugaagauauguuguccguauggaauaggguauggaucgaggaaaacccauggauggaagacaagacucacauuucguccuggggagauguaccuuauuuaggcaaacgcgaggaccagugguguggaucacuaauaggauuaacagcgagagcuaccugggcaacuaacauucaaguagcaauaaaucagguaagaaggcucauuggaaacgaaaacuaucuagauuauaugacaucgaugaaacgauuuaaaaaugagucggauccugaaggagcauugugguaa

SEQ ID NO: 21599 - RNA, 9879 nt, Artificial Sequence
  derived and/or modified CDS sequence (opt6) from DENV-1__FJ410264__SS-prME
ucaguaaccaugcuacuaaugcuaaugccgaccgcccucgcguuccacuugacaaccagaggaggugaaccgcacaugauaguaacgaaacaagaacgcggaaagagcuuguuguuuaaaaccagugcuggaguaaauauguguacacuaauagcuauggaucuuggugaauuaugugaagauaccaugacauacaaauguccaagaauuacagaagccgaaccugaugauguagauugcuggugcaaugcuacggacacauggguaacuuaugguacaugcagucaaacgggagaacaccgaagagacaaaagaucaguugcacuggcuccacacguaggucuuggccuagaaacuagaacggaaaccuggaugagcagugaaggcgcauggaaacaaauacaaagaguagaaacaugggcuuuacgacauccgggcuucacuguaaucgcauuguuucuagcucaugcaauuggcaccaguauuacgcaaaaaggcauaauauuuauucuccucauguuagucacaccuaguauggccaugcggugugugggaaucggcucgagagauuucguugaaggcuuaucaggagcgacuuggguggauguuguauuggaacauggaagcuguguaacaacaauggccaaagacaaaccaacauuggauauugaauuauuaaaaacagaaguaaccaacccagcaguacuuagaaaacuaugcauagaagcaaaaauaucuaauacgacuacggacucaagguguccuacacaaggcgaagccacucucauggaagaacaagacgcaaauuucgugugucguaggacauuugucgacagagguuggggaaacggauguggucucuucgguaaaggaucauuaauuaccugcgcuaaauuuaaaugcguaaccaaauuagaagguaaaauaguacaauacgaaaaccugaaauacucaguuauaguaacggugcauaccggagaucagcaucaaguugggaacgaaucgacugaacauggaacaacagcaaccauuacaccacaagcaccuacgucugaaauacagcuuacugacuauggggcacuaacccuagauugcagcccucgaacgggcuuagacuucaacgaaaugguucuacuaacuaugaaagagaaaagcuggcuaguucauaaacaaugguuucuugaccugccccuaccauggacuuccggagcaucaacaucgcaggaaacuuggaaucgccaagaucuuuuaguuacauucaaaacagcacaugccaagaaacaagaaguaguaguauuagguucccaagaaggugcaaugcauacugcacucacaggggcgacagaaauacaaacguccggcacuacuacuauauuugcagggcauuuaaaauguaggcugaaaauggacaaacuuacauugaaagguaugaguuacgugauguguacaggaaguuucaaacuggaaaaagagguagccgagacccaacauggaacaguccuugugcaaauuaaauacgaagggacagacgcgccuuguaaaauuccauuuaguacucaggacgaaaaagguguaauacaaaacgguagguugauaacugcuaaucccaucgucacugauaaagaaaaaccggucaauauugaagcagaaccucccuucggagaaucauacauaguaaucggagcgggagaaaaggcuuugaaacuuucuugguuuaagaaagggaguucaauagguaaaauguucgaagcuacggcucgaggagccagaaggauggcaauauuaggggauacagccugggacuucgguucaguaggaggaguauuuaccagcgucggcaaguuaguucaucaaauauucgggacagccuauggcguauuauucaguggugucaguuggacgaugaaaaucggcauaggaguauuacuaacguggcuuggcuuaaauucacgaucaacaucccuuagcaugacuuguauagcaguaggauuaguuacacuguacuuagguguaaugguucaagcagauucgggauguguuauuaauuggaaaggccgcgaacucaaauguggaagcggaaucuuuguaacuaaugaagugcauaccuggacggaacaauacaaauuucaagcagauagcccaaaaagauugagugcagcuauaggaaaggcaugggaagaaggagucugcgguauuagaagugccacucggcucgaaaauauaauguggaaacaaauuucuaaugaacuuaaucauauauuacuagagaaugacaugaaguucacgguagucguaggugaugucgugggcauacuggcccaaggaaagaaaaugauuagaccgcaaccgauggaacacaaauauucuuggaaaagcuggggaaaagccaaaauuaucggagcggauguacaaaauacgaccuucauuauugacgggccuaauacaccagaaugcccagacgaucaaagggcuuggaauauaugggaaguggaagauuauggauucggaaucuuuacaacuaacauaugguugaaacuuagagauucguacacacaaguuugugaucacagauugaugagugcugcaauaaaagauucaaaagcaguucaugcagacaugggcuacuggaucgagagcgagaaaaaugaaacuuggaaguuagcuagagcaaguuuuauugaaguuaagacaugcauauggccaaaaucucauacacuuuggucuaacggaguacuagaaucagaaaugaucaucccgaagauauacgggggaccaaucucgcaacauaauuaccgaccuggcuacuucacacaaacagcgggaccauggcacuuaggcaagcuagagcuagacuuugaucugugugaagguaccacaguagucgucgacgagcacugcggaaaucgagggccuucccuacgaaccaccaccguaacuggcaaaauaauccacgaaugguguugucggucuuguacauugccgcccuuacguuucaaaggagaagacggauguugguacgguauggaaauuagaccuguaaaagagaaagaggaaaaucucguaaaaucaaugguaagcgcuggaaguggcgaggucgacucuuucagccuggguuuacuguguauaucgauuaugauagaagaaguuaugaggaguagauggucuagaaaaaugcuaaugaccggaacccuagcuguauuccuacuauugauuaugggccaguugacuuggaaugauuuaauacgauuauguauaaugguuggagcaaaugcaucugacaggauggguaugggaacgaccuauuuagcgcuaauggcaaccuuuaaaaugcgcccgauguucgccguaggacuacucuuucgacguuuaacgaguagggagguacuauuacugaccauuggucuaucauuaguagccucaguugaauuaccuaauucauuagaggagcuaggcgacggauuagcaaugggcauuaugauauugaaacucuuaacagauuuucaaucucaccaauuaugggcgacucuacuuucauuaacauuuauuaaaaccacguugucacuucacuaugcuuggaaaacgauggcaaugguuuuaucaauagugucuuuauuuccauuaugucugaguacaaccucacaaaagacuacauggcuaccgguccuacuggguucguuaggauguaaaccauuaacgauguuucugauuaccgagaacaaaauauggggucgaaaauccuggccucuaaaugagggcauaauggcuguuggggucgucagcaucuuauugucaaguuuacucaaaaacgacgucccauuagcaggaccgcuuauugcaggggguauguuaauugcauguuaugucaucaguggcaguucagcagauuugaguuuagagaaggcugcagaggugucgugggaagaagaagcagaacacucaggcgcuagccauaacauucuuguagagguccaagaugacggaacaaugaaaauuaaggacgaagaaagggaugauacacuaacuauucuacuuaaggcuaccuuguuagcaguaucgggugucuauccguugagcauuccagcaacauuguuuguaugguacuucuggcagaaaaagaaacaacgcagcggcguuuuaugggauacgccuucaccaccagaggucgaaagggccguacuagacgacgggauauaccgaauaaugcaaagaggauuacugggaaggucucaaguaggcguaggaguauuccaagaaaauguuuuccacacuauguggcaugucacacguggggcaguuuuaauguaucaagguaagagacuagaaccgucgugggccucagucaagaaagaucuaauuucauauggaggaggauggcgccuacaaggaucauggaauacuggugaagaaguucagguuaucgccguggaaccgggcaaaaaucccaaaaauguucagacggcaccaggcacuuucaaaacaccggagggugagguaggagccauagcgcuagauuuuaagccaggaaccagcgggaguccaauaguaaaccgugaggggaaaauagugggcuuauacggaaacggaguaguuacaaccucagggacuuacguaucggcgauagcgcaagcaaaagcaagccaagaaggcccguuaccugaaauugaggacgaagucuuuaggaagaggaacuuaacgauaauggauuuacauccgggaucugguaagacaaggagguaccucccugcaauuguaagagaagcaauuaaacgcaaacuacguacacuaauacuagccccgacacgcguuguagccucugaaauggcagaggcuuuaaaaggaaugcccauucgauaccagacuacugccguaaaaagugagcauacgggcaaagaaauagucgacuugaugugucaugcgacauuuacuaugagacuuuuaucgccaguaaggguaccuaacuauaauaugauaauaauggacgaagcacauuuuacugacccaagcucgauagcugcacgaggauacaucagcacuagaguuggaaugggagaagcagcggcgaucuucaugaccgcuacuccacccgguucgguagaggcuuuuccccaaucaaaugcaguaauacaggacgaagaaagagacauaccagaaagaucuuggaacucagguuaugaauggauaacugauuuucccgguaaaaccguuugguuugucccuucaauuaagucuggcaaugauauagcaaauugcuugaggaaaaauggaaagaggguuauccaauuaucacgaaaaacauucgauaccgaauaucagaaaacuaaaaauaaugauugggacuacguuguaacaacggauauaagugaaaugggcgcuaacuuuagagcagaucguguaauagacccgagaaggugucuuaaaccgguaauacuaaaggauggaccagaaaggguaauuuuagccgggccuaugccaguaacaguugcaucagcagcgcaaagaagagggcgaaucggcagaaaucacaacaaagaaggagaucaauauauauauaugggccaaccuuuaaacaacgacgaggaucacgcacacuggacggaagccaagaugcuauuagauaacauuaauacacccgaaggaauaauaccagcgcuauuugagcccgaaagagaaaaaucagcagcuauugauggugaguacagacugagaggugaagcuagaaaaacuuuuguggaacuuaugagacguggcgauuugccuguaugguuauccuacaaaguggcgagugaaggauuccaauauagugaucgucgaugguguuuugacggugaacguaacaaccaaguuuuggaagaaaacauggaugucgagauauggacaaaagaaggcgaaaggaagaaacuaagaccacgcuggcuagacgcgcguaccuacagugauccacuagcauugagagaauuuaaggaguuugcagcaggaagacguucgguauccggagaccuaauacuugagauaggaaaacucccgcaacaucuuacacaaagagcacaaaaugcuuuagacaauuuagugauguuacauaacucugaacaagggggaagggcguaccgacacgcuauggaagaauuaccugauacaauugaaacauugauguuauuagcccucauugcgguucucacaggcggagugacuuuguucuuccugucuggcagaggccuuggaaaaacgucuauaggacuacuuugcguuauggcuucgaguguauuacucuggauggcaaguguagaaccucacuggauagccgccagcaucauacucgaguucuuucucaugguauuguuaaucccggaaccugaucgacaacguacuccgcaagacaaucaacuggcuuacguugucaucggauugcucuuuaugauuuuaacuguagcugcgaaugaaaugggcuugcuagagacaaccaagaaagaucucgguaucgggcauguagcugucgaaaaucaccaccaugcuacaauguuggacgucgaccuucauccugcaucagcauggacgcuauacgcaguagcgacaacaauuaucaccccuaugaugagacauacaauagaaaacacaacggcaaacauaucacuaacugcgauugcgaaccaagcggcuauacucaugggauuagauaaggguuggcccauaucaaaaauggacaucggagucccacuccuagcgcuaggguguuauagucaagugaauccuuugacuuuaacggcugcagucuuaauguuaguagcacauuacgccauuaucggacccggguuacaggcuaaagcaacuagagaagcucagaaacguacggcugcgggaauaaugaaaaacccgaccguagacggaauaguagcgauugaucucgauccuguuguuuaugaugcgaaauuugagaaacaacucgggcaaauuauguuacuuauacugugcaccagccaaauucuucuuaugcgaacgaccugggcuuugugugagaguauaacccuagccaccggaccacugacgacacucugggaggggaguccaggaaaauuuuggaauacaaccauagccguaucgauggcaaauaucuuucgaggauccuaccucgcaggagcaggacuugcuuuuucucuaaugaaaagccuuggaggugguagacguggaacaggugcgcagggugagacucuuggugaaaaauggaaaagacaacuaaaucaacucaguaaaagcgaguucaauauauacaagcggagcgggauuauggaaguagaucgaagugaagcgaaagagggauuaaaacguggagaaacuacaaggcaugcuguaucuagaggcaccgcaaaacuccgaugguucguagaacguaaucucguaaagccagagggaaaagugauugauuuagguugcggucggggaggcuggagcuauuacugugcuggauugaagaaagugaccgaaguaaaaggcuauacaaaagggggucccggacacgaagaaccaauaccuauggcgacuuaugguuggaauuugguuaaguugcauagcggaaaagauguauucuuuacacccccggaaaaaugugauacacuuuuaugugacauaggagaaaguagcccuaaccccacaauagaagaaggacgcacauugcguguacuaaaaaugguugaaccuuggcuaagaggaaaccaauucuguauaaagaucuuaaauccauauaugccuagcgugguagaaacauuagaacaaaugcaaaggaaacauggugggauguuggugcgaaacccacuuucacgaaacucuacucaugaaauguauugggucucaugcgggacugguaacauuguuagugcuguuaacaugacaagucguauguuguugaaccgauuuacaauggcgcacagaaaaccaacguacgaaagggacgucgacuugggagccgguacgaggcacguagcgguggaacccgaaguggcaaauuuagauauaauagggcaaaggauugaaaauauaaagcaugagcacaaaucaacauggcacuaugaugaggauaacccuuacaaaacgugggcauaccacggguccuaugaaguuaagcccuccgggucggccucguccaugguuaacgguguaguuaaauuauuaacaaagccaugggaugucauaccgauggucacucaaauugcuaugacagauacaacaccauucggacaacagaggguauuuaaagaaaagguugacacgcgaacaccaaaagcgaaaaggggaacagcgcaaauuauggaaguuacagcgagauggcucuggggauucuugagccguaauaaaaagccacgaauuugcacccgggaggaguucacgcgaaagguuaggagcaacgcagcaauaggagcuguuuuuguggaugaaaaucaauggaacucugcaaaagaagcaguagaagaugaaagguuuugggacuugguacaaaaagaaagagaguugcacaagcaagguaaaugcgcgacuugugucuacaacaugaugggaaaacgagagaagaaacuaggggaguucgguaaagcgaaaggcaguagagcaaucugguacaugugguuaggagcucguuuccuagaauuugaagcucucggguuuaugaacgaagaccauugguuuucaagagaaaacucguuaagcggaguggaaggagaaggguugcauaaacuaggauacauacucagagacauaucaaaaauaccgggaggaaauauguaugcagaugacacagccggaugggauacuagaauuacagaggaugauuuacagaaugaagcaaaaauaacugauauuauggaaccggaacaugcucuuuuggcaacaaguauuuuuaaacucacauaucagaauaaagugguucguguucaaaggccagccaagaauggaacaguaauggacguaauaucccgaagagaucaaagaggaagcgggcaaguaggaacauacggauuaaauacguucacaaacauggaagcccagcuuaucagacaaauggaaucugaaggaauauucuugccuucagaguuggaaacaccuaaucuggcagaaagaguacuugacuggcuggaaaaauaugguguggaaagauuaaaaaggauggcuauaaguggagaugauuguguggugaagccuauagaugauagguuugcaacagcauugacagcgcuaaacgauauggggaagguccguaaagauauuccccaaugggagccaucaaaaggcuggaacgacuggcaacagguaccauucugcucucaucacuuccaucaacuaauuaugaaagauggaagagaaauugucguaccauguaggaaucaagaugagcuugucggucgagcgagagucagucagggcgcagguuggagccuacgagagacugcaugccuaggaaaaaguuacgcucagauguggcaacuaauguauuuucauaggagagaccuacgauuagcggcuaacgcaaucuguucggcagucccaguagauugggugccaacaucuagaacaacauggagcauacaugcucaucaccaguggaugaccacugaggacauguuaagcguauggaauaggguauggauugaggaaaauccuuggauggaagauaaaacucauguaucaagcuggggagacguacccuaccuugguaaaagagaagaucaauggugcggaucucuaaucggauuaacagcucgugcgacaugggcuucuaacauccaaguagcaauaaaucaaguuaggcgacuuauuggcaaugagaacuaccucgauuauaugacaagcaugaaaagauuuaaaaaugaaggggacccugagggagcacucugguag

SEQ ID NO: 21600 - RNA, 9879 nt, Artificial Sequence
  derived and/or modified CDS sequence (opt6) from DENV-1__FJ410265__SS-prME
ucaguuacaauguuguuaauguuaaugcccacagcucuugcuuuucaccuaaccacaagaggaggagaaccacauaugauuguaucgaaacaagaaagagguaaaaguuugcuuuuuaaaacuagcgccggagugaauaugugcacgcuaauagcaauggacuuaggugaacuaugcgaagacacuaugacuuacaaaugccccaggaucaccgaaacagaaccagaugauguugacuguugguguaaugcgacagauacaugggucacauaugguacaugcucgcaaacuggagaacauagaagggacaaacguagcguugcauuggccccgcauguagguuuagguuuagaaacaaggacugaaacauggaugucaucggaaggugcuuggaaacaaauacaacgcgucgaaacuugggcccucagacacccaggguuuacuguuaucgcccuguuucucgcucacgccaucgguacgucuaucacacaaaaagguauaauauucauauuacucauguugguaaccccgucuauggcaaugagauguguuggcauagggucacgagacuuuguggaagguuuaaguggagcuacuuggguagacgugguuuuagagcacggauccuguguaacuacaauggcuaaagauaaacccacuuuagauauugaacucuuaaaaaccgagguaaccaauccggcuguccuuaggaaacuauguauugaagcuaaaaucaguaauacuacuaccgacuccaggugcccaacccaaggagaagcaacuuugguagaagaacaagaugcgaauuucguauguagaagaacauuuguugauaggggaugggguaacgguugcggauuauucggcaaaggcucuuugauaacgugcgcaaaauucaaaugcguuacaaaacucgaagguaaaaucguucaauacgaaaaucuuaaauauagugucauaguuacgguccauacgggugaucaacaucaaguaggcaaugaaucuacagaacacgggaccacugccacaauuacaccucaggcaccuacuacagagauacagcuaacagauuacggugccuuaacccucgacuguagucccagaacuggacuagauuucaaugaaaugguucuacuuacaaugaaagaaaaaucauggcucguacauaaacaaugguucuuagauuuaccauuacccuggacaucaggcgccucuacaagucaggaaacguggaauagacaagacuuauuagugacguucaaaacagcacaugcaaagaagcaagaaguaguuguucucggaucucaagaaggagccaugcauacugcacuaacaggggcgacagagauucaaacgagugguacaaccacgaucuuugcaggacaccucaaaugcaggcuaaaaauggauaaauugaccuuaaagggcaugagcuauguaauguguacaggcucguuuaaacuugaaaaggaaguggcugaaacacaacaugguacaguauuaguucaaaucaaauaugaaggaacagaugcacccuguaagauacccuucaguacacaagaugaaaaagggguuacacaaaauggaaggcugauaacggcuaacccaaucguaacagauaaagagaagccugucaacauugaagccgaaccucccuucggagaauccuauaucguuauaggugcuggagaaaaagcucuaaaguuaucaugguuuaagaaaggcuccucaaucggaaaaauguucgaagcaacagcgcguggagcccggaggauggcuaucuuaggagacaccgcuugggacuuugguucaauuggaggcguuuuuacauccgugggaaaauuaguucaucagaucuuuggcacagcauauggaguuuuauucaguggaguaucauggacuaugaaaauugguauagguguuuugcuuacuugguuagggcuaaauucgcguuccacuagccuguccaugacauguauagcuguuggcuuagugacucuuuaucucggggucaugguccaggcagacagcggguguguuauaaauuggaaagguagagaacucaaaugcggcucaggcauuuuuguuaccaaugaggugcauacauggaccgaacaauauaaauuccaagcugauucaccuaagcgucuaucugcggccauuggaaaagcgugggaggagggcguaugugguaucaggucagcaacacgacuggagaacauuauguggaaacaaauaucaaaugagcugaaccauauauuacucgaaaacgauaugaaauuuacgguugucgugggagacguugcaggaauacuggcccaagguaaaaagaugauacgaccacaaccgauggaauacaaguauagcuggaaauccugggggaaagcuaagauuauaggcgcugacguacagaauacgaccuuuauuauugacggacccaauacgccagaauguccagaugaccaaagggcauggaacauuugggaaguagaagacuauggauucgggauauucacuacgaacauauggcucaaauuaagagauaguuauacucagguuugugaucacagauuaaugucugcugccaucaaagacucaaaagcuguacacgcagacaugggguauuggaucgagucagagaaaaaugagacuuggaaacuggccagggccuccuuuauagaaguuaaaacuuguauuuggccgaagagucacaccuuauggucaaauggcguguuagaaucugagaugauaauaccaaaaauuuauggugggccuauaagucaacauaacuaccgaccgggauauuuuacacaagcagcaggaccauggcaucuaggaaagcuggaacuagacuucgaucugugcgaaggaacgaccgucgucguugaugagcauuguggcaauaggggccccagccucagaaccacuaccgucacaggaaaaauaauucaugagugguguugucguucgugcacucuaccaccgcugagauuccgaggggaggauggauguugguacggcauggaaaucaggcccguaaaagaaaaagaggaaaauuuaguaaagucaauggugucugcaggaaguggggaaguagauuccuuuucgcugggauuacuuuguacaagcauuaugaucgaggaaguaaugcgcucucgauggagccgaagaauguuaaugaccggaacccuagcgguguucuuuuuacucauaaugggacaauuaaccuggaaugaucugauacgacucuguauaauggugggugcaaaugcgucugaccgaaugggaaugggcacuaccuaccuugcauuaauggcaaccuucaagaugagaccaauguucgcaguaggcuugcuauuuagaagauuaacuucgcgugaaguauugcuuuuaaccauaggucucagcuugguugcgagcguagaacucccaaauucguuagaagaacuuggagacggacuagccauggguauaaugauuuuaaaacugcuaaccgauuuccaaagucaccaauuaugggcaacccuacugaguuugaccuuuauuaaaacuacauucaguuuacacuaugcuuggaaaacaauggcuauggucuuauccaucguaagucuauuuccccuuugcuuaagcacaacaucucagaaaacaaccuggcuuccuguauuacuagguucguuaggauguaagcccuugacaauguuucuuauagccgaaaauaagauauggggacgaagaucuuggccucucaaugaaggaauaauggcaguaggaauuguaucuauuuuacugagcucuuugcuuaaaaacgauguaccucuagcaggcccacuuaucgcuggaggcaugcuuaucgcuugcuauguaauaagcggaucuagugcugaucuaaguuuagaaaaggccgcugaaguuucaugggaagaagaggccgagcacucaggggcaagucauaacauccuaguagaggugcaagaugaugguacaaugaagauaaaggaugaagaaagagacgacacucucacaauacuccuuaaagcaacgcuauuagcaguaucaggcguuuacccgcuaucaauccccgcaacacuauucguuugguacuuuuggcagaagaagaaacagcgaaguggaguacugugggauacccccaguccaccugaaguggagcgagcggugcuugaugaugggauauacagaauuaugcaaaggggacuacuuggaagaagucagguuggggucggaguguuucaagagaauguuuuucacaccauguggcaugucacccgaggagccguacuuauguaucaggguaaaaggcuagaacccaguugggccagugucaagaaagaucuuauuucauacggaggaggauggcgacuucagggcuccuggaacacaggagaagagguacaaguaauagcaguagagccggggaaaaauccgaaaaauguucagacugcaccggggacauuuaaaacaccagaaggggaaguuggggcuauagcguuagauuuuaaacccgguacaucagguucaccuaucgugaaccgagaggguaaaauugucggauuauacggaaaugggguaguaacaacgucaggcacauacguuagcgccauagcacaggcuaaagcaagccaagaaggcccacuuccagaaauugaagacgaagucuucagaaaaagaaaucuuacuauuauggaccuacaucccggaucuggaaagacaagaagauaucuaccggcaauaguacgagaagcaauuaaacguaagcuacguacauuaauacucgcucccacuagaguaguagcgucugaaauggcagaagcguuaaaggguaugccaauucguuaccaaaccaccgcggucaaaagugagcauacaggcaaggagauagucgaccuuaugugucaugcgacguuuacuaugcgacuuuuaucuccuguacggguaccaaauuacaauaugauuauaauggacgaagcgcauuuuacugauccuagcuccauugcugcuagaggauauauuucaacuagaguuggaaugggugaagccgccgccauuuuuaugacagccacgccaccuggaucaguugaagcauuuccgcaaucuaaugcagugauucaagaugaagaaagagauauaccagaaagaucguggaacucuggcuaugaauggauuacagauuuuccaggaaaaacugucugguucguuccuagcauuaaaucugguaaugauaucgcuaauugucuaaggaaaaauggaaaaagaguuauccagcuuagcaggaaaacuuuugauacggaauaucagaaaacgaagaauaaugacugggauuaugucgucaccacggauauuucugaaaugggagcgaacuuucgagcugacaggguuaucgacccccggcguugccucaaaccuguuauucugaaggauggcccagaaagagucauauuggcuggcccaaugcccgugaccguugcuuccgcugcccaacgcagaggacgaauagguaggaaucauaacaaagagggggaucaguauauauauaugggucagccucuaaacaaugacgaagaccaugcccacuggacagaagcaaaaauguuacuagauaacauuaacaccccagaaggcauaaucccugcgcuuuucgaaccugagcgcgagaaaagugcagccauugauggugaauauagacuucgaggugaagcaaggaagacguuuguggaacuuaugcgcagaggcgaccuaccagucuggcuuucauauaagguugcuagcgagggauuccaauacagugauagaagauggugcuucgauggugaaaggaacaaucaaguacuugaagaaaacauggacguagaaauauggaccaaggaaggagaacguaagaaacuacgaccuagaugguuggaugcaaggaccuacuccgacccucucgcauuaagggaauuuaaagaguucgcggcggggagacgaucagucaguggugaccugauacuagaaauuggaaaguuaccacaacaccucacccaacgagcacaaaacgcgcucgacaacuuaguaaugcuccauaacucugaacaagguggacgcgcguaccgucaugcuauggaagaauugccagacacuauagaaacuuuaaugcuucuagccuuaaucgcaguuuuaacagggggagugaccuuauucuuucucucagggcguggacucgguaaaacauccauagggcugcucugcguaauggcuucuaguguguugcuuuggauggccagugucgaaccacauuggauugcagcuaguauaauacucgaguucuuucugaugguacuacuuauuccagaacccgaccggcagagaaccccgcaagacaaccaguuggccuauguaguaauaggacuauuguuuaugauacucaccgucgcugcaaacgaaaugggacuauuagaaacaacaaagaaagaccuagggauaggacauguagcagucgaaaaccaccaccacgcagcaaugcuagacgucgacuuacauccagcuuccgcuuggacuuuauaugcaguggcgaccacgaucauuaccccaaugaugagacauacaauugaaaauacaaccgcaaacaucucucugaccgccauagcaaaucaagcagcaauccuaauggguuuagauaagggauggccuauaucgaaaauggacaucgguguacccuuacuggcccucgguuguuauucucaagucaauccccuuacuuuaaccgcagcuguacuuauguuaguggcucacuaugcgaucaucgguccuggacuacaagcaaaagcaacacgagaggcacagaaaagaacugcagcggguaucaugaaaaaucccacuguagauggcauaguagcuauugaccucgauccuguggucuaugaugcaaaguucgaaaaacaauuaggacagaucauguuacucauacuauguaccucgcaaauacuccuaaugcggacaacuugggcauuaugcgaaucaauuacacuugccacgggaccccugacuacccuaugggaaggcucaccaggcaaauucuggaauacaacgauagccguaucaauggcgaacauauuccgcggaucauauuuggcaggagcaggauuagcguuuagucuaaugaaaucccuagguggaggcagacgcggaacaggagcacaaggugaaacguuaggagagaaauggaaaaggcaauugaaucaacucagcaaguccgaauuuaacacauauaaacggucagguauaauggaaguagauaggucagaggcuaaagaagguuugaagcgcggggaaacgacaaaacacgccguaucgagagguacagcaaaacuaagaugguuuguggaacgaaauuuaguuaaaccagaagggaaaguaauagaccuuggcugcggucggggaggauggaguuacuacugcgcuggacuaaagaaaguaacggaagucaaagguuauacaaaggguggcccuggucaugaagaaccaauucccauggcaacauauggguggaaccucgugaaauuacauagcgggaaagauguuuucuuuauaccaccggaaaaaugcgauacguuacuuugcgacauuggugaaucuucuccuaaucccacaaucgaagaggggcguacccugagagucuuaaaaauggucgaaccguggcugcgagggaaucaauuuuguauaaaaauccuaaauccauauaugccaagcguaguagaaacuuuggaacaaaugcaacgaaagcacggagguaugcuugugcgcaacccccuuagcagaaauucuacacaugaaauguauugggugaguuguggaaccggaaauauagugucugcgguaaauaugacaaguagaaugcuauuaaaucguuucaccauggcucauagaaaaccuacuuaugaaagagacguagauuuaggagcaggaacacggcacguagcagucgaaccugaaguggcuaacuuggacauuauuggccagagaauugaaaacauaaaacacgaacauaagucaacauggcauuaugaugaagauaauccuuacaaaacaugggcuuaccacgguucguaugagguaaagccaagcggcucagcaagcagcaugguuaaugggguuguuaagcuauugacuaaaccaugggacgucauaccaaugguaacacaaauagcaaugacugauacgacaccauucggccagcagagaguuuuuaaggagaaaguagauacuagaacgccuaaggcaaagaggggcaccgcucaaauuauggaaguaacggcaaaaugguuauggggauuuuuaucuaggaauaagaaaccgagaauauguacgcgagaagaauuuacacguaaaguuaggucaaaugcugcgauaggcgcuguuuuuguggaugagaaccaguggaacuccgcgaaagaagcaguggaagaugaacgauucugggauuuaguucaccgggaacgagaauuacauaaacaaggaaaaugcgcaacaugcguguauaacaugauggguaaaagagagaaaaaguuaggagaauuuggaaaggcuaaagggagucgugccaucugguacauguggcuuggagcaagguuccucgaguuugaagcauuagguuuuaugaaugaagaucacugguucucccgugaaaauagucuuucagggguugagggcgaggguuuacacaaacuuggguauauucuccgagauauaucaaagauucccggagguaacauguacgcagaugacacagcagggugggauacacgcauuacagaggaugacuuacaaaaugaagcaaaaaucacagauaucauggaacccgaacaugcguuguuggcaaaaaguaucuucaaauuaaccuaucaaaauaaaguagucaggguacagcguccagccaaaaacggaacagugauggacguaauuucuagaagggaucaacguggauccggacagguagggacauacggucuuaauacauuuacuaacauggaagcccaauugauuaggcagauggaaagcgaaggaauauucaguccaucagaauuggagacacccaaccuggcagaacgcgcauuggacuggcuagagaaguauggcgucgaaaggcuaaaacguauggcgauuagcggggacgauugcguggucaaaccaaucgacgaucgcuuugcaacagcacuaacagcgcugaacgacauggguaaaguucguaaggacauaccccaaugggaaccuucaaaggguuggaaugacuggcaacaaguaccuuuuuguagccaccacuuucaucaauuaauaaugaaggauggcagagagaucguaguacccugccgaaaucaagacgaacuugucgggagggcacgaguaucucaaggagcagguuggucguuaagagagacagcaugcuuaggaaaaucuuacgcacaaauguggcaacuaauguacuuucacagaagagauuuaagguuagcggcuaacgcaauauguucagcuguaccuguggauuggauaccaacaucacggacgacauggaguauucacgcacaccaccaauggaugacaaccgaagacaugcuuaguguuuggaaccgaguuuggauagaagaaaauccauggauggaagacaaaacgcauaucucuuccuggggugauguacccuaucuaggaaaacgagaagaccaaugguguggaucucuaauuggucuaacggcucgagcaaccugggcaacaaauauacaagucgcaauuaaccagguucggagauuaauagggaaugaaaauuaucuggauuauaugacaucaaugaaacgauuuaaaaacgaaucagauccggaaggcgcacuuugguaa

SEQ ID NO: 21601 - RNA, 9879 nt, Artificial Sequence
  derived and/or modified CDS sequence (opt6) from DENV-1__FJ461336__SS-prME
ucgguuaccaugcuucuuaugcucaugccuacugcauuggccuuccauuugacgacuagagguggggaaccgcauaugaucgucaguaaacaagaaagaggaaaaucucuucuauucaaaaccagcgcuggaguaaauaugugcacgcucauagcaauggaucuuggagaacuaugcgaggacacgaugacuuauaaaugcccgagaaucaccgaaaccgaacccgaugacguugauugcuggugcaacgccacagauacguggguuacuuaugguacuuguucacaaacaggagaacaucgacgcgauaaaagaaguguugcauuggcaccacacguaggacuagggcuggagacacgcacagaaacauggaugucuuccgaaggagcauggaaacaaauucaaagggucgagacuugggcuuuaaggcauccuggauuuacuguaauugcacuauuuuuagcacacgccauugguaccuccauaacacaaaagggaaucauuuuuauuuuguuaaugcuuguaacccccagcauggcgaugcgcugcgugggaaucggaaaucgcgauuucguugaaggauuaucaggcgcaacauggguugacguagugcuggagcaugguaguuguguaacaacaauggcaaaagauaaaccuacguuggauauagaguuacuaaaaacugagguaacuaacccggcuguacuucgaaaacuaugcauagaagcuaaaauuagcaauacgacgaccgauucuagauguccaacacaaggagaagcuacacuuguagaggaacaagaugcgaauuuuguaugccgcagaacuuuugucgacagaggcugggggaaugguugcggacuuuucggaaaaggaagucucaucacaugugcuaaauucaagugcguaacuaaacuugaagguaaaaucguccaauaugaaaauuugaaguacucgguuauagucacaguacacaccggugaucaacaucaaguagguaaugaaucaaccgaacauggcacgacugcuacaauaacaccgcaagcgccaaccacggagauacaacuuacggauuacggcgcauuaacgcuugauugcaguccaaggacaggauuagauuuuaaugagaugguccuucuaacaaugaaagaaaaauccuggcugguacauaagcaaugguuucuagaucuuccuuuacccuggacaucuggcgcaucaacuagccaagaaacuuggaauagacaagaccuucuggucacguuuaaaacagcucacgcgaagaaacaagagguaguuguuuuagguagccaagagggcgcuaugcacacagcguuaacaggggcuacugagauacaaacaucaggaacgacaacaauauuugcuggccaucuaaaaugcaggcuuaaaauggauaaacucacguugaaaggaaugaguuauguuauguguacugguaguuucaaacuagaaaaagaaguggccgaaacgcaacauggaacuguccuaguacaaauaaaguaugaaggcaccgaugcgccuugcaaaauaccguuuucaacccaagaugaaaaaggaguuacccaaaauggaagauugauuacagcaaaucccaucguuacagacaaagaaaaaccaguuaauauagaagcagaaccaccauuuggagaaaguuauauagugauaggagccggugaaaaagcauuaaaacuuaguugguuuaagaaagguagcucaauaggaaaaauguuugaagcaacggcacguggagccaggcggauggcaauauuaggagacacagcaugggacuuugggaguauaggagguguacuuacuucaguuggaaaacuuguacaucaaauauuuggaacagccuacgggguauuauucagugguguaucauggacgaugaagaucgguaucggaguacuucuuacauggcuaggcuuaaacucaagaucaacaucuuuaaguaugacauguauugcaguuggauuaguaacauuauaccugggaguaaugguucaggcugauucagguugcguuaucaauuggaaaggaagagaauuaaaaugugggagcggaauuuucguaacaaacgaaguccauacauggacagaacaauacaaguuucaggccgacagcccaaaacgauuaucagcagcaauaggcaaggcuugggaagaaggugugugcggcauaagaagcgccaccagauuagaaaauauuauguggaaacaaauaucaaaugagcuaaaccauauauuacuagaaaacgauaugaaauuuacagugguagugggagauguagcggggauauuggcucagggcaagaaaaugauacgcccccagccgauggaauauaaguauucuuggaaaucuugggguaaagcaaaaauuauaggugcagauguccagaacacaacuuucauuauagauggucccaauacgcccgagugucccgacgaucagcgcgcauggaacauaugggagguagaggacuauggguucggaauuuuuacuacuaacauaugguuaaaacuaagggauucguauacucaaguaugugaccaccgccuaauguccgcagccauaaaagauucgaaagccguucaugcagauaugggcuauuggauugagucugaaaagaacgaaacguggaaacucgcuagagcaucauucauagaaguaaaaacauguauauggccaaaaucccauacucuguggucaaacggaguauuagaaagugaaaugauaauaccaaagauauacggaggacccaucucucaacacaacuacagaccuggauacuuuacgcaaacugcaggaccuuggcaucucggaaaacucgaacuggauuuugaucuuugcgaaggaacuacaguaguggucgaugaacauuguggcaaucggggaccaucacucagaaccaccacuguaacagguaaaauuauucaugaauggugcugucguaguuguacucuaccaccauuaagguuuagaggcgaagauggcugcugguaugguauggagauacggccugucaaagagaaggaagaaaaccuggucaaauccauggucagcgcuggcucaggugaaguggauucuuucaguuuaggacugcuaugcauuucaauaaugauugaagaaguuaugcgcucaagguggucaagaaaaauguuaaugacaggcacucuugcuguuuucuuccucuuaaucauggggcaauugacuuggaacgauuuaauacgccuuuguauaaugguaggcgcuaaugcaucugauaggauggggaugggaaccaccuaccuagcacuuauggcaaccuuuaagaugaggccaauguuugcaguagggcuacuauuucggcgauuaacaucacgugaaguacuucuucugacuaucggacucagccuaguagcaaguguggaacuaccaaauucccuagaagaauugggagaugggcuagcuauggguauaaugauacuuaaauuauugacagauuuucagagucaucaauuaugggcaacguugcuuagccuaacuuucaucaaaacuacuuucaguuuacauuaugcauggaagacuauggcaaugguccuaucuauaguaagccuguucccucuuugucuuucaacaacaucgcagaaaacgacauggcuacccguccugcuaggcucguuaggauguaaaccacuaacgauguuccuaauugccgaaaacaaaauauggggccgcagaagcuggccauugaacgaaggaaucauggcuguuggaauaguaaguauauuacuaagcucacuacugaagaaugaugugccucuugcugggccccuaauugcuggagggauguuaauugcaugcuauguaauuucagguaguagugcggaucuaucauuagaaaaagcugcagaaguaucaugggaagaagaggccgaacacucaggggcaucucacaauauacucgucgagguacaggacgauggaacaaugaaaauuaaagaugaggagagggacgauacauuaacgauacuauuaaaggcaacauuguuagcaguaucagguguauacccacuuaguauaccugcuacgcuauuuguaugguauuuuuggcagaagaagaaacagcggucuggggucuuaugggacacuccaucuccgccagaaguugguagagcaguacucgaugacggaauauacaggauaaugcaacgaggcuuacugggacggagccagguuggugugggcguauuccaagaaaauguuuuucauaccauguggcauguaacaagaggagcugucuuaauguaccaaggaaaaagauuggaaccgucgugggcaagcgugaaaaaggaccuaauuucauaugggggaggauggcggcugcaagguucauggaacacuggagaagaaguccaaguuaucgcuguggaacccgggaagaaucccaaaaacguccagacugcuccgggaacauuuaaaaccccagagggugaagugggggcaaucgcuuuagacuuuaaaccaggcaccuccgguaguccaauaguaaaccgcgagggcaagauagucggcuuauaugggaacggaguaguuacuaccaguggaacguacguuuccgccaucgcgcaagcuaaagcgagccaagaggguccuuuaccagagaucgaagacgaaguguuccgcaagaggaaccucacaauaauggaucuacauccaggaagcggaaagacuagaagguacuuaccagcaauaguuagagaagcuaucaaaagaaaacuaagaacucuaauccuagcgccuacuagagucguggcaucagaaauggcugaggcauuaaaagggaugccuauacgauaccaaacgacagcugugaaaagugaacacacugggaaggaaauaguagaucuaaugugccaugcuacguucacgaugcgauuauuaucaccugugcgugugcccaauuauaacaugauaauaauggaugaagcacacuuuaccgauccaaguaguauagcggcaagggguuauauaucuacucgaguaggcaugggagaagcagcugcaauuuuuaugacugcaacuccucccggcaguguugaggcuuuuccgcaaaguaacgcugucauccaggaugaggagcgagauauaccagaacgaaguuggaacucuggcuacgaauggaucacagauuucccagggaaaacugucugguucgucccaagcaucaaauccggaaaugacauagcuaacugccuuagaaagaacggaaaacgcguuauacaacuuaguaggaagacuuucgacacggaauaccagaaaacuaagaacaaugauugggacuauguaguaacaacagacaucucggagaugggcgcaaacuucagggcugacagaguaauagaucccagacgauguuuaaaacccguaauccuuaaggacggaccagaacggguuauauuagcaggcccgaugccgguaacaguugccucugccgcucaaagacgaggacgaaucggucguaaucauaauaaagaaggagaucaguacauauacaugggucaaccccuuaacaaugaugaagaucacgcccauuggacagaagcaaagauguuauuagacaauaucaacacuccagaagguaucauucccgcccuuuucgagcccgaaagagaaaaaucagcggcaaucgacggcgaauaucggcuaagaggagaagcucgaaaaaccuucguagaacuuaugcgacgaggugaucugccaguaugguuaaguuacaaaguggcgagugaaggauuucaauauagugacagacguuggugcuuugauggugaaaggaauaaucaaguauuagaagaaaacauggacguggaaauauggacaaaggaaggugagagaaagaaacuccgcccucguugguuagacgcgaggacuuauucagauccauuagcacuaagagaguuuaaagaguuugcagccggccggaggagcguaaguggugaccugauccucgaaauuggaaaguuaccucaacauuuaacucaacgugcccaaaaugccuuggauaauuuaguaauguuacacaacucugaacaagguggacgugcauacaggcaugcaauggaagaguugcccgacaccauagagacguuaaugcuauuagcauugauagccgugcuaacuggaggagucacccuauucuuucucagugguaggggccuuggaaaaaccucgaucggacuacuuugcguaauggcuagcuccguccuucuguggauggcuagcguagaaccacacuggaucgcggcuucuauaauauuggaauuuuuccucaugguucuacuaauaccagagccugaucgccagcgaaccccucaggauaaccaacuugccuacguaguuauaggacuguuguuuaugauacuuacaguagcugcgaaugaaaugggauuguuagaaacaaccaagaaagacuuaggcauaggacauguugcaguggaaaaucaucaucaugcagccauguuagauguugaccuacauccggcaagugcauggacacuauacgcugucgcgacaacuauuauaacuccgaugaugcgacacacuauagaaaauacuacagccaacaucucucucacagcaauagcuaaucaagcagcaauacuuauggggcucgacaaaggauggccaaucucaaaaauggacaucgguguaccgcuacuugcucuagggugcuauagucagguuaauccacucacacucacagcagcaguccuaaugcuuguugcccacuacgccauuauugguccagguuuacaagcuaaagcuaccagggaagcccagaaaagaaccgcugcgggaaucaugaagaauccuacuguagacggcauaguagcaaucgacuuagacccggugguuuacgaugcgaaauucgaaaaacagcuaggccaaaucaugcuucucauacuuuguacgagccaaauccuguuaaugagaaccacuugggcauuaugugaaagcauaacauuagcgacgggaccacuuacaacgcucugggaaggaucaccaggaaaauuuuggaacaccaccaucgcuguuucaauggcaaauauuuuucggggaaguuaucuugcaggcgcaggucuagcauucaguuuaaugaaaagccuaggaggugguagaagaggaaccggagcacagggcgagacgcucggggagaaauggaagcgacaacuaaaucaacuaagcaaaagcgaauuuaauacauauaagagaucgggaauaauggaaguugaucgaucagaggccaaagagggacugaaacgaggagaaacuaccaaacacgcagucagucgugggacagcuaaauugagaugguuugucgaaagaaauuuaguaaagccggaaggcaaaguaauagauuuaggaugugggcgaggaggguggucauauuauugugcuggacucaagaaaguaacagaaguuaaaggguauacuaaaggagguccaggucaugaagaaccgauccccauggcaacuuaugguuggaacuuagucaaacuucacaguggaaaagacgucuucuuuauaccgcccgagaaaugugauacacuauugugcgauaucggagaaagcaguccaaaccccacuaucgaagaaggacgaacccuaaggguauuaaaaaugguagaaccaugguuacgaggaaaucaauuuuguauuaaaauauuaaauccauacaugcccagugugguagaaacucucgagcagaugcaaaggaagcauggcgggauguugguuaggaauccucuuaguaggaauaguacacaugaaauguacugggucagcuguggaacggguaauaucguaucggccgucaauaugacaagcagaauguuauugaacagauuuacaauggcucaucgcaaaccaaccuacgagcgugacguagaucuaggugcugggaccagacacguugcgguagagccugaaguggcaaaucuagacauaauugggcaacgaauagaaaacauaaaacaugaacauaagagcacuuggcauuacgacgaagacaacccauacaaaacgugggccuaccacggcucguacgagguaaagcccagugggagugcgucaucaauggugaacggagugguuaaacuucugacaaagccgugggacgugauaccaaugguaacacaaauagcgaugacggauacuacaccauuuggucaacaaagaguuuucaaggagaaaguugauacacgaaccccaaaagcaaagagagggacugcccaaaucauggaaguaacggcaaaaugguuaugggguuucuuaucuagaaacaaaaagccaagaauauguacucgagaagaauuuacacguaagguuagguccaacgcggccaucggcgcgguauuuguugacgaaaaccaguggaacucagcaaaggaagcaguagaagaugaacgcuucugggauuugguucaucgagaacgagaacuacauaaacaggguaagugugcgacaugcguuuauaauaugauggggaaacgagaaaagaaacucggcgaauuugguaaagccaaaggcagucgagcuaucugguauaugugguuaggggcucgauuccuagaauuugaagcacuaggauucaugaaugaagaccauugguucucgcgagaaaauucauuaaguggaguagagggagagggucuucauaaauuaggauauaucuuaagagauauaaguaacauaccaggugguaauauguacgcggaugauaccgccggaugggauacuagaaucacagaggacgauuuacagaaugaagcacgaauaacagauauuauggaaccagaacacgcgcuucuugccaaaaguauuuuuaaauugaccuaccaaaauaaggugguacguguacaacggccugcaaagaacggaacaguaauggacgugauuucaaggcgggaucaaagaggcucaggucaaguagguaccuauggauuaaauacuuucacaaauauggaagcgcaauuaauacgccaaauggaaucugaaggaaucuucagcccaucagaacuggagacaccgaaucuagcagaaaggguacuugacugguuggaaaaauacggaguggagagauuaaaacgaauggcaauaucaggggaugacugcgugguaaaacccaucgacgauagauuugcuacggcauuaacagccuuaaacgauaugggaaaaguucggaaagauauuccucaaugggaaccaucaaaagguuggaacgacuggcagcaaguaccauuuugcagucaucauuuucaccaauuaauaaugaaagacggaagagaaauaguuguaccauguagaaaccaggacgagcuaguuggccgggcacggguaagccagggagcggguuggucacuacgugagaccgcaugucuuggaaaaucuuacgcucagauguggcagcuaauguacuuccauagaagagaccugagauuagcagcaaaugcaaucuguucggcggugccuguagauuggauuccaacaagucgcacaaccuggaguauucaugcacaccaucaauggaugacaacagaggauauguuauccguuuggaacaggguuuggauugaagagaauccuuggauggaggacaaaacccauaucucuucguggggagauguaccuuaucuugggaagcgugaagaccaaugguguggaaguuuaauuggucuaacugcucgcgcuacgugggcaaccaacauacaaguggccauaaaucagguaagaagacuuaucggaaaugaaaacuacuuggauuacaugaccaguaugaagcguuucaaaaaugagagugacccagagggugcacuuugguaa

SEQ ID NO: 21602 - RNA, 9879 nt, Artificial Sequence
  derived and/or modified CDS sequence (opt6) from DENV-1__FJ410266__SS-prME
ucugucacuaugcuauuaaugcuuaugccuaccgcauuagccuuucaucuuacuacccgugguggugaaccccauaugauugugacuaaacaagaacgggguaaaucccuacuauuuaaaacaucugccggagucaauaugugcacauuaauagcaauggauuuaggugaacugugcgaagacacaaugacauacaaauguccaagaauuacugaagcagaaccagacgaugucgacuguuggugcaaugcaacagacacauggguuacauauggaacauguucccaaacuggugaacacaggcgcgauaaacgaucaguugcgcuagcaccacacguaggacuuggauuagaaacaagaacagaaacauggaugucaucugaaggggcuuggaaacaaauacaacgugucgaaacuugggcauuacgccauccggguuuuacgguaauugcauuauuccuugcucaugcaauuggaacaagcaucacccaaaagggaauaauauucauucuuuuaaugcucguuacgccaucgauggcuaugcgaugcgucggaaucgguaguagagauuuuguggaagggcugucaggugcaaccuggguugauguagugcuggaacauggaucgugugucaccaccauggcgaaagauaaaccuacacuggacaucgaacuuuugaagacagaaguaacuaauccggcaguauuaagaaaguuauguauagaagcaaaaauaucuaauacaacaacugacucgcgauguccuacucaaggagaagcaacuuugauggaggaacaagaugcuaauuuuguaugucggcggacuuuugucgacagaggaugggguaauggauguggacuuuucggaaaagguucccuaauaacgugcgcuaaauuuaaaugugugacgaaacuagaagggaagauaguacaauaugaaaauuugaaauacucggugauaguaacgguacauacaggagaccaacaccaaguuggaaacgaaaguaccgaacauggaacaacggccacuauuacuccacaagccccaacaagugagauacaacuaacagauuacggagcauuaacucuugauuguucuccgcgcaccggucucgacuuuaaugaaauggucuuacugacuaugaaagagaaaucaugguuaguucacaagcagugguuucuugacuugccucuaccauggacuuccggcgcuucaaccucgcaagaaacauggaauaggcaggaucuucucguaacauuuaagacagcgcaugccaagaaacaagagguuguaguauuaggcagucaggaaggcgcaaugcacaccgcacuuacaggagcaaccgaaauacaaacaucaggcacaacaaccauauucgcaggccauuuaaaaugucgucuuaaaauggauaaauuaacauugaaaggcauguccuaugugauguguaccggcuccuuuaaacuggaaaaagaaguagcagaaacgcaacauggaacaguacuuguacaaauaaaauacgaggguacagaugcgccauguaagaucccguuuucuacgcaggacgaaaaagguguuacccaaaauggaagauugaucacagcaaauccgauaguaacagacaaagaaaaaccgguaaauauugaagcggaaccaccguuuggcgaaaguuauaucguaauaggcgcuggagaaaaggcucuaaaacugucaugguuuaaaaagggaagcaguaucggcaaaauguuugaagcaaccgcuagaggggcgcgccgaauggcaauucuuggugacacagcgugggauuuuggcaguauaggagguguuuucaccagcguaggaaaacuggugcaccaaauauucggaacggcauaugguguauuauuuucgggggucucuuggacgaugaaaaucggcauagggguuuuacuuacuugguuaggguuaaauucacguucuacgagccuuucaaugacaugcauugcagucgguuuaguuacucucuauuuaggcguuaugguucaggcugacagcggcugcguuaucaauuggaaaggaagagaacuaaaauguggcagcggaauuuuuguaaccaaugaaguccauacuuggacggaacaauauaaauuucaagcggacagcccgaaaagacuaagugcagcaauagggaaagcgugggaagaaggagucugcggcauucgcagugcuacuagauuggagaauauuauguggaaacaaaucagcaaugagcugaaucauaucuuguuagaaaaugacaugaaguuuacagucguuguuggugacguaguagguauccucgcccagggcaagaaaaugaucaggccucaaccgauggaacauaaauacuccuggaagucauggggaaaagcaaagauaauaggagccgacguccaaaacaccacguucauaaucgaugguccaaauacuccagaaugcccagaugaccaacgugccuggaacauuugggaaguagaagacuauggauucgggauuuuuacaacaaacaucugguugaaauuaagagacaguuacacgcagguaugcgaccaucgccuaaugagcgcugcaaucaaagacaguaaagcgguacacgcagauaugggauacuggauagaaagugagaagaaugaaaccuggaaauuagcacgugcaucuuuuauugaaguaaaaacuuguauauggcccaaaagccauacauuauggucaaacgggguauuagaaagugaaaugauaauuccaaaaaucuacggcggcccuauuucacaacauaauuaccgaccaggguacuuuacacagacugcaggaccauggcauuuaggaaaauuggaacucgauuucgaccugugugaagguacaacugucguaguugacgaacauuguggcaauagaggaccuagucugcguacuacaacaguaacugguaagauaauucaugaauggugcugccgcucuugcacgcuuccaccuuuaagauuuaaaggugaggacggaugcugguacggaauggaaauuaggccaguaaaagaaaaagaggaaaaucucguaaaaucaauggucucagcagggucaggagagguagauagcuuuucauuaggacuauuguguauuucaauaaugauugaagaaguuaugcggagccgcuggagcaaaaagaugcuaaugacggggacccuugcgguauuuuuacuguugauaaugggacagcuaacuuggaaugaccuaaucagacuauguauuaugguuggggccaaugcgucagauagaaugggcaugggaacuacuuacuuggcuuugaucgccaccuucaaaaugcguccuauguucgcugucggucugcuauuccgacgucuuacuucgcgagaaguucuacuccucaccauuggccucucguuaguagcaagcguagaacuaccaaauucccuagaagaacucggagacggccucgcgaugggaauaaugauauuaaaacuauuaacagauuuucaaucacaccaauuaugggcgacuuuauuaucuuucaccuucaucaaaacgacgcugucgcuucauuacgcauggaagacaauggcaaugguauugucgaucguuagcuuauuucccuuaugucuguccacuacaagucaaaagacaacaugguuaccaguccuacuugguucucuaggauguaaaccucuaacuauguuccuaauagccgaaaacaaaauauggggucgcaaaagcuggccuuugaacgaggggaucauggcuguaggaguggucaguauacuguugucgucauuacugaagaacgauguuccccuagcagguccucucauagcaggcggaaugcuaauagcaugcuacguuauaucugggucaucagcagaucuaucacuagagaaagcagcagaaguuucaugggaggaagaggcagaacacagcggagcaucccauaauauccugguagaaguccaggacgaugguaccaugaagaucaaagaugaggagcgggacgacacucuaaccauauuauugaaggcaacucuucucgcggucuccggaguauacccuuuaucaaucccagccacguuauucguauggcacuuuuggcaaaagaaaaagcaaaggagcggcguacucugggauacaccaucacccccugagguggaaagagcaguauuagacgauggaauauaucgcauaaugcagagagggcuacuaggcaggagccaaguaggagugggcguuuuccaagagaauguuuuccauacgauguggcauguaaccagaggagcgguucuaauguaccaaggaaaacgauuagaaccaagcugggcuucuguuaagaaagaccugauaucauaugguggaggguggagacuccaaggcagcuggaacacuggagaagaaguacaggucauagcaguagagcccggcaaaaaucccaaaaauguacaaacugcaccagggaccuucaaaacaccugagggcgaaguaggagcuauugcgcuggauuucaaacccggaacuucggggaguccuauaguaaacagagagggaaaaauaguaggacuauacggaaaugguguaguuacuacuucaggaacguaugucucagccauagcacaagccaaggcuucccaggaaggaccacuuccugagauagaagacgaaguauuucgcaaacguaaccuaacaauuauggaucuacauccaggauccgggaagacaagacgauacuugcccgccauugugagagaagccauaaaaagaaagcucagaacacuaauccucgcuccaacacgcguuguagcaagcgagauggccgaagccuuaaaaggcaugcccauccguuaccaaacuacugcggugaaguccgaacauaccggcaaagaaauaguugacuuaaugugccaugcgacauuuacaaugagacuguuaaguccgguaaggguaccaaauuauaacaugauaauaauggaugaagcacacuuuacggacccgagcucaauugcugcaagagguuauauaucaacgaggguaggaaugggagaagcagcugcaauuuucaugaccgcaacgccaccugggucaguggaagccuucccacaaagcaaugcagucauacaagacgaagagagggacauacccgaacguucauggaacucugguuaugaauggauaacugacuuuccaggaaaaacggucugguucguaccuaguauaaagucaggaaaugacaucgcgaauugccuuaggaaaaauggcaaaagagucauccaacugaguagaaagacguuugauacagaauaucagaaaacgaaaaacaaugauugggauuacguaguuacgacugauauaucagagaugggagccaacuucagagcugacagagucauagauccaaggcguugcuuaaagccggugauacuuaaggauggcccagaaagagugaucuuagcugguccaaugccuguaaccguugcgagcgccgcacagagacgaggaaggaucggaaggaaucacaacaaagaaggagaucaauacauauacaugggacaaccuuuaaacaacgacgaagaccacgcacauuggacagaagcgaaaaugcuacuagacaacauaaacacgccugaggguauaauuccagcacuauuugaaccugaaagggagaaaagcgcagcuauagauggagaauauagacuaagaggagaagcccgaaagaccuucguagagcucaugcggaggggugaucuacccguaugguugagcuacaaaguggccuccgaaggguuccaguauagugaccgccgcuggugcuuugacggugagaggaauaaccaaguccuggaagaaaauauggauguugaaaucuggacaaaagaaggugaacgaaagaaacuccgccccaggugguuagaugcucgaacuuauucagauccuuuggcucuacgcgaauuuaaggaauuugcagcggggagaagaucagucucaggagauuuaauucuagaaauaggaaaacuuccccaacacuugacucagagagcacaaaaugcucuagacaaccugguaauguuacauaacucagagcaggguggcagggcuuaucggcacgcgauggaagaauuacccgauacuauagaaacauuaaugcuacuagcauuaauagcgguauuaacagggggaguuacacuauucuuucuaaguggccgcggauugggaaagacaucaauuggacuacuaugcguuauggcgaguaguguacuacuauggauggcguccguugagccacauuggaucgcagcgucgauuauauuagaguucuuucugaugguuuuauuaauaccagaaccagaucgacaaagaacaccccaagacaaccaauuagcguaugucgucauaggacuacucuuuaugaucuuaacgguagcagcaaacgaaaugggacuacuagagacgacuaagaaagaucuuggaauuggacauguagcaguagaaaaccaucaucaugcuaccauguuagacguagauuuacacccagcaucggcguggacacuguaugcagucgcgacgacaauaauuacgccaaugaugcggcauacaauagaaaacaccacugcaaacauaucgcuaaccgcuauugcaaaccaggcagcaauccuuaugggccucgauaagggauggcccauaucuaagauggauauugguguaccguuacuugcucuaggcuguuacucucagguuaaccccuuaacacuuacagcagccguauuaaugcuaguugcccauuacgccauuauaggcccuggauuacaagcuaaagcaacuagggaagcccaaaaacguacggcggccgggauuaugaaaaacccgaccguggauggaauuguugccauagaucuagacccgguuguguacgaugcuaaauuugaaaaacaguugggacaaauaauguuguuaaucuuauguacaucacaaauccuuuugaugagaaccacaugggcuuuaugcgaaucaauaacccuugcuacggggccguuaaccaccuuaugggaaggaucgccuggcaaauuuuggaauacaaccaucgcuguauccauggcaaauauauuuagaggcagcuauuuagcaggagcuggauuagcauuuucuuuaaugaagucauuaggggguggaagaaggggaacaggagcacaaggcgaaaccuuaggugaaaaguggaagaggcaauuaaaccagcucagcaaaucugaguuuaauacauacaaaaggagugguauuauggaaguugaucgaucagaagcuaaggaaggucuuaaaagaggcgaaaccacucgacaugccguaagcagagguacagcuaaauuaaggugguuuguugaaagaaauuuagugaaaccggaggguaagguuaucgacuuaggaugugguagaggcggcuggucauauuauugugcugggcuuaagaaaguuacagaagugaaaggauauaccaaaggagguccggggcaugaagaacccauuccuauggcuacauauggauggaaucucguuaaacuucacucaggaaaagauguauucuuuacacccccugaaaaaugugacacgcuauuaugcgauaucggagagucaagcccuaaucccacaauagaagaaggacguacacuccgagucuuaaaaauggucgaaccauggcugaggggaaaucaauuuuguauuaaaauacugaaucccuacaugcccaguguaguugaaacacuggaacaaaugcagagaaaacaugguggaauguuagucagaaauccauuaagccgaaauagcacgcaugaaauguauuggguuucgugugguacaggaaacaucguaucggcagucaacaugacuucuagaaugcucuuaaacagguuuaccauggcacaccgcaagccuaccuaugagagggauguugauuuaggugcaggcacacgucauguugcuguggaaccagaaguagcaaauuuggacaucauaggacaaagaaucgaaaauauuaaacaugaacauaaaucuaccuggcauuaugaugaagacaauccauacaagacaugggcauaucacgguucguaugaaguaaaaccaagugguucggcauccagcauggucaacgguguaguaaaauuguuaacaaagccaugggauguuauaccaaugguuacgcaaauugcgaugacagacacaacgccauucggccaacaacggguauucaaggaaaaaguugauacucgaacucccaaagcuaagagaggcacggcacagauuauggaaguaacagcuaagugguuauggggauucuuaucgcgaaacaaaaagccccgaauuugcacucgugaagaauuuacaagaaaaguaaggagcaaugcugcuaucggagcaguuuucgucgacgagaaucaauggaacucugcaaaagaagcaguggaggacgagagauucugggaucugguucagaaagaaagagaauugcacaaacaaggaaaaugcgcuacaugcguauauaauaugaugggcaagcgagaaaagaaacuuggugaauuugggaaagcaaaggguucaagggccauaugguauaugugguuaggugcucgcuuccucgaguuugaagcauuaggauucaugaaugaagaccauugguuuucaagagaaaauucguuguccggcguggaaggcgaaggacuacauaaauuaggcuauauacuuagggacaucucaaagaucccgggagguaauauguaugcagaugauacggccgguugggauacaagaauaacagaagacgaccuucaaaacgaagcuaaaaucacagauaucauggaacccgagcaugcauuacuugcaaccucuaucuucaaauugacauaucagaacaaagugguccggguucaaaggccagcuaagaauggcacgguaauggacguaaucucaaggcgggaucagagaggaagcggacaagucggaacuuauggauuaaauacauuuacuaauauggaagcacaacuuauacgacaaauggaaucggagggcauauuccuccccggagaguuagaaacgccaaaucuagcagagaggguuuuggauugguuagagaaguauggaguggaaagauuaaaacguauggcuauauccggagaugacugugugguuaaaccgauugaugaucgauucgcaacugcacugacagcccuaaaugauauggguaaaguuaggaaagauaucccacagugggaaccaagcaaggguuggaaugauuggcaacagguaccuuucugcagccaccauuuucaucaacugauaaugaaagacggaagagaaauaguuguaccuugcaggaaucaagaugagcugguaggacgggccagaguaagucaaggagcaggauggucacugcgagaaacagccuguuuggggaaaaguuaugcgcagauguggcaauugauguacuuucauagacgggaucuacguuuagcagcgaaugcgauauguagugccguucccguugacuggguuccaacuucaagaacgaccuggucaauccacgcucaccaucaauggaugacuaccgaagacaugcuaucaguauggaauagagucuggauagaagagaaucccuggauggaggacaaaacccacguaucaaguuggggagauguaccuuaccuaggcaaaagagaagaucaaugguguggcagcuugaucggccuaacugcaagggcuacaugggcaucgaacauucaaguagcaauuaaccaaguaaggagauuaaucgguaaugaaaacuaucuagauuauaugacaagcaugaaaagauucaaaaaugaaggggaucccgaaggcgcauuaugguaa

SEQ ID NO: 21603 - RNA, 9879 nt, Artificial Sequence
  derived and/or modified CDS sequence (opt6) from DENV-1__FJ410269__SS-prME
ucaguaacgauguuauuaauguuaaugccgacagcauuggcauuucaccugacaacaagagguggugaaccucauaugauuguuacgaaacaagaaagaggaaaauccuuguuguuuaaaaccucagcagggguuaauauguguacauuaauugcgauggacuugggggaacuaugugaagauacaaugaccuacaaauguccucguauaacagaagcggaaccggacgauguggauuguugguguaacgcaaccgauacauggguuacauaugguaccuguucgcaaacaggagaacacagacgcgauaaacgaaguguggcgcuagcaccacacguuggucuaggcuuagagacucggacugagacauggaugaguucggagggggcauggaaacaaauucaaaggguugaaacaugggcauuaagacauccuggcuuuacaguuaucgcuuuauucuuagcgcacgccauugggaccuccauaacacaaaaaggcaucauauucauauuacucauguuggugacuccgaguauggcaaugcgauguguaggaauuggaaguagagauuucguagaaggccuauccggugcaacuuggguagacguaguauuggaacaugguaguugcguaacgaccauggcaaaagacaaacccacauuagacauagaacugcuaaaaacggagguaacaaaccccgcgguauuacggaaacucugcauugaagcuaaaauaucaaauacuacuaccgacucacgauguccaacacaaggggaggcuacucucauggaagaacaagaugcgaauuucgucugcagacgcacuuucgucgacagagguuggggaaaugguuguggacuuuuugggaaaggcagcuuaaucacgugugccaaauucaaauguguuacaaaacucgaaggcaaaaucguccaauaugaaaaccucaaauacagcguuaucgugacgguucauacaggcgaucaacaccaaguugguaacgaaucaaccgaacaugguaccacagcuacaauuacgccucaagccccuacauccgaaauacaacuuacugacuauggcgcucucacacuagauugcucuccacguacaggacuggacuuuaacgaaaugguucuuuuaacgaugaaagaaaaaucaugguuaguacauaaacaaugguuucuagauuugccauuaccguggacaaguggugcaagcaccagccaggaaacuuggaacaggcaagaccuucucguaaccuucaaaaccgcccaugcgaagaaacaagaaguaguaguguuagguagucaggagggagcgaugcacacagcucuaacuggagcaacugaaauacaaacaaguggaacuacuacaauauucgcaggucacuuaaaaugcagguuaaaaauggacaaauugacacucaaaggaaugucuuacguuaugugcacagggagcuuuaaacuagagaaagaagucgcggaaacccaacaugguacaguguugguacaaauaaaauaugagggcacggacgcaccauguaaaauacccuuuucaacacaagacgaaaaaggaguuauacaaaauggacgacuaaucaccgccaacccuauugucacugacaaagaaaaaccaguaaauauugaggcugaaccaccauuuggagaguccuacauaguaauuggaguuggcgaaaaagcccuaaaacuaucaugguuuaagaaaggcucauccauugggaaaauguuugaagcaaccgcucgcggugcacgccgaauggcaauucucggagauacagcgugggacuuuggcucaaucggaggaguguuuaccucaguuggcaaauugguacaccagauauucggaaccgcauauggaguauuauucaguggaguuucguggacaaugaaaauugggauuggaguauuauugacauggcuugggcuuaauagucgaaguacuucccuaaguaugaccugcauagcaguaggauuaguuacgcuauaccuaggagucauggugcaagccgacucuggauguguaauaaauuggaagggucgggaacuaaaguguggcuccggcauuuuugugacuaaugagguucacacguggaccgagcaauacaaauuucaagcugacucuccaaaacgacuaagugcagcaaucgguaaggcaugggaggaaggggugugugguauacgaaguguuacgagacuagaaaauaucauguggaaacaaauaucuaaugaauuaaaucauauacuacucgaaaacgacaugaaauuuacagugguaguuggggaugucguaggaauauuagcucagggcaagaaaaugauaagaccacagccaauggaacauaaauauucguggaaaucauggggaaaagcuaaaauuauaggagcugauguacaaaauacaacuuuuauuauagacgguccuaacaccccggaauguccggacgaucaacgagccuggaauaucugggaaguugaagauuacggauuuggaauauuuaccacuaacauauggcugaaguuaagagacuccuauacacaggcuugugaucaccgauuaaugagugcagcgauaaaagauuccaaagccguacaugcggacaugggcuacuggauagaauccgagaaaaaugaaacguggaaacuagcaagagcgucauuuauugaagugaaaaccuguauauggccaaaaagucauacacugugguccaacggaguacuagagagugaaauggugauaccuaaaaucuauggaggaccuauaagccaacauaauuaucgcccuggguauuucacgcaaaccgcaggucccuggcaucuaggaaaacuggagcuugacuuugacuuaugugaaggaaccacggucguaguugaugaacauuguggaaauaggggaccuagccuuaggaccacuacaguuaccggaaaaauaauacaugaauggugcuguagaaguuguacucuuccaccguuacgguucaaaggagaagaugguugcugguauggcauggaaauacgacccguuaaagagaaggaagaaaauuugguaaagucgaugguaagcgcuggaucuggggagguugauaguuucagcuugggacuuuuauguaucucuauuaugauugaagagguuaugcguaguagauggagcaggaagauguuaaugaccggaacuuuggcaguauuuuuauugcuaauaaugggucaacuaacuuggaaugauuugauaagauuauguauuaugguaggagcuaacgcaucugacagaaugggaaugggaacaaccuaucuagcucuaauggcaacauuuaaaaugaggccuauguuugcaguaggcuuacucuuuaggcgcuuaacaucacgggagguacucuugcuuacaaucggacuuucauuaguugccucaguggagaucccaaauucauuagaggaauugggagacggauuagcgaugggcaucaugauacuaaaauugcugacagacuuucaaagucaccagcuuugggcaacucucuugucgcuuacuuuuauaaaaacaaccuuaaguuuacacuaugcuuggaaaacaauggcaaugguauuaucaauaguuucauuauuuccgcuaugccuaaguacaacaagccagaaaacaacauggcuacccguucuuuuaggaucauugggauguaaaccacugacaauguuucuuaucgccgaaaauaaaauaugggggcgaaagucauggccuuuaaaugaaggaaucauggcgguuggaguaguaucuauucuacucaguagucuccuuaaaaacgauguuccacuagcgggccccuuaauugcagggggaaugcuaauagcauguuaugucauuuccggcucaucagccgaccuaucacuugaaaaagcugcagaaguaucaugggaggaagaagcagaacauucaggagcuagucauaauauccuagucgaaguacaagaugacggcacgaugaaaauuaaagaugaggaacgugacgauacacugacaauacuauuaaaggcgacacuacuugcuguauccgguguauacccuuugaguauuccagcaacauuauucgugugguacuucuggcagaagaagaaacaacgaagcggagucuuaugggauacaccgagcccaccggagguggaaagggccguauuagacgaugguaucuaucgcauaaugcaacggggauuauuagggcggagucaaguggggguaggcguauuccaagaaaacguguuucauacaauguggcaugugaccagaggugcaguacucauguaucaaggcaaacgauuagaaccuaguugggcuucagucaagaaagacuugauuuccuauggcggaggguggaggcuacagggaucguggaauacgggugaggagguacaaguaauugcaguggaaccagguaaaaaucccaaaaauguccaaacggcccccgguaccuucaaaacaccagagggagaaguaggugcaaucgcauuggauuucaaaccaggaacuucuggaucaccaauaguaaaccgagaagguaaaauugugggucuauauggcaacggagucguuacgacaucaggaacauauguaucugcaaucgcacaagcaaaggcuucucaagagggcccucugccagaaauugaggaugaaguuuucaggaaacggaaccucaccauaauggaucuccacccggguaguggcaaaaccaggcguuauuugccggcaauaguacgcgaagcuauuaaacggaaacuuaggacacucauccuugcaccgacucguguuguagcgucagaaauggcagaggcacuuaaggggaugccaaucagauaucaaacuaccgccguuaagagugagcacacuggcaaagaaauaguggaucuaaugugucacgcaaccuuuaccaugagguuauuaucaccagucagggucccaaacuauaauaugaucaucauggaugaagcccauuuuacugacccaaguucaauagcagccagagguuauauuucaacaagaguaggaaugggugaagcugcugcaauauuuaugacugcgacuccgccuggaaguguagaagcauucccucaaucgaaugcaguuauacaagacgaagaacgcgauauaccggaacguaguuggaacagcggauaugaauggauuacagacuuuccuggaaaaacagucugguuuguaccaaguauuaaaucgggaaaugauauagcuaacuguuuaaggaaaaacggaaagagaguaauccaauuaaguagaaaaacguucgacacagaguaccaaaagacaaagaacaaugauugggauuauguaguaacuacugacauuucugaaaugggggcaaacuuuagggcagacagggugauagauccuagaagguguuugaaacccguaauccuaaaagaugggccagaaagaguuauauuagcagguccgaugccgguuacgguagcuuccgcggcucaaaggagaggaagaauuggaaggaaucauaauaaagaaggggaccaguacauuuauaugggacaaccgcuaaauaaugaugaagaccaugcacauuggacagaggcaaaaaugcuuuuagauaauauaaacacuccugaggguauaauaccugcgcuguucgaaccagaacgagaaaaaucugcagcuaucgacggagaauauagacuucgaggggaggcucgcaaaacauucguugaauugaugcgacguggcgaucuuccuguuugguuaagcuacaaagucgcuagugagggcuuccaguacucagacagaagauggugcuucgauggagaaagaaauaaucaagugcuagaagaaaauauggauguagaaauuuggacuaaagaaggagagcgaaagaaacuacggccccgauggcuagaugcacggacauacagcgauccucucgcucuacgcgaauuuaaagaguucgcagcaggaagacguucuguaagcggagacuugauuuuagaaauaggcaaauugccccaacaccuaacccaaagagcacaaaaugcucuggauaacuuagucauguuacacaauucagaacaaggaggaagggccuaccgucaugcgauggaggaauuacccgacaccauugagacucuaaugcuucuagcccuaauugccguguuaacagggggagugacacuauucuuccuuucaggcagagguuuagggaaaacaucaauaggauuauuaugcgugauggcgagcaguguauuacucuggauggcuuccguagaaccgcauuggaucgcggcuaguaucauacuagaguucuuuuuaaugguucuucuuauccccgaaccagacagacaacgaaccccgcaagacaaucaguuggccuauguagugaucggcuuguuauuuaugauacuuacgguagccgcgaacgagaugggacuguuagaaacgaccaagaaagaucugggaauuggucacguagcaguggaaaaucaucaucacgcaacgaugcuugacguagaccuccacccggcuucagcauggacauuauacgcaguggcaaccacgauaauaacuccuaugaugagacacacaauagaaaauacgacagcaaauauaucccuuacugcuaucgcaaaucaagcagcgauauuaaugggacuugacaaaggcuggccuauuaguaaaauggacauaggaguuccauuauuggcgcuagguuguuauucccaagucaacccuuuaacacuuaccgcugccguucuaaugcuugucgcccauuaugcaauaauuggccccggcuuacaagcgaaagccacgagagaagcucaaaagagaaccgcggcugguauaaugaaaaacccaacgguggaugguauaguagcuaucgaccuagacccuguaguuuaugacgccaaauucgaaaaacagcugggccaaauaaugcuauuaauauuaugcacaucccaaauuuuguuaaugcggacaacaugggcccugugugagucaauaacauuagcaaccggaccguugacaaccuuaugggaaggcucaccgggcaaauuuuggaauacuacaauagccguaagcauggccaauauauuucgagggagcuaccuugccggcgcaggucucgcauuuagucuuaugaaaucucuagggggagggcggcgagggacaggugcgcaaggagaaacguuaggagaaaaguggaaaagacaauuaaaucaguugucaaaaucagaguucaauauuuauaaaagaucagguauuauggaaguugauaggagugaggcaaaagaaggauuaaaaaggggagaaaccacaagacacgcuguuagccgaggaacugccaaacugagaugguucguagaacguaaccuaguuaaaccagaaggaaaaguuauagaccuaggaugcgggagaggcgguuggucauacuacugugcaggacuaaagaaagucacugaagugaagggcuauacaaaaggggguccgggacaugaagaaccgauuccuauggcaacuuacggguggaaucuugugaaacuucacagcgguaaagacguauucuuuacaccaccagaaaaaugcgauacuuuauuaugugauauuggggaaucuuccccaaaucccacgaucgaagaaggcagaacacugagaguacucaaaaugguggaaccuuggcugaggggaaaccaauucugcaucaaaauacugaaccccuauaugccaucgguaguagaaacacucgaacaaaugcaacgcaaacauggagguauguuaguuagaaauccuuuaagucggaacucaacacacgaaauguauuggguaaguugugggacugggaacaucguauccgcagugaacaugaccucccggauguuacuaaauagauuuacuauggcacauagaaaaccaacguacgaaagagauguagacuuaggagcaggaacacgacacguggcaguggagccagaaguugcaaauuuagauaucauaggacagagaaucgagaacauaaagcacgagcacaaaucaacuuggcauuaugaugaagauaauccauacaagacaugggcauaucaugguagcuacgaagugaaaccauccgggagcgcgaguaguaugguaaacgguguaguaaaauuauuaacgaagcccugggacgugauuccaaugguaacccaaauagcaaugacugauacaacgccauuugggcaacagaggguauucaaagagaagguagacacuaggacuccaaaagcuaaacguggcacugcccaaauuauggagguaacggcaagauggcuuuggggauuuuuaucccguaauaagaaaccgagaaucugcacacgcgaggaguucaccaggaagguaagaucaaacgcagcaaucggggcuguauuuguugacgaaaaccaauggaacagugcaaaggaagcaguagaagacgaacgauucugggacuuaguacaaaaggaacgggaacuucacaagcaagguaaaugugcgaccuguguguauaauaugaugggaaagcgagagaagaaacucggcgaguucggcaaggcaaagggaucaagagcuaucugguauauguggcuuggggcgcguuucuuagaauuugaagccuuaggcuucaugaaugaagaucacugguucaguagagaaaauuccuuaucaggcguggagggugagggguuacauaagcugggauauauucuucgagacauaucaaaaauaccaggugggaauauguacgcugacgacacugccggcugggauacacgaauaacugaagaugaucuucaaaacgaagcaaaaaucacagauauaauggaaccagaacacgcauuauuggcaaccucgauuuucaaguugacauaucaaaauaaaguuguuaggguacaacgaccagcuaaaaacgguacuguuauggauguaauaucuagacgagaccaaagaggaucaggccaaguagguacguacggauugaacacauucacaaauauggaagcacaacugaucagacaaauggaaucugaaggaauauuuuuacccucagaacuugaaaccccaaaucuugcagaaagaguauuagauuggcuagagaaacacgguguagaacguuuaaagagaauggcaauuagcggcgacgauuguguaguaaagcccauagacgaucgauuugcaacagcccuuacugccuuaaaugauaugggaaaaguuagaaaggauauaccacaaugggaaccaaguaaagguuggaaugauuggcagcaaguacccuuuugcucucaucauuuccaucaacuuauuaugaaggauggucgcgagauaguuguaccuugucguaaucaagacgaguugguaggacgggcgcgagucucucagggugccggauggucguuaagggaaacagcgugccucggaaaaaguuacgcacaaauguggcaacugauguauuuucauagacgugaucugcgccuagcugcaaacgcaauauguucugcgguacccguggauuggguaccgacaagucggacaacauggucaauacaugcccaucaccaauggaugacaaccgaggacaugcuaaguguuuggaaucgagucuggaucgaagaaaacccuuggauggaggauaaaacccacguaucuucuuggggcgaugucccauaucuaggcaaaagagaagaccaauggugcggaucccugauuggauugacagccagggccacgugggcuucaaacauccagguagcaauaaaccagguacgccggcuuauagggaacgaaaacuaucuagauuauaugacauccaugaagagauucaaaaaugaaggugauccagagggcgcuuugugguaa

SEQ ID NO: 21604 - RNA, 9879 nt, Artificial Sequence
  derived and/or modified CDS sequence (opt6) from DENV-1__FJ410273__SS-prME
ucuguuacaauguuauuaaugcuaaugccgacagcauuagcauuucaccugacaacuaggggaggggaaccgcauaugauuguaaguaaacaagaaaggggaaaaagccuacuauuuaaaacuucugccggagucaauauguguacauugauagcuauggaucuaggugaacuuugcgaggacacgaugacuuacaaaugcccaagaauuacggaggcagaaccagacgaugucgauugcuggugcaacgccacagacacuuggguuacuuaugguacuugcucucaaacuggagaacauagaagagauaaaagaagcguagcauuggcuccucauguagguuuaggauuagagacgaggacugaaaccuggaugagcucggaaggagcauggaaacaaauucaacgagucgaaacuugggcauuacgucauccaggauuuaccguuauagcccuauucuuagcgcaugcgauaggaacaucuauuacucaaaaaggaauuauauuuauuuuacuaaugcuaguuaccccaucgauggcuaugcgaugcguugguauagguucccgcgauuuuguugaaggucuuucgggugcaacuuggguggacguaguacuugagcaugguaguuguguuaccacgauggcuaaagauaaaccgacuuuagauauagaacuacugaaaacggagguuaccaauccggcaguauugaggaaguuaugcauagaagcaaaaauuaguaacacaacaacggauagcagaugcccaacgcaaggagaagcgacucugguagaagaacaagacgcaaacuuuguuuguaggaggacguucguagaccgaggcugggguaauggcuguggucuauucggcaaaggcucacucaucacaugugccaaauucaaaugcguaacaaaacuggaaggaaaaauuguacaauacgagaaccuaaaauauucagucauaguuacaguccacacaggcgaucaacaucaagugggcaaugagucgacagaacacgguacaacggcuaccauaacaccacaggccccaucaaccgagauacaacuuacugacuacggggcgcuaacccuugauugcucuccaagaacuggcuuagauuuuaaugaaaugguauuauuaaccaugaaagagaagucaugguuaguucacaagcaaugguuucuugaucuuccacuaccuuggacaagcggagccagcaccagucaggaaacauggaaucggcaagauuugcuagucaccuucaaaaccgcacacgcuaagaaacaggagguaguuguacuagguagucaggaaggagcaaugcauaccgcauuaacuggcgcaacagaaauacaaacaagcgguacgacaacgauauuugcaggccaucucaaauguagguugaaaauggauaaauuaacucucaaagguaugagcuacgucaugugcacggguucauuuaaauuagaaaaagaaguggcagaaacacaacauggaacaguauugguacagauuaaauaugaaggaaccgaugcaccauguaaaauaccauuuaguacacaagacgaaaagggcgugacacagaauggaaggcucaucacggcaaacccuauaguuacugauaaagagaaaccagugaauaucgaagcugaaccaccguuuggagaaucguauauaguaauaggggcuggugaaaaggcguugaagcuaucuugguuuaagaaaggcuccaguaucgguaaaauguuugucgcuacagcgaggggugcccguagaauggcaauccuaggcgauacagccugggauuuuggaucaauaggagggguauucacaucuguaggaaaauuaguacaucaaaucuucgguacugcauauggagugcuuuuuagcgguguaagcuggaccaugaaaaucggaauugguguucuccuuacuuggcuuggucucaauucucgaagcaccucucucagcaugacuugcauagcgguaggcuuaguuacgcuauacuuaggaguuaugguucaagcagacucaggauguguuaucaacuggaaaggucgagaacuaaaaugcggaucgggaauauucguuacaaacgagguacacacauggaccgaacaauauaaauuccaagcugauaguccgaagaggcuuucugccgcgauaggaaaggcuugggaagagggaguuugugggauuagaucagcaacaagguuagaaaacaucauguggaaacaaauaucuaaugagcuaaaccauaucuugcuagaaaacgauaugaaauuuacuguugucguaggugacguagcugguauucuaacgcaagguaagaaaaugaucagaccucaaccaauggaauauaaguauucauggaaaagcuggggaaaagcuaagauaauuggagcugacguacaaaacacgacauuuauaaucgacggaccaaacaccccagaaugccccgaugaccaaagagcauggaacaucugggaaguagaagacuaugguuucgguauauuuacgacgaauaucuggcuaaaauugagggacagcuacacacaagugugugaccaccgcuugaugagcgcggcaaucaaagacaguaaggcagugcaugcugauauggguuacuggauugaauccgagaagaacgaaaccuggaaacuagcgcgugccaguuuuauagaagugaagaccuguaucuggccgaagagucauacauuaugguccaauggcguacuagaaucagaaaugauuaucccaaaaauuuacggaggaccaauaucccaacauaacuauagaccuggauauuuuacgcagacggcagguccguggcaccuagguaaacuagaguuagauuuuaaucuuugugaaggcacaacuguaguaguagaugaacauugcggaaauagagggccuagucugagaacaacuacggucacugggaaaauuauacacgaauggugcugcagauccuguacacuaccaccgcuaagauucaaaggcgaagauggauguugguauggcauggaaauccgaccaguaaaagaaaaagaagaaaaucuagucaaaucuaugguuucugccggcucuggugagguagacuccuucagccugggccucuuguguauaucuaucaugauagaagaggugaugcgcaguagguggucgagaaaaaugcuaaugaccggcacacuugcuguuuucuuccuauugauaaugggccagcugacuuggaaugaucuuauuagauugugcauaauggucggcgcaaaugcuagcgaccggaugggcaugggcacuacguaccuugcacuaauggcaacuuuuaagaugagaccgaugcuagcuguaggacuuuuauucaggcgcuugacaaguagggagguauuguuacuuaccaucggccugagucuaguggcaucuguugaacucccaaacagcuuagaggaauuaggggauggacuggcgaugggaauaaugauauuaaaauuacucacagacuuucaaucucaccagcucugggcuacucucuuaucccuuacauuuaucaagacaacguacuccuugcauuaugcauggaagacuauggcuaugguauuaucgauaguuucacuguucccacuaugcuuaucuacgaccagccagaagacuacuuggcucccagucuugcuaggcagccuaggcuguaaaccucuuacgauguucuugauagccgaaaauaaaauuugggggcguaaaagcuggccacuaaaugaagguauuauggcggucggaauugugaguaucuuacugucuucacuuuugaaaaaugacguaccauuagcaggcccucuaauagcaggcgguaugcucauagcaugcuauguuaucaguggcaguucugcugacuuaucacuagaaaaagcugccgaaguguccugggaggaagaagcugaacacaguggcgcaucucauaauauauuaguugaaguacaagaugacgguacaaugaaaauaaaagaugaagaacgggaugauacauuaacgauuuuacuaaaagcaacauuauuagcugucagcgguguguacccucucucaauaccugcgacucuuuucguuugguauuuuuggcagaaaaagaaacaaagauccgguguuuuaugggacacucccucgcccccugaagucgaaagggcuguacuagacgacgguauauaucgcauuaugcagagaggcuugcucggcagaagccaagugggagucgggguauuucaagaaaauguuuuucacacaauguggcacguaacaaggggagcaguauugauguaucaagggaaaaggcuagaacccucaugggcaucagucaagaaagauuuaauuucuuacgguggaggcuggagguuacaagguaguuggaacacuggugaggaaguacaaguaaucgcgguugaacccgguaaaaaccccaaaaacguccaaacagccccgggcacguuuaaaacuuccgaaggggaaguuggagcuauagcauuagacuuuaagccugguacaucagguaguccuauaguaaacagagagggaaaaauaguaggguuauaugggaacgguguggugaccaccucuggcacguacgucagcgcuauugcacaagcuaaagcuagucaagaagggccauuaccggaaauagaaaaugaaguauuuagaaaaagaaaccuaacuaucauggaccuccaccccgggaguggaaaaacuagaagguaccuaccagcaauaguucgugaagcgaucaaacgaaaauuacgaacauugauucuagcaccgacuagaguuguugcaucagagauggcagaggccuuaaagggcaugcccauucgauaucaaaccacugcagugaaaagugaacacaccggaaaagagauuguugaucucaugugucaugcaacauuuaccaugcguuugcuaagcccgguacggguucccaauuacaacaugauuauaauggaugaagcccauuuuacggauccaucaaguauugcagccagaggauacauaaguacucgaguggguaugggcgaagcggcagccauauucaugacugcgacaccaccgggaucaguagaggcuuuuccucagucuaaugcgguaauucaagaugaggaaagagauauacccgaacgaagcuggaacuccggguaugaguggauaacagacuucccagguaaaacgguuugguucguaccuucuauaaagucaggaaaugacaucgcaaauugccuaaggaaaaauggaaaacgcguaauacaacuaagcagaaaaacauucgauaccgaauaccaaaagacuaaaaauaaugauugggacuauguagugaccacagauauaucagagaugggcgcuaauuuccgagcagacagagucaucgaccccagaaggugcuuaaaaccaguaauuuuaaaagauggcccugagagaguaauacuagcaggaccuaugccgguuacaguugcaucugcagcccaaagacguggacgaauaggaaggaaccacaauaaagagggugaucaauauauauauaugggccaaccucucaacaacgacgaagaccacgcgcacuggacugaagcaaaaauguuacuagacaauauuaacacaccagagggaauuauaccagcguuauuugagccagaaagggaaaaauccgcugcaauugacggagaauauagacuccgaggcgaagcccguaaaaccuuuguagaauuaaugaggaggggagacuuaccaguaugguugucguauaagguggcuucggaagguuuccaauacagcgaccgccgguggugcuuugacggagaacggaauaaucagguucucgaggaaaauauggauguagaaauuuggacuaaagagggugagcguaaaaagcugagaccacgcuggcuagaugcaagaacauacagugacccauuagcacuuagggaauuuaaagaguucgcagcugggcguaggaguguaucaggagauuuaauauuagaaaucggcaaauuaccucagcaccucacucaacgagcacaaaaugcucucgauaauuugguuaugcuccauaacucugaacaaggaggcagagcguaccgucaugcuauggaggagcuuccugauacuauugaaacacugauguuguuggcauuaauugcuguuuuaacagguggagugacccuauucuucuuaucaggucguggauuaggaaaaacaaguaucgguuuacucuguguaauggcuagcucaguucuauuguggauggcaaguguggaaccccauuggauugcugcaucaauaauuuuggaguucuuucugaugguauuauugaucccagagccggauaggcaaagaacgccacaagacaaccagcuugcauacguaguuauuggauuguuguuuaugauucucaccguugcagcuaacgaaauggggcuauuagagacuacaaagaaagaucugggcauaggccacguugcaguagaaaaucaccaucacgcagcaauguuggacguagaucuccaccccgcuagugcauggacacucuaugcuguugcuacuacgauuauuacuccuaugaugagacauacuauagagaauacaaccgcaaauauaucacuuacagcgaucgcaaaucaggcagcaaucuuaaugggacuagauaaaggauggccuaucucuaaaauggauauagggguaccgcuacucgcuuuaggauguuacucgcaaguaaacccccuuaccuuaacugcugcuguccugaugcuaguagcucacuacgcgauuauaggaccagggcuucaagcaaaagccacacgugaagcacaaaagaggacagccgcaggcaucaugaaaaauccgacugucgauggaauaguagccauagaccuugacccaguaguauacgaugcuaaauucgaaaaacaacuaggccaaauuaugcugcugauucuguguacaagucaaauucugcuuaugagaacuacaugggcguuaugugaaucgaucacacuugccacaggaccauuaacaacauuaugggaaggcuccccugggaaauuuuggaauacgacuauagcaguaaguauggcaaauauuuuccgaggaagcuaccuagcgggugccgguuuagcauucagcuuaaugaaaagccuuggagguggacgcagagguacuggagcacaaggggaaacauuaggcgagaaauggaagaggcagcuuaaucaauuaaguaaaagugaauuuaauacauacaagcgauccggaauaauggaaguggacagaagcgaggccaaagaaggucucaaaagaggcgaaacaaccaagcacgcggugucgagagguacugcuaaacuacguugguuuguagaaagaaauuuggucaaaccagaaggaaaaguuaucgauuuaggaugcggcagaggaggauggagcuauuauugugcaggacuaaagaagguuacggaagugaaaggauauacaaaaggugguccaggccaugaggaaccuauaccgauggccacauacggauggaaucuagucaaacuucauaguggaaaagacguguuuuucauuccaccugaaaagugugauacauuauugugugauauaggggaaucgucaccaaacccuacgauagaggaaggaaggacacuacgaguccuaaaaaugguugaaccguggcuaagaggaaaucaauuuuguaucaaaaucuuaaaucccuauaugccaucuguaguugaaacauuggaacaaaugcagcgaaaacacggggguaugcuaguacggaacccuuuaagucguaauagcacccaugaaauguacugggucagcuguggaacugguaacauuguuucugcaguuaauaugacgagccgcaugcucuugaaccgcuuuaccauggcucauaggaaaccuacauaugagcgagacguagaucucggagcaggaacuagacacguagcuguagaaccggaagucgcaaaccuugacauaauuggucagagaauagaaaacaucaaacacgaacacaaaaguacuuggcacuaugacgaagacaacccauauaaaacaugggcuuaucacggaucuuacgaagucaaaccaucuggcucagcaagcucaaugguuaacggaguaguaaaauuacuaacaaagccuugggacguaauaccaaugguaacucagaucgcuaugacugacacuaccccauucggacaacaaagagucuuuaaagagaagguugacacucgaaccccuaaagccaagcgagggacagcacaaauaauggaaguaacagcuaaauggcuuuggggguuccuaagucgcaacaagaaaccacgcauauguacaagggaagaguuuacuagaaagguuaggucaaaugcagccaucggcgcaguauuuguugaugaaaaucaauggaacucugcaaaggaggcagucgaagacgaacgcuucugggauuuaguucaucgggagagagaacuccauaaacaaggaaaaugcgcuacuugcguguacaacaugauggggaaaagagagaagaaacuuggugaauuuggcaaagcgaaaggcucacgugccauaugguacaugugguugggagcaagauuuuuagaguucgaagcccuuggcuuuaugaaugaagaccauugguucagcagagaaaauucucuuaguggcguagaaggcgaagguuuacauaaacuaggauacauauuaagggauauuucaaagauacccgguggaaacauguaugcagaugacacagcagggugggacaccagaauaacugaagaugaucuacagaaugaagccaaaauuaccgauauaauggagccagaacacgcacuauuagcaaaaagcaucuuuaagcuaacguaccaaaacaaaguuguaaggguucaaagaccugccaaaaacggaacagucauggacgucauuucacguagagaccaacgagguuccggucagguagguacguauggauuaaauacauucacuaacauggaagcacaauuaauuaggcaaauggaaucugaagggauauuuucucccucagagcuagaaacuccuaaccuggcaggccgggugcuugacuggcuggagaaacauggugucgaaagacucaaaaggauggcuauaucaggugaugauugugucguaaagccgauagaugaccguuuugcaacugcacucacagcauugaaugacauggguaaaguaaggaaagauaucccacaaugggaacccaguaaaggguggaaugauuggcaacaagugccauucuguucgcaucacuuucaucagcuaauaaugaaagauggacgugaaaucguaguuccuuguagaaaccaggaugagcuaguugggagggcaagggucagucaaggagcugguuggaguuuacgcgaaacugcgugcuuggguaagaguuacgcacaaauguggcaauugauguacuuucaccguagggauuuaaggcuagcagcaaaugcgaucugcucugcugugccaguagacuggguacccacuuccaggaccacauggagcauacaugcccaucaccaauggaugacaacugaggauauguugucgguuuggaaucgaguuuggauagaggagaauccguggauggaagauaaaacucauauuuccucuuggggugacguacccuauuuaggaaaacgagaggaucaauggugcggaucacucauaggauuaaccgcuagagcaacaugggcgacuaauauucaagucgcuauuaaccaaguuagaagacuaauagggaacgaaaauuaccucgacuacaugaccaguaugaagcgcuuuaaaaaugagucagaccccgaaggggcauuaugguga

SEQ ID NO: 21605 - RNA, 9879 nt, Artificial Sequence
  derived and/or modified CDS sequence (opt6) from DENV-1__FJ410276__SS-prME
ucgguaaccauguuccuaauguuaaugccuacugcuuuagcauuucaucucacgacacggggaggugaaccacauaugauagugucuaaacaggaacguggaaaaaguuuauuauuuaaaacaucagcuggaguaaauaugugcacccuaaucgcaauggacuugggagaacuaugugaagacaccaugacauauaaaugucccagaauaacagaaacagaacccgaugauguggauuguugguguaaugcaacagacaccuggguaacuuauggaacuugcucacaaacgggugaacaucgucgcgauaaacguaguguagcucuagcaccacauguuggauuaggacucgaaacucgaacagaaacauggaugucaucugaaggagcuuggaaacaaauacaacgaguagaaacaugggcgcugagacauccagguuuuacuguaaucgcucuauuccuugcacacgcgauaggaaccucuaucacacaaaaagguauuaucuuuauauuacuaaugcuuguuacucccuccauggcaaugagaugugugggaauaggaagccgggacuuuguggaaggacuuucaggugcaaccuggguagacguaguacuagaacauggcucgugcguaacaacgauggcgaaagauaaaccaacacucgauauagaacuauuaaaaacugaaguaacuaacccugcagucuuaagaaaacuauguauagaagcaaaaauaucuaacacaacuacagauagccgcuguccgacacaaggagaagcaacuuuaguagaagaacaagacgccaauuuuguuugucgacgaacuuucgucgacagaggcuggggcaacggauguggguuauuugggaaaggaucauuaaucacaugcgccaaauuuaaaugcguuacgaaacucgaagguaaaauuguucaauaugagaaccuaaaauauucaguaauuguaacaguacacaccggggaucaacaucaaguaggcaaugagucuacugaacaugguacuacugccacuaucacuccacaggcucccacuaccgagauacagcucacggacuauggagcgcuuacgcucgauuguuccccacggacagguuuagauuuuaaugaaaugguguugcuaacaaugaaagaaaaaucuuggcuaguucauaagcaaugguuuuuagaucuaccacuuccauggacaucgggugcuucaacaagucaagaaacauggaauagacaggaccuacuugucacuuucaaaacugcucaugcuaaaaagcaggaaguugucguuuuggguagucaagaaggagcgaugcacacggcgcuaacaggggcgaccgagauucaaacgagugggacaacgacuaucuuugcaggacaucuuaaaugccgauuaaaaauggauaaacuaacacuaaaggguaugucguaugugauguguacugggucguuuaaacuagaaaaagaacuagccgaaacacaacacggcacugugcuagugcaaauuaaauaugaaggaacagaugcuccuuguaagauaccauucuuaacacaagacgagaagggagugacacagaacggacgcuuaauaacagcaaauccaauuguuacugauaaagaaaaaccuguaaauaucgaagcagagccaccguuuggcgaaucauauauaguaaucggggcaggcgagaaggcacugaaacuaucgugguucaagaaaggaucaaguauagggaagauguucgaggcaacagcgagaggagcacgacgaauggcaauauuaggggacacagcaugggauuuuggaucgaucggagguguauucacuagcguugguaaguuaguucaucaaaucuucggaacagcauacggcguguuauuuaguggaguaucguggacgaugaaaauaggaauaggaguucuucugaccuggcucgggcuuaacaguagaucuaccaguuugucuaugacuuguauagcuguaggacuggucacauuauaccuaggaguuaugguacaagcugauaguggguguguaauuaacuggaagggacgggagcuuaaaugugguaguggaauauucgugacuaaugaaguucacacauggaccgaacaauauaaauuccaagccgauucuccaaagcgacucagcgcagccaucgggaaagcgugggaagaggguguuugugguauucgaucagcuacacggcucgaaaacaucauguggaaacaaauaaguaaugaauuaaaucauauauuacucgaaaacgacaugaaauucacuguaguaguaggagauguggcaggaauauuggcacaaggcaagaaaaugauacguccacagccuauggaauacaaauauucauggaaaaguugggguaaagcaaagaucauuggcgcggauguacaaaacacaacuuuuaucauugaugguccaaauacgccagagugcccggacgaccagcgagcguggaacaucugggaaguugaagacuauggauuugggauauucacgacgaauauauggcuaaagcucagagacucguauacgcagguaugugaucauagauugaugucagccgcaauuaaggacuccaaagcuguacaugcagauaugggauacuggauagaaagugagaaaaacgaaacuuggaaacuagcgagggcuucguucauugaagugaaaacaugcauuuggccaaaaagccauacacuauggucuaauggaguguuggaaagcgaaaugauaauaccaaaaaucuacggaggacccaucagccaacauaacuaucgaccuggauauuuuacucagacagcgggaccguggcaucuaggaaagcuggaguuggacuucgaccucugugagggaacaacugugguaguagaugagcauugugguaaccgaggaccuagucuuaggacgacaacaguuacugggaaaaucauacaugagugguguugucggucaugcacauuaccuccucuccgcuuucguggugaggauggcugcugguaugguauggaaauaaggccagugaaggaaaaagaagagaauuugguaaaaucaaugguaucugcuggaucaggugaaguggauucuuucucucucggacuucuaugcauaaguauaaugauagaagagguaaugagaaguagguggagcagaaaaauguuaaugacgggaacuuuggcaguauucuuuuugcuaauuaugggucaauuaacuuggaaugaccugauccgccuauguauaaugguuggugcuaaugcuucggauagaauggggauggguacaacuuaccuugcacuaauggcuacuuuuaaaaugcggcccauguucgcuguggguuuacuuuuucguagguuaacaucacgugaaguccuauuauuaacgauagggcuaucucugguagcaagugucgagcugccuaauucguuagaggaacuaggagauggccuagccaugggcaucaugaucuuaaaacuuuugacagauuuccagucucaccaacuuugggcuacguugcuaucacuuacauucauuaaaacaacauuuucgcuucauuaugcauggaaaacgauggcaaugguucuaucaaucgucucauuauuuccauuaugccuuaguacaacaucucagaagacaacgugguugccuguacuauuggguaguuuaggcuguaaaccgcuuacaauguuccuaauugcggaaaacaaaauauggggcaggaggaguuggccgcuaaaugaaggcauaauggcuguagggauagucucuaucuuauuaucaagucuucuaaagaaugacguaccauuagccgguccccuaauagcgggcggaaugcuaauugcauguuacguaauaagcggcucgucugcagaucuaucguuagaaaaagcagcugaaguuuccugggaagaagaagccgaacauaguggugcgagccacaauauauuaguugaaguccaagacgauggaacaaugaaaauaaaagacgaagagagggaugauacccuaacaauccuacuuaaagccacacuucucgcugucagcggcguguauccucuaaguauuccagcaacccuguucgucugguauuuuuggcagaaaaagaaacagagguccggaguacuuugggacacacccucgccaccggaaguagaaagagcagucuuagaugauggaaucuaccguauaaugcaaagaggauuacugggucgaucucaagucgguguagguguguuccaagagaauguguuccacacgauguggcacgucacuagaggagcuguccuaauguaucagggcaaaagacuagagccuaguugggccagugucaagaaagacuuaauauccuacgggggugguuggagacuucaagguuccuggaauacgggugaagaaguacaggugauagccgucgagccaggcaaaaaucccaaaaauguucaaacugcuccagguacguuuaaaacacccgagggagagguuggcgcaaucgcgcuagauuuuaaaccuggcacaucuggcucaccgauaguaaacagggaaggaaaaauuguaggccuguauggaaaugguguggucacaacaagcggaaccuacguuucugcaaucgcacaagcgagagcuucccaagaaggcccucuuccagaaauugaggaugaaguauuucguaaacgaaaucugaccauaauggacuuacacccaggaucaggcaaaacaagaagauaucuaccagcuaucgucagagaagcuaucaaaaggaaacuaagaacacugauacucgcacccacuagggugguagcuuccgagauggcugaagcacugaaaggaaugccgauaagauaucagacgacggcaguuaaaucagaacacacaggaaaagaaauaguagaucuaaugugccaugcaacauuuacaaugagacuuuuauccccugugagaguaccgaacuacaacaugauaauaauggacgaagcucauuuuacugacccaaguucaauagccgcccgcggauacauaucaacgagaguuggcaugggagaggcggcagccauuuucaugacugcaacaccgccaggcucaguagaagcauuuccgcagucgaaugcuguaauucaagacgaggaaagggauauaccggagaggucuuggaauagcggcuaugaauggauaacugauuucccggguaaaacggugugguuuguaccgagcauaaaaucagguaaugauauugccaacugcuugcguaagaauggaaaaagaguaauacaauuaucacgaaaaacguucgacacagaauaccagaagacuaaaaauaaugacugggacuauguaguuacaacggauauaucugaaaugggagcgaauuucagagcagauagaguaauagacccacggaggugccuuaaaccuguaauccuaaaagauggaccagaaaggguaauauuagcuggcccaaugccugucacaguggccagugccgcacaacgaaggggaagaauuggacgcaaucauaauaaagagggagaucaauauauauacaugggccaaccauugaacaacgaugaagaucacgcgcacuggacugaggcuaagauguuauuagauaacauaaauacgccggaaggcauaauaccugcgcuauuugaaccagaacgagagaaaagugccgcuauagauggugaguauagguuacgaggagaagcuagaaaaacauucguagaauuaaugcgacgcggagaucuaccgguauggcuaucguacaaagucgcuucggaggguuuccaauauucagauaggcggugguguuuugacggugaaaggaacaaucaaguucuagaggaaaauauggauguggaaauuuggacuaaagaaggcgaaagaaagaaacugagaccaaggugguuagacgcgcguacauauuccgaccccuuggcacugcgagaauuuaaagaauuugcugcugggcguaggucggugaguggcgacuugauccuggagauuggcaaacuuccacaacaucuaacgcaaagagcacagaacgcauuagauaaccuuguuaugcuucauaauucagaacaagggggucgcgcguaucgccaugcuauggaagaguuacccgauacaauugaaacacucaugcuauuagcauugauugcuguauuaacggguggugucacacuauucuuuuugucaggaaggggucuagggaaaacaaguauagggcugcuuugugugauggcaucaucaguacuuuuauggauggcaucgguagaaccccacuggauagcagcuaguaucauauuggaguucuuucuaaugguacugcuuauaccugaaccugacaggcaaagaacuccgcaggacaaucaauuggcauauguaguaauugggcuccuauucaugauccugaccguggcagcaaacgaaaugggauuauuagaaaccacgaagaaagaucuaggaauaggccacguagcuguggaaaaccaccaucaugcagccaugcucgacguagaccuacacccugccuccgccuggacccuguaugcgguagcaacaacgauuauuacaccaaugaugagacacacgaucgaaaauacuacagcgaauauaagucucacagcaauagcgaaucaagcagcgauucuaaugggccuagacaaaggguggccaauaagcaaaauggauaucggaguuccauuguuggcucugggauguuacagucaggugaaccccuuaacccucacagcagcaguacucaugcucguugcucacuaugcaauaauuggacccggccugcaagccaaggccacuagggaagcccaaaagagaacugcagcagguauuaugaaaaauccuacugucgacgggauuguugcuauagacuuagaccccgugguauaugaugcuaaauuugaaaaacaauuaggacagaucaugcuacuuauauuauguacaucgcaaauccugcucaugcgaacaacgugggcauugugugaaagcauaacgcuugcuacagguccacugacaacuuuaugggaaggcaguccaggaaaauuuuggaauacuaccauagccguuucaauggcgaacauauucagggggagcuacuuagccggugcaggacuugcauucucacugaugaaaucucuagguggaggacgccggggaaccggagcccaaggagaaacacuuggggaaaaauggaaaagacaguuaaaucaauuauccaaauccgaauuuaacaccuacaaacgaagugguauaauggaggucgacagauccgaagcuaaagaagguuuaaaacgaggcgaaaccacgaaacaugcuguauccagaggaacagcaaaacuaagaugguucguugaacguaauuuagucaaacccgaagguaaagugauugaucugggguguggaagaggugguuggucuuacuauugugccggucuuaagaaaguuacagagguuaaaggcuauaccaaagguggcccaggucacgaagaaccaauccccauggcaacuuacggguggaaucuuguaaaacugcauucaggaaaagauguuuucuuuauuccacccgaaaaaugcgauacccuacuaugcgauauuggagaaagcucaccaaaucccacgauagaagaggggcggacucuaagaguccuuaaaaugguugaaccuugguuacgugguaaccaauucuguauuaagauauugaacccuuauaugccaucgguaguagaaacccuagaacagaugcaaaggaagcauggaggcaugcuaguucgcaacccgcuaucacgaaacaguacacacgaaauguauuggguuaguugcgggacgggaaauauugucucugcagucaauaugaccucacgcaugcuauuaaaucgcuuuaccauggcccacaggaaaccaacauaugaaagagacguugauuuaggcgcgggaacacgucacguugcuguagagccagagguagcaaaucuagauauaaucggucaaagaauagaaaauauuaaacaugaacacaaauccaccuggcacuaugaugaagauaauccguauaagacaugggcauaucacgguagcuaugaaguaaaacccucugggagcgcaucuucuaugguaaaugguguuguaaaauuacuaacaaaaccaugggauguaauaccaaugguaacacaaauugccaugacagauacaacuccuuuuggccaacagcgagucuuuaaagaaaagguggacacgcgcacuccaaaggcaaagcgagguacagcucaaaucauggaagugaccgcaaaauggcuuuggggauuuuugucacgcaauaagaaaccacgaauauguacuagggaggaguuuacaagaaagguuagaucaaacgcagcuauuggcgcgguuuucgucgaugaaaaucaauggaauagcgcaaaagaagcuguagaggacgagagauucugggaucuugugcauagagaaagagaacuucacaaacaggguaaaugcgcaacguguguuuacaacaugauggguaaacgugagaagaaacucggugaguucggaaaagcaaaggggagcagagcaauaugguacaugugguugggagcccgcuuccuugaauuugaagcguuaggauucaugaacgaagaucauugguuuagcagagaaaauucacugucuggaguagaaggagaaggauuacacaaacuuggauauauauuaagagacaucagcaaaauaccaggagguaauauguaugcugaugacacagccggaugggacacgcgaauaaccgaagaugaccuccagaaugaagcacgcauaacagacaucauggaaccagagcaugcacuccucgcuaagucaauauucaaauuaacguaucaaaauaagguuguuagaguccaaaggcccgcuaagaauggaaccguuauggauguaaucucccgacgcgaucaaagaggaucgggacaaguugggacguacgggcucaacacauuuacaaacauggaagcgcaacuaauaaggcaaauggaauccgagggaauauucagccccucggaguuggaaacuccgaaucuagcagaaaggguucucgauugguuggagaaauauggcguagaaagguuaaaaagaauggcaauuucaggugaugauugcguuguaaaacccauagaugacagauucgcaacugcacuuaccgccuuaaacgauaugggcaaaguaagaaaggacauuccacagugggagccuaguaaaggcuggaaugauuggcaacaaguaccauuuugcucgcaucauuuccaucaacuaauaaugaaggacgggcgagaaauuguagugccaugcagaaaccaggaugagcuaguggguagggcucgaguuagccaaggagcaggcuggaguuuacgcgaaacagcgugccuaggaaaaucuuaugcgcaaauguggcaauuaauguauuuccaucgccgagaccuucgauuggcugcaaacgcaauuugcagcgccguuccaguugauuggaucccaacuagccggacuacauggaguauucaugcacaucaccaauggaugacaacagaagauauguugaguguauggaaccgcgucuggauagaagaaaauccauggauggaagacaagacgcauauuaguucauggggagacguuccuuauuugggaaaacgcgaggaucaauggugugggaguuuaaucggauuaacagcaagagcaacaugggcaacaaacauccaaguugcuauuaaccagguaaggagauuaaucgggaacgaaaauuacuuggacuauaugacaucuaugaaaagauuuaagaacgaaucggaucccgaaggcgcacuaugguag

SEQ ID NO: 21606 - RNA, 9879 nt, Artificial Sequence
  derived and/or modified CDS sequence (opt6) from DENV-1__FJ410278__SS-prME
agcguaacuaugcuuuuaaugcuaaugccgacagcuuuagcauuucaucuuacuacaagaggaggagagccgcauaugauaguuuccaaacaggaaagaggaaaaagccuucucuuuaaaacaucagcgggagugaauaugugcacacuuauagcaauggaucuuggugaacucugugaggacacaaugacauauaaaugcccacggauuacugagacugaaccugaugacgucgauugcugguguaaugcgacugacacauggguaacuuacggaaccugcucacagacaggugaacacagaagggauaaacggucuguugcauuagcuccacacgugggccuuggacuugaaacacguacggaaacauggaugucaagcgaaggcgcuuggaaacaaauacaacgaguugaaacaugggcucuacgacauccuggauuuacagucauugcacuuuuccuagcucacgcuauagguacgaguauaacgcagaaagguaucauuuuuauuuuauuaaugcuaguaacuccuagcauggcaaugcguugugugggaauagggucuagagacuucguagaaggguuaucaggagcuacauggguggauguagucuuagaacacggcaguuguguaacaacuauggcaaaagacaagccaacguuagacauugagcuauuaaaaacggagguaacaaaucccgcgguucuccgaaaauugugcauugaggcaaagauaaguaauacaacuacagauucuaggugucccacacaaggagaagcuacguugguugaagaacaagaugccaauuuuguuugucgucgcacuuuugucgaccggggaugggggaacgguugcggacuguuugguaaggggagcuugauaacaugcgcgaaauuuaaaugcgugaccaaacuugaagguaaaauaguucaauacgaaaaucuaaaguauaguguuauugucacggugcauacuggcgaccaacaccaaguaggaaaugaaaguacugaacaugggacaacagcgacgauaacuccacaggcaccuacuacugaaauacagcuuacagacuacggcgcuuugacgcuugacuguucaccgagaacuggauuagacuucaaugagaugguucuucuaacuaugaaagagaaaagcugguugguacauaaacagugguuuuuagauuugccuuuaccauggacuucgggagcaucaacuagccaagaaacuuggaaccgacaagaucuauuggucaccuucaagacagcccaugccaagaaacaagagguugugguguugggaagccaggaaggagcaaugcacacugcucucaccggggcaaccgaaauacaaaccagcggaacaacgacuauuuucgcuggacauuuaaaaugucgauuaaaaauggacaaacucacucucaaaggaaugucauauguaauguguacugguucuuuuaagcuggaaaaagaaguagcugaaacucaacacgggacaguauuaguacaaauaaaauacgaaggaacggacgcgccauguaaaauccccuucucaacacaagaugaaaaaggagucacucaaaauggaagauuaauaacagcgaacccaauaguaacagacaaggaaaaaccagucaauauagaagcggaaccgcccuucggagaaagcuauauagugauuggcgccggugagaaggcucugaaauuaucuugguucaaaaagggaucaucaauagguaaaauguucgaggcaacagcuagaggugcaaggagaauggcaauuuugggagacacagcaugggauuuuggaucgauuggaggagucuucacaaguguugggaaguuaguucaccaaaucuuuggcaccgcuuauggcguucuguuuucggggguuuccuggacgaugaaaaucggaauaggugugcuccuaacgugguuaggucuaaacaguagaaguacgagccucagcaugacgugcauagcgguaggacuaauuacauuauauuugggcgugaugguucaagcagauucagguugugucauaaauuggaagggacgagaauuaaagugugguagugggauauuuguuacuaacgaaguacauacauggacagaacaauauaaauuucaagcggacaguccaaaaagauuaagugcggccauuggcaaggcuugggaggaaggcguauguggaauacgaagugccacuagauuggagaacauaauguggaaacagauuucgaacgaacuaaaucacaucuuacuugaaaacgauaugaaguuuacgguaguagugggagacguugcgggaauccuugcgcaaggcaagaaaaugauucgaccccaaccuauggaguacaaguauucauggaagucguggggcaaggcaaaaauuauaggggcggauguacaaaauacgacauuuauuauagaugguccaaauacuccagaauguccagaugaccaaagagcuuggaauauaugggaaguagaggacuauggguuuggaauuuucacgacgaacaucuggcuuaaguuacgagauaguuauacccaagucugcgaucauagguugaugagcgcagcaauuaaggacagcaaggcaguacacgcagauaugggauauuggauugaaagugagaagaacgaaacuuggaaauuagcacgagcaucguucauagagguaaagacauguauauggccaaagagucacacacuuuggucaaauggaguccuggagucggaaaugaucaucccaaaaaucuauggaggcccaauaucucaacauaacuauagaccagguuauuucacucaggcagcggguccguggcaucuaggcaaacuagaacuggauuucgaucucugugaaggaacuaccguaguagucgacgaacauugcggcaacaggggcccuagucuuagaacaacaacuguaacaggaaagauaauucaugaauggugcugucgaagcugcacccuaccaccgcuucgauuuaggggugaagacgguuguugguauggaauggagauacgcccaguaaaagaaaaagaagaaaaucucguuaaaucuaugguaucagcuggaagcggcgaaguagauaguuuuaguuuaggucuauugugcauuagcauaaugauagaggaagucaugcgaucaagauggucuaggagaaugcugaugacagguacacuugcaguauucuuucuauuaauaauggggcaguuaacguggaacgaucuaauaagauugugcaucaugguaggagcaaacgccagcgaccguauggguauggguacaacguaccuagcccuaauggcuacuuuuaagaugagaccaauguuugcugucggauuauuauuucggagauugacaucucgagaaguccuucucuuaacgauagguuuauccuuaguagcaagcguugagcuaccuaauucucuagaggaauuaggcgacggacuagcaaugggaauaaugauucucaaauugcuaacagauuuccagagccaccaauugugggcuaccuuauuauccuuaacuuuuauaaaaacaacauucucucugcacuaugcauggaagacaauggcaaugguacuaagcauaguuucauuguuuccacuaugucuaagcaccacgagccagaaaacgacaugguuaccuguacuuuuaggcucucugggguguaagccucuaacuauguuccuaaucgcagagaauaagauuuggggaagaagaaguuggccgcucaaugagggaauaauggcuguugguauaguaucuauacuccuaaguagccuacucaaaaaugaugucccccuagcagguccacuaauugcgggcggaaugcugauagcauguuauguuauaagugggucaagugcugacuuaagucuagaaaaagcugcagaagucagcugggaggaagaagcggaacacagcggugcuucacauaacauccuagucgaaguccaagaugacgggaccaugaaaauuaaagaugaagagagggaugauacacuuacaauacuccuuaaggcuacacuacuugcaguaaguggcgucuauccucuuucaauaccagcaacuuuauucguuugguacuucuggcaacguaagaaacaaaggaguggcguacugugggauacaccgaguccuccggagguagagagagcaguucuagacgaugggauauaucgaauaaugcaaagagggcuuuuagguagaagucaaguugggguagguguauuccaagaaaacguauuccacacaauguggcaugucacgagaggagcaguacuaauguaccagggaaaaaggcuugaacccucuugggcguccgugaagaaagauuuaauaucauacggcgguggauggcgacuucaaggaagcuggaacacuggagaggaaguacaggucauagcaguagaaccaggcaaaaaucccaaaaauguucagacagcaccugguacuuucaaaacgccugagggugaaguuggcgcuauugcgcuagauuuuaaaccaggaacaagugggucuccaauaguaaauagagaaggaaaaauugugggacuauacggaaauggcguaguaacuacuucugggacauacgugucggcaauagcacaagccaaagcaucacaagaaggaccucucccagaaauugaggaugaaguuuuucgaaaacgcaaucuaaccauuauggaccuacacccaggaucgggaaaaacccgaagauaucuaccagcaauuguacgugaagcuauaaaaagaaaacuuagaacgcucauacuggcaccuacaagggucgucgcauccgaaauggccgaagcauuaaaagggaugccaauuagauaucaaacgaccgccgucaaauccgaacacacugguaaagagauuguagauuuaaugugccaugcaacuuuuacuaugagauuacucuccccaguacgcguaccaaauuacaacaugauaaucauggacgaagcccauuuuacugacccgucuaguauagccgcuagggguuacauuucaaccagagucgggaugggagaagccgccgcuauuuucaugaccgcaacuccuccagguagcguagaagcguuuccccaaucaaacgcagucauucaagaugaggaacgugauauaccagaaagaucguggaacucuggauaugaguggauuaccgauuuuccagguaaaacgguaugguucguuccaaguauuaagucagguaacgauaucgcaaacugccuucguaaaaaugguaaacguguuauucaauuaucccgcaaaacuuuugacaccgaguaucagaaaaccaaaaauaaugauugggauuauguuguaacgacagacauuagugaaaugggcgcaaacuuccgagccgauagaguaaucgacccaagaaggugcuuaaaaccaguaauccucaaggacggucccgaaagaguaauauuagccggaccaaugccagucacuguagcaucugccgcccaacgcagagguagaaucgggaggaaucacaacaaggaaggagaccaauacauauauaugggucaaccuuugaauaacgacgaggaccaugcccacuggacugaagcgaagaugcuacuggacaauauaaacacgccagagggaauaauaccagcacuauuugaaccugaacgcgagaaaagugcugcuaucgacggugaauacagauuaagaggcgaggcaagaaaaacauucguugaauuaaugaggagaggggacuuaccgguuuggcuaaguuacaaaguugcuucggaagguuuccaauacagugauagaagauggugcuuugauggugaaaggaauaaccagguguuggaagagaauauggauguggaaaucuggacaaaagaaggggaaaggaagaaacuccgcccaagaugguuagaugcaagaacauauagugacccauuagcacuacgagaauuuaaagaguucgcugcagguagaagaagugucucaggagauuugauacuagagauaggaaaauuaccccaacaucuaacacaaagagcacaaaacgcuuuagacaauuugguaauguuacacaauagcgagcaagggggacgggcguacagacacgcaauggaggaacuuccggacacgauugaaacacuuaugcuacuggcucuuauagcaguucuaacgggaggggucacacuauuuuuccuaucaggaagaggacugggaaaaacaucaauagggcuauuaugugucauggcgucaucaguacuuuuauggauggcaucagucgaaccgcacuggauugcggcuaguauuauauuagaauuuuucuuaaugguucuacuaauaccggaaccagacagacaacgaacgccucaagauaaucaacuugccuacgucguaaucggucuauuauuuaugauccuuacuguagcagcuaaugagaugggacuacuagaaacgaccaagaaagaccuaggaauuggacauguugcuguagaaaaucaucaccacgcagcaauguuagacguggaucuccaccccgccagcgccuggacauuauacgcaguagcuacaacaaucauuacacccaugaugaggcauacgauugagaauacuacagcuaauauaucguuaacagcaauagcaaaucaagcugcaauacuaaugggucuugauaaagguuggccuauaucuaaaauggacauugggguuccauuauuggcccuggguugcuacucgcaaguaaauccccuuacgcucacugcagcaguacugaugcuaguagcacauuaugcuauuauaggaccaggucuccaagcaaaagcuacucgggaggcacagaaaagaacugcagcugguauaaugaaaaauccaacuguagacgggaucguagcaauagaccuagaccccguuguauacgaugcuaaauucgaaaagcagcugggacaaaucaugcuguuaauacugugcacaucacagauuuuguuaaugaggacuacgugggccuuaugcgaauccaucacuuuagcuacugguccauuaacaacuuuaugggaaggcucuccuggaaaguucuggaacacaacuauugcagugaguauggcaaacauuuucaggggaagcuacuuggccggagcaggccuagccuucucacucaugaagucucuugguggugggagaagaggaacuggagcucagggugagacgcuaggagagaaguggaagcgccaauuaaaucagcucucuaaaagugaauuuaacacauacaagagaaguggcauaauggagguagacaggucagaagcaaaagaaggauuaaagcgcggggagacaacuaaacaugcuguuaguagaggcacagcgaaacucagaugguucguggagcguaauuuaguuaaaccagaggggaaaguuaucgauuugggcuguggacgggguggcuggaguuacuauugcgccgguuugaagaaaguuacagaaguaaaagguuauacaaaagggggcccugggcaugaagaacccauaccgauggccacauauggauggaaucuagucaaacuccacucagggaaagacgucuucuucauaccaccggagaaaugcgacacacuauuaugcgauauuggagagagcagcccgaacccuacuauugaagaggggcgaacccuaagaguacuuaaaauggucgagccuugguuacgcggaaaccaauucuguauaaaaaucuuaaacccuuacaugccuucuguuguagaaacuuuagaacaaaugcaaagaaagcaugguggaaugcuagugcggaacccuuugucuagaaauucuacacacgagauguauuggguaucauguggcacuggcaauauaguaagugcaguuaauaugacaaguagaaugcuucuuaacagauuuacuauggcacauagaaaaccaacauacgagagagacguugauuuaggugccggaacaaggcauguugcuguugaaccagaaguugcuaaucucgauaucauuggccaacguauugagaacaucaaacaugaacauaagucaaccuggcacuaugaugaagauaauccuuacaagacaugggcauaccauggaaguuaugaggucaaaccaaguggaucugcuucaucuauggugaacggaguaguuaaacuuuuaacaaaaccuugggauguaauaccaauggugacgcaaauugcgaugaccgacaccacacccuucgggcaacagagaguuuucaaagaaaagguagauacgcgaacaccaaaagcuaagagggguaccgcacaaaucauggaggugacagccaaauggcuguggggauuuuugucucgaaacaagaagccaaggauaugcacaagggaagaauuuaccagaaagguuagaucuaacgccgcuauaggagccgucuuuguggacgaaaaucaguggaacucugcuaaggaagcggucgaagaugaacgauuuugggaucuugugcauagagaaagagaacugcacaagcaaggaaaaugcgcuacaugugucuauaacaugauggggaagcgggaaaagaaacucggggaauuuggaaaagcgaaagguaguagagcgauaugguauaugugguugggugcccgguuucuagaguuugaggcucuaggguucaugaacgaagaccacugguuuagucgugaaaauucgcuaucgggugucgaaggagaaggcuuacacaaacucggcuauauacuacgugauaucaguaaaauaccgggcggaaauauguaugcagacgauacagccgggugggauaccaggauuacagaagaugaucuccagaacgaagcccguauaacagacauuauggaaccagaacacgcauuauuggcaaaaaguaucuucaaacucacguaccaaaauaaaguuguuagaguucaaaggcccgcgaaaaacggaacaguaauggaugugauuaguagacgugaccagcgugguucuggucaagugggaacauauggacucaauaccuucacuaacauggaagcacaauuaauaagacagauggagagcgaggguauuuuuaguccuagcgaacucgaaacacccaacuuggcugagagaguacucgacuggcucgaaaaauaugguguggaacgauuaaagagaauggcgauaucaggagaugauuguguugugaagccaauagacgauagauucgcuacggcauuaacggcgcuaaacgauauggggaaagucagaaaagauaucccccaaugggaaccgucaaaaggguggaaugauuggcaacaaguaccguuuuguucacaucauuuucaccaguuaauaaugaaagacgggagggaaaucguagugccauguagaaaucaggaugaguuaguuggacgagcucgcgugucgcagggugccgguuggagucugagagaaacagcaugccuuggaaagucauacgcucagauguggcaacugauguauuuucacagaagggaucuaagacuagcagccaacgcaauaugcagugccguaccuguagacuggaucccaacuucaagaacuacguggucuauucacgcucaccaucaauggaugacgacggaagacaugcuaucgguauggaauagaguauggaucgaggaaaauccauggauggaagauaaaacacauaucaguaguuggggugauguaccauacuuagguaagcgugaggaucaauggugcgguagccuuaucgggcugacagcacgagccaccugggcaaccaauauccaaguagcuauaaaucaaguccgacgucucauaggcaacgaaaauuauuuagauuauaugaccagcaugaaaagauucaaaaaugaauccgauccagagggugcucuuugguaa
